United States Patent 9,328,346 (POLYCOMB-ASSOCIATED NON-CODING RNAS) - sequence listing, part 127

SEQ ID NO: 191490 - RNA, 296852 nt, Homo sapiens
uucuuucuuuuggugguaaauagguauuuauuugaaaugaaaaaaaaauuacuuaaguaccuggacuauugcauuuaaucauguauuguaauuguguuacucuaccuuuuugcaucagagacaaauauacaaugaacauucagauaucacagacugcacacuagauaguaauucuucaggucuuuuacauaaccaccaagaaacagauauugguuucugcaauauaguauaaaaguccacaaucaauccagucuuagccaguaucuucaauuuacuucuguugcuguacaaauaauuggccauuacuagggcuuacaaguuaauaacaggacaaaaaauauacauugcacugacacaaaaagucagcuguguuaagagucaugcaacaaguaaccaaacuugcugaaauuaaaaauacuuucuaaaaacaguuuuaacggcauaaauauuuuauacacaguucauuuaccaaaacaaaauguauuuaaaugauacaaagcaaaaauaaguuucuaccaacuuuauacauaagaaagugcaaaauaacuuaucuagaguguuuugcuauuauccagacggauggcugcuaugggcagcuauucucuucuucaaaagcaugacauuagaguugcacacuacauagaaauguuagaauacauggaugaacaaaugaacagguggauggaugaaugaacaaacuacaaagaucaggcaggagcccuaugagguacucucagaaaaagaaugcagaccauacuaagguagauguacauguugacaauagauguugguaaauaaauuuacauggaacacagaaagauauccagagaaauaauuaguuuauguaugugaguguacuuguaugugugagugauucuguugauuucugcauuagaggcaaaaagaaaagaaacccgauugaacaaaacaguugcccacagcaccagcugccagaggaaauacuaccaugaggguuuugguuuccaccuucuaguuauggaaguucuguuagaaaguuaguaauggaaguugugucggaaaguuuaaaaguguucaucccauauaguuuccuauuacaaagaggaauaaccuuuaaguaacuacacacacacauucauauauucaagucuuuaaagaacaccucugccacuggguaugggguaaacaugauucauggacaaaaggaggacgcuucuuuuaaaaaguguagaauaacacugcuacaaaucaucuagagggccagacaggggcaaggcccacaguuacauaauagcacaauuucugcaacuguugaacaucagcauuauuuauuagaauugaagauggugaugggggagggagaguguggggggaguaagacacagaaaggaaaacagaacacaacuuuucuuuaaauuaaaguauuaaugccgauaauccuuuuauuaacaaguauauuugaacuuuuagaaauggaaguguuuuaaucaauuuugauauguaaucauaaauagacuguaggcucaaacccagguaaauaaagauuuaaauuuaguaagcguaaggcacuaaagcagccuuucuauuuucucuuggagaccuaguuaucauaucaggaagaacaaauuuguucuuaagcugguuucagcccaucagguacaagaucaccauuguaccaaaugccuauuuuugaaugcaugugcauauaugugcauuuuagugcauaagugugccucucaccagggccuaaagauggaaaauuggaaaagccaaagccgcuguccuuugcaugaugccucugugagggugugaaggccuuuccuuucgcaccugugaaggugugaaggccuaucuugggccauuaaugauucuauauuuuucaaaucacagggcuuuuagaauuguucauaauguuaucacuaaguuucugaaaauguuaaaaucuagauuaauuguuucauuuuuaauauauauuauauauauauauauauguacauaacacacauuuaaaaaaaucccaccaccaagccuuuucucuguaaacuaaucucuuagccccuuccagcuuuaaucccccuggauuuguguguucuguauccaacuaguagaacaaauuaaauaacuaaauauuaaaauacuguaauuauauucauagcaaaaacaaaaaaauagacauugauacaguauaaaucucacuguuuucagguagaugacauuaaaugguaaagguuaauuuuaagcaguucugacaugauucaguuuuacaacaaaguuuauauguuaauucuguacacuucuuucuuuccuuuuuuuaccccuuguuugaaaauaagcuauaguagaacauuagugucaccaaagacacauacuuauuauguucuaugcaagauaagcuaauuuuggguuacaugcaaauauauuuccauuaguugagacagggcuguuuccugcacuacacuggucaucugaccaccuuucugcaaugcuaagaagguauucuuugaccaaacagcaguccacauacaaguuuaaaaggggcccuguuuauguaggaacaacacugagguggugcguagccagguacaagacgcccaaauauuuccaguuuaucuuacggcuggacuccuauucucccacacuguuuccuaaagaagguccacauuauuuugguuacuagccuaguuuaaguggagauacugugggcaacuugaaagaaaugacaucaggcacacaggcugagcuugaaaggaaaaaaagaccacagauaaugucuuuggggauuuaaaaaaacauauuuauaauuaauugguaagugagggaugucagacaaaccauaaguaguucauugaguuagugguuuaguuugaaguuucauguuacaggcaguuaaguccuuauuuagaaaaaaggccuuuuauaucuauuuacaauauacauaguuacuugcaaagaagucagauuuacaaccauuuucuaaaagccuuuuuuguuguugguuuuuccaaauaaggaugaguagcucuauaaaaaugagaugcaagaaaagagaguuaauaagugaggauuuuucucuuggagacagcuacugucaucagggagaacuggaggucgaaaguguugcuccuaggaaccaccucauauucuucuugugcuguucaccugaaucgcgucugccccauuccuguacucuacacccguuuuauucaaugaucccuuugaauuuuaacacuucaaacacgugguaugaagagauguguaaacggagacuguuuucaaugccuuccaagcugggacaggagaaucgggaaggggucuacagaccauggucuccacucagcuuguugaaucuucaacaauuucgaggcccaucuucugaaccucucucaugcuguaaguuauaauaacaguucugacaaacacgcaccggggaugagauuuucaagcguuugauuucagauugaaagcgacugcaccuaaaggaaaggaaaagucaauuaauuauaggucuucuccaugcuugaucaugggcaccggaaacauuaauaaucgaauggaaagcuugcaguaaaaugccaaaggccauacugguuuguguuguguggcugaacaaggacuaaaaggaaagcuguauuauuuguuucagucuaugaagaaaagcaguauuaaaccagggaagcuauuucuuugacugacaagaauuaaaaaaacgaaaacaaaaaaacagaguuaagauuuuccuauacaaugaggccaaggugucugaacagugauguaaggccauucuaccuguguagacuaauucucauggccuauaagcuugggagguaugucaaugucuuuaccuggagcuugacauauuucucuuggaaaucagaaaaacucacuagcggaaauuagaagacucacuaaugaguaucuauuuucaagagaauuacuaaugacucauuagugagucuucuaauuuccaaaagaaauaugaguuugaucacuaucaaguuccauugugcuuuuaaacauuuugauugauccacucuuuaaucauuucuuaaacaguuagacuggcuuuccuuuuccagucccaacacccucauuuccuauuuaucuugcuagaacuguuugaaggagacuauucuuaagagauguucaaauucuuuaagaaguauucagaguuccuauuccuggaauaaagccaggugugacucaggaugugguauuaaaucacuuuaggcuuggauuuucagaagauugaaauggaaaugaaaaaaaaaauuuuuuuuugguagggauggggucucauuacauuguccaggcuguccucaaacuccuggccucaagugaucuuccugccuugaccucccaaagugcugagacuacagacgugagccacugugccuggccuugaaauggagauuuauguuuaguccauuaaucuaccaguaaaaauguccagagaguaaauuaaguacuauaaccuuauggguuuaaaggacugucacuggaccucucagaucccucaagagugucaacagcucucagccauagagaccacaggcuguguguucuggaaagcacuuccuucugugccugcuucaucagaacuuaucacuguuuggucaguuuccaauaaagcuuccauccaacauuuaauagcaauggauaauuuaaagaauuaccuauauuuaaacaauauuuugaaaauuaaacacuacaaagaacagaugugugccagcauacauacgggagugcuaguacaaaucacuagauuaauaugauggguguggaggcugaaaacuguaaucccagcacuuuaggaggcugaggcggggguacugcuugagcccgcggcugugagaccagccuggggaacauagugagacucuaucucuacaaaaaauacaaaaauuagccaggugugguggcucuugccuauagucucagcuacuuggaaggcugaggugggaggacugcuugagccugggagaucaaagcugcacugagcugugaucgugccacuguacuccagccugggugauagaggaagaccccaucucaagaaauauauauauauaggcugggugcggaggcucaugacuguaaucccagcacuuugggaggccaaggugggcagaccacaaggucaggaguucgagacgagccuggccaauauggugaaaccccgucucuacuaagaauacaaaaauuagccaggcgugguggugcacgccuguagucccagcuacucaggaagcugagguagaagaaucgcuugaacccaggaggcggaggcugcagugagccgagaucacgccacugcacuccagccugggugacagagugagacuccgucucaaaaaaaauaaaaauaaaaauaaaagauauauauauauaugucuagcggcucugugcuuugaaaggccugcucuauaaaacccauuauggguuuuuaaauuuauuaucuauuuuuuugagauggagucuugcucuguugcucaggcuggauggagugcaguggcgugaucucgggucacugcaaccucugucugcuggguucaagugauucucucgccucaaccuccugaguagcucaccaccacaccuggcuaauuuuuguauuuuuaguacagacaggguuuugccauguuggccaggcuggucucgaacuccugaccucaggugaucagcccaccucagccucccaaagugcuggcauuacaggcaugagccacugugcccggucccauuauagguuuuauagagcaggccuuucaaagcacagagccacuagacagaauccucugccagccucacagaaauucccacaggaaauggcuggcugcaacauuuugggucccucaucuugaaccagacugcccagcagaaaagguuuaaggaaucaaaugauggaacaccuguuuugccagacucugaacuuggugcuuuacaacacucauauaugugaucucauuuaauucucucaauagcucuaagaggacuggucuucuuacccacauuuacagauaaagaaaccaaagcucagagaggcucgguaacuugcuggcauuauggcaacagaaaguagcacagugagcauuuggucaguguaaacccaaagacuaugcccauaccaguaagccaaugcugccuauaaaaccucaggaauggacucauaauuacacaaguugagaauaauaugcuuucuaugaaagcaucucuggaguaaggcaauauaagccuuaaaguguacuguccauggaauccuuucuguugucuggcagaaaaaguaacgacuguggauguguaucugggacccagguguaggacagagauaucaaccaaaucuauagccaugggaccacugaccuuucauaugggggaaaaauagauccucgccucauguuauaccccaaaauaaauuacaaaugaauuaaagaccuaaaugugaaaaauaaaacuuugaaaccuuuaaaagaaaauaaacaagauuaucuuugugauccuaggacagagaaagaauucuuaaggcacaaaaaagcaaaaaucauagaguaauacaugugacuacaaccaguuuaaaaacuuguagaugacagaaaaaacauauacaaaguugaaacacaagccacagacuggcagaacguaucugcaagauauauaaaaaacaaagguguacagcacagaauauauaaaagaacuccucaaggaaaaaaaaagggcaaaguacccaaaaggaaacccaaauagccaacaaacaugaaaagauguugucucacuagcauugcaaguuaaaacaacaaagcacuauuuuuuagcuaucagauuggcaaaaguggaaaaagucuggcaguaccaagcaugacuaagaauuuggagaaccuucauggccuguuggagguaguggagguaguauuaacuagcacuacuguuuugaagaguaauuuggcaauaucuaauuaagaucaagaauaagucuguguucuaucaauuucauuccaucucuagaggaauucuagcuuguguauuagaagggcauuuauagggaugugcauuguagcauuauuuauaguacugauaaaaauagaaaaaaaaaaacccugagagggcaucaaaagggaaauaaugaugauaaauucauauaauuaaaauaaccgacaguaguuaaaaugaauauauuacaauaagauaucuauauaaauggauuucaaaaacaauguugaguaagaaaguuacagaagggcaaaaacaguauaguacguaaagcugaaaaguaaagcugagaacaccaaaauaguaugauguaauguuuacagaggcaacacauguuccugaaagcauaaaaacauggagaaugggugugauuggugaaaggugcaaagaggauacuuacaauguaucuauaguguuuauagaaucauuucacauacaggucucuaaauuaaauacgaugaaauauuagcauaugugcauucugugucauggaugacaagguguuugugacuuguaugacagaaaaauuuccuaauuguaguaauaaagaagaacagaaaaagugaagacugguucauaccaacaaggcauacuguaguggggacgccagggcaaaucagaaccugugugcaggacauaauuaacaaccuuagagcuuaaucaauguaaauucaaaaagcagauaucuuaucuuacuucuggcagaagagcugaccacaguuccugcaauggugucgucuuucugugagugaaaaccucaccgagcagccugagcagcugucaccaccuucauccuucacccagugaucagcagcagaacggccuggcuggucacucacagaccagcugaaaacucggccucgacugucaccaacgaggauccuacugugaucccugcaggagacacgacagaggaggucacugcacggaaggcuucugugaucuccuucuugaggcucucuggauuuugguggauguguguuuugaggucggggcugguaaggguccuggagagaccccuugauucacucagagauguauguguaaacagacaaaaacugaaccgagcccaaauuuacacuuccauuucaauuuucuuuggaucacccuugcuguaucuuugaagaacagaaaaagcaguuuuucacuuuuuaaaaaauucagaauuuaaauccaguguaugggcaugguggcucacaccuguaaucccaguacuuugggaggccgaggugggcggaucacuugaagccaggaguuugagaccagccugggcaacacgguaaaaccccgucucuauaaaaaauacaaaaauuagccgggugugauggugcacgccuauagucccaguuauuugaggggcagaggugggagaacugcuugagccugggagguugaggcugcagugagcugugauugugccccugacucuagccuaagugacagaacaagacccugucucaaaaaaaaaaaaaaaaaaaaaaaaaagaaaaagaaaagaaaaauauccacacacuaacaggguucuucuucaaauuuaucucuuugagcuacauacgauaauacaaauaaaaucuguuuuccccaaagacugggcuggaguauguggcccuuggcuaaccaaaugacucagaugggaagcggagcuggaaaaagccugacacuuacuuggagaugcccaaggcagugaccucagcugggugugcauuguccuuucgaucaaaggcugugugcauagucagcuuacuccugaacaccagcugccguucccaucgguacccuggaauggagaaguggaggacacaacauaacucaacugagagaagccaauacuggggagaacuacucuaagaugguggccuuaaacuuaggguaccucaacauacagcuacagcagcuuuuccaguucucggcagcugcugccuugguugaaaguaaagcuaccuagcuugacauuaacaugggccaggcuggagaaacaucucguugaaggagacaaacuaaugagaaggagaaauuuucaaugcaagcagaugcauccaauuucuccaauugaggaccuugccucuaacucuauucugggcaaaguuaccugcaaaugcaguuuuauuuauucauuuuuaauuagcuucugugauuuaaugaguugugaauaaauacaguuucuaguuugagguauuuuucuuuaaaagaugcccagcauauugcaaacaccaucguaggauagaauuuuuaaguccacuuuacacuagaagaaacugaagaggccuucuguguaaagaggcauucugugugaguggcccagcucacggggcacauccaggguggggcccagggagagcuagaccccacugccucaauccaccaacccucacaccacauauaaggagugagaaauagauaccagacuucaaguuaccagguuucaaucugcuguaauuccgcaccucaaugggauugggguggggguggcuaagggggcccugcagaugggcucuggucuggcccucugaauaguucacaaauaugaagccgucuuucucaucuagacugagcuggucggaccagcgucuggagucgucagagccacugucaguacaccaggcggcuguugcgcggcaggaggcugcccggggccuguggcuggugcugcuggguuggcuuggaguguccuuaggguccuggcugaugcucugcucaucugcuucugaaucacugcuguccucgucuugggcuuccugcccugggugaagcauugagagaauuggaacauacggaaccaucaaaguuacacccagcuuuguucugcuaguauuuuuuuucucccaguuauaagccucuauagacauaauauuuuaagcuaaguguaacaaaaaagaaaguaagugccaggauuuuuggcuagaguacagagagcaaagaaauaaaaaagucgaauuucugaaagaguuuauuaaaaacuuuggccaaaauccuuagcuuggaauucaaucucucacaaucuggccagaaucugccuuugccgcacacucccugcugugcugcagcuagauggugucacuccagcucucucccugcagaccugcuccuccaaaggugagcuucuucacaugcugcuggugccgccuagacccaucuuuccaaucucuguggguuccgaugucaccuagcuuucaagggacagcuuaaacauucuugucucugaaucacccaauuccuucagcucaaaguauucucccccuuuucuggacuccuuuaacaguucugugccuccugaguucuugaaauuaucauucuaaaugauuacuuuuggauauucuucauauauauauauauauauauacacacacacacacacacacacacguacguguguauauauauauauauauguauguauguauuuuuugagacagaaucuugcugugucacccaggcuggagugcaguggcaugaucuuggcucauugcaaccuuugccuccuggguucaagcgauucuccugccucagccuuggaaguagcuaggacuacaggcacccaccaccacaccuggcuaauuuuuguauuuuuaguagagacgggguuucacuauguuggccaggcuggucuugaacuccugaccucaugauccacccacuuuggcauccgaaggugcuaggauuacaggcgugggccaccacacccagcuauuuuuggauauucuuucuacaagaugguagagaaaagggccauugcauauagugguuaaugacucaaagauuagugaauuaccuuauuuuuaauuuuuauuuauguauuuauuuuuacauacauggaucuugcucuaucacccaggcuggaguguaguggagcgaucauagcucacugcagccucaaccuccugagcccagggaaucugcccgccucagccuucugaguagcugggaccacacgugcaugccacaacaucuggcuaaagauuagugaauuauucuaugaaagccuuacuuuggaauuuuguucuucuuccucuuuucacuguuauuuugcauuucuucacaucaacucucuacucucuugcaauaaagucuacuggagggaaaauguauaagaaacaaguauaccuggcccuccauuucuguggguuccacauccauggauucaauuaaucucagauggaaaauauuuggggaaauaaacugugucugcaaaugaacaugugcagaauuuuuuuccuugucauuagucccuaaacaauacaauaucgcaacuauuuacacagcauuuacauuguauugguaguaaucuggagaugauuuaagguauacaggaggguguuaguagguuuuaugcaaauacuacauacaccauuuuauaucagggacuugagcauucucagauuuugguaucaaaaggaggucuuagaaccaacuccugaggauacugagcccaccaaaguuauuuucuuagcaagacaaauacuuuauuugccugcuuccuacucaguagggggcuauuggacuaaugugaaugaaguuuucaccccaacggcuuaugaucgugagcucugagguccgcaaacaagcagcuuuggaagcggcuuuaauuuccagugaaccacuagcuuguuuacauuucaccccagcaagugcccacaaaucucaccacuucuacauuguucaauccuuccugugggcuguucucccugccacuucugccagacuacccacaauaaagacauacaaauaucuuuccacccugaauuugaccccuucuaucucacucauucaucuccucuuccacuguuauuuacuuaaaagcuuuuuaagggaaaggaaaaugacccacuuuucauugguucccuuaauucaauaucugacauauaacagguaacccccaaacacuuauugaauuaaacugaauuuuuauguccccaaacacccagaugaccuuuuugguggggcuguaauuagaaauuuacauguacuaauauaacaccaacauuaaaauguccugcccaagggaucuuuuuucuucucuggcauggaaaguaaaagcuacuuucagcuuauauagagaagugacuuguguccuuuugcuaaguuuccuuuauuaacucucucacaucaucaaagucacacugaauucucagugcacaaaagccaaucauggagaaacaaucugaaggucaaacuucaaaccuuguuccuuuccaggaaguuccuuuccaggaaguuccacuguucuacaucaaagggggcggcuucuucagugacugcaaugcaaagcagaucucacccuggcauuauggcauugcuuucaguuauucuggguagaaaucaauuaucucuauauuucacugaaaaauuuuaaauugcuucacaaauaauggacuauagguaaccaggcuucagugugaauuaaugccccaauguaagcaagucugacuguggacucuggucugccucuguuaauuguuuacaaacacaauuguaucuguuguccacacugagccagccccauggugggcagaacaaauguggggcuggggugcagcagggcuugucugacuuauacaacagcacgcccucuaggucuguuguguguuuucagaagugaaagccaaagccuuugguacucuaggaaguaagugcuauauuuaguauggaauguggaaguuaaccacaagacaccacuacacugaauguugcccagugaaguagagaaaaccuugcaugucugcucaaaggaaucacacaacaggcagcaaccaugcuucuccaagcagugcccaaccuugggcuccucuuuauguuguuugguauaagcuuauccacagugacuuaaaagaaauaugaaaacgauuugagucauuuuuagaaaguauuaaauaccuauuugugcuucuggacagucuuccugcauuucuaggacuucagcaggcucaggagcugguguuucaggaacuugcaaaaauuccauucuccaaaacuaaauuuaaauaaguacaaaaauuaaaaaguuaagaaacagauuaaggaaccaauuuacauuacucaaugaagagagacugucaggguuaacagauaacuuaauuuccaucauguuauacaguuagauuucccguaucuuggaagauguggcagcgggcugccugcacacaauggcuguuucaaaguacagggaaaaagauuauagucauauuaguuuaaaaacaugguucaggccagguguagugcugccuauaaucccagcacuuugggaagccaagaugggcggaucauuugaggucaggaguuugagaccagccaggucaacauggugaaacccugucucuacuagaaguacaaaaauuagccgggcauagcagugcaugcuuguaauuccagcuacuugggaggcugaugcaggagaauugcuugaaccugggaggcagagguuucaguaagccgagauugcaccacuacacuccagccugggcgacagagcaacucacucugucucaaaaacaaaacaaaaacauaguucaacuaaguaaacuuuuuuguuuccuacaaaaaccucucagagucuugcauaugcuaauacacauuauauaucuccaagagggcauacaguaaacagaauccccaggugccuggcuagggagcuauuuuaugcugcuucacagauugagcagugugaaauaccacugucgaggaagcagacuccaggguguguguguuugugaguuuuugugugugcacagauguguaccgugugagguacagggugugguauuggaguggacugauggcuucacugucuuucaacaugugacucugacuaaagagggugguaaucagcugcucucugcuuuuacaaagagcacaauuaaagaaaaacaagcacaaagaaaaaucuccugagacagaaaaacucaaauacuucaacagacuacaaaagugaauacuccauugccucuauuuucuguagagucccagcacauagcaaccuaagaaaaggauaaacuacaucuaggcuucaggugcagucaucugggauccuagcuggggauccucgaaguguuuuccagcacugugauucucuguagggaagagacuuaucccugcucacuauguuuucccuacgaagccauuugacaggcugaaaacccaguacuucugcaguucgcauguugagcaaucccagugugacaugggaaucauguuugacugaccucacugugucaagcugucaaauggccaguagcacuaccagaucuacuuaauaggaagaaaagaggccaagacaccaguguuccucaugucugauaacgcagaggccaaggccugucugagcuggagcgagaguucacuaaacauuacaacuuguucagguguucuuaaccuguaauuagcuacaaguuucugguaaacuaggaugacaaauauccuaaugaguuuuucucucaguucacuuacccgaaccacuccaucugaguguccugucacuaugacguucugcgugucccauucguucaucuccgacaugcagcagcagaugaucugcuggcuccuaccugugaacguguugacacucacgauaggguucccauugaugcuccacacauggauauaugugccagcgcaggacacaaugucccccugagaagagagagaaaaacgucauucucuuugcucccuuccaauuaccuucugguuucugaagcaaauugaaucccuggccuaguucucagaaagccuuucaguccuaagacuaguggcuaauuucuuagguaaccugaaauucagugcuugcugacuuaaaaaaaaauacuccgaacagaggcuucuuuaagaauucacaguugaguggaugcaguggccaaagggaccacggauggagacaaagggcagguccacgucccuggcacacugcugagcaaggucuggcgacacaagaaagcucccugucaucugaggagaugaagaacuacucuucuuccucccauuguuaacaaaaucuauuacgccuuucaucuagaggcaggaauccaccuccacuuuuacaaaaugaauccaaccacuaaaaccacaggguagaagaggcauuuuucaguccagauauaguuguguuucuucaguaaaucaaaaggcacaaucuugguaaugcuguaauauccuauuuuaaaaucuguauucaaaauaggggugggggaauguggggggagaaaaggaaacugguaaaugggucacuucuuggcaaacuuaguaaaaaccaagacucccugagcugauaacuuauguuuuuaugagauccaaagauagaaaagaacaaccuauuuucuuaaauucuaccaggcugggcucuaccuaaccugguaagaacacaacccacuauaguuaaagaaaggaggaugcuuucugaagcaucuccugugugccagucacugggguggagacuucagauguucuaguuaacacagcaaccuugugagauuaucacuagcccugcuguaaaggaugaaagugaggggcaaagaauuuaaguaacuuauuuaucaucagagauuugaagccagcuuucuauagcgccaaagcuuauauaccauaccgugcugccucuuucauuccuaagauagucuguuugucacaaugcuggguauuaccuuuagaaaagaccugguaaaguucaguacccucaggagauauauaagaaccuacauaagucuuaagauggucagcaaaaacagaggagaacuagaagcugcaaagcagcaucaacacauaaaaagguaagguggaggaggcugggguagggugaggaggaggacugggccuguuccauccacagucugugcugcaccgucugugcuggucuugcuacugcugcuccuugcuccucccacccccuagcucuucuucuaccaaaauggcaagaaauaaaccaaaacccaaaccaaaacaauacuuagcaaagcacuguugugucugcuucuguaucaguuacugaaccauuucugacuauaagugucagcaauugaguuuuaauuaguggcuuuagucucugcaagagaaaauugcuccauucugcacugggcaagaccuucuucaguuacucuggggccuuaauuagaguuuauuagaguaaauccuguuguuaugagggcagagacauaagaagaauuaaaggcaaaguggcuuuggccugaaguguaaacugaaguaaagcaggcuugauauugguuggagaaacacaacagaaauagaaaucuuuucaugacuuauuaagauauuacaaaagcaucuuaaaaagaaaacacugcuuuuguaguauuugcagcaaauauugcaauccacuaguguacacuggcucaaauaacaacuggcuauauaauaaaauuaucaguauuuaaguuaagaacaaccccaaaacaaagugcuccaaauaauugauuaagcaucugacucaacacugcugcauaagagcaguucuacagcacccacauuuuuguaaagcucuuuugguucaaauguuugcaggaccaacccaagguguuguucugaaaaccucuuaaaccuuucagacagaaaaaacaaauuuggaggccgaggcgggcagaucacaaggucaggagaucgaaaccaucuucgcuaacacggugaaaccccgucucuacuaaaaauacaaaaaaaucagcugggcgcgguggugggcaccuguaaucccagcuacucaggaggcugaggccggagaauggcgugaacccgggagguggagcuugcauugagccgacauagcaccacugcagucaggccugggcaaaagagcgagacuccaucucaaaauaaauaaauaaauaaauaaauaaaaccccaaaaaacaaaaacaaaaacaaauuugacucuucuacccuugcaugucccccacucauucucaaccugaguacgucugccauuauuaaucaaacacucuaagugauugacaacuguaagugaauuccuuucuuuuuccuuuuuuaauaagugacuacaagauaguugacuaaaaguguuaauacugaguaacuucugguagaaaucaaagaugcagcauccuucaagaggaaagcugucuguguaggugauggugugaaugucacucaaugacauggcuagaacuguucugugucaugaaggauggcccugugguaggggugaggguaagguggcaauggauauguauagcuaagaggcgaugaggcuuggguggguuccugucgacucccaagacggauuuguauauggggcaucaccuacaugcugacacacauuaucuacuugcuaaugcgacacacaucaucaacuuacuaacgcgauaagcuugugaggccuuagucucuguaaaccugcccucaagcuucccguuucaagaccaucuuagcaaugaauccccucgucugcuucagguaggcuugguauguguagagggauccuagaugagggcauuuauuuuauuugacuucuuucauuuauuuguauaugaacuauuuauuucugaaaacagcaucuuuugauaacuucuggaucuguuuugaaaauagcuauauaagaauuuuucucuuguuuggguacccaaaugucacccuuuuuacuuuccauacucugacuauaauuuauuaaaauuuucaacacauuucuaaccuucuucuucuuuuuuuugagacugagucucacucuauuguccaggcuggagugcaguggagcgaucuuggcucacugccaucuccaccucccggguucaagcgguucuccugccucauccucccaaauagcugggauuaaaggcacccaccaccagcccggcuaauuuuuuuauuuuuaguagagacggaguuucaccauguuggccaggcuggucuggaacuccugaccucaaaugauccgccugcacugaccucccaaagugcugggauuacaggcaugagccaccaugcccggccaauuucuaacauucuuaacaaauccuacaaauuuccuguuuuuuaaaaaaacauauucuagaaagcuuuguuuuauuuuaaucaaauuuuguucucucuacugcauggagcagugaauggauuuuaagacaaaacugcucucuggauuacaaacuuuaacaucuauuugcuuuucaaacaacacuaaaucaaagaaaagguaguaacuuuuauaaaaugaguaucuaucaacuucaaaaacaaugagucauuuuuuuagaagaaaaauuuauuuauuuuuuuaagagacaguguuuugcuguuucccaggcuggagugcaauggcuaucacaggcacagcccaccacugaucagcaugggaauuuugaucugcuccauuuccaaccugaguugguucaccccuccuuaggcaacuugguggucucugacuuucaggaggucaccaaaucggugcugaccuuagugcagacaccugauggguauagugccuacagcccagaaguccugggcucaacuaauccuccugcgguagccuccugagcagcugcaacucagacauguuccccugagccccaccauuuuuaauugaguuuggccaagacuacuuguuuaccuaaacauaagugggcaauuuacuacuuacuguuaauucauugauacaaagagcagaaacuggagcucgaugcccucgaagcuggguuagaaaugacaguuuguucaaaucccaaaugauacagguucgaucacgggacccacugacaauuaugugauaggcuaaugaugcuguggcgcaggugacgguaucaguguggcccaguaaggccuacgaaugagaacaaacaaacaaaaucagguugaucucagugacaggguuccacagugacuccagaagcuccuggaugcaucaggaagcaguggcacgcaugcuagguaguaggugacuugagcaguggugucuggagagucuggaaggcagaccuccuuucuccuccugcugacuacccuugccucagcccacggggguagagagaagccuggagcacucuggaggcucuuuacuuucacauuaguucuuuccuggaguugggccaggaucuuagaaggaagagggaaugacaaccacaacccagcuuggguuucuuuauaccauuuuuauguagagauguauugauuaugggcaucaaaaauacagaauuucaacucuauauccauucuuuuaugccacaaacuccuguucagaccauucuaaagaauuacaauugaaugaauuuuuuuuuaaaaaaaugcauaaacugcgagaaccacauggcuguagcacguggucuacaauagacaaagcgagaauguaguccugaggcgucaacaugcugaaguccugcugccaaucggagauaucugaguaucugugccugagaggaauucuuucuuuaaacuagaaaaagaacuucccucuuuugcuggaauaugaagagaaaaaggacccaaggaaauggcaaugugugaaaauaaguaaauauucugaagaaaaagauuuagauuacuguuaguaguuccuaaguacuuagaaugggccaucugcccuggcagaaaaauauauccgcuuaauaaugaguuggcuucaucugccgccuuccacacuagaauguaagagguugccuccuauuguacauuuggggaaagccuuggguguaaaucaguguaaacuuggaggagagauuuugcuaucauguagaguagguauuuuuuacagauugaagguugauaaauuuuuuaauacuuuugagagagaaaacuaucuguguauacacaugaaguauauauaugugugugugugcauaauauaaaaaaagaguuggcuuaaaauuuuggucauauagacaucuuuauugcaugcuuagcaaaccccaggaaacuauuuuaagcaggaaguccuuuuuccuggcacauuacuuucaaagugcauuuucuaaauggaaaauauuuuuaagcauaauuugaaucagcaaaauguacuauuaaccuuguaaucuguucacuucaagacuuucucccucuuuauauggcuugccucaggacccagcaacucugugaaguuucuggccuauacagaugauucaguuuuauacugaacagggguucaauuuuuuucuauagguauuuaugacaccacuguuugaguuuggcuuuauaauagcuuugaagucagacagaacuuaauuuaaauuauagcuuuacugcuacaugugacuuuagacuugugucuugaccacucuaaccugugucuuuuucagggguaaaauggggcuaauaacuaccuuguagaauugugucgacuagaguuuuguauuuguagaauacucaacacaguccccugaaauagaggugcucaauaauugauaagugguauuguuacauuauuuuucaaauuuauaucauuaaaaauacuuagauauaugcuccuuauuuaaaaaauaccuuaugguaaguucucucacagaucaaauauuaagaaauggcuuaauuauaaaaggacucuugcuuuaaguaaaaauuaauaauagaaucauguauguaauagacaaucagaaauacucguuaauuaaaucaucaagggcucuacugaauauauucaugaguuuggcauauccuuaaguauaugacaaaugagaaaagagagaaacaaaaaauaaagaauuuaguggcagauaaauggaaaucacccuggaaggaaauuaauaugagucaauagcaaacauaauucaguuugcaaaaauucaauuuagacuuuugcauuuauauuacuuaaauacacugaaauauauguuaccuaaagauaacuuucuucagauuuuaacaaagggaccggcuuagaucauuguuagaaacaaccuauucugauuuccuuuuuuuuucaaaaaaguauuucuagcaacagaacgucacuuugguuuuguccauuagaucugaaguaccucagaauuaaggaagcuuuuuacuuccuacaggguguaggcacaggagauggacuauguccuucuuggcauuuucuauguucucucuuaccuguuugagggugacggucuuggccuuuucuuuggaggugcccaucucccacacacacacaaccgugcuuguuccacccgugaugaccagcuugggguuggggcagauugcacagagaaucuggccccacucagacaagcauucauaaacagucauggccuauaaaguaaaacggaugugagacacacaugccguuaaguacuauacaaacuucugaaacucaaggagcagaauugagugaaggugcaggcaccucaccagcaaauagcggcucauguucugagcuagcuuuaguucagaagcauauccacugaaucucuacccugaacuaccccuaccgccuccaaacuauuguugcugcugaaagccauaaccaaaaaggacuuugcucauaaugggggucucugguuucuccagauugggaaagugaugcucaaauugugugaucuauggaaggugcaggggacaauguggcaaaaggaugcauuugcuguagacagaaugugaaaagagagcacgacugcugcuaaggagaacaucaacaaaauggaaucguguuacaaagcaacauaacagacuaugcagauucuuuucgucuugcauuugggaagggacuguuggagggcaaacacagggcacuaaaggaucacuauggauugucucuccaagagguacuuaugggacccaaaacaguugcuguugcuucuugugggauggagcaacagguuuucugccagcuuguuuggagcacuaaaaugaaaaguggggcagauggugacucaucaaaaggaggcuauucugguugacagaaaugcugagcuccuugcuggcuaggaucucucggaggaauucuuugagugagaaggaaacugcuagccccuguuacacaacuuugcaaaagaggcuuguucugcagggaacaugacaucucuaugagcuccuuuauccugcucucauucagugaagcucuccuuuccccaaauaggaaagcucacuuuucuuuugggcuuuggaggaacagcugacaagcccuuggacuggguucuccccaacccuauuagucauauaggauagccagaccacaaaagagcaauauuaaaugaguaggcaggaaauaaugcaaaccuugucugacucauagguucccagucugcaacugaggucugcauagccccaagcaaaaguuuuauuccagguuggugggauaagaaccuuauucuguuccaccgcaagaauaccuuuaucuguacauacgauuuguccuacagguucuuugaguucuagaaaaaagaaaucaugguauuaggacaggaacaggaaaaacuaaugucauuaucucauagagcaugauaauuucaaauauucauauaaaucaagcauccugauaccuacguugagaaaaaaugaucucugaaauagagcugggcuuuugaaucuccuacaagaccugcuggguggaauguucaaccuaacagggccucugcaggacuuuccuccagcuuuccuauuucugggcacucucugguuuggguacuaccauucagguuugccucccuaggguuguacagaguaaucugggaugcuccccagaaugucauagggacacagauuaucaacaaaccuaugucuuuaguaccucccaaguuauagccagaccuuagacuuccucaaggaaggucaugucauuccccagaggaacggacuccuugcuccacaccagcacucugaugaccauauuacuacuccagaagaaucgccaacagugacugacgcuggcacagagcagagucuguguaaugaggacaaauggcauagaauggcacacaaguuaaccagauuuuguuccaauucuuggauauuuuuaagcgacaacuucaagauuuugcagaacuuuuuuuuuuucauucuaaggggaaaaaaccuacuugaaaaaauauuuuuagauaucccauuauaccauuagauaaaacacagaugucuuuucauuggcauacuaaaaauguguucuuuuacuaauauaucggauaggcagaauauauuuaaaugagaaugaaauuaugaagacaaauuuuuuuuaucuauaaaguugaauuuacaagguuuugguauuuuagagcuuugauuaucuuaaagaggagagagaagacuguuugguucuuucugauaugaaguccaacaagccaaaaaaagaaaacagagaaaaaaaagcaaaaagagaaaauauaaauacuaguagguauuuaguaaucuaacacaaaauguauggcacuuauuaaacaaauuaugcuaucgucaaaaagcaaauuuguuauuguuaaacugggauuauuaacaaucccauuaaaucauuaaucaaaaguuuauuucucauuauuuuaccuuuuacagguguuagagaaggccucaaguugucuagaugaugaaaaaagaucuugucacuuguagauccugguaggacagagauuccugcauugucuccauugagucgacuucucacucgcuuugguggaugagguuuuuuaaauaacugguaugaaagaagaugacucacuuuauaaugaaagauaacacuuauaagcccuuuuauaugccaggcauuguguucuuauuucaauuaagguucacaagaacuauuagguacuauauuauccucauuuuacacccgaggaaagagauucaaagacgcuaugaagguggccagagaacucacaccugaauaagcagggacaggacuaugauacuaaagcaugggcuauugucuuguucuaugcuaagcugaauucacaauaacuuucucaaagaaagucaaucuacaguugauugacaauuauuuuccaaugauauucaaaaguuaacucucaguagccuaauaccauucugugccauugaaggcaggcagacacucuaucuaguuggauuauuucugguuucaauguggccuuuaugugauuuagaaauaucauuuugguguccuaaaaaggugcuacugauuugcugaaagugugaauauuaucaucuucuuugugcuuugcuauguuguaaagggaaaaaagaaaacaaaaaugugcuacaucgucauucuguauuucuacaggauuaaaaauauuaauggcugggugagguggcucaugccuguaaucccagcacuuugggagacugaggcaggcggaucaugaggucaggaguucgagaccagccugggcaauauggcgaaacccgucucuacuaaaaauacaaaaauuagcugggcguggugguacacgccuguaguuccagcuacuugggagggugaggcaggagaaucgcuugaacccaggagguggagguugcagugagccgagauugcgccacugcacuccagccuggggcaacaaagcgagacuccgucucaaaaaaaaaaaaaaaaaaguacauuuaagauuacuauuuuucaauuauuguaaaucuuugagacaggcauagaguaguuucuguuggaaaacuaguauuugaggaggagaucugaaaaacuuuaaaugaaaugagauuuaagauaaauacgacaccaucacacuuuguaaauuagauauuugggguuuccaagggaaaaaaacagaaaaaauucuuugugcagaggaagauacacauuccagacucucaaaucuuuaaauguuuuauuccuauuuuaucuacauaaaggacuauaagaucaggcuucuauaaagauacauaguuuuaaagcacuuucaugaaugugcauuuacugaagcacuuuuacgugaggaccuaaggagagagcacugcgccaggcugcggguauauaaugauguauggagaugaugaccauaaaaccuacauuucugaggauggcuuuacuugaaaguacccucuauuacucaaugugugucccagaaauauguuggcauccaaacgauacuucccagacuucuggccucuucuacuucaaaguagcacaaaaauccugcaacagugcaagugucuugauuuuuauguucagaauauguauuuccccuaggguaugaaagauggcuccagcccuuguaacucucaggaaaaagaaaaaaguuaacuaaauaaagguauagcuaauauucuucaacugugaauaauuuaucagcaagcauuuugcuuuaaaaguaaacacagccaggcgccguagcucaugccuguaaucccagcacuuugguagcugaggugugaggacugcuugagucuaggaguucaagaccagccugggcaacauagugagacucuaucucuauaaaauaaaaauaaauaaaaauaaaaguaaacauguuucuuuuauuaggggaucacauugcuaggggaucagacugcauuguaaaugguacaguuacagcauguccugcuaucuaucauggcuuuucuauauaaagauauaaagagaugagccauuguuuuguguguucucaagugucaacccuggaaaccucaaguuaaccuacaaaaagggaguccguagagacaucuaaagcaggaaaagaggagguagccaggaucaaaguaugagccacugguacuuaguaaagguggguggccucaccagcucgucaaagugugccuucuccacacuguggagaagugcugcaguuacuucuggugcacccagcccuccugccauaccucggacaauggggaugacagaagggaugaggucucuucauggagguuugcucaucacugaacaugaaacaggccuacaguaucugggugcugagaggcuuagaucuuggucuuccucuccaaguuccagaagguggugagggcagcuauugcguguccuaggcacuccuauggcacgugcucucacagcacagcacuuauuaggccuaugucaacaaucuaacccaauccaucaucaucuguucucugaacuaccacaauagcuuucuuaguggucuuccgcuccccauuugggucccgugugugugugugugugugugugugugugucagacacacacacacagagacagagagagauagagagagagagagagagagagagagagagagagagagagagaggcacgcauagaguaguuuauucugacugaggccagaaugaacuucuaaaguuuaaauaugaccaugucauuucucugccuaaaaucagcacugguuucccacuggccuccagacaaaaccuugucucuguguauguggccuauaaggccccuccuguuacaucucauggagguuuaagaaagcauacccugcauuagucuguaagggauaauucucuuuaaacaaaaauuuuuauuuaucuggacugugagagugagaaaaaagcaacaaucuaggaaucuauugaaauccuaggugauauuuauggcucuuuauuaaguuaaucuaaacuuaauuauuuugugguaaucuacaaucuagagaaauguuacaaaaugaaacagaguacaucaaugacaagaaaaaaacauccauaccuguuuagggaucugaccgaaguuauuaaugaacccaauuguggcugucuccuuuagugggucauugauguuguagauauccacuugacccucauaaaaaagaugauggaagacauuuacagcuucuacugcagcagggccuugcuguuuauaaccgaagauuaagucaauccacucauguagaugggcacucacguaaucacacuccaaagccuguaauuucaaacauagguuuagucacuggcugacuucuauuacuugcucagagacuagaaaaaccuugguaagugguuaauaggaacuaaaauaacuaaaaaucauaaaaacaacauaguauuccccucuuauuugugguuucacuuucugagguuucaguuaccugcaguaaaccaugguuugaaaauauuauuauauuuaugagagugagagacagagaucacauucacauagcucuuaguagguuguuaugauuguucuauuuuauuacuauucuuaaucucuuacuaugccuaauauauaaauuaaccuuuaucagagcuauauauguauaggaaaauacauaguuuauauauauauauaggguuugguacuauuccugguuucaggcaucaacugggguucuugggauguauccccuguagauaaggggaccuggcuguauuaguaacaaacaggugguacucuggcuagaggcccugucuuuguauuauguucaaugaccaaaugaaauucaacuucaauuguaaaauguacuuccauuaccucacgauggacucugaugaauucucguggguccccuuuugcccaggguggaaggauaacaucuccaagcuuggugccauuuuguuuacagccuaugcaauuggauacauuaaaaauaaaaaaaaagaaagaaugggauaaaugguaacuuuauauuaaucugacugagaaaugguggguuagauucaauaccagaacgcuaaaauuguacaccagaaaggacuucagagauuaucaacucuagcaucccucaagacugcuccucagaucacuccagcagaaagaguuacuaagucagcaaaacugaggcccucacugccaaugucuucaggaaaugcugaguuauaccaagcgaaacaugcuucuuucugcagagucuugagcgcaggacuccucggagguuuaauaugcuaacaugcacugcccuucucuaagagggauaucaaacacaaaaugucugaaauuuaauugaccacaagacuccuuuucagcaaaacauuuugcaggguuacugucuugaaucuccuggacacagucuacuguagauaucuguaauacaagagguuucucauaucgcugacucuuagguucucaaaagagcucuguagaacuggcauguauuuugcaguaagcauucucauuuaaaaagcaaaaucugaaaugacguaacuuuuugcuguuauugcaucauuuaacagaaaaaauauuuggaaaaacuauagggcuaccugucaaaaacaaaaaauaacauguugugauaaagcacauaaauaauauuuauuccauauaaacuuauuuuaagugauagccaagauaauuucuaaaauauaaaagaaaccauucacugugaaaucuauccacaucaaaauauauuaaauuuggcugcaucuaaacaaaaaggguguuuuucuucuuuuugaaauauaccaaaaaagucacuuuagcuuacagaguuuuuauagauacaaaucagauuaucauuguaaaaaugacucuacaaacaacaauguugacucacuaguuuaauagcaguugguuagauaaauacuuguucuggaaauuuucauacagaaaugcaguuguucaaauuuuagaacacaaagccaauuccaaguggaagcgaauaaaauaucucccuuagauacaaucuugccuuuaucauugcuagucgaugguuuauuuacaaugugauaucgagugguacaaauaucaguuuguuguuuaaaggaaugucuugacuugguuggaaagguuaccauaugauuuacaacaaaaauaaaucaaguuauuacaacccuuccuccucaaccacacacacugcacgcugucuguugaaucucccugaaaugcccacuaggucuaauuuuuugguaauaauaaacagguaaaaaggcuacuugagauagaaauuacuuuuccaaauuuugcuacaauccuugaauacuuauuugauagaauuuuauuuuaugaacacuauaugcaauuuuaaaaugacauauaaagauaacauagucugcaggaaagccuuugucuaauucuauauaauauauauauauauauuuuuuuuuuuugagacagggucuugcucugcuguccagccuggagugcagugguauaaucauggcucacuucagccuugagcuccuggccucaagugauccuuccaccucagccucccacguacaggcacgugccaccaugccuggcuaauuauuuuauuuugaagggacgagguuuugcucuguugcucaggcuaaucuugaacuccuggccucaagugaugcuccuaccuuggccucccaaagugcuugaauuauaggcaagagccagugcuccgcccuuaauuuugcuauucugaagcucuccuccauguguauccaaggaugcauggacaagaagaccccagggugaauauuacuuaucucauagcaaggggaaaaaaaaauccaagugcuuuuucuuucuuucuuuuuuucuuuugagacagagucuugcucuguugcccaggcuggagugcaguggcaugaucuuggcucacugcaacaucugccucccgggugagucuugugccucagccuucugaggagcugggauuacaggcacacaccacgaugcccagcuaauuuuuguauuuuuaguggagaugaguuuucaccauguuagccaggcuggucucgaauucuuggccucaagcaaucugcccaccucagcuucccaaaguccuggaacuacaggcgugagccacugcgaccagccccaaguguguuuucuuuuacaccauuuacuauuuuuucugugugaagaggcaaacuguuuuuuuuuuuuucuauuggggugaaauucacauaaagccagccauuuaaagggaacaaugcaguggcauuuaguucagacacaauguuacgcaaccacgauuucuaucuagucccaaagcauuuuuaucaccaccaaaguaaucuuguaccuguuaaucaguagcugcccguauuaccuucaacccagccccagaacaccaaucuguguccugucucuguggacuuaccuauucugaguauuuccuauaaauggaaauguacaauaugugacuguuuuugucuggcuucuuucacuuugcguaauguuuuugagguucaaucacauuguagaguuuauuagugccucauucacuuucauggaugaauaauauuucacuguauguauaugcuacaacugguuuauccacucaucacuugauagacaucugggcuguuucugccauucgguuauugugaauaaugcuacuaugaacaugcucacacacauacuuacuugaguugcguuuucaauucuauauaccaaggaguggaacugcugggucauaugguaauucuguuuaacuuuuugaggaacugccaaacuacuucccacaguggcuaaaccauuuuaugcucccaccagcaauguaugaggguucuaauuuuucuauaccuuugccagcccuuguuguuuuucaguuccccccaccccauuauggucauccuaguaaauaugaagugguaucucauugugguuuugauuugcauuccccuaaugacuaaugauguucagcaucuuuucaugaguuuacuggccaucuguauaacuuauuugggaaauugucuauucaagcccuuugcccauuuuccaacuggguuguuugucuuuuuguuguugaguuauaaaaguuguuuauauucuggauacuagauccuuauuagauauauuauuugcaaauauuuucuuccauucuauaggcaucuuuucauuuucuugguaacauucuuggaugcagaaacuucuaauuuugauuaaauccaauuuaucuuuuguuguuguugcuuguaauuuugauaucauauuuaagaauauauugccaaauucaagaucaugaagauuuaccccuauguuuucucauaagagucguaugauuuuagguuuuauauacaaacaguguuuugucuuguuuuguuuuggagacaaggugucacuuuaucacccagguuggagugcaguggcacgaacacggcucacugcagccucaacuccugggguaaagugauccucccaccucagccuccugaguagcugggacuacaggugcacaucaccacgcccagcuaauuuuuguauuuuuuguagagaugagguuuugccauguugcccagguuggucuugaacaccugagcucaagugauccaccugccuuggccucccaaagugcugggauuacaggugugagccaccaugccuggcccaaccacuguuuuuuaaaguaugcuauuucaaggagggaagauaauuuguuaugagggugaacaugauaaagauacauccuccuuuuuuuauuuacuuauuuuaaaaguagauugguuaguuggguuuguaaguggucggucuggaacaccuuugcaacauggauuaucauaagugauagauguuucuggaagauuaugagcuaucucuuucuuucugcaccucuccauauuugucucuuugacagugguaucccuggggaagaaggcaacguucuccaaaguugaauuauaagugaacauaagaaaacacuaauguggcugugcgugguggcucacgccuguaaccacugagacgggcagaucacuuggcugagacgggcagaugacuugaggucaggaguuccagaccagccuaggcaacauggggaaaccccgucucuacuaaaaauuugaaaaagaauuagccaggugugguggcgcauguaaucccagcuacuugggaggcugcagcacgagaauugcuugaaccuguaaggcggagguugcgaugaacagagaucaugccacugcacuccagcuugggcgacagugcaagacucugucucaauaaaagaaaauguuaaugugcauucacagucaaaggcuauagcagguauuuguugauuguucucguugacuauucuauucuuuugggaaaacccaucacuuucucuaauucuaaguccuaaaguugugucuuuagcugcucaagggugagcucuaggcauaauuacagguaaugaaaaucaauuucagacuuuuccuggggcucuggagacagccuuguuaucuuucccauuucacaaagguagaguugcugauggacaauuaaauacauaaaaauuaucuuuagaaaacuucaaauagaaauaucuuucauauguauaggauacaaacacuucccuguauuuucuguucaugaaaauuuggagguaguacaguuauaauuuaugugcuaacucuuacaaaacaguagaaaauacaaggaaugaaaaaaauauaaaacaacaaauaucuggcaggaauauucucacauggaaacaauggaauuuugauaugcuuuaaaagaaauacucagaagcauagaucagcaaacuguguuccaagaaacuguaaccaaagucaaauccacuuccucuaacagccagauaauauaaaaacagcacugauggaguuuuucuuguuuuuauaaaugcugauuugguccuguuuuucuagaaaauagaguccuuacaggauaaagaaaagggguuuacuuaaaguuauucugaaguucuaauuuuaaaacacauuagccuaugaacugagaauguauuaggcaauaaacaagauuaaaacaauacauggaaaauuuggauguaccacucuuagcuauuaauggguuucaauaguaauacuuuucaauaaauuuucaccucuguuuucaucaaaacaacgaaauucuaaauguugggaguaaucugucucaauauuuauuuauuuagagacggagucucgcucuguugcccaggcuggcgugcaguucacgaucucagcucacugcaaccuccaccucccagguucaagcaauuuuccugccucagccuccuaaguagcugggauuacaggugcccaccaccacgucuggcuaauuuuuguaacgacaaaaaucacauguaaccacacccaauuacagcaaaugacugcaagaaacuguaucaaauuuuuuucuuguuaaugugugcugcagacaaucuucagagaagugacuuauuucuauuggacuuuuccuggcuaacauuccuaagacagugccauagcucuacguaccuagaucaaaguuguuggaauugaacaggaauucugguaaauaaaagaacucugggauaaguucuuuuacaucugccauauugugcuuugacgcugaauaccaggccucgcgcacacugugaaacauccggucagccaggucaaaguggccacccugugggcagaauaagacaccucucuauuagagaaccguucccaccugacagcuucugucaaguucaagagcuugaaaacuccaacuauaguuggugacauuucaauuucccauuauccuacauuaaauacgcacaaauuuuuaauaaacauaaaacaucuaauucucuuugggguaauccuuacagaggguucucucugcauuuguuuuuauaaucaaacugaaauccaaauguaaagauuuuaaaaagucauccaaaaaauaguagauuuuaaagagaggacaaggcuguaagaaauaugaguucuggccgggcgcggcggcucacgccuguaaucccagcacuuucggaggccgaggcgggcggaucacgaggucaggagaucgagaccauccuggcuaacacggugaaaccccgucucuacuaaaaauacaaaaaauuagccuggcgagguggcgggcgccuguagucccagcuacuugggaggcugaggcaggagaauggcaugaaccccagggggcggagccugcagugagccgagaucgugccacugcacuccagccugggggauagcgagacucugucucaaaaaaaaaaaaaaccaaacaaacaagaaauaugaguucuuccauaguuugaugaugccaucacaagaaaagauucuaauguaaaucaucuacaguuggaaacauucaaauuauguuuggcuaauuuuauaaauuaacaugauaugcaaguucucauacuaaugaaaauuaaauggagaauuagaaaaggugaucaguuacagaccgaugaagcaaauuaaaauagaaaagggauauuuuucacuacgcagccucacagguacacuauccaucuucuucagucaagcccccuaugcugcuguguuuuaaguuaacaugguguaccugucuuacgaugcucacugugggaaaaugccaaaguccaugccauggcugccaaugucugccauacaaucuagccuguuuccuugucgaacucuuccccuacaacuaacuuuccuccuuacuuacucuauucuggacacacuggcccccgggcugcuccucgaacaugccagguacaagccugccuuagagcccuugcacaagcucuucccucugccuggaacacguaucuccagaugucugcagaagcaacacccuuaccuccuuuagacuuuuuuucacaggagaccuacucugaccacucuacuuaaaacugcaucccaccuugcccaaccuccuguucuccccacuucccaucccccuuucuggaccuauaucuuucugauagcuuuuaucacauucugaaacaccuuacaauuuucuuauuuuugauuucuggcugucuccuucaacugaauuacauaaacugcacagguaaggcuuuucucuuuauuaauugaaguccucccaaguaccuggaacagugccuggcacacaguagguauuuauuaaauauuugcugaauaaaugaaugagaauguacagaaaagcaauuauaaucgaggaaacagagaaugagcuggaauauaucauguuuuuguaaaauaaaaauuguuuaauucaaccaguuagggcugguugaaaaauguaugcuacuuauguauuugauuaaaggaugcuggcacuuauuuguucuaagcgaauucuaguucauuaaucaauuuugguccaacaaaauucuacuuuaguuauguaacuacuuugucacuaaaauuucgcagagcuucuuauaauagaagauaaugauguuuuaaaaggugacauuuuagauagaaguaggcuuguauaaaauagaaaaaccccaaauuuaaaguuuuaccuguagccuuaagaauaucugugugaaaggcuccauccuuacaagguaugaggccacaaucauugcagaugaauagugggucccauagugguaugcaggaguuucuccuguuuaagaaaauuaaagcacaauugaaaccaaaagaagaaauaugaaaaauaaaauugguauuaauuuaugcuugaaaaugcuagccuaugugauaacuguaacacuaaaugcaauuaguacuggcauuugcagcaggaaaacuucaggacaccacuaccccucucuucuauauuugacaguaguccagauuaaguauaauucaauggccuauucccacaaacuuaguaugucuaccaauuucauguuuugaggcuuacuauaauaguuaacccuuaauaguagaccaucuuccacuaaagcaggauauugacuuauaguuuuuauuagguucuggcuuugcaauuauauauuucucuaaaucauuguuuaugaauguuaagcacuuuuauguauuuuuacuacauauucuccuuggcagagagggggugggaaaaaagaguucacauaggacuacaagcuuaggcuuucuuucuccuuuguuuugccuuuuugagggagaaacaccauaaacauuaaacauaauaaauaacaaguaaacuauaagguuuuagaguauaguaauuuuuuuuaaaugcaaaaggguuccaaaauugccucaauaaaauuaaagagagacaauaaauuaaaguaugguuccuggacuaaacaugauuagagacagaggcagauuaugaugggaaauuucugcccuaugcaaagcaggaauacuuaguuuuccaccaauacucugauaagcuauuuaaaaugccuucuaagcauggccauaaguuggcaugcaaaccugauuccucugcuauaauaaucugcauauauguguggacauauaauacauauagauaugauauauaagcaauuugaaggaggauguaggaaugucagaccgcuacauaaugacuuacuuuugaaacuuggguacaaaguccaaugacagaaaaaguuccuuaccauuaggauccucccagucuuuauaccgcuucuuauacugagcuaaucguucaucuguuugugcucccauuggcuuagccagguuucuaaacgucuugggauuaguaagauccaccuccuaaaauacaaaauguaacucaauuccaaguuacuauacacuaucuagccucacuaacguagauacaguggcuguuguggaugaugaugauuuauaaacgcacuaguaucuguggggucaaacugguauaacuggacuccaaaauaaugcuauauauguacuguuuauacacacuuuacagacaggcacaugggaguugguuaacagauucaguuggaagacaagugcuuuggaaauuauauguuucacagaggaagccacucaggauccagguuuaggggaugaggauuaagagggaaaauacuuccaagucuugacaaggacccagcaggagacuguggacacaauagcuccaauucaucguuaacuucaucacucacauaacuggaggaucagaucucccuuguguccucccucccuccacccccgcccugucucccuccaacguuacuucugagcauuuucuucucagaggugaucuggaagugauaaaaacuagaacacucaguaauucuuucaccucuaaaagauaacaucacaccagaucaaguaacuucccaaugagauggauucuucuaguuuaccagagaucacuuuaaaaguugaugaguugaccuaauucauauauuuaaaaggaaacuaaaauuuacucccugaggauuuuaaaaguggaaauuugaaauaugugccuguggcauauuuguguccuuuuuauaggacauccugaauaacuaauuuugccaaacuuuuauuuuuaaaaaucuugggcaggagaaacugaucuacauuuaugaauguaagucaaguuagcauauuuguuaucucaaaguuuauauguaaaguaccuuguuuauauuuucugguuaauucaacaaauguuaaaguauguacaaaguaccaggugucauccuaugggcugagaguugagagagacauaaaauggacuaugugcucaaggaccuugacccuacgauugaguagggucaaacaaauagcaggacaaugcuguaaaagaaagcucccugauuaaaauggugaaaaaaaaaaaaaaaacccaacauagguaccauguuauacagcuauagggcagugugggaauagaaggcagaggagaaaaagaacagaaggguccccaucaccgggcugguacuugagugccuccugaaggaugaaguggagcuggucaguugaguuaguugguggagagaagaaaugcacgaugggcaccaggcaggucaggcuguaugugaaaagccacuaaauuacaagagagggaacuggggugccccacgauagcaguucugggaguauaugaggaauauauacacaggagcugcacugaaaagguugcuauagugagguuuuucaacucucucccaaauuaugauggugauucacugaauaauuuuauuauuuauuuuuacuucuuuuuuuuuuuuuuuuuugagacagcuucuugcucugucgcccaggcuggagugcaguggcacacucucagcucacagcaaucuccaccucaccagcucaagugauccucccauuucagccuccugaguggcugggacuacagaugcaugccaccaugccuggcuaauuuuuuguagagaugggguuugccauguugaccaggcuggucuugaacuccuggacucaugcgauuugcccuccucggccucccaaaguucugggguuacaggugugagccacagcaccuggucacugaaugauuuuaaacagggggaugacucaauuaguguuccugaaacuggcugcaguguagagggcacacugaaggaaggagagacuagagcauuaagcccaguuaggagacugcugcaaugguccaauaaagaugaggagggccugaaaugagacacuggguacacugauggagacaaagguagacaugccuuggccacugagcagacauggacaguaggaaaaguauaauuuccagccuguaagacagcauggaugauggugccauuuccugagauggggaauacacggugaaggucagaauugcaucgggagaaugugguagagaacugaagguucaguaaugggaccugccauguuccuaugagauacauauucaaauaugaguugacaaaguacuccacucccuucucagaaaaccacauuucuuuuggacuuccugucucuuuaaaaaaucuacauuuucuuucuaacuuuccuugauugacuuaaagaaaaaauauuuucauuuaucaaucuuuacuccugagcucuucuuuuccuuuuauuauuuauuuauugugcauuagguaugcaaauuaacuauacaagcaaauauauagauucacacaucaaaugaacuaacguacacccaugcauauaggguggauuuccuuucauucuuucauuagaccaaaauuuucugaggauaguuuuaucuuuccccuuaauauguugaugucuaaaauuucugaaaggauaagcagucaugauucuagugaauaagaacguucacugaauuucugaauuuuaaaaacaaucuuuuuguuuguuuaccuagggcuaagugucuuuuguuuugccuguuaugguucauuucugaacuaaucagaugucuaucagacaggaggcaaaggaagaggggaaucaaaauauucauaugcaucuauguguucuugauuuugagacuuaagucauguacauguugaauuguuggaaaucuucuaccaagccuucuuggaauaguauaaaaaauuucuuuuauauggcaggaacauuuuguagaagaguuacuuuguguuuuccuaacaaacacuucaaacuacacagauggauucugacauccaccaauagaugcaaauuaauccgcacuuaaagaaacugaagagauauuaugaauuaauagccaguacucaguaagugggucaauuauccaaacuuuuuauaugucugugcuaaaugcuucucaucuauuugaauuaagugccuuugccuauugagaacauuaaacuacaaaccaaauaaaacauuuaggcaaccguaguuuuuuuuuuuuuucuuuguggagacagagucuugcuugguuggucacccagucuggaaugcaguggugcaaucuuggcucacuggagccuccaccuccugggcuaaaguaauccucccaccucagccuccugaguagcugggacaucuggggucuggcaccacaccuggcuaauuucuguaauuuuaguggagacaggguuucgcccuguuucucuggcuggucucaaaauccugggcucaagugauucgccucucuuagccucccaaagugcuaggauuuuagggaugagccacugcaccccacuucaauugucguauuuuaaaauuauuuuugaaaauguguucuacguaagcaaaaugacuuaagauuuaccucugagucauaaucugcaaggauccaggggaagacaggauacugcaugagaucauuauaugaucugccagccaaaguguucaaaugcaucaaauauuggaaguugcugauuucaccucucuggaaaaagauaaauauucauuuuugagcuaucgauuauuuccacuauguucagcuuuuaaaauuuuauauacaaaaugauguaaaggacaguuucuuuuuaacagauuucagaacaaugaaauacuuuuuuuucuaaaaagaaugaaaauaaaacauuuucucuaugguauauauuuuauggauaauuaaagugcuuuuaacuguaugacuucuacucuaauuacgaacuucuaaggaagcucauauauucauuaaacuuaccucccaucucugagucacagacuucucuccaaccaaagugcuaaguaacccagaucuaaaagcaauacauaauacaauaaauuacaagcaauaaaauuuuaaaucugaaaaauuauaaaguugaaaaauuuaagucaccugguccaggaauuuuucaaacuauggaggaucuauuagugggucauaaaaucaguuuaguggguugugaucagcauuuugaaauaugaaguaacauagaacugaacugaagaaaacagaggacaucagaaggcaucacauauaguaagaaaaaguauuguuuugugaauuuuguuugaguugaguauuuauaacuccauuuaugugccuugggaugaauguaauauauauuuuuuacucuaggucauauucaaaagaguuggaagaacacugaucuaguucaacuuucuguuuguuuuguuuuguucuguuuugagacggagucucgaucugucacccaggcuggauugcaguggcauggucucagcucacugcagccucuaccuccuggguucuagugauucucuggccucagccuccuggguagcugggauuacaugcacucgccaccacgcccagcuaauuuuuguauuuuuaguagaggcaugguuuaccauguuggccaggucucgaccuccugaccucaggugauccucccaccucggccucccaaagugcuaggauuacaggcauaagccacagugcuuggccuucuuuuucuuuuuaaaaccauuuuauaauuuauuuuuuguagagauggggucuugguauguugcccagguuggucucaagauccuggccucaaaugauccuccuaacucagccucccaaauuauuaggacuucaggcaugagccauauucuaaccauagucuaacuuucuaauuuuuacuauaaucacuaaguaaacagauccaagcauacuuaauuagaauaacugaaauauuauauaauauucuguacauaguagguacauaaugcauuaaauaagugaaagaaaauaugaauauuguauaacaggaaagucauugcuguccaggucauuuaaaauuuaaacauuacuuuuuuggggacagcagacuuccuuaaaauguuauaaaauccuauuuaagguuuaucagcuuuauaauauugauaauuaauaauuggucauggaaccaggagaaaguauuuauauauuuucuuuucugagaggaaauuaauacauuuguaaaccuuagauccuaaacacauccagcucgaugguacuauuuuccacuuugagauagucuuuccaucaggcaaauugaauguacaagauacucucuuuggaaaaauagccaugaucacucuucaacaucguaagaaagaggauaacugaaauggaagauuaaaguuggaaaugaauuucuguuucuugccucugagcucuuuaaaguucuuuaagaacugccaacucagcacaggcaguagcaagaacaaagaaauagcaaguuuaagauuaucuaggaagcaguagcaauucgcuuacaaguagaaaaaaggcucauuauguuuuuaaggaaaucuuucacuuccuguauuuauguuaacaacaacacauaugauuaggagcagaacauguuucugggguuaaaaaaagcauauauuuagcauuguauuuguuaaggcuuggcuauagaaaaauaaaaacaaaacuuaaagagaaauacacaaaguauuuagaugcacacagacuggaaucaaauuuauuuacaaauuacagaaucucuagaacuuguaaaagucauuuucuugcauguucuaauaauuaauuuacagccccaaagcacugcuucuuuccagucgauuauaaagggcuacuaguuacugagugauauaaauggaacugggucuacagauucuugaaauggcuguguuaccuagaaggccucgcuaagaugaagcacagcuauaaggagcauaaaggaaucacugauaggucagaauacauaaaaacagaaguuuaaauguaaaugucaaaaagcaaaauuuagaggaaaacugggaaaucugcaacaaauaugacaagcaaaggaguaauaccuuaugguagaaaaauccuauacaaauugauaagaucucaaaggaaaaauaggcaaaagauacggacaauuuacaaaaaugauuuuaaaugguuaauaaacauauacagagcucaugcuuacuaauaaucaaagaaauauacauuaaaaaucagaaaacauuuuauaaaaucaauaaaauaaaaaaauuaauauacaggccaggcgcaggggcucaugccuguaauuccagcacuuugggaggccgaggagggcggaucgcgaggucgggaguuugagagcagccuggccaauauggugaaaccccaucacuacuaaaaauacaaaaauuagccaggugugguggcgcgcaccuguagucccagcuacucgggaggcugaggcagaagaaucguuugaaccugggacgcggaggcugcagugaacugagauggugccacugcacuccagccugggcaacagagcaagacuccgucucaaaaaaaaaaaauaauaauaauauacaaaguuagcaaguaucuauugagacaaacuuauccacuaauaguacaauauaaacuuguauaguuuuuaugaauaucaagcugguuuuguguaucaagagccuuaaaauuccuacucuuuguuuuauuaaggggacucuaccacaauaaaauaaugaagaaucauagccgggcauggugacucaugccugcaaucccagcgcuuugaggggccaagauggguggaucacuugaggccaggaguuugagaccacccacgccaacauggagaaaccccuucucuacuaaaaauacaacaauuagacaggcaugguagcacaugcuuguaaucccagcuacuugggagacugaggcuugaaucagccucaggcugggaagugcucagccugaugcugagaaucgcuugagcccaggaggcagagguugcagugagccaagaucacaccauugcacuccagccugggugacagaaggaaacugucucaaaagaaaaaaauuaaaaaaaaaaaaaaaaaaaaaagaagaaucacauuuccagucuuaugauaagaaaaccugauaaaugccaggcacaguggcucacgccuguaaucccagcacuuugggaggccgagguggacagaucaccugagaucaguaguuugagaccagccugaccaacguggcaaaacccugucucuacuaaaaauacaaaaauuagccaggugugguggcaggcaccuauuaucccagcuacucgggaggcugaggcaggagaaucgccaugaacccaggagguugcagugagccaagacgugccauuacacuccagccugggugacagagcgagacuccaucucuuaacaauaauuaaaaaaaagcaaaaaccugauaaagaugaaauauccaaaaauuacaugauguuuuauauaugugaugaauagauagcgaauaauaguuauguuucugaauaguuuuuuaaagaugagagggaauauuuaaauauaacacugaauagaagaagcagaauaaaaacuuguauuuagaguauaaacucaaucaugcacacagcaauacucaugcuuuaaagaacagaagguaauugaucaaaaugugagcagugauuugacacagugcuuaugcauaccuuuuucuuuucuuccuuuaguuuucaguauuuuuuuaaaaaaauuugcaaccaccaggggaaaaacacucaucuaaaauguuaaauaauacuguccagauaugaaucaucccaacuucacuauuaaacuguaacaugcaaggaacaaaccaccuaccccugcuccacacucguguuuggucguugcccagauacagauucugaacuguccguuagagauggcacuacagccaaaaaccugaaaaauuuaaaauagcguaaaauuacaagugaagucucagucaggaucuaaugggaagccuaagaaaggacgauucguuuagauuuucauaguugcgucuacccucccauaacccacuaaauggcaggcaaaaggaauauauaaauuuuggacuucucuaaagaggaaauaauuucuuagcacugaaaacaauagcaccuuuagaaauuaaaaaaaucagauaaguaaaagugaaucucaaucacuuuacuuagcucuucccauaugugaaaggaguuuuggguuaccaaucaacauccacaggcccuuuauuugaagaaccacccucauuucccaggugcucacggguaauauuacuguacugcaaugagaagcaauguuggaugguuuaguuauuccucauggaaauaaucugaaauauaaaauuuucuauaauggagggauugccaggaucuguaucacccuucaaagaacaagagaaugccucucaucuacaugguuaguucagaauagccuuauuauucacacauucaaaagaauuaucuuuuaaguaccagagauguguguuguuuuuccuuuuuuaaaaaauuuauaggcugugugugguggcucacgccuguaaucucaacacuuugggaggccgaggcgggcagaucaugaggucaggagaucgagaccauccuggccaacauggugaaacuccaucucuacuaaaaauacaaaaauuagcugggugugguggugcaccuugauaucccagcuaauugggaggcugaggcaggaaaauugcuugaaccugggagguggaaguugcagugagccgagauugcgccacugcacuccagccuggugacagagcaagacuuugucuaaaaaaaaaaaaaaucauuauuauuuuuugaaacagugccuugcucacucaggcuagagugcaguggugugaucguggcuuacuacaaccuugaccuccugggcuuaagcaauccucccaccucaaccugccauuacaggcaugugccaccaugcccggcuaauuauuuucuuuuuuauagagacagggucucacuauguuccccaggcuggucuuuaacuccuagaccaaagugauccucccuccuuggccucacaaagugcuaagaauaugagcgugagccauugcacggcuuggccuguuuuucacuuaaaagguaaauuuuaaauauaguuuauuaaagauaaaaauaugcuuagauuagauuaacugcuuuauuuagcuauacuacuuuuucaaggaugaagguauccaacaucccuuccauggccagagaaaagucccacaugaauuaaauuuacucaguccuugcauucaauagcaagaaacugcauuggcuucauuuugguaaauacaaagaaagcuuauuuugaaacuaaaguuuuauuuuuggccgggcacgguggguggcucacgccuguaauccuagcacuuugggaggccgaggugggcagaucacaaggucaagagaucgagaccauccuggcuaacacggugaaacuccaucuguacuaaaaauacaaaaaauaagccggggaugguggcgggugccugcaguuccagcuacucgggaggcugaggcaggagaauggcgugaacccgggaggcggaguuugcagugagcugagaucaugccacuguacucuagccugggcgacagaacgagacuccgucucaaaaaaaaaaaaaaagaagaagaaaaaaagaaacuaaaguuuuauuuuuaaagcuacaguuucaucauccuuuguauuuagagacacaggacuuagugauaaaaguaguuuuugaugaucucuacuauaaguuaccagaaggaaaaaugguaugucacaauagaauugcaccauuuuaaaagucagaagaauaauuguuucaagaggguggcaaaaauaauauaaauuauuuucuucaaagauguuggcucauugaucuagauuuuuaaaaaccagcaaaacugagaaaagauucccccucccauaucuucccauaauaguauacaaaguguuccgaauaaacaagaccuuugauagacuuuguuucugauuccuuucugaaaagcaaggagguaauuccguccaucuccagagaaaacuuccacagcaauaggcugaaaugaucagagagaaaaacauuaagaaaaaacagaaguucacaaauaaaauuauauauuaacuuuuccacuauaaauuucuacaauguucaagaaguuaaucugcggccgggcgcgguggcucaugccuguaaucccagcacuuugggaggccaaggcggguggaucacaaggucaggagaucgagaccauccuggcuaacacagugaaaccccgucucuacuaaaaaauacaaaaaauuagccggccuugguggcggguaccuguagucccagcuacucgggaggcugaggcaggagaauggcaugaucccaggaggcagggcuugcagugagccaagaucgcgccacugcacuccagccugggcaacagagcgagacucugucucagaaaaaaaaaaaaaaaaaaaaaagaaguuaauuugcuaacacuuuuagagucaugaauucccugcagauuaagcuacacaauaaauagauauuucuuauucugcucaauuuauuucuaaagucuuuaguaacagaauaaaaaaaguaauuauaauuuuauaauuauaauuuuauaaaauuauaguaaggauguaauuuuuauauuagaagaaaacuaaaauguugauuuggauagcuacagggaaagauggauaacaaagauaauuacccaaauuuuaggcuguguuuaaacaagagaaaugcauuauacaaaauuaugcauccacaugaccugagucugucuauaaccauaucuaaggauuauucuaaaugcagauccuggccagccacgguggcucacgccuguaaucccagcacuuugggaggccgaggcaggcggaucacgaggucaggagaucaagaccauccuggcuaacauggugaaaccccgucucuacuaaaaaacagaaaaaaauuagcugggcgugguggcaggcgccucuagucccagcuaugcaggaggcugaggcaggagaauggugugaaccagggagguggagcaugcagugagccuagaucgugccacugcacucuagccugggugacagagcaagacuccaucucaaaaaaaaaaaaaaaaaaaugcagauccuauugaggguuuccauggcauguaucaauuuuaaaauaauacauuuucggccgggcgcgguggcucacgccuguaaucccagcacuuugggaggccaaggcgggcggaucaugaggucaggagaucgagaccauccuggcugacacaaggaaaccccgucucuacuaaaaaaauacaaaaaaauuagccuggcgugguggcgggcgccuauagucccagcuacuugggaggcuaaggcaggagaauggugugaacccgggaggcggagguugcagugagcugagaucaugccacugcacuccagccugggcgacagagugagacucugucucaaaaaauaaaaauaaaaaauaaaaaauaaaauaaaauaaaacaauacauuuucagaauaaagaaacaugauaaaacaguacuacuaaauugacucaccugcaggagauaucuccuuuuaugaacuuccuugauaucuucauaugcaaaaaugcugcauguucucuugaguugacuagggccuugccuggcuccucuaggaauaauaggcucaugcauacuacaggcagccaagagaaaaagcaaauaaaaacacagcaagggauaaauucacuguuccauaaagggcgugcuaauuuuaaacacaugaacaggauggaggaguaauauauaucagaauuuucaguuaaaaaauauauuuacaagaagaauuuguuagcuaccugagauacaaggaacccccuuugaugaauauaauuuuaaaaauccccuuauuacugucaggaccaaguuaucuaccagacaugguuagcacagugccucagcucacauauuuuggggcccaagaaaaugucuuaauuucuuuuaaaaaucagaaaaaaaaucaacuuuuagguagaaaaacacauuuuaauauaagauuauauuuauaccauuagccacaacauacaauuuuaaauauuuuuguauggaaaaaggacccacgaaagacuucaugugacccugauuguuguugacaguaauuauuugaaauaucuccuaggaaugaacuacagaaacaaugucuguguucaagggugcuaggaaaauguuaaaggaagagaagcagccuguugaucuucuaagcccuaagcuucuuaacuuucuucuagguuggucugucuccugaguuuuccacuacucacuaccacuuucaucacaggacugguagaagaaaaggaagaugccuacaacucagucaguaaaucucugcuaaugcuuuagucaugcuguuucuagggugcuccgaguaccugaugaugcucuuucauuuuuaagaguauucuucacgccuguaaucccaacacuuugggaggccgaggcgggcggaucacaaggucaggagauugagaccauccuggcuaacauggugaaacucugucucuacuaaaaauacaaaaaauuagccuggcgugguggcgggcgccuguagucccagcuacucgggaggcugaggcaggagaauggcaugaacccgggaggcggagcuugcagugagccgagauugcgccacugccacucacugcacuccagccggggugacagagugagacacugucucaaaaaaaaaaaaaaaaaaaaaaaaaagaguauuuucucuacaauuguauaucugcuauauuuuuuaaaaggaccauuuauaaauucagaauaaauuuguaaauauauacauuauaauauaaauaacucagaaugcacagaaauaaauguuauuuagcuuucaucuugauaaauaagccaaacauuuucauuauuaccuuaaaauaacugaauaucaucuuugugaauauguaaugaugaaugcacacaaaccgagagauaacauuaccuagaacacaauuuuuugauuaaaaaagaaaacugcaaauacauuuucugucuucuaaagauagccauacauuaugucucuucauucauuuacuuacuuuggagguaagguuucaauaucucuuauuucccugguugcugucaugguaaauccaucaaucacauaaaaaugcucuuuaccaaaaagaaggagccccucacugguaucuaggcccuggacucgagcacagcgguacauguguuggaucuauaaagaagcccacaaacauucauuaauauaggcuuuuuguaaagaucaauuuuuguuagacuacuacggcaucccuagagcuaagcauauuaaaucagaguuuaagcauauugagaagauuaagcuuagauuacagucugauuuacaucugacuagaguaaaacuaaacaauucacucauacccauccacucaucugccaaucccaucucucucaauauuccggguguacuuuauguaggccaggcaaacaugcgcuagcuucuaaaagucaagaacauuagauaaggcuccugcucucaugaagggagacagacacagcaaacuuggcaggaaagggaauugaggcauacauguaaggagauuagaauaggauuguguucuaugugaggcaagaugauacagagugaaaauugcagggccugcuaacucaggguaaauuuccaguucugccacuuuguagacugggucaaguuucuuaauuucucugagccuccaugucuuuuuuuguaaguuucuaauuggcuuguugugaaaaauaagugagauaauguacauaaucagguuaggaauuauugguugcuuucuguuccacacaguuuaccuucuuuuuccaucauacccccuggaaauggaacuguagaauuuguuucuauucauuccccaccuggauucugcucccuggagacuacuguacuauugcaaaaagccaagcuuggcagaaguuguauuuuccucauaggaaggagcauugcuaaaucucucaaaguaaguauuguuuucucccaaagggcaguaucuaauucuuucuaaaaacucuuucuugcuuaaacuuaguucaacaugagucaagacaaaaaucagcaauuaaaucagagucaaacacaugucaguuugaauacacuuccugcacuauuaaagcaaccagagcaaaaacuguacucaugagauuaaaaguuuuaaaaaugaaagcauuguaauagguuuucuaaaauaucuaaauauaagucaauuuucauugcuacauuugaucaauccugauguacuuuaaaaguuucucuauugcaguauauuuuaugcauauacauacauacauacauauauuauauauaaacacauacauauacacacacacacaaaauguuuauuuccuaaguguauggcuggaugaauuuucaaaugcuaaaaauuuugugugaccagcauccagaccaagaaacagaaugcuccccaguuccuagaagccucucuugugcuuccuucauaccugguguacuuuuauaguuacaugaucuuuucuaauguauugucauucaauauuaauuagggcauacauuugaacggaacuguuuugauuauacucaaauuucuagugacuacuucuuagaggguaagaacucaaagguuauaccaagaucuaauauaauaggcaaaagaacauccuuuaaaaaggugauauucaugacacauucaagucauucauucccuuguuuauuaaaccaaucauuccuucauucaaagguuuacugguugucuauuaugcaacuggaccuguguaaggcaaugagauagagauaagacacaguuugccuauaaggagcucgacaucuaggacgagaaagaaagauacuggaacaaguaauuaugacaugauaauacagagugauauauauaaggcaucaugaaaguauagaggaaggguaugcaaccaagccugaguagcaaaagagucaaaaaaagcuuccuauguuugaauauuacaaacauccagauaaaugggauuauaacacacaggauuuauuaggauaaagguuaugcaaguaaaaggaagggggcauuuuggcagaaaaaaacaauaugagugacacgguuugcauauguguccccuccacaucucauguugaaaugugauccccauuguuggaggugcggccuuaugggaggugucugggucaugggggugggcccuucaugaauggcuugguguuguccuggcgguaaugaguccuuacucuaucaguucacacaagagcuccuuuucucacuaugugacaagccuauucccccuucaucuuuugccaugaguuaaagcuuucuaaggccucaucagaagccgagcagaugcuggugccaugcuuguacagcuuguagaagcguugagccaaacaaaccuguuucuuuauaaauuauccagccucaaguauuccuuuauagcaaugcaacauggacaaccacaaugaguaaagugcagaguggaaaaaaaaacacaacaugguggguguaaugaacuccaagguguaccaggcugcaggggcucaggcuacaagacagagucaguggaaugagaccagagaggucagcaggguauuggagguugagcaagaaauaggaaggugaugucuucugugagugaaggagagcaggggcuaaauaauccaaggcuggaggugacaguccagauuggcugaagccgcuuguagguuauuacuggaauuauggagauguagaaaaaaauacaaggccagauuacugaauaggcugucuacauggauuugaaauagagaauuauggcaagaucugugguauagaggaagaaagaauuagaugccaguuguuaacacuguaucugauaaaaucuuaugcuguuuaauguuucaggguaugagaaaacccuuacagaugagaaaaguagaguacugaacccaaaaggcugcuuaagcuguauuuuauuaccgaggcuaaugcauuuacuuuccacagcuacccuaucaacucaucuugucuuaauaauauguuacugaaguauuuacaauccuuacuuuucagaagcacaauaccuuuucuccuuccucuaacaggcgcaguaagguagcauuaucuguuuucuccuccucuucuauggagcugcccucagcaaucuggucuuguagcugcuccugguucuccucaucuccuccaucaggugcagaucgggagcguuuuagaggaggcuugaccaaaccuacaguauaauaaccaagagggccauguggcauuguaaggaccuuguggggaagcaguuuagucucauguaguuccuucuauagauuuccaauuugagacaauuuuggaagguauagggagguagcacauucagugguuaagaacauaguccucuggaguuaaugaccuuggaaaauuauucaacuuucugaaccuuaguuucuuaucuauaaaacugggacaagagccaggugugggcaacacagcaagauucugucuuaaaacaacaacaacaacaacaacaacaaaaaacaugguacaaguacacuaucuuagaggauuguuggaggacuaaauuagguaacucauguaaagugcuuagcauuaugcuuaaugcauaauaaauucucaauagugucagguaaugaugauaacagaaagcuauaauaguaagaaugguauagcuuagguaggugucauuaaggggacaccaugaauaaauaaucaaugauugucacaaaaauaaagacagcaaauuauaaacaugauuacgacugggugcaguagcucacaccuauaaucccagcacuuugggaggccaaggggagcagaucaccugaggucaggaguuugagacuagccugggcaacauggcaaaaccccgucucuacuaaaaauacaaaaauuagcugggugugguggugcaugccuguagucccagcuacucaggaggcugagguggagaaucgcuugaaccugggaggcacagguugcagugagcugagaucacgccacugcacuccagccugggugacacagcaagacucugucucaaaaaaaguaaaaaauaaacaugauuacaagauaucccaccuacuuggagggcucuugaagacuauuucaugccucauuucacaaguggcaguauggcuuuucauacaugaauuaauuugaucaaaauaccaggucagaaagaacagaauucuuuauaauacaaggacauauaauguaauuugcagauuaaggaaacauuuuacuaccuacauuuugacaacuuuuuaauaaucacaguacgauaauuuaaaaucaguugacaguaaccagugaggacccaaaguaugagaaguccuuaaaaugcaugccaaaucacacauuuugauuaaauuaauauucuuugugccauccaaaguaacacuauaccugccuguuacaguugcucuaagcacuuuggaaaagcacaagucagccugagucuuauccuuugaauauuacuuaucagagguucugcuuugccuugagaagagccuuguuuucauauuugaacaaguguaauaaguaagcaagagagaucaaauccugcagagaacauccacaagggguggaaagcuuacagcugcuuuauuuuuagcuuaaugaaucaaaaccuccauuucuaugucuagcauaauacccuguauauuugcgcuuuuagcucaauuagagauuaggaaaaucaggccagagaaguuaaaagccaaugaccuaaacacaaauaaucuaucaaacucugugaauuauaccuuggcuuguauccagcaacagcuuuggacccaauucaauaacuaugcuggugcaaugucaacaaaauuagaaggcuuuaaucucuguucaacuacgaacaguuucagugauuucaugaaaauguuggaucaauuauaaaauguuuaguaagucauagucaucacaugagagaacagguaugucauaacaacaggagaaacugaucacaaucucaauaguguuuuuuguugacacagucauauacuaucaguuuuuaaaacaaucugaaacucauuuuuaauuuauuaacucauuaaaacuuauuuuuaauuuauuaguuuuuaauuuuaaaacuaacuuuuacuuaaaaucuuaauuuacacuuuagggcuuuauagacuaugcaaagacuuuugaauuuguggugaaucagaggcuuacaaagauuaaaacaauggauugauuuacuuacucaguugaacugauugaauccucauucugugcuagucaugugucaaaauuuauaaagugagaaaaaaaaucugucuuugagaaaaacucauaaauuagaaaguggaaacauacagcagugaaaaaaucacugaaacugcuauaacagacaugagcgaaguauuaucagugaacagaggaguuggagaagacuuuagagaaggaugauuuuauauaugaccagugaguuuaagacugaguaggauguguuaagguagggauaauggagaagcuguagaaaagaagaaaccauuucaggcucaaggcaccacauguaaaaguacagaauccgaaagucuauggacauuguaguccaauucaucaucuacucagcuccuaaaguuuagaucugggauaaucucucucaacucauaggaagaaagaccauuauuccuuacuauuggcuaauaugcacuaaugacagguuuaguuuuaauuucauaaauauuuauuuaguuauuaagcccuuaaaauaucaagugccaaggcacauguucucaauaccuccugaugcugugucaugaaaaaauacauauguguauuaaaaaaacuaaauaucaagugccacugagaauucugagaaauacaauuaaaaaaccauuaagccaaugggcacgugauauucauuuguaggcaauaaacaagagcaagucuuuuuaguucugacaaagaaaucaaucuuuaagaagggugagaugguaaaauguguauggauauuuuuaaaguuggcccuacuauuuauaguugcucaaauuuuuguaugaauucaaauacaagaauguuccaaaaucacuuuuaaucaaaaucaaaaaggcaggcugaccuuugacuuuagcaauagugucuuccccaugcucugguucuugcugagcagcuucaccuucugaacucuccacaauggcgucuuggacaauggcgggauugccagaggccagucgcauguaguacucuuuacugucauaacuuacggcucuucuauaucgagcagguuucuaagaaaugacaaaagaaaaugacuccgauaacuaucaccaagaauuaaaacguaauauucuugagggaagguauggugucaagguguguuaccuuuuuaaaggggcuuuucauagacuguauguauauacaguaaauccacacuuuuggguuaaguuucucuauuuuaaaauucuauugauuuuuuaaaagacauacauaaaacaacaauauuagcagcuuuguucuuccugaaauaaucucuagccaaaaaauguuucuguguuagugcagugugucuucuuugguguaugagaaaaccuccccauccgguaaagagaaugaucacuguugaagagcaucaagcugcaaacagccugucuagucugugaggagccuggaacuucacuuccaccccaagugaaguaauuaggucaggccuaaagguccacacacucagaauaaucggugugaguguguaguucaaauacuuggagguagagacucaacuggccuauucuuuccuauauucccagguuucacugagaauggccaaaaucuucuucagauccuucugagaguccugacccaaaaaggaaucaagaaguuuuaugccaggugacacucugguuagcuugccacugcaagcugcuaucuccaauuugcucauucucauugucuguuguguaaaggaauaugauccauaacuaacucaacuaaaugaguauuugauauacucauucuuaaugaacauacagcaguccauucugaagaagaaauuaauuaccuagaaacauaaggauuugauguuuuagaacaugauacaugaacauuucuuuuccugauuagccuuuauucucaaaacagguucuccaacugacuuaaauuguuuuccccuuaaaaucacggaagaugagaaacuaagaucuaaaauauccuauaaaauaucagacagagggaaaaguuuguauguauauagguuccucggaucggaauuagacccagacuauggauuaauaauuuuaaaaagaugaaaucugaaacaugcuuuaaaaccuuccccuucuaaauaugacuuuacuuuccuauaaacaagaauauauaauuuuaaaaauuuuacuacccgucuacucuucaaacucaaauaaucaauaugcaucauuuacaacaaugcccuuuucaagcaacauuuuuuuuaagugauuuccaacuaaaguggaaaacaaguguccuuugggugagacauguagaaugagauacugaaccaaauuuuagauaaaaagauaacuaagucaagccacauuaaccuucuuuaacuucagguacagagcaaggaaauaaagagaguugccagugaacugaggaaugauauacagcaaauggagacugaaaauauuacuugacauagcaaaguauuaaaaugauguacaauauuacaauuuggaggaacugauggguaaacaaacaagaacacugcacuauuuuugaaacugaaaggaaggucguagauuuuguaccauaaaaauucuuuuaugugagguauuuucaacucaaaauugcuaauauuuaaaaagauaaaagcauaguuagugaugggcaagacaaugaauuaauagaugagggacagcaucuacuugauuacugacuucauguacagauuuaaaauugaccuaaaagaauuuuuuucuaaauauuuugauguacauuucuguguucuaaaaaacuacauuuuuuauuaaauuauguacuuucaucuuucuggaauacaaaaacgauaauuaacuuuucuacuaauuaaaauaaauuuguauuuuaaaaagugaucacacacucuuuguuuccauucguucugauugaaaaaaauaauuuuaaaagaggagacacuguugcauucucaaaauauacacuuuaguauuuagaagaauuaaaugagucacugaaaaguugaagaugccaggcugcccauuacuaacaugccucauaauuuguuaguuuaugugugaagcaaaagauguuuuuauagugagagcagugaaaacucagucuguuagugaguggcauauaaauccuaaaaagagauaauuagaaaaagcugagcaacaguagaacaacaucucucagccugaaugaaaccaacgguucaacucuaaggaacuuauaggaagaacaaauugaaagccaaucuuuuaaguuagucuagucuaccaugcacuuaaaaaaaaaaccagaaaacaaaaaacaaaacuacaaguaguuuacauucuuuuacuguaauuuguguuuuaccuuuugaggaauaucaucgggugucucaggcuguuuacuugggaucucagacugaaaacaggguauuaaguauagacauaucagaaaaaaaaacauaaagaggaacacaaaaauaaaauuuuucuugaggauuguaugaaauaugaaagauguaguuacucaaacaaaauuaacaugauagccuaagcagcuuaaauaaucacuaagcaucuugugguuacugucucacagaucaaaagcaguuuuaaguaaagcuuaaauacggcaaacgucucagugcuacugaacaggacaaacucuuacaaaucacacaggcaaaacuucagcacaggcugccauugacuuggaugauuuacaggcaacucuuuacauuguuuaaaaaaaaaaacaaaaaacaaaaaaccugaaaucaggauaauagaaccuaaugcuagcuaguaucuuccaucuuccuuucccugggguuaucccuaaaucuguguuguaacaggggcaaacggcugauuuaagcuaucauuuacaauacuccauaccacagacaucauucucuuuaagaauccucccuuaaaagcauaaggaucuacuuccuucacuaccuuuaccaucccagaaagggugaaagcagaggguagacuggaucaucagcccccagaucagaagcuuuucuagaguacuuuuaaaagaauuagguaauggcuuuauauuuuauuuucagaauaaaauccugguuaauaagaaggcaauucuguugagcuguagcauguggcuucauguaagcacacagguagcuacagacaauaaugcaaccaaaaaccacuuccgaauuuccuuccuguucaugguuuauaucuggugaugacuucugguaccuuucccuauaguaaacaugagcaggcaaaauguuuucacaaauguuugcuuaccaaggcaaaaccauggcccacuaggcauacuuacaaauacuucacaugguuuuagugauucuuucuuuuuaaaagcaaacuuguaaagguauaucuuauauugaaaaauaauauuuaacaucuaaucaauguucuuuaucuugguagggauuuagaagauaaaaguauaauguauauauuuguuaaaacucacugacuagaccauaauaaaauaaaaguauuuuaauggcaaaaacagaucaggaaauccaacauuaaaaaaagaaagaaaaaaaaaucacugaacaguacacuuaagauuuguauauuucaauguauauaaaauuuccuucaggaaaaaaagaauuguaaacaaauacugaacucauaauaugcauaugaaagugaagaaaacggauucuucaaccugcucugaaauucauaaaacaaaacaaaacaaaacaaacaaacaaaaacaagauaggaccaggagcgguggcucacaccuauaaucccagcacuuugggaggccgagguggguggauugcuugagcucaggaguucaagaccagccugggcaacauagcaaaccccccaucucuaccaaaaaauccaaaaacagccuggcauaguggugcaugacuguaauuccagcugcuuggaaggcugaagcgagaggauuacuugagcccaggagguccaggcugcagugagccaagaucaccacugcacuccagccugggcaacagagcgauaacuugucuuaaaacaaaugaauaaaaaaauaagauagacuguuggauagauaugcaacaaauaaguacaacaaaacagaccaauuacuaaugucacaccuaacugugacauucacuauauauacucccagccaggauguaggcagggucuacuaaguauacccuuauauuuuuccugguaccauaugauacaguguugauuuaauacauauuugcucacugauugauuaaccgguucuuauuuuacuaaaaggcccagcacucaauaguaaauauguuauaccaauaauuuuagcauuauuuuggcuuccuuuuauuuaaaaaagcauuaaauuauuacuauaauucuuuaccuagaaaccugcauuuuucaaagucagaauuucuagcaaauaauguuauaguccuuuuacuucaaauuuuucuauaaugcuggcaaugaaauuuccuaaaugagcugcuuaguuucugugagucuugugacauuuauacauuauauaaaaauauauacugaggcagccacaagaaacucuccuaguuagaaaaggaaccuaaaaguugacuagcuuccugcccaaguaaccccaaauuaauaggcagacaaacucuucacuguaaugaacuuugcaaauaauaguaaauguguuugagauuauuauucuuuaaaaauaagggaauuauagaauuaaagccuaguuaauauuuaaauauaauuuuuuuuuaaauggcaaaauauacauuauuuuccucccuuaggauucagaggaacaaccagauuuugaauuuucagcauaucccaggcuuacaucuuacacuaucuauaauauuuguuuaaaauacagaauuauaguauaauucauuuguuuuaauuaugaaaauuacuccccaaggaagguuacugugugaagaguacaaaucauuuuuauaugagaauacagaauuuuccauauguacuuaauuuuucucgauauuaauaauuauuacuauuuuuauuacaauaauuauaguugauaaacuauuaacgcuuuaaagucugaauauguuccauauucuauacacaaacauccaauuuaaaaucaauaaauaaaauucaaaacuuagacuagguaagcuauuuguuauacagcauguaacauuaucaaaguuuaagaaauaaaacuuuaaugaguaaaaaaaaaaaaucaccugauuuauuucuaacaaaucaaagacuuuaaaacaagaaauuaacuuuugaaucaccacuguauucuucagcuuaagggacaggacaaaaaaaggaaauguuacugagaaauaauaauuauuuuaaucaauaaggcaaaagaucaaaucauuugcccuugcaccagguaaagucucuuuuaaauaucaagaggcuucaaaagcaacuuuagguuggcacaaaccuauucuaucacaaaaaguacugacuauauuaaacaugcaugcaaggagggcaauaaauucauggaaguuuaaaggaaagaacugauugaucucuaacucugggaggcaauauuuuuuaauauagaucagggcagagguggauuuacuaugaaguuaagguaguuuaaacuuuaguggccuucacuuccauugagucccuuucaaaacccuggaaacaaagcccuacuaauuuuauauucauaauuuuuacucuuuuucuuagagagcccucuccuuaaacugcauaaacuacagggcccauaaaauugaauucgaggccauuuuaguggaaaaguuuuagauuuaggaaaauucuauagaaugcuaaagagaaagcaaaggaaaaaagucuauaacuuagggaagacaagagugcuggcaguucauucacucaauauucacuaaguauuaggcacuuuguuagcacuagagagauaaaaccuaauauggaauacauucacuaucaauggauaaugucauaaaaugggcaaacauuagaaucuuuucuuuuucaaagugauucaacuaggggacuguugaaauauacuccuaccuuacuacacuauuuagcagcugcagccuagaagggguuccuuaacuacucuagguuucaguuucucaucuguaaaacugggauaacaauauuaacuguacuucagagggcuguuauaagacugaaacaaaaugcauucaaacugcucuauagagcaucuagcucaggaguguccaaucuuuuugcuuccuaggccauauuggaagaaaaauugucuugggccacacauaaaauacacuaagacuaacaauagcugaugaguuuaaaaaaaaaaucucucucucuguauuuuuuuuuuuagauggaguuuugcucuuguugcccaggcuagagugcaauggcgugaucucggcucaccgcaaccuccaccucucugguucaagcaauucugucucagccucccgaguagcugggauuacaggcaugcgccaccacacuuggcuaauuuucuauuuuuaguagagacaggguuucuccauguuggucaggauggucucgaacucccgaccucaggugauccaccugccucggccucccaaagugcugggauuacaggugugagccacugcgccuggcaaaagucucauuauguuuuaagaaaguuuaugaguuuguguuggguugcauucaaagccauccugggccauaugugaccugugggccucggauuggacaaccuugaucuagcucauugugcuuuguaaauauuagcuccucuuuuuugauuugaugguagaauucagugggauaauagauacuaccacuuuuugaaaauuuguuuuuaacucugccggaaugcacauuccaaaagauacaaguugacauuuaauggcauuucaaauuuacaaaagaugugaacuacuaaaaccaaaauaaaaauuacuucagaaaauuucaucauagcagauuaauccugaccuugauuugugcaugaacuaugcaguaugaauucuacauucuguaccugucucuccuuccugacugcuuuuuccuuuuaggugaaagcaucuccaacauuucucaacugucuaguauuuuccaauauguaacccaccuguuaaaaaaauaaauuccaucuggugcauacuuauuuaugagcgugucuguuucgauuucacagguuggugaauuccuuugccuagguaaaaugcugaugauacuacgguuguagaugugaacucuuaauaggguacuuuguuuuuaucugauauagaaguuuaaauacacuuuuguaaacaaaugacauuauuauaaggaaggaaaggaguauagauaaaacauauuaugguuauuguaaaaauaauucaaaaguaaaugccucaguuaaaucuaaacagugagcuggucauauauuugggagagcauauuuauauuuuaguauucuugaauggauucaauuuaagaagugacucaauaagaaauauuuuaucaaauugcuaauggcuuaaauucuuaauagauuguuagggaaaaaagauuaagaacugaaagaucauauuguugcuuugcucuuauaaaaguaagugcuaguaacaggcugcaaaaauauggguggauuaccuuuuuuacacagugcuccagaauuagaaauuauagugcuuuaaggcacagcugcaucaaguauggcauucuuggcagaauugaauagcuuugagaaaaguagacuuuagagagcuaucuuccaaaaucuuaauaacuaucagcaggagcuaagaccuacgcauauuauuauuuuaaaaauguuacuguuaauugacaaauuguaauuguuuaugguguacaaaguaaugcuauauguauaugguuugaaugauuaaaucaagcuaauuaacauauucaucgccucaaauaccuaacaauuuuugugccaagaacguuugaaaaguacucuuagcaauuuugaaauguacaauagauuauuaucaauuauagucacuauggaauguaauagaucucaaaaaaugauuuccuccuguuuaucugacuguacccuuugaccaacaucucccuauuccccucacuucuuggccucuggaaaccuucauucuacucuguuucugaguuugauuguuuuagaugccccauauaagugagauggaucauguaguauuuguccuucguaccuuguuuauuucauguaacauaauguccuccagguucuuauacguuguuacaaaugacaggcuuuccuuauuuuuuuaaggcugaauacuauuccauuauguauacacagcauauuuucuuuaucuauuacucugcugauagacacuuaaguugaugcuaagcucuauauuagcaucaggacugggguuaaaccaaucaguacaagauaaauggagccaggguguuugucagagaaaaacaagaggcauuggaacaauucaagcugccucaccuuauaugaucagagcuacuuagaagauucauguguucuaauauacagugcuuauucuggaccagacacuauucuaaguacuuaacuaauuuuaaugaacuaaauccuccuaacaguccuacgagguggaacuauuauuugcuccaauucaggcauaauaaaaugaaaacucagagagguuuaaugacccauaacccagcuauaauagcaaaguggcagagucaggucuuaaauuugggcagucuggcucuggagucuguaaucuaaaccucuuuauuaugaugucuccuucuugcacuguugcaucuuuucacuccaccuccacucugaaguuaucaauuuaauagcguauguugaauuuuuaaaauuagcuauuugagguaauugacuaaauagagaaaaaacgcuuacagaggaaaauaaaaacuugaaagagccauugugaucauugaauucugcauacucaccgccacauuugucucuugcucaguuucuggcacguaaggguaaugguuauaaaacauaucauuucgcaccaucuuuuuccucauccugcagggcccuucugucaucuccagcauccacuugucgaggugggagccgaugggagggccccacagcccccgcucccucaacagcucgcacucgaucugacaccacucuucugucacguacuucagggcauucugcugacgcugacaggaaagaguccaggucgguuuucaagcaaaagcaggaguaacaguaacaagucuacaagucacugaaaaucaaguuauuauuuggaaacaaacacaauccacaccauuucaguuaacauuauaaaaguaaaauuacauuuguuuaugguuaaaguaagagguuuuguuguagaagguggacuucuuaaagcaucaaguaaaugacagacauggauaggguagagugugcaauauagugaaacagagaguugaaagaaguuuguuucucuggcacaggaaagaugguaauauuacuaugaauuauauugaaaugguuagcccuaugugcguuaauaaauauauaugguaauuuaaggauacaccaaacuguaaaauagcuaccacaacauguacgggggauauucuaggaagucagaugaagaaaaagugccaacaggcuugauuacuggugaacuagguaaacauuuccaaagauuuuagaugaagaauauaaacaugcagcacuaagaggaaacuugauguucauacaaaaaucaaagagaaaccauuuucuucuggccacugggauagauccaaaccauuuuuuaaauggaaauuaugacacaguacaaguucuuaucuaucaaaugacaaauauauaacauuucaacaguagacagugacaaauaacuugcccaaugauucauggaauauaaguauauacaauuuaaaucuaaaaauaaagauuucuaaaauauaacugacaguaaagauuacugagugaacaauuaaaaaauuaucuaucacaguaguacugauauguucuuugguuggggaaacuaaggaucuaguguuauauccguaaaauauuagcaguuaaccauucagaaaccuuuaauagauccaaaauagcuaaucugagaauaaaauauuuaagauaagcuuuugaguaauuaugaauuuaccaagagaauuucaauaaauuuauuuuucacugacauaaucaccaagcacuuguaguauaguaaaaaauaauuucauucaaucuuguaauuuuuuacaauuuuaagagacuucucagagacuuggaugcguauuuucacaaucuccuuguuaaaagccugaaaaagaaggcucauucuuacauuuuuauuuuuauuaggaacaaagacauguaacauaucaguagugaaugucaacagaauucagcugggcucauuuucaguuaguugcuuuuugaaaugcaguuuguugacagaagauuaaaauuuuccauccuaaaaucaguagccaaaguagcugauggcaggaauaauuaaaaccaucaucugaugacgaaugcaguccagcaaguaccuuaaaaugggcagaaagauaccaggacaaacagagaccuuucacauacaaaaaauguaaaacaaaccauuaugaugauuauaaguccuuaccuccugauauucuuuauauuguguaucuacuaagucacgaacaacagcaaugugaguaaacauccacugcgaaaucuccuaacaauggauggaaaaagagucuuaauauuucauggauuucuggaaaaaaauaguuaauuacccuugaaauuaaugcuaaauaauugguuaaaauucugccaaaagcaccaaaacagaaaacuaaaacaaaaaauucagaaugaauuauaugcuugugugauggacacagaucugcaugcucucccacccccaaagccccuucaaggaagggcuugcugcccacgugucugggcugcucucaacacccucagggauggccuuagcugcagagggccgacggggugccccacauccaacgaucuagggguaagaagacucacacauuucagcuuaauggaggucaauuauaagaggguauucuguccucaaagcuccacuuagcuuggcugaggcugucacuagaccagcacugcagccugacuuuucccuauguccaauccugcuuucuucucccuuccacagguauugaucccaagggcacccccuaauauacauuaugcacacuaaacuccaucucagaguuugcuuccuagaaaaccuaaccugaugcaugagauggcugacacauacuauuucucucagauccuuuucauagcugccacuuagauucugggauggugaaggaaguaggaugaggaagaaguuaaugcuggaggcagaugagcuuuuaaaaaaccauagguauacacaacaagauuguaaaaauuaaaaaaggcuuguuuggcuauugccuuaaaauuuauauaauuauuaguaauaacauuauugaaagcugggaaaauugagagaaaauuaucuauagucugaucauacauuaaucucuaaaucucaucuuauauccaguuauaaaauggguauaaguaaauagcacucauauauaguuuuaucauaagaaaaugagagaaauucccauagucuggauuacuucuaucucuauucuaaagcaaaaauacagaaaaguuucauuuccaaucaauugcuuguacauguuaaguauauuauacaaaauacuacaacuaauaucagcaaugaaacuaaaaaaguaccuggguggaaagacuguguuuauuaagaccacuuucuuuucgauuccuucuugauccuguuaacuuggaaagaccaaagccacugcugacacgggauaauuuggacuguguggugggcgcuaaagcuucuccucgacuuaugcauuucuuuucaugggcuauuaaaaaaucaaauuagauuauuuuauaauuucuccauguauuuaugagucuuacuuuaaaaacuuaucugguuauaaacuacaacccuguaguuaacaaaaguagcacauauuacagaugcagauauuacauucagauaucacaaauuuauuuauugguaaucuuaaggaugacugcucgcaaauuguauuagcugaacugauaguugguugaaaguucacagcucuguaauaacaugcaaauuuaacuauaacgaguuucuauauuaauaauucauaaucaccuaauuaaaaccuuugguguuggguauacuucgcaacuuagaaacuauuuggauuuuuaaaaggcuauacagcuuauacacuagauuauauaaugccaccagagaaucuaugguaauaagcuauaauuuaauacgucaauauuacugcaacaaaauguaugaauauucccauaccaaguaggacaaagaaagauaaauuagguucuguuauaaagucaguuuuggcaccaaauuaaugaaaaaacagagcuuuuugaauuucaaaauuauaguuaagggauuguggaccuguagccaagacagugacaauacuagagcuguuagcaaugcauuacauucugaaugcauaaacgccugauguauaacauaccucagaugcuaaaaaaaaaaaaaaaaaaaucaaagagaacuaagaucucaguauaaucauucuagaaugguuguuauauugauuuuaaggaugacuuuauagaauccuuuugugaaugcuguagucacauauuuaaaguauacccauauaugauagccacauguaaaucuccuggugguaugaucucuguaggccuuacccaaaugauucugccagcacuucagggcagcuucuucaaugaguggccuugcuguagcuauguccacguggccccuuucauucacagguagaguuacuuugaaaaguuccucuaagacuuguuucuuacuauguaucaguucaguccaaacucuguugacagcuuuuaugagaagcugacgcccuaguaaacaaacaaacaaacaaacaaaaaaguaagcaaaugaucaaaacacaguauaaaguuaguuuuuauuuuucuucauguuuacaugugggaauuucgacuacaguauuuaauguaaaaaaaacaaagcucauguuguaucuagcccagugaaaagguuauuuagacaacugaaacugugguugccuauuuagaaaacauuaaaaaaacuuuauauucauacaaaagaacauuuuuauuuauaaaauuggaaauuauauauauguaauuaacuaacuuuuucuagauuaaaaacuuaucccccauuuaaaaguaauuuuuaaaucugaauguuuaaggugaguucaaaacuaaguuaguauucuugaauauuuugcacaagaaaagaaauauuuugaaaagacuuuuacuaugaaauucauucuugcuuuggauuccuuguuuguaugccugacuccuccuccagaccagucggcccucagcaaucaccugagggccugugauaacaagcugcuagucccucaccucaggguuucugauucaguaggucagaguagggcaacagaaucugcuuuucuaccaaguucccaaaugauauugauguugcuauucugaggaccuugcuaugagaaccaacgccacuuccucagggggugaaaauaauaaccgcaucuuugguguuuaggguucaaaacauuuuggugaaagaacagagaauaaauucauguuuaaaugaaggaaugaaauuaaaaugagugcugggcuucucaacaaugaaaccauauguaaaacuaucgcacaguauuucuggggagacaaacaccaccagagugauuucucuuuaucacuaaacauguggaaauaagaaaucaauccauacaaagacuucaauaugcaauccuuacaggauuagugggaaaaccagauugaaaaaaaaaagagaggggcugggcaugguagcucacagcuguaaucccagcacuuugggaggccaaggccgguggaucacuucaggucaggagguugagaccagucuggccaacacggugaaauccugucucuacuaaaaauacaaaaaaaaauuaagccaggcguggugaugugcaccuguagucccagcuauuuaggaggcugagacaugagaaucacuugaacccgaaagguaaagguuguagugagcugaaauagugccacugcacuccacugugggcaacugagcaagauuuuguuuaaaaaaaaaaaaaaaaagagagagaguauaaagaagaauaaaaaauagcacuauugauaaccugucucaagcaauauuagccuacucuaaugugauaugccuggcauuaucauugggcaguucucuuuauaguuaauuccaagguaguauuuguacuucuacuuaagcaaauguaaauauuaauaccaccaccaaaucucacaguguuacuaagaaaugaugagcuuagcaauauuacugguuagugcuuuacuguuauuggcaugaggagacucuuuauguauagguugcccuacugggagaguugcuaucaaugcuggcaguuucugaagccaauuuguugguuaugucuuaaaaacuggagauaaaacaaccacaauuuaaaaacaucccaagucaaggcaauuaccuucacuaauaucuuggcuguaacuaccaucugguucaauguccgaggggaucauaaugugccauguggucaugcgggcuucugcuuccaguccaaauccauccacguugcugaaaaauuccagucaguuuaaacuuuaugaaggaaaugauuagcugaagacuacaguaacuaagaauuacucuauuuccauuaccagcagacacugaaugucuacucagcagaugcacagaacagaauucuaguuugccaggaagaugccauuuuuaagaggugaucaaauaaauccaccugacuaaauguaauuagacugaucuauagcaucaagauuauuaccuuaauauuuaacaugccuuuugauuauugugaacauuuuuaccuaauaauuacaaaauguucauucaacuaagaacauuuuucuaauaugccuguguccucucuccagucuuauaucucacuacucugcuccuguagugaaguaguugcaguuccccugaggugccacacuccuucuucccucugggcauucauacagacuguucuuuccuccaguagcaguugucuccauucucuuguccuccccaaccaggucucaagcugcagcucagcagguauuucuuucagguuaggggccccucuuaugugccuccaaagcacuggguuguuccuagcagaucacucaauacagcugacuggucuugcuuagcuguuuccccucaagaaggcugccacagggucuaucauacucacauuuugucccagccccuaauucaaugcuuggccccggcagacucuaaugaaauaucugucaaagcaaucaacugaaaaauacuaauuuuacucauuuaacauauaacacugcauugagcuucacuuuuuacuucucuuagauuucaaugguauauauuuuauuugcuuuaaaagcaaacuuccuuauauaagugacauauggugauaauggaaaauuuuaaagguguagaaaacuaaguuaaaggaaaaaaaaauacccauuauuucacugcaaaaauucaacacuugcccuuuaccuuuuuacauaaagguuuaaauaaaacagaguaaggguaaaagaaauguuacuaucaaaaaaaauaaagaauuuuguuggaauaacaucaaagccaaauuuaacauggcaaacugaaccuaaaggauuuaccuuccaacauguagauuuaucaagcagugggccagacagcuaaugaauucuuggucaugguucccaggucccaggaucaaguuucuguuuacagugaggacccugagugaaucaagcagagcuacuugcugaggaacgguuuugugugcccgugagaacugguacaagaugguccuauugaggcaaugauacacugcauccagugacaaucccugugaucuucucuuugacuaaagacaugaaagguauguuuuuaguauaauagacaaaaguaaaacaccuguuaaucauucauacaugaacuuuuauuaggucuauuauauaccagaugccaugcuaaguaugcaggugcuaaguuaaaagauacaaagcucuuacuauuauggauuucagaacccaugagacacaucaauaucaucuaaugaaugauaugagggcuacauaaaaaaaaagagcucccagggaggagagccacuaacgaugcuguggggcagagcagucucccugagaacacgaggaugugacagcuaggggagucuccucacaaauauauuuuguuaggauaaaugaucuauauucaaaaguacugaaaaaaauuaagauguuacuaaaaucauuuuuuuuugacauucuaauuucauccccucauuugagaauuuuucucuuuggcuuaaauacaaauauaucccuuugaaaagucuuaggugacaugacagagccuauguaucuguguagcauaugcuaacaaaacauguaacaauuauuucuuacuuucuacauuaaguauuaaauaagauuaaucaauugugccaaaccaggccaaacccuuaauuaaaaguacugugaacaugcacaaaaaauaacaacuucaagagaauauaaacuacaaggaacuuuguaaagauucaacugauaagagaauauucuuuuaauaucaacucuucaugcuguguaagccuuuacacauggauguaguauacaguacaaaccuaccaaacuguauuacuguauuaagguauuuaaaucuaucuggguagcaaagaauaauaccuaggcaacuuuacaaaggacacauuggcaccaggcaauugguaauaggggagggguucaaagucuguaucucuauucaguuuuuuuuuuuuuuuugagacggagucuugcucugucacccaggcuggagugcaguacugugaucuuggcucacugcaaccuccaccucccagguucaaaugauucuccugccuccaccucccaaguagcuggaauuacaggcgcgcaccaacaugccuggcuaauuuuuguauuuucagcagagacagggucucaccaugucggucaggcuggucuccaacuucugaccucaagugauccaccugccuuggccucccaaagugcugauacuacaggugugagucacugcgcccagccugucucuauucacuuuuaauaagcuuagcuuuuucuuaaauguuaacauucauuaucuuauuaguuauauuuaauuucaacaauuuugacaccauaggcaaaacaggaaaacauguacucuacaacugauagugacaauggauuaccugugcaauuaguugaauuauaaaaucuauaagaaguuuagauucuuuguugaacaugccuugccaaagcuuguccaccacacgcugugugaaauaaaacacauuguucaccaauaccugguagcuuccuccacugguaauaggcagagaugcaucuuccccuaaauuccaguaggaaaaaaagucuaagaaaauugauaucuaccaacacaggaccagauccucaaaaaaaaaaucaggcuaagguaaaauaaguguaucuacaacagguagcaauaugacuacuagcuuuuaugcacuacuugaagaaaaugacauucaauggccagaaaucaggauaaauaauuucagcaggauaaagcguuauggauugaaacuaccuguggagucuccuauugccuaaagagagucugugauaaacaagcaguuccucaacauaaacugucagucacagcuguucuccauuugagagaaaacgggccaguuuauuagcucuuaauugauuuuguguauguaauaaaggguaaaacugugaaacaaaacucuguuuuaguguauagcucuaauagcagugaaguaacacagacagaagagagcuucaagaaaacugugaaaaauaaaguauaaucauuguugagggguguguuuagccccuccaucauuaccaucagcucucucucuuucuaaagcuauccgaguguuuucaguguguuugccauauacauauugcuuucagacuaauccuccuagcuccuccuccuaaccagaaugcuuccucuaagccagggguccccaacucccaggccauggaacggaccacacagcaagaggugugaggugggugugcaagcauuaccaccugagcuccuucugucauaucagcagcggcauuagauucucauuggagugcaagcccuauuaugaaccgugcaugcaagggauccaggguugcacaguccuuccgagaaucaaaugauaaauguaaugcuugcaucaucgcaaaaccguaauccccccuuagucuguggaaaaacuguccuccaugaaacugguccccagugccaaaaagguuggggaccacugcuuuaagcccuuccuccacagaaauucuggaggugccacagaauuugauuuuuauuauucucaccuaaugcuaaauugccccauuaagcaaaauuauuuguguugugucuuuguguaguaugacugcucuaaacugguaagaauaaguacaaaagugugaauugacuugagagugcacaguugcauguugagacaauacuaaagauuuccuggcaaauuuacuucgggaaaaaaauuguaauuuaauagcacagagguuauaugauuagcacuauugcuaggaacucaaaaguagcacauauaguauacuaacccauuauguuuccuucuuuuauaauucuacuuuguuuuauacacaaauguuggcuucacuguaaauguauuaaguuuuauauuuguauuguaauuagauacagacauacagaaaaaacacauuucaauguguuuugacucuauguccuggaagccauacuaaaaagauaacauacauauaccuaugaccuaacaauuccacucauagguauauacucaacagauuauguguaaguauuguacaccuaugugguccauaugaacaagaauguucauagcagcuguuaaaauaauuaucucaagcugaaaacuuucauauaucugucaagaguaaaaugacaaauucauauauucacaugaugaaauacuauaauguacuccugcuacaugcaacaagauagacaaaucucacaaauauaauguugaguaugagaagcuagacaaaaaaggaaagaaaaaagcugauguuaaaaaguaguuuuacuuggggcuuagagaggaaagugauuauagguauuucuauaaaauaaaaacacagaauuaccuaauaacacaucagcugcaagcaaaugguccaucacgcuauccaaaauguaaguuugaaauucuuuuugcugaguucuuguagaccuuucaggggaagccuaaucaagaaaauuuagaauuagaaacagaaccaacuaaaacaaaaauaugagcucaaccacauuuacauuaccuaauauauuaaaaagauuaaaaaauucuacuaauaaauuuguuuuaaaugccaugagagaugguauacaugcuaugcuuauggucuuucacguauuuucugacuacagaauuaaaaaaaauuuaaagcaaaggugaaacaucaucuucuuuugaauccauuauuuaaaacauaguauucuaaacauuauauuuauuauauuguuauaguuuauauuauauaauauauaguauauauaauauauaaaacuauauauaauauuguuauauaaaaacuguuauaacaguuuauaacaauauaaacuacaauaauauaauaaauacuugacuauuaucacaccucacuuccaaaagagauauggugguuuacaaugaaauacagguaaaauaaauaacaaaugaauuauaaagccauuaaaacuaauacaaaaacccaagaaucuaguaaucaagagggcaugucaauagggaggggaaauacauuuguaacaaaaaacuaagcacacaauuuagcucugagcuucauagaugucaagaaaaaaaugguuuacaaagcuuuuuauugucuauaaaaagaaacacauagcgucaagugccuacagucccagccacuagggaggcuggggugggaggaucacaugauuuugagucaagccugugcaauacagcaagaaccuuuuauuaaaaaaaguaagaaggggccgggcgcgguggcucacgccuguaaucccagcacuuugggaggccgaggcgggcggaucacgaggucaggagaucgaggccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaguaagaaggaaagaaaaacacaauagauugucagcaaagacauauguuuuccuaaaauuguucugacaggaauguucucuguggguuuuuguaaggaggacggugaacaacccuauauaggugguaucuuuguuaaguuuuacaauguacaaagaugauuuugaaaauuaucuuauguuaaaguguagagcacaaaguuaaacuguagucuacugacaacaauucuacuuguaauuaggguaugaaaauccaggugcauaacuuuccaguaucugauccagugaguagcaaggaacugggaacagagggaugagauguaggaaagagccuuuugucauccucaaaugccaguaguuucagccagguuuuugauaggaguuggauauuaaacaauucaauaaaugucauaacuuccuuucuuaaaaagagaucuguauguuuuagauucaggcacaguauugagguuuugcaagugaaauggaagaaccuacuuauucuugaauagagagauccaggacuguauuuaugacccuguuacaaagaugggcuuuuggaaugcuguucuauuuucccuucuauucugauuuucaaggugguccuauuaaauguuuuaagaaaguagcuagaauaaaaguucuacauugagaacaagaauacuagcuuaaguucucaaaagccaacagcuaaaccaaaauuguaaggaaaauugcucuuucuucugcaugagacuauucauuuuguuuuaaaaugacaaaauaugggucuaguaagaauuaaaagaauaccagugcuuaggaguuugguuugucauuaaacuaauuugggaaaaagugaagaacaucucauguuuuuaucuuuauaaauuuuccuguguauuugaacagauuaauacaauagcgagcaggagacuugugaccaaggccugucuaguccuuucaagccgauacuacauugggagucuuaucccuauaaacugaagaggaugugaggacuuuuaagugauuaacagcagacugauaguuccaggaggcuuuccuuauaucagagaccauuuuuuccaauagcuugagucaucauaauuugcuaaggaauaaagcuguccagucacagaaggacauaaacauuuugaaaaaaaugguacuccugguugggcacgguggcucaugccuauaaucccaguauuuugggaggcuaaggcagguggauuacuugaacgcaggaguucaagaccagccuggggaacauggcaaaacccugucucuaccaaaaaaaaaaaaaaaaaaaaaaaaucucuggcaugguggugugugccgguagucauagcuacuugggaggcugaguugggaggauugauugaccucagcaggucaaggaugcaaugagccaugacugugccacugcauuccagacuaugcaacagaccaagauccugucuuaaaaaaagaaagcuacucuuucagguucauaaucaacucaaggugguuaaugagauuaguaaugaguagggcuuaucaaaucuuaacuagaaaaaguuuugaagucuguaaaacaaagggacuauuaaacguacagaaaugcuuggugaauaacauuuauuuuuauuaaaauaauauucuuucuuauuccagaaggauuuaacacuggcucagucaucaacaggcauuuaaucuucugauucaucucaauaaaacuguuacacgaaugaugaggacccagaauuuacacuuguuacugguccuaguggccuaguuugauguucuuacugagauguauagcagucuaacuuuucaaggacuuaacauuuuaugaaagcaugcauuauugucucggagguguucuuuuucuuuuuaaacaauucacuggacuacuguuuugugccagacacagggcuuauauauauacauuaucucauauagucaggaaaauacccuugaaauagauacuaacauccccauuuuagaaauaauugaggcuuagagagaguaagucacuuggucaagucacaacuaggauucaaaucucaguuucugugaagccaaagcccauggcuucaccaguuaugucauacucuccccacucuacuaaaaucuccuuaugaaaguuaaaagcacaagagcaaaucugcaaagugugggcuacaaucucuucaucacucuuuuagauaagacugguuggcccaccagacaaccagaaugaaggcaggacaggcacggugaucugcucuggacucugguggucagaucuguuuuccuggugaaaacagcaaagccagucaacauauccaucagucuccuuuuuaaggucuuggggacacuacccaggaucuuugugucccacacacaggccagacagcccuuacgcaucugcugcccauggguagacagcacaguggcuauggaaggaaggccuuuggaauucuguccuguuucuguaaugggcuggaagccuuuaaagauaggauuuugagacuccugauucugacuguagucugccuguugacugauuuuuccucucugaguuacuuuguggugcucucuuugcccaauuugccauuguuuuuugcuuguuucccuguaguuccucaggguggguuucacucugauguaugacaauggggagcucuuguagaagaugguuggcauagaguccagugaacuccucagaccauagcaaugugcuuauguuggcuguauccccuaccaaaucucaucuugaauuguagcucccauaauccccacaagucaugagagggacacaguggaagguaauuaaaucaugggggugguuacucucaugcuguucuugugauagugagugaguucucaugagaucugaugguuuuauaaggggguuuuccccuacuucauucugcacuuguccuugcugccaccaugugaagauggauguguuugcuuccccuucugccaugacuguaaguuuccugaggcauccccagccaugcugaauuaugagucaauuaaaccucuuuccuuuauaaauuuuuauuuuuauaaauuuauaaaauuuauauaaaggaaaauuuuuauaaauuuuccuuuaugaagacauacccagucucggguaugucuuuauuaguagugugagcuuggacuaacacgcacuccaagucagcacccucucaguuucauuaucuuuaccuccagguauacacaaaucuguuugagcuguucucaugcacuuucuucccauugccacgguauuuauuugcagcaaauucauuuggcucuucaugagaagucugguggugacagcacagggcacugauaaacaggagcuaggagaagagucuccaggcacccuuguagaagccaacacaggccacguagucaauuuuuugaguauguuuaaguguugggcacuguguuaugaauauuaaaucuuauuuaguuuucacaauaauucucagagagagguucacuuuuauaucauuuuacagauguguaaauuguauagaugugaagagaauugaacuuggucaaggccacacagcuauauccagcacacauguaauuccucagaauacuuuuuguugggugauguacauauauuuaauccucacaauaaucuuguaagagagaugguaaauaauaucauucucuagagaaugaauuuagcuugggaagaugaaaaugcuuauauaauaaacaacagggccagaauuuaaacccaggcacuucuuacucucaaacccaugcucuagcuuucugccacaccacacuacuucccuuguauuuggccucagucacacuaaagccagucuauaugaaugggaaucuccuacuuuuaugcuaaugaauuuuacugcuaaugaagauaauuuuacauguucuuuuguagguauaaucaaguaaguagauacuuuuaugaugaaauucuaacacucauaggacugaagaugcucugguucacauuuacuggacucagauguucaagccccuuccuucacaaagguaaaugguaaauauguaagauaauucucucucucuuuuuuuuuuuuugagacagggucucacucugacacccaggcuggaaugcauuggaaugcagugguguaauuacggcucacugcaacuuugaacaccugggcucaagcgauccuuccaccuuagccuccaguagguaggauacaggcacgcaccacaacacuggcuauggcuaauuuuuuuguaaagaugggauuucaccuguugcccggguuggucuugaacuccuaacuuuaagcaauccuucugccuugaccucccaaagaaaguguugggauuacaggcaugagccaccaugcucaaccuaauuuucuucuugaaucucuucauggauaaagacuucauaaucauaauuuucaaaaucauauguuuauaauuuauucuguuacaccauuggaagacauagaauguuaauauuucauuaauauaauuuuuuuuguauauguauucugcauauguauauuaaagauacucaaaauauuuaaaaguaaauuucuauguucuuuauuagauaguauccuaucuuccuguuugggaauuuccagggaugaaguuaauaguuaaaugauucaaaaauacacuaagccuuacuuaaugucauugacaggcuccuggcaacugcaacuuuaagugaaacaauguacagcagguccucaaauaacaucauuuccuucaaccuaguuuuauuauaagguugacgaggaaaaaaauuuaguuuuguuacacaucauuuugcuuaaaguugcagcuaccaagaacuuaucaaugacguuaagugaggacuuacuguacugacagaauacaccaaggcacugugcuaaaaguugugagagaugaaggaacacaugaaaguuguucucuaagcaguuuauaaucuaucuggaagcuucaauccugacacccccugcuuuucccugaacuguacuccuacucgcuaguauauugaagcacuauucuaccguagggcaaauucaugcccacaacaaagagaaccuuacuucaagguuaauacauguuauuauauaucaaauucuuccuacuaaaaaauauagaaaacaaaaauaaagggcaauuauacaauuuaaauauggguaauuaauuagcuauucagguaccagaagcuugaaaaugcuaucacuguauguuuccagucauuccauaucuuucauguauguauuuuccuuuuuugaucaguuaugcuuucuugcacacaucucuucuggacuuuauccuauuauuuuccaauaaacuauuucacuuuuucauaaaaugcuucaaauuuuuacccuauacaguaagauacuggucaucucucuuagagcuuuuuaaaguuuccaaaggggagacguuccauugggccugcuuuuuaauucuaccacaugcauuagugaggaaaccaauuauucuccugccauuauuaaacacugucauccugguuaaaugcuuagcauaacugguacccuaauuacauuagugauuuuaaaaaaaauugaccaaauugagauacuuucgcaugaauaagauaaacaugugguuuucagguuucuauuuauaaguuaacuguacuagccacuagagggagcacaaaaaaaaaaaaucucagguucagcugucaaacugcugagagacagugcaguuccucagggagaaaagcagucuucuccacagauuuacucuuucauaaaacauguuauuuucagagccccuggcauggacuguuugaccuuauuuauaugaauuggucaaaagaacauuaauguauaugcaacuaauuacauuguauuaaauuuucucucugugauaucuucagacuuuucuagguaaacauuuuuuaaugcuuuucugggauagcuaauuucuagaggcagcaaugaggucacuuaaaggcuuagagccacucucauuuucugaugcaucaguugauucauaucaauugucaggagaaugggcaggcagccaaccuagaaguuugcugccuuggggaauuuaacaaguacauccugggcaccuguucuguacaaugcaccaugucuuaaguugcacaggacacugacaacaguaauaccuggcaaugacagguaagagaaauugauguaggaaauuauaagguaagaagacaaugccacuaggcacuguuaauguccagggaagggguuggcacacuauggccugugggccaaauccagccugugcuguuucuguagauaaaguuuuaucagaacacugccaugcucauucucuuacguauuguccauggcugcuuucuagcuacaacauacuugaacagaugugacagagaccguauggcccacaagcuuaaaauauuuacuauuuggcuuuuuacagaagaaguucgccagcucuuagagaaaggaugauaaaggacugaauuagagacauccuugagggaaggaaaagaacaaacugauaggguuuaaagcacaugugggauuaagaacuuuccacagccuauaacauguucugccuacacauaaacaagaggaauuagaaauccuuguuauagaacuuguuugguuacuaauguucuaauuuaaaaaguaaugcaaaagagauguaaaugcguuucuuuuucuuuaccuccaacaaaagaucaauuaguggaguuugcuugcuggcaggagugagacagagguugucuaugauuaagacccgcaugaagucaaaaacgaacuuuuuagccgggugauuggucagauaugucuuggugcccacauugcaguacucugauuggcuccuguucaucccugugucugcugcaaacgcuuuaaacucuucugcuggagauccaacuucaucaucaaggucagucaccuaguaaaaucaaguggaaagauacgguaaucacauuagacucugacauuuuuacuucuguguuuccuaaaaauaaaacuggagcagcagcauuuuccaccuauuaagcuauucagcacauuauuucacucugcuuuacucgacccuuccuuucaagguaguaaucuggcaccauaugucaugguuacgcaacauaugguguuucugacugaccacuaacaauacgucaccuuuaaguugaauuguaugucuauuguggcuaacugcacuuaaaauauauggaauaauaaaauuagaauaaauauguuuccauauuugaacucuaccccuacugugaagucaaaugucacagaauuucacauaaaaaucuggcauaaugguagcauguaaggggugauccauuuauuauagguuaaaaaaaccccaaauaaauuuaaaaaaaaaacaacaauauuggugccaauuuugaaccaagugacagagcgagacuagcaaacaaauuauaagaugcugauggccaggcacaguggcucacgccuguaaucccagcacuuugggaggccgacauaggcagaucaccugagaucaggaguucgagacuagccuggccaacauggcgaaaccccaucucuauuaaaaauacaaaaaaauuggccaggcguagugguccaugccuguaaucucagcuacucaggagggugaggcaguagaaucacaggagaaucgcuugaacuugggacguggagguugcagugagccgagaucgugccaccauugcacuccagccgggaugacaagagcgaaaccccgucucaaaaaaaaaaaaaaagaugcugacaaggaaaagauauugauauauuauugaaggucuuuuuuuuuuaaaccaaaaauaaggauucuaaaauuauaaacaagccaagguauuaaggucaugugucacauuugccuuucuccuaaaaauccccaccauuuuagaauaaguauuguaccuuuauacauggagaaaaauuaguauaaagaaggucauuuaucccagguccuagaguauaugguggaaauaugaagaaacaucaugaaauuuugaaguacuauggaggaauaacuaucuuuuggguguguuuuaucuauuuauuuuuaaaccuguuuuauguuuacaguuuauuagcuaaucaacaucaacgugcaaaaguaagugauaagccccugcuauaugguuuuguguaaacuacaguaguucauucguuuugaaaagucaccaauauuuaugucaacugaacuauuaguuacuguaaugaauaguauuuagacucuaaaguuaugaaacuauccugcaagcccucugcaaaaaugugcuucagugaauuuccacgugaauacauuuucaaagcaggaaaccaggcagcauuuuugggcuuauuuuaaagaacaaaagaguaucuauacuauaugugauuauaaucuaauaguuuuuaaguuaguacaaaauaagcaaaauaaaacuuuaaugaaaaaagaaaagucaggcggaagaaaggaccaacauuugcuuucaacccuauaauuuauuggcaaaaguuaaauccagcaaauaccuacuuccuaaaauaaaaaauaaauaaauuuggucagacuagaguuaucuuaauggaaaagaacauuuuacaacuacacagcuggcaucgcguaaaauaaaugaaucaacuacuugaaaagggaaauuacuaacaagggacuuacaagaauauggugaaugagaaaaggaaguagaguucacugugauuuuaggagaaagcagaaggaaacuguggggagcuggggacaccggacaauaaugcaagaggugauguauaaaguuaugaaacuguaacuuggucagaaacuuaaaagacugucaaaaaaaaucugcuaaccauugaaacagacuaauuccaguucugacauucuaauuccaguucugacauuuuccucccccuuuccuaccaucucugaguaagggcgaauauugaaggggaagacgguggcugcuaaugcacacaggaagucagggcucauccacauggaggcaaggucuggcacguugugauacaaauaucugaagaacugcaucagggucacaggauauucucggagccaagaucccucuucuucugauugccaaggcuguuauggggacaugagaggaaacacuauguuacaguuauugacacugcuauaaauuauuuuaaaaauccauuacucaguauucuuaugaaacuggauauauugaugguccagaacucuguaaaccacacauaugagcaaacacacauguauacacacaugcaaagaaauuuagaaacuagcuaaaacaaaaaauccccuuagaaacugauaggaucauugucuaaucauuagauuaaucgcaggucugcuaacuagaaucagugguuuugauuauucauuauuauuaccaugaguguuggugguaccaaaguggcuguauuaccauuaauguugccccaucgugcaucaugcuaaguuaggaguaagauaaaagguagggaaguuacuucaccuuucugagccucacucuuaagcauuauguaauacaacaaugaugaugauaaaaaaaugaauacuguauauuugaacaauguauaucuucugauaccugcccagagaguaucuuuuaaaaaacuuuucuuaugucuuuauaguuguuuaugaauaggcaccaaaacgagacuccuaaaacauucuaaauuaauacauuuaaugguaauguucuguucuuagaugauacaacaauaguuuugacugaaauuagauuugucagguacauguaauucaaggagucaaguuaauauuuccuguuacaacacaauccuaaauuguauaaacaaaucuggucauuauucacaguauuccugucagaucaacaggaacaucaguucugucuuuuacucuuucaauucuucaucucuaaguuagacauaauuagagcagaacaaaagcaaaaacaaaaucaaaugaaacuuguauuguuaacauuucugaccucuaaaugaaagugacuuuaaaaguugaaauaacauauuauuguaauaacauauacuacaaauauguacucauuauauauguacucauuauuauauauuuuauuacauuaauaaguuaauacuuacgaagcacuuauuauguaucagccauguuuauaagugcuuuauguguauacacuaucuuauuaauuccucacaaauacccuaagagaugcaugcuauuauugucggcauuuuaaacaccaggaaacugaggcacauaacugaggauaauagauuggaaguaccagaggugagauuuuaacccagguagggcuccagagugcacggucuuaacaacuacacagucuguucuuacguuagauauaauuuugucuaacauaagagucugaaguuccagagaucaugcaguaaauaaaguaguuauguuaccaaaaaauuccucuauuuacaaaaaaguauccuaggcaggaggaauucucaauaggccugggcauuugagugaacuuacugaagucagcaugcugcggagcauucccaauaauaaaaaaacagcuucugugcauacguuauggauagaagagaccacaguuccgcuggaggcaggaacuccaaagaugaauguccaaauggaauccaaaucaaacugcagaggugaaagggagcaaauauuagccaccacuaauuuuucaguagagacccucauaaguucuaauaggcuaaaauuucuuugaaacuaguuuuuuguuguuuuuaaaaguaaccaaugauauagacauaaagaacuaguacccuuccauccuacauuuuaaaacucauuuuuauagauauaaaaaauugaauacuguguaucauucugcauucugccuuagguaccuauguuaaaaacauugcuuucuaccuuuuuccuaaagaauauaaaaauaaaauacauguuaauuagccaagagauaaaauuauagaacaaauaaauuuaagcaagaucuuuuaaacaaagcacauuaagcucacuucuuucccauucucagcaguauuuuaauuuuagauuacuuacagauaaaucugauaaaauaaaauuaauuuaagacuuauuaauagcaguuuuauauauaaacuuuaugacuauggcaccauggauauugaaaaauugcauaaccaauacaacugugcuaggcaugaaucuguaucuuaauuuaaucuaagggcacagacucaaguguuuacacuuaaaagauuuugucaacuacuagaauugauuugaauagcauuuggcauuaggauggaaguguaguugagucuaaaagcuaaauuccuacagugccacaaacauaagcuauauacagacaucuuuaacagucuucaauuagaagucaaguaaagucuuacuauuuucccaauguggaugcuaucuaucauuaaguaauuuuuuuuuccuaauccgaauuugcacugagaauccugucauacccacucgaggagugauauuuaauuuaugguauauaagccacuccuuucauuuuuaauucugcagaaaucaaucacaugacaggcuggacacaguggcucgcgccuguaaucccagcacuuugggaggcugaggcagguggaucaccugaggucaggaguucaagaccagcuaggccaacauggugagacccugucucuacuaaaaauacaaaaauuagcccagcgggguagcgccugacuguaguuucagcuacucaggagacugaggugggagaaucgcuugaacccgggagguggaauuuucaaucagcugagaucaugccacugcacucuagccugggugacagaguaagacucugucucacaaauaaaauaaaauaaaauaaaauaaaauaaaauaaaauaaaauaaaauaaaauaaaucauauaacaaaagaguucuuuagaucaccauuaaauaucauccagagucuuuaugcaucuauaauauacagaguuaucauauaggaaaaaauuguaaauagggacaaaggacuuuuugggaaaauuuucugugguauuuucagauuuuucugucccaaaucaaaccuuaaauguggggaaagugauggaauugacaguugguuuuacagugauuauccauuauccuacggugauucuuuggaauacguaauuucacgcaccccuugcuagauaauuccuaccuggcaacccugcuuacuccggcagcugaugacaggcacacugaccugcagguucucaggcagcucacuaacuggcugcugcagaaacaaggccaugaggagaaaauagagggcagggacauuaguguguuuaggaaggaaugacugaaggacuggaaaaccaggaaaaugacaagcaucucgguuaaucucccugaccgucgaucucccaccagcacuucugcccacguugaauccuaagagaagaggaauauaacaguaagugcaaaaucagcaacugauaaacaugcugcauuaacaaagaaggaaguaauucaguauguguuaacauuucuauccagaacauucauacuacuauaggcaauuaaguauucaacuguugaauuaaucuucaguuaaaaguuuuacuuuacaauuuguuugacuuuagcaaaccugucuauuaggauauagguuuugaaacacaguugagacaauaagauacaagggaguuugaaaauccuucuuaaggugcuguaaguucuacuuauuaaaugaaagaccucagaagagcucuaguguucuuguaguucccuaagaaaaaagugaaauccaaaauacagccaaaauuuagaaugcuacaaaaacauaacuuaaaaauauccuuguuaugauauauuuuuauuuuuuugagacacaguuuugcuuuguugcccaggcuggagugcagugccaugauauuggcucacugcaaucuccaccuccuagggucaaagcaguccucccaccucagccuccugaguagcugggacuacagacaugagcuaccacccccagcuaauuuuuguaacuugcuauaauguaguuaauauauuucauuguccugaaaaucaugaaaaacuaguuaaccuuaaauuaccuaugaauuuagagacaagacuaaaugaguaaguaaaacaaucuuuacucacaacaugaucuguaaucuguuggaaagcugcugggcagugggaugguaaauccaagcccguuguggcugcagcuauccacuggcugaacuuaacauccagaauucccucuagaaacccagcuuuuuaaggagauaaucaguucuuacuaauguagcuuauggcaucaguguuuccaucaaucuuguuuccucuguuuuauaaugaaacucaggauacacccuaagcaugugguucaccucauaccuagggaaguacucaguacacagugaauguuugucaaauuuucaauggaaacuuuugugaauagcaacuaauagaugaggaacugauuucggucugaagcaauuuguauuucaaauagauauuugcauuuauuauuuauucuuuaagaucugaggguucacucuguugcccaggcuggaguacaguggcaugaucguagcucacuuaaccucaaacuccuggacucaaaggauccucccgccucagcuuccccaguagcuagcacuacaggcacaugcaaccaugccuggcuaauuaaaaaaauuuuuugguagagacaaggucuugcuauguugcucaggcuggucucaaacuccuagugucaaaugaugcucccgucuuagccucccaaagcacuaagauuacaggcaugagagacugcacucagcaaagauauccauauuuuuuucaacuucuuuuuuucuggagugcagcaaaguacauauuacaacugcuauuuuauauaauaaaggaaaaauuuaugucuagguugcuuucaaaauauuuuauccuaaccaauuccucagugugacgugauuaacuccaaaguaugcucuucuaauuaauaaaaaaauuauauagcaauuuaaaaaacucuuucccauaucauuccuuaaucacaaugaacaugugaggcagaaauuacuauuaucauuuuuacaacauagaaaacaugauuuguucaaagucacaauguguuuuagacaugaaguccuugcccgugccuauguccugaaugguaaugccuagguuuucuccuaggguuuuuaugguuuuaggucuaacguuuaagucuuuaauccaucuugaauugauuuuuguauaagguguaagcaagggauccaguuucagcuuucuacauauggcuaggcaguuuucccagcaccauuuauugaacagggaauccuuuccccauugcuuguuuuucucagguuugucaaagaucagauaguuguagauaugcggcguuauuucugagggcuguguucuguuccauugaucuauaucucuguuuuggcaccaguaccuugcuguuuugguuacuguagccuugcaguagaguuugaaaucagguagggugaugccuccagcuuuguucuuuuggcuuaggauugacuuggggaugcgggcucuuuuuugguuccauaugaauuuuaaaguaguuuuuuccaauucugugaagaaagccauugguagcuugauggggauggcauugaaucgauaaauuaccuugggcaguaugaccauuuucaugauauugauucuuccuacccaugagcauggaauguucuuccauuuguuuguauccucuuuuauuuccuugagcagugguuuguaguucuccuugaagagguccuucacaucccuuguaagguggauuccuagguauuuuauucucuuugaagcaauugugaaugggaguucacucaugauuuggcucucuguuugucuguuauugguguauaagaaugcuugugauuuuuguacauugauuuuguauccugagacuuugcugaaguugcuuaucagcuuaaggagauuuugggcugagacaaugggguuuucuagauauacaaucaugucgucugcaaacagggacaauuugacuuccucuuuuccuaauugaauaccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauacgucccaucaacaccuaauuuauugagaguuuuuagccugaaggguuguugaauuuugucaaaggcuuuuucugcaucuauugagauaaucaugugguuuuugucuuugguucuguuuauaugcuggaugacauuuauugauuugcauauauugaaccagccuugcaucccagggaugaagcccaccugaucaugguggauaagcuuuuugaugugcugcuggauucgguuugccaguauuuuauugaggauuuuugcaucaauguucaucaaggauauuggucuaaaguucucuuuuuugguugugucucugcccggcuuugguaucaggaugaugcuggccucauaaaaugaguuagggaggauucccucuuuuucuauugauuggaauaguuucagaaggaaugguaccagcuccuccuuguaccucugguagaauucagcugugaauccaucugguccuggacucuuuuugguugguaagcuauugauuauugccacaauuucagauccuguuauuggucuauucagagauucaacuuuuuccugguuuagucuugggagaguguaugugucaaggaauuuauccauuucuucuagauuuucuaguuuauuuguguagagguuguuuguaguauucucugaugguagcuuguauuucugugggauugguggugauauccccuuuaucauuuuuuauugcaucuauuugauucuucucucuuuuuuucuuuauuagucuugcuagcggucuaucaauuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugugucccagagauucugguauguugugucuuuguucucguugguuucaaagaacauguuuauuucugccuucauuucguuauguacacaguagucauucaggagcagguuguucaguuuccauguaguugagcgguuuugagugaguuucuuaauccugaguucuaguuugauugcacuguggucugagagauaguuuguuauaauuucuguucuuuuacauuugcugaggacagcuuuacuuccaacuauguggucaauuuuggaauaggugugguguguugcugaaaaaaauguauauucuguugauuugggguggagaguucuguagaugucuauuaggucugcuuggugcagagcugaguucaauuccuggguauccuuguugacuuccugucuccuugaucugucuaauguugacagugggguguuaaagucucccauuauaaaugugugggagucuaagucucuuuguaggucacucaggacuugcuuuaugaaucugggugcuccuguauugggugcauauauauuuaggauaguuagcucuucuuguugaauugaucccuuuaccauuaugacuucaugucuaaaacaccaaaagcaauggcaacaaaagccaaaauugacaaaugggaucuaauuaaacuaaagagcuucugcacagcaaaggaaacuaccaucagaaugaacaggcaacccacaaaaugggagaaaauuuucacaaccuacucaucugacuaagggcuaauauccagaaucuacaacgaacucaaacaaauuuacaagaaaaaaacaaacaaccccaucaaaaagugggcaaaggacaugaacagacacuucucaaaagaaggcauuuaugcagccaaaaaucacaugaaaaaaugcucaccaucacuggccaucagagaaaugcaaaucaaaaccacaaugagauaucaucucacaccaguuagaauggcaaucauuaaaaagucaggaaacaacaggugcuggagaggacguggagaaauaggaacacuuuuacacuguuggugggacuguaaacuaguucaaccauuguggaagucaguguggugauuccucagggaucuagaacuagaaauaccauuugacccggccaucccauuacuggguauauacccaaaggaauauaaaucaugcugcuauaaagacacaugcacacauauguuuauugcggcacuauucacaauagcaaagacuuggaaccaacccaaauguccaacaaugauagacuggauuaagaaaauguggcacauauacaccauagaauacuaugcagccauaaaaaaugaugaguucauguccuuuguagggacauggaugaaacuggaaaucaucauucucaguaaacuaucgcaagaacaaaaaaccaaacacugcauauucucacucauaggugggaacugaauaaugagaacacauggacauaggaaggggaacaucacacucuggggacuguucugggguggggggaggggggagggauagcauugggagauauaccuaaugcuagaugacgaauuagugggugcagcacaccagcaugucacauguauacauauguaacuaaccugcacauugugcacauguacccuaaaacuugaaguauaauaauaaaaaaaaaagucacaauguggcauaaguggaggcacuaugauuugacaacucauuucuccauuuuagagucuguaaaauuauuguuuucuuugcccucauuaaugaaacugccacauuucugaaagauuggcuuaauuagaauggcuuaauuaggagaucgugcugauuuuucuuuauagaaauucuaaauaaaauuguaagauuaaacaauguuuugagcucuaagaaaucaaaaggcaucucagcuacucaggaggcugagaugggaggacugcuugagcccaggagcuuaagucuagccuggaccacauaacaagacccaaucucuaaaaaauaaaaaaaauuuaaaaagugaaaaagaaaccaaaagacaucaagugguuauuuuauacauuaaauaggaaaauagauuuugauuacauugcaaguccuaaaaaaaaaccaaaaaacuggcauucucauuuuccucuccucucacauuauuuuccccuauaauuaaucuuaaggaauauuuaauauaucacgauuaagcauuaauuuagauacaaguuucagcuacaugaaagauuuuuauggcagccauaacaaagaaugaguucauguccuuugcagggacauggacaaagcuggaaaccaucauccucagcaaacuaacacaggaacagaaaaccaaacaccgcauguucucacucauaagugggaguugaacaaugagaacacauggacacagggaggggaacaucaugcaccggggucuguuguaggguggggguuaaggggagggagagaauuaggacaaauacccaaugcauguggggcuuaaaaccuagaugacgggcugauaggugcagcaaaccaccauggcacauguauacauacauaauaaaccugaauguucugcacauguaucccagaaauuaaaguaaaauuuuaaaaaaucuauuuuuauaaagaaaaauuuuacaaaaaccaauaaaugugaauaaaaaaguaaaaaaaaaaaagguugccauuccgaucaaggagaaauagaaucaaaugagcugauauguacacuuguuuacauacacaaaaauguguaugugucagauagauauucagggaaaauuaaguuaaguggggucaaauugaaauuaaauuuaaauugaauaccuagauauaggagcagcauaugcaugcucaugcaaguaccaaugaaggacaaaaagauucuaaugcaugaaaucagguaggucagacacagugaaagcaccucucucuaauauuacuaaagugacgcaggacagaaaaagcacaggacuaacaaaagacagauucuuagagaguauuacugccuagcgaaauaaccuuauguaguuaacagucuuaauuuccuaauuagagaaauuaauccuuacuuuauauucauuaggcuuauuuucuagaaaauaaaacuuauaugcuauaaaauauaugccugucuccagaauuaugaaggacaaaugagaugauauaugugaacuaauuuugcaaaccacaauguacuauuauaaaucucaggcguuauuacuacugcugcuguuggccuucaaaauaagcauugcugucaauuagcauuuaaaccuugcauauucaacagaacucacauucaguugugccuuucguuauuuauucuccaguagguauuauuaaggccaauaaacgaaacuucuuacuaccaaaauguucaaaauaaucauaucuguagauuaaauccuuccccagaguucauguaaaaugugaucuauuuuuugagcacaaaaguacccaugaugaucauuuaaaauguauauuauaaagcagacaauuuucuuuagaaaucauuucacugugacauggaaaugauauuacuuuuccuuuaucacauacaaaguuucuucagaccuucuucacaucugaaauaacaauacaauaguacuauguugaaagaccugucuuccuauggcugggugcaguggcucacgccuguaaucccagcacuuuaggaggcgaaggcggguggaucacgaggucaggagaucgagaccauccuggcuaacauggugaaaccccgucucuacuaaaaaaaaaaaaauacaaaaaauuagccgggcgugguggcaggcgccuguagucccagcuacucaggaggcugaggcaggaagaaugaacccggaagguggagcuugcagugagccaagaucgugccacugcacuccagccugggcgacagagcuagacuccgacucaaaaaaaaaaaaaaaaagaucugucuuccuauaauuugcuuucauguuuaaagaaguaguacaggcagcagcuagacacugauacuuaaacuuuuuuucuauaaaugaauuacauauuaaauucuaaucccuauuuuucccaucggaccaagguaaauagauauucucaauaucagcuucuuaagaucagacacacaaacaauuagauaugauuuacaaggcaauguuacaugacaaauguauuuuuaaaauuauuuaacugaaugacuuugccuuuaaauaaagacaguaucuucaaauauauauuuuccaaaguaauauuacuaauaugaauggaaacauaugaguucaaauaaaucuagcauaguaaacugcaauuuucuaacauuagguaaaugcucaguuauaggcugaaaauagcuaugguacuagugagcuuaaauccuuguguggcaauauaacauaaauguuaaaagcauaggcuuuggaacuaaauaaaaugaauuugguuuccuaaucugcaaaauagauaugauagcauuugcaccucacagaguuauugugaugaaauguuauugccuggcaaguguuuaggaacuggcacacaguaaguacucaaaauaaauauuuauuauuauuauuaauuuaguucuacuacugauaauuugcuaauuauuuacuuacagaucaguaaggccuauacuacaaaaagaucuugaggaauucccugaguuuucaaaucuuaguauguuaucucugucuucaguuugauuugccauuuaaaaggacuaauuugaaaucuuguaagcucuuccuucuaucauuaauuaaaauuaauaucuccuuaauggugaucaaaccgcagaggauaaguuuacauaaaauuuaaaauaaaacaaaacacaccagcucauuuucaagcagcugacuagaaaagucccauaccuaauacaguuccaaucuuauuaguuaagacagaaucugucuguucaagccauccuccaccacugaguccuucuuuaaacuugaugagaauagacugauuacuuaguaggacaacaagaauccucauggcugcuguaacugugguggaauguaaguguuccuccauaaacaucaugauccagucaaaacccagugucuucaccaguucuucacaagcucuauucaagacagauggauuuaaaaaacaaaaaacaaaauuaauuucagaaauuaggauuucaaaucaaaaaggaaaaagaagacugaguuucauucuggagauacuauaaauuucaggguuaaaaaaaucuauuuaaagucaauggcaauuccuucuuuugccuaacaugaauuaacuaguaguagcaacugguauaaucacuuuuaaaaaagauuuacuuacugcaaauuaaugcuugucuuuucuuuagauguauaaauuaguuuuagcaagauauccagaagucuguuccucaaaaguauaagauuagcugauacaagaccuccaaacuccucuucaguuccuaaaauaaaaauaaauacauuaaaucucccuaguagauaagcuaaaagaaaauuuacaacauaguucuuggaaaguuuacugaaaaauauaucuuuuagaaaacauuuucuccaggacugcuuuucaccaacauggacaagaaaaagggucaguuaaauauuucucuuuagaacuccgaaaauuguucauuuacauuugacauuuccuaaacuacugauaauaaggcugugagauauuuuuuacauuaauauuccccuugccuucccaguagggggaaagucaucaaaugaggaccaugugaauaaaaauaauaaucaccacugacucuuaaccucucaaauccuuaauucuuaguuucuuuuuugaaagauacaguuaauucuaccagauuuaaaaauugaaaauaggaagcauagacuuauucaguaaacguaauacauaaagaaaaguuagaauuaaauagcacagaagaaaggcaaaggcgcacaaacgcauaaaggagaaauuagagaagaaacgaagaaauggagcugagacauucucagauaguacugcaaguacacagaacugggcaucaacaacccagaguucuaggcccagcucuccuccagcagagcuaugaguuacugagucacagaccucacagaggcacaccuuuuaaugcacuuugcagauacuguguuucuuacaaauuaaaggguuguggcaaccacacauacagcaaguccaaucaggccauuuuuuuuuuucaaaagcaugugcucacuucaugucucugucuuauuuugguaauucuuacaguguuucaaacuuuuucauuauuguaauaucuguuacagucaucugugaucuuuuauguuacuaucauaauuguuuacaagugccacugucuuacucuuauaagacagugaacuuagucaaaaaauguguuuugacagcuccgacuggccauuuacccaucucucucacucuucucaggccucccuauucccugagucacaauaauaucgaaauuagacuaaguaauaacucuacaauggcaccuagauguucaagcgaaagaaagacucauguaucucucacuuuaaaucaaaagcaagaaaugauuaaguucagagaggaaggcauguugaaagaucagacaagcccaaagcuggccucuugugcuaaaaaguuagcuaaguugugaauacaaagaaaaaauucuugaagaaaacugaaagugcuacuccagugaacacgcaaugauaaaaaaaaaaaaagaaaagaaacagccuuauugcugauagaaaguuuuacuggucuagauagaagacuaaaucaucuacaacauucccuuaagcuaaaacauaauccugagcaaagccugaacucucuucaacucuaugaaggcugagagagcugagaaagcugcagaaaaaaaguugggggccaggugcacuggcucgugacuguaacagaacauuagggaggcugaggugggacaaucucuugaguacaggaguuugagaccaaccugggcaacauaguuggacccugucucuaaaaaaaugaagaaaugaacuggguguguuagcacacaccuauagucccagcuacucagaaggcugauguaugaggaucgcuggagcccaggaggccgaggcugcagugagccaugauuguuccacugcacuccagcaugugugacaaagugagacccugucucaaaaacaaauagacaaaaagaaaaaacaaagaaaagcuggaaccagaagagguugguucaugaggguuaaggaaagaagccaucuccauaacaaaagugaaagacgaagcagcaagugcugauguagaagcugcaguaaguuauacagaagauuuaguaagauaauuaaugaaagugacuacgcuaaacaacggauuucuccaacagacuucucaacagauuuuuuuccaacaacuuccuauuggaagaagaugccaucuaggacuuucauagcuagaggggagaaguuaaugccuggcuuuaaagcuccaaagaacagagcugacucucuuguuagaggcuaaugcagcuggugacuuuaaguggaagccaaugcucauugaucaacuugaaaauccuagggcccuaagaauaaagcucaaucuacucugccuaugcucgcuaaaugaaauaccagagucuggaugacagcacaucugcuuacaguacgguuuacugaagauuuuaagcccacuguucagaccuacugcucagaaaaaaagguuccuuucaagauacuaccagcucacugacaaugcaccuagccauccaagagcucugauggagaugcacaaaaaaauuaauguuguuuucaugcuugcuaauauauccauucuguagcccaugaaucaaggaguaaucuugacuuugaauuaacuucaaaguuuuauuauuuaagaaauacauuucuuaaggcuauagcugccauagauggugauuuaucugauggaucuggccaaaauaaaguaaauauuuuggauaaaauucaccacuuuagacgccauuaagaauauucaugauucaugggaagaggucaaaauauaaacauuaacaggaguuggaagaaguugauuccaauucuuauggaugacuuugaggggcucaagacuucaguggaagaaguaacugcagaugugguagaaacagcaagagaacuagaauuagaagugaagccuagagaugugacugaauuacugcaaucucaugauacaacuuuaacagaugagaagcugcuucuuacagaugaacaagaaagugguuucuugagauggaaucuacuucuggucaaaaugcuuugaacauuguucaaauaacaacaaaggacucagaauauuacauaaacuuaauugauauaggagugacaguuuuugaaaggauugacuccaauuuccaaagaaguucuaccauagguaaaaugccaucaaacaguaucgcaugccacacagaaaacuuuugugaaaggaagaguccauuguuauagcuaacuauauugucuuuuuuugcuuuuauuauuauuauuauuauuuuuuugagacgaagucucacucugucgcccaggcuggagugcaguggcgcgaucucggcucacugcaagcuccgccuccuggguuaacgccauucuccugccucagccucccgaguagcugggacuacaggugacugccaccaugcccggcuaauuuuuuuuguguguauuuuuuuaguagagacgggguuucaccauguuagccaggauggucucgaucuccugaccucgugauccacccgccuuggccucccaaagugcugggauuacaggcaugagccaccgcgcccggccugcuuuuauuauuuuuuuaauugacauauaauuguaugcauucauggggaacaguaugauauuucaauacauguguaccauauguaaugaccaaaucagaauaauuagcauguccaucaccugaaaccauuguugucuuauuuuaagaaauugccacagccaccucaaccuucagcaaccaccacccuggucaaucagcagccaacaauauccagaaaacacccuccaccagaaaaaauuacaauuugcugaaggcucagaugauuguuaucauuuuuuagcaauaaaaaacuuuuaaacugaguuauauacuuuuuuuuuuuuugagacggagucucacucugucacgcaggcuggagugcaguggcgugaucucugcucacugcaagcucugccucccagguucaagccauucuccugccucagccuccugaguagcugggaccacaggcgcccaccaccacgccuggcuaauuuuuuuguauuuuuaguagagacggguuucaccauguuagccaggauggucucgaacuccugaccucaugauccgcccuccucagccucccaaagugcugggauuacaggugugagccaccgcgcccggccgaguuauauacauuuuuuaaaagauacaaugcuacugcacagauaguagacuacaguauaguguaaacauaacuuuuacagcacugggaaaccaaaaaauuuaugugacucacuuuauugugauguuagcuucauuugcagugguguggaacuaaaccugcaauauuucugagguauuccuauacuuuccuucuuucuagaacuaacgcucaggcuaaaguuucaugguuauauacuucuacuuguuuggaacaauguaccuguaaacuguccuuuaaaaugcuaacuuaguaccuuaaucauuauggauacuucaagcuaccaagaagaacccaagauccucaccucuucuaagaagacagagacugguaauuugaaaauugccuuaucaaaagaauaucacaaaacuuacucuaagagcuacuuccuuuaaauuuuucuacaauaaaguaauaaucuagacagaaauuaaaaauuuuauuuaacuuuuaugucuccuuuucuuacugccacaguuuucauuuuuuagaacauuauacucaauaaagucuucagugcauaucaaauaaauaauaaaugucauacacuaacaagacuagcaauuugcuucugacuuuauuauuucaaaugacaauaagcugaugagaguaucagucuaaucaacuuggcauaucaaaagaaaaauuuacuaauuuauacaucccuacuucaauguucuauaugaaagaaaaauuuacaacacuacuaugguuacugaauucaauggacagcaaauaaauauggaaaccagauaaauauuuuucccaccuuuuuuuguuuguuuuuagagacagagucucacucuugucacccagguugaaggucaguggcacaauuacaauucacuacagccucagccuccucaggcucaagugauccucccacugcagccuucugaguagcugggucuauaggugcacaccaacacaccugguuaauuuuuguauuuuuuguagagacggagcuuugccauguugcccagucuggucuugaauuccuggacucaagcaauuuaccugcuucagccucccgaaguguugggauuacagguguaagccaccauguucagcccacauauuuuuuauacuugaaauaaaugcauuacauauuucagcaaucuuuaaagcacuuucacuaccuaauuauaauuagucagccuauauuaauuuagaacuuagaaauaaucuuugcauuucguaggaaaauguaguaguuaaaagcuuagaaugcuuguuuagacuaccuggguuccuauauagucaaugguaugauauuggauaaauuucuuuuacuuguaucuuuuugggcugcaguuuccucccuuguauaauuggaauaauaguaccuauuucauaugguuauuacaaaauuauauagagcacuuaguaaguauucaauaaguguuauucauugaucugaucuuuauacuucucauccacugcuaauuugcuucaccagagaaauaucagcaucauucuaaaugaauuggcaguagguaacugucaggguccugaaccugucacuaacauacugugugauuugcagcaagucacuuaguuuuucaaaucucuccaucucuccuuugaaaauuguaaucacaccacuuucuccuacucaugaagcacaggagaggcugugcucgggaaggacagacaucauggagaaccccuuugggaggaagugauacuacaacaguucuucuccacccuccagguagaugggguuguauggacuuaaauaaucuauaugauaugauuugggaauaauauaauaggguaauaauguaaauaaggcugaacaaauauaagauucugagaauuuaauuccagaggucaaccuaaaaaaagguccuuucaaugcauuccaagcaacucuccuguccuagcauauacaacaagaaaaacauaugggaacagagggaggauauauauguacuaaaugaggaaagguuuccaaaaaaaguacuugucauggacccaggaacuuacaacuuaugaaauuauuuuuauauuauacuuacauaaagugauacuauguuauuuuucucagugacuacuaaauauuuaacagggaagugaaaauaauaguaauacagauauauggauauaauuuaguuuagcaaguaucauguuucugaagagauauacauacauuuaaaaaaucaaauaauguucaaaucacacaggaagaguuugcuauuuaaagaaacauugcuaugaauacucuaaaaauaggaaauauuuuauuuuugaaguaaaauucacacccuauuaaauuuuguaggcaauacuguauaggcuuaauauaagacaaauacaucagagaagggccaaaaacguaauguaaggagaaaaguuauacauauauuauauauaaucacauguaauucaggucuaauuugggccagaagaaaaaaggcauaauauuuaguugaccacuaucuucuccaagcuccagaaucaacuuaccagugucaagcuucucuucauuauuuauuuccauuacuacaaauuucucacaaaccgcaaagguuggcaaaguagaagaaauaaacugcccaaaucuuuaaacaaaggaaaacaagauuauggauuuucuuuuuccucuucccaaaacaaacaacaaaguacaaagaaacaaaauacaaagaauaaaaaccaaaacaguacuuuuuuuuuuuuucauaaucucauuucauuuuauucacuugcagaaagaaaugcauguucugaucaucuggagauuuuaguuuccuuguugcccacucaguccuucacagcauaccaccagcgagaaagauaagaguagugugggggcaugucuuuguacuucuuaucuuaacuagccuuuuaaggaccauuaggugauaauauuuaguuugcuuccucuuggaccaucccaaguaacauuauauaaaauaaugcuuuuaaaauauggggaaaauacaguucuucgaaauaugaauucuuuaaugcacuaacaugcaaaugguuucaaaaaccaaacaacaugauccauauucgaauguccuaacauuaucuggauggauccacuguagccuagcaguuaagaacuuggguuuacauauaugauuaaauuccuggaguagggggaacaggagaagaaaaaacauccugacuguaucacauucgaauuacgugaccuggggcuuuguuucuucauuuauaaaguagggaaaaaaacaaaaacuuuuacagguuuagggaauaauuucagcaaagugaccauuacaaugcuaggaauugcuuuaaauauacauucuugacauaaugauaauuauaauuaauucuccaaaauaauucuuaagcuaaaguuuuagaucugccaccagauuuuuuguuuguuuguuugagacggaguuucacccuugucacccaggcuggagugcaguggugcgaucuuggcucacugcaaccuccgccucccggguucaagugauucuccugccucagccucccaaguagcugggauuacaggugcccaccaccaugccuggcuaauuguuccuauuuuuaguagagaugggguuucaccauguugggcaggcuggucuugaacuccugaccucaugauccgccugccucagccucccaaagugcugggauuauaggcgugagccacugcacccggccccccagguuuaaaaauauguuuugaaggcaaauuaauaaaaaagugagugacuuacaaacuauacagauuagagguuaguccaugagaauaacugaauaaaugggugugauuucaccugagauacuugguagaucacaugaacgaacaguagugaccaaguccaguuuaagcaauucucuacuugaaaaauauucaauuguguaguuuguuuuucuuguuuuccuucuauaauccccaaauuuuccaaaauggggauuaucaugugaacauaagaacauuucuacagacaugccuucaauaugccuuaaaccgcauuuugcauugucugcaaaauaauacuuauaucauacaaaaaguguggauaugcaacagauuuaaaauaccauaaucuguuugaaugacagagaauaaaaaauagcgguggcacacccacuauuuaggaguguguaugcgugcuugugcacauacauuuaaaaauuagcagggcuugggaaauaggauugggaaccaagaauuccuagacugaauacuuuauauccaggccaauuucauugggcuaauuccuacaucuuuucucaccaauauucuacuauucacuaguggcaacaauuagcuuugcuccaucaaggcaagauauugucucauucauguuuuccaugcgucauaaauauuuugaaucguauuaacauuacagguguuauuacacagucauaaaaaccaauuaaauucaucucauccaucuuaaccucauugguacuuuuaguuaauaaaaagacaaagacaaagaaguuuuuccuaccugagcagaucauugcugcuaggaaaaccuugcaguaagaagcucaggacauuacuaauagcagcaauaguaggcugggauaaagacauaucucgaagagucaggagcagcuuugggauuaacuggaauucucucauuaauuuggcauucuuugaggcuucacuauaagagaaagaagauuuuauacacuguacuaucaccuuuucuauagcugaauaauuaacuacguggguauuaauuaauaccuggacucugugagcaguucaauaaaguguucaaauaaggaaagaugaaguucauauggugcauggagccagaccuauaauaaauaaaaacaguaguauauuuaagguuaaaaaaaaugcccaaaugccaaaccaacaaacaccaauacagcacauggaacuuauuucacuuauauaauuauuaucuuguaaaguucuauaaaaccacuuauaugcagaaaaaaaaucauuauaaauuggccaaaaaaaugaccaaaaugauggaauuaucacacuuuuacaaagcuaguucaaauacccuccauaugcuaaagaauguauugaaaaacaugcacaugacgaggagccaaaugaaagacaaccaaagcccccuaaugaaccucuagacaugacaaauaaaauauuuaaaaugaaaaauauacuggacggcauuaauaguagaugagauacuuccgaaaaaaaauucaauaaacuugaagacauaacaauagaaauuauucagaaugaagcauaagaaaaaaauacuaaaaagaaaugaccagauuuaguguaugagugauuugagacaguaucaagcaaucuaagauaugugucauugguguccagaaaagggaagggaguggcaggaaaaaucauugaagaaauaauggcuaaaaaauucaaaugugaugaaaaugacaaacucacagaucaauaaacccaagcagaagaaacauuaaguggacaaaggggacaaugaaaugacugacaucuuuaaugugugaaaacaauaaaaacagucaacuagaacucuauuccaugcaaaaauguccuucaaaaaggaagaaagaaauggaagacuuuuccagaugacagaauucacugccaauauuucuguaauacagaaauguuaaaaaaaaaucuccaggcagaaaaauuacacaagauggaaauggagauuuacacaaaggaauaaagaaugcuauaaauacuauauauguagucaaacagaaaauaauuguaaaauguuuuuugaaaauaauugaucauuuaaagcaaaaauaauacaaacuaucguagggauuauaaacauauagaaguaaauguauacaauagcauaaaaaugggagaaaugaaagucucuuauugcaaaguauuuauaagguauaauauucuucaaagauagacugaauuguuuuagaugcacauaauaaauucuaaaacaaucacuaaaaauuguacauggcauugcaauuauuuuacuuauauuugucaaaugaguauucuaaaaauuugguaaauuagguauuuauagacuacuugugguuuggaguaauuagggaugcuauaagaagccauaaagugagcaauguacuauaaaauaaagcaaaauuuauuaagcaacuaaauuucugauguuuguauauugaguuuuaaucagaaaucugaaacugaagauaauccuugauuuaaaugugucaguuaccaggugaaaacaagguuaggcuggguuagguaggucuucuuaguguucccauaaucccuucugucuaccaucucugggcuuucacaaguuuuaaauuaucuauuucuuugucuuuuuccucuaauggacuaaaugccuugagcuguggacucuuacuuuuucuuuucacauccuuaguaacuaauauaguguuugccucaaaaauacucagcaagugcuuucuaaaagaauaagagguuuggauauuagaacuuugaauacuaggcugagaaauguguacuuuauaguguagaaaaggaaaaucacugaaaguccuugaauaaaugauacgauuaugccuuugaaagaaugaggucccaaggguauguaggacagccugagcaaagggaaaaagaagugauaguuauccuaguaugaauaggagaagaauugauuagggcuugaauuaagauauagcaguagaagcagaaaaggcagacuacgaaaugugaaaguagaaccuauaugacaauaucagacuguuuauacacagggaagaaggaagcugauguuuucaauuucaagacuuggugacuaggggaauggugguguuauuaagagaaauagagaaguuagaaggaagaacuaauuuggagagggaugcuaaguucaguuaagguguuggugggacagugcugacugagcaagaauuaaaaauaagucuggaauucagaugucaagguuagagauuuagauuugaggaucaacuccacagagaugagaccgucagccuagguaagaguuuaaagaaaggaaaacaacaaauaaaggaaaauguaaaaaaguaaagaugaacauccuuacauaaaauaaugaaaacauugcugcaagaaaauaauagaaaaaaauaguaagaaagauguaagaaccaggauauuaacaccugaaagcuagcaaaagaaguauaacuugaaagaauaugagggaaacagacaauagccaauguuacugagagcugcggaugcugaaaacugaguacaggccauagauuuuuauuuagggggaagcuucuaguaagcuuugaaaauacagugucaguaaagcaauuagggcacacuguuugugagggauucaauaauugacaaaacagagcuuacagaaguugugaggaagaaggguuagggccuagacacaagaguucgcaaauauuaagugcuaggcacuauucuaggugguaggaacacaaagacaaagaagauaaacaugauuuccccaaucauaaagcccauagauccuacaguuucacagggauauauuacauaaauuuaguacauaauaacuaacaugcaaagugcuguaaacaagaaauuaaauggaaaaaggauauaagugaucacgaguugccuugagagaacagaguguaagcuguuacaguaauaagccaguagaaaugaaaaugccuuugaaagaaugaggucccaaggguauguaggacagccugagcaaaggggaaaaagaagugauaguuauucuaguaugaauaggagaaggauugauuagggcuugaauuaggauauagcaguagaagcagaaaagguagacuaugaaaugugaacauaaaaugaaugauauuuuaccaugcagcuguaaccaaaauuagaggucuagguccuauuuaucaagaaaaaguuucuaucagaauugccugaugaaacuauguuugacucauguaaugccacugccagcagcaaaucagcuaguuagggauaugcaucauaccauuucacuucuaaaauauuugcaaaauggaauauccuuggagaaaaggaaccccagcauuauucuacuuuuuauauuuuacuaaaugauauuaacaugaacaucauaaaauuauagggcuuuaaacacauuuuagagauaaaauaguuuauaaucauauggaguaagaaaugcauucauugauuauauauuaucaauuaugcuuauauacauacuucaaaaucacagaggagguccuggaaagcaguugaauuuggaauaauggaggucucauguccacuaucaacaguucccaccaaagaaaaaguuagauggaggauguggcuguuaagaagggaacguuucuucuuaagcaacauugccagcaacuacaagaaaguaauaccaaaugccuguugauaaaucaucauauauauucauuacacacacacaaacacacacauacacacacaaacacacacauacacacacaaacacacacauacacacagaauccuauguagaugauuuucugagauuauuaaguuaauuucuaaauuuuuauuaugaaaauauaacauuagguaaaaucugaaaaacaaagggaucuuaacauucuauuaaaauauccacuuuuacauuuacccuuucaauuccauuauaaauauguaaauaguuaccaacgcgugcauaaaauuguauguauaaugaaaacaucacagcaagaauauaaaauuguaugcacaugaugguaacuacuuaaauauacacuuuuuguguuauaaaguauuuuuuuuugcaacacggucuuaauaauuacaauuuuaaaagguugaaugauagucuauggaaugcuuagaguauaauuagucauucucuuauuacugguauaucuagauuguucuauuuuuucaugauaaacaacgcugcaauaaucauuuugaaaguuuugcaaaagaaaacacuuauugaaauacuauaauuaaaucuauacaacacaguaaacaguauauucauuaucaauaaacuaaugguuaaacuugcagaaggcauuuguacuucguguaugauagguuuuaaucuugcuucaaguauuuguuccucuucuuacaagugauuuuuuaucuaauucugacuguggauacauaaaugcugcuuuuuuuuuuuuuugagucuugcuccuucgcccaggcuggaaugcaauggcgcaaucucggcuuacugcagccuccgccuuccagguucaagcgauucuccugccucagccucugaaguagcugggauuacaggcacaugccaccaugccuggcuaauuuuuguauuuuuaguuuucaggaauagcaaugguacacuuauuauguaguggcuuucacgucuccugaguaaguaacagagauaaaagaugguggggugugagguggaggggagagagaaggaaacagggagagcccugaaucuaccauggauuuggcaauccuuucaggaagggggaauaggaccccauuucauuucuuucccauuuccacagagaaaaacaacauucaaaccagcaaaccuuuguucugaaaauaaauucaauguauuaaagcuauauugaaauaauguugccuaacucaaguguuuaguaagauuugauaagauaggagaaaaaggauaaagcaaaauaaagaaacaauacauacuuucauuugacauauauuaguuuucauaaaacuacugucucuuuaaguuuccuuggacaauauaauucuuccagaguuucaaacaacaugaaugauaauaaaaaagcagaguauuuuaggugccaggugaagugaaggcaaaguuuuacaguuacaaaccugguagcccuugauucuuuccauuucuuugcuggcuaguggguuacucuugaccacacaaaccagggccuugacugcugcauauaacccuuccacaucagaggccauggccaccaggcccaggauggcugcagcuccaccaacguacugcaaaguaguggcaacaggcuuagggacaaauguucuuacuccugauuaaaagauagugaaaaauaauuaagauaaauuccccaugugaacaagaacuguauacaucaucuugaaaaguuuuuuaauuagcaguguuuuauuuuaaaaauaucuucugucuauaaugcaaauucuagggaaagcauuaaagguagaauuugggacaaggcaauacaggcuggcugggcacgguggcucacaccuguaaucccagcacuuugggaggccgaagcaaguggaucacaaggucaggaguuugagacuagucugaccaacauggugaaaccccaaaccccgucucuacuaaaaauacaaaaauuagccgggcgugguugcacgcgccuacaaucucagcuacacaggaggcugaggcaggagacucacuuuaaccuaggaguuggagguugcagugagccgagaucgcgccaccgcacuccagccugggugacagagggagacucccucucaaaaaauaaauaaauaaauaaauaaauaaauaauaaaauucuuugaaaaggaaaaaaagcuaaucuacauacucuuagagaagacuggguguagaggagugagcagagaagagcagggcuuuacagcaagcacaaauguuucuacuguguagcucugggcuguacucaaaaguaaguggucuugagaaugcauuucugaguaaguaagagugccuuacuagcaucuguuggggaauaaccuuggggacaauaaaagucacuuuaacucugugaacuggagaaagguuuggagaagcuauccuggcggggaugauguauuuccuauagauaaaccaagcaaagcacauuacugaccauuacccagagcuucucuugguuaaguaaucuguguaacaguacaucaguaacuuuaggagagcauaaguuuauagaaacacaguccuggaacugugugccaauuaaaaaaaaaaaaaucacaccuacauuccuaacauuuuaaagaggcauuguuugaaugucacuugccugcugaccaagacugagauuuuaaaaaauaaaaguaacaugcauauuauauuucuaugugcucugcaguauucacaauacuuucuuuccuucuuucccuuuuguuuuuuuuuuuuuuuuuugagacagggucucauugucacccaggcuggaaugcaguggcucaaucacagcucauugcagucuccugggcucaaacaauccuccugucuaggccucccaaagugcugggauuacauggugugaaccaccaugcccagcccacaauaccuucauauauuacagugcuggauuuugaaaacuagcuccuaagguaauuagggccaguauuacuaguuuauagauaagaacacugaaguucauagagcuuaacuguauggcauaauaucacauagugacacaacaggggcuggaaccuaagucucugaacuuacugcucacugcucuuuccacuauaccacagggcugcuauacuuuugaaaaggacauaccacagugcuuguaaguauuuuuugaauaaaagaacgcuaccacgugcuuuagaguaaagaaaauuuuuaccaaugcuguauuaucaaaaaagaaaaacaaacauuuaugcaauucacugggacaauaaaaauugccaaugacuaauaaacauguuggauucugaccagcacaacacuaacuuuuuauuaaucuaaaaaggaaccaguauuauauacugauuuacacauuaaaagucacaaucacugguucugaauuuugaauggcgugauugguuuaugucucaagauccuaucuaacaaaaaaacaaaaacaaaaauaacguuuuaagcagacauguacaaggcucugaagaauguccacgcucuaaauuuuuauuauaguuugagucaguguuuauacucagaagcucuaauuucuagcucauuucuaaauuaacaaaaacucaugagcuauauaccaaaucaugaaacaaucaauaauaguucugaauuuugauaccugucacuaaauguaauuugaaauuuaccuaaaaguuacacgaaauuauauagucagugcugaucauuacugacaagagggaaacagugcaauuuuuuuuuuuuauuuuacuuuaaguucugggauacaugcacagaacgugcagguuugcuacauagguaaacaugugccauggugguuugcugcaccuauaaaccugucaccuagguauuaagcaccacaugcauuagguauuuguacugaugcucucccuccccuuggcccacuuccccugacaggcccugguaugugauguucccgucccuguguccguauguucucauuguucagcuccccgcuaugagugagacuaugcaacauuugguuuucuguucuuguguuaguuugcugaggaugauuucuagcuucaucuaugucccugcaaaggacaugaucucauuccuuuuuauggcuguauaguauuccuugguggauauguaaaaguuagugggauuuuaugaaagguuauuauuuuaaauugacuggaauuugagauuguuacauguaaucucugaauacugcacguacacuauaggucagugcuauuaaaauaugaacuuaaauacugccccuuaagugaggaaagugaaugcaaacuugauggcaaauaaagaaguuugaaacaacaaagauaaguccacucacccaaguauccaaucagagcggccccaauuguccgugcagauccauuaagauguccugcugaauuguguaucaacuucacaggaguggcauucucaugugaggaaaugccuaacugaaaaauaggaaaggaaaagaauguaauuauauaagaacaguuucaauguuuugauuggaaaagaaaccaaacacaugaaugguaacauaucuuuucucuccucccuuaucagaauacugaaaaacgagcauuuagguccagccugguggcucaugccuauaauccuaacacuuuguaagauagaggcaagggaaucgcuugagcccggaguuugagaccagccugggaaacauggcgagacccccaucucuacuaaaaugcaaaaaauuagccaggucuuguggugcauuacucaggaggcagaggugggagaaacaccugagccuaggaggucgagaaugcagucaacggagauugugccacuggcacuccacacuccagccugggagcauuuauuuuuggaaauguacaaacacuuccaaaguguggaaacucacaggagguaaguuaaacacaauuuacugagauaaagauggugagaggaucuugagacacagcuucaggggucuuugugaaugaaguucuuugguaguuuaaagguuguuaucacuaacugccucacaguauuucagaucagugaacauauuagcuuuauuccauauccaaguaaacauaaguuauccaagaguuuauagauaaaacaugccuacauaaaggaaucuuacauuuuguacauucacacauacacaagaucuauuuucaaggcaaauauaacuuuaauucuguuguucacuauagaguuaugugaaguuuauguuccuuagauauguauaugugucauacauacacacacacacacacacacacacacacacacacacaaaagcucugcguaagaguugucaauacuuacaguuccuggucucuugauauccuuccccuuggacuuugccucugauaaucagccaaaauggcuugucaagcucacugaugaguucaccuugcuaaaccccauagucaguccucacuucuuaucuuacugugaccacuuaagucauuuccacagugaauccuugaucuuacaacauuaagcccuccugguuuuucucccuucucacugacugcuacuucucagucuuuucugguucuucuugaucuccccaacuccauaacacuggaacgucccagguuucagucuuuaaaacuuuccauuucccuaucuacaucuaugcuuuggugaauacauguagacucauggcuuuaaacaccaccuguauaaaugaacuccagauucguauuuccaauggccuugaaaucucuacugugaugucuaauacacuucucaaacuucuaaaacagaauucucaauauuccucccaacucuacucuuuuuguaguuuucuccaaaucagaaaaugugacuccauuuuccuagcuguucaagaaaaaaaccuggaguccuuaacucucucaccuuccacacucauuccacauucuaucacacaaaacugcuaggucaacuuuuaaaauauaccuugagccgggugggauggcucacaccuguaaucccagcacuuugggaggcugaggcagguggaucaccugagguuaggaguuugagaccagccuggccaacauggugaaacccugucucuaauaaaaauacaaaaaucaguugggcaugguggugcaugccuauaaucccagcuacucaggaggcugaggcaggagaaucacuugaacccaggagacagagguugcagugagccgagaucacaccauugcacucuagccuaggcgacaagaggcaaacuccaucucaaaaaaaaaaaguguauauguauauauauauauauauauauauauauauauauacacacacacacacacacacacacacacauacacaccuugaaucugaucacuucuuaucacuaccacugcuacugcccaaauuaaaaccaccauaaucucucauaggaauuauuuaucgcauuggccucauaacuugucucucugcuacuaccuuuguuucucuucaaccuauugucaauagaagucauagugauaaaauguaaguuacagcauuucccuccuaugucugaaacuccauaaugccucccaucuuucuccaucagagccaaugucuuuacaauugccccaugaauccuaaacaaccuaagacccaucgucacucugggcuccucuccuacugcccgggcccucucuaauuuuacugcauccacaucugucuccauggcagguacguacaguacacuucucagggccuuugcacuuguauuccuggaauacaaaacacucccacacccauagguauaucccaugcucccuauuccuguggccuguuaccucaucccugucaagucuuugcucaaaauuaaccuucucaguaacgucuccuuggaccaccauauuaaaaacuugaagcuucucucuuuccccuucccugcuuuauuuuacugcauagcaccaucaccuucuaacauacuucaugauuagguuauuucuuuagguauuaucaucugucuuuuccacuagaauguaggaaauauaaaagcagaaauuuucuuuuuauccacugcuauguccugaacugaaugucaccuggcacauaauaggucauucguuaaaaaguugaguuguagccuuaaaaacaguaauuguuuucauuaguuuucuaaaguuaaauuucuuaauugccaauauaaauaaauuaauaugaauuauguacucauaacagaaacugucacuuuuccaaauuaaguuacauaucuacauguguuuuggccuacauuugaagucaaauuaaccaaacauaaacaauacaugaaaggcaugauuuuuagcagucacucauaauugaguaguauccauaugagacucugagacauguucccagugagaaucagccauaguacaccaagaaaucauucugcuuaccugcuuagcaauggcuuugcuauccaauuuguuauacacuuuccggauucuugccacuguuagagacgacacagagagugcauagaggccaaaugacacuuucuccucugguacuaaugacacaggggauggcaccaccccuucggauuuugcaucuuuaccuucaaaagaagaauaauucuuuucaaaaucaucaguaguucucaucuuaaaguaaguuuuuuauucuuacuaucauuuuuaaaugaggaggcuugaaagucuuaaaguagaauaagagagguaaauuuaaaaacuaucuucucagcucuucauuuauuucuuuaauuaaaagauggaaaaagaaaucuagucauagaguucuacauucuaagugccacucuuaaaacauguuuaacauauagcacaacguaaaggaugaaaaguuuuaacuguuaucugacaaacuguaaaacaugucccccuagauucaaaggaaaaaggaaugaagaugaauaaaaugcugaucagccauguagcacuauguccccuccccuaaaaaagcacucagauaugccugccuguauucuuugagaccacaaagcagaggaguuauuaauaaaggcauguguuuuaaagcuacauggccugaguuugaaucuugcuuuaucacuuaaaagcugugcgaccuauaugucuuugugccucaguuuccucuucugugaaaugggaaugauaaugacaguaccuaacucacaguguuuugagaugaauaaauacaugugaagggcucagaacagcuacauccuucauguguauugacuuauuuagcacacaguaagugcccaagaaguguuagcuuuuauuagauaccaucuaaauuaagaaugagugaaaagauaaauuacuaaaucuuaggauuaugaccauuuacaauauacuuguccuaacucuucugagauucuugguggaaucagaacaagggaguggaagaccaucauuugcaaggaguacuaccaaggaacugccagcuuaacaucaguuccucugagucuaaauuucauuugggagaaaggauaacaaaaaguaggcuuggaguaaagaaaugaggaaaaauaauguuaagugaucucaucuagagaauauguguguguguuuauugaaccuaucuguucuuccuuuaacagggguggcuauacuuuaaacugcuucauguaauaggagaaaucacagaaagagaagagugucacaguuagacuccuagagggcauauaccuauaucucagagccaguaagagaaacuggauaauaagcgaucagacauaaagacaaagaauccagaaagugcaguauaaucaguggaggaaaauauuuucaauaggagugaguauccugcugaagaagauuagaggagaaggcgcuuuuccuagauuaacaauauguauaaccucagacacacacaugcaucuauauugcaggaguuaaguuucauacaacuucaagaacuaaaaauaaguuacucacauggcauacauacagccugaaagcuuccaacauaauuugguccaaguucauaaaugguaguaacauuugaagaagguaaaacuucuucuagaaaaugugugggucccaggcgccaaaccaaugaggcaauuuggcguugggcagguggaguaccaauguaggcauagaccgugcucaccacugguggauuugccgaaccugaacccccuggaguacuguggacauaaugaagcuguaaggaagacaaaagcaaaugugugagaugugaacacuuuccccaggaaaauaacuacuucagcauauguauuuucauuaucccaaggucacacaacuuuacaaaugcacaaaaacauuugggguggagaaacaggaagggcaaggcacgauacugggaucuguaacugaggaccagguauaguagcuaaaacuuuuauccaacucucuaacacagauaaacucuuuaaugcuagaaauggcaacaggcaaauacagggauacugucaauggcugguuugcacaucaaguuaaugacgcuucucugaaauuuuugugcugauauaaagagagcuuuccacuauggaauuaaaguagucuugaaauuagguauguuaccuucaaugugagucuguuaacuaaaauuacugaugaaaagcguuuuauagggguaaauuauuauaauaaauauauaauuaaguacaguauaagagauaaagaacuuaaguugcuuuuucuugcugaagcagcuuaaugggaugaaggacacuuccauuaacugcugugucauaauaacaucucagcuucagauccuauucauuauucuauauauuaaacagcaguucuuggugauguuaauagcacaauugugaagaccaacauaagagcuagaguugauuucacaguacugugacuauugacagggacagugaugaugauguaaauaaaucaauaauaaauuuccuauugcucaacucuagaagcugagggcauuuuuauuuuuaaugacacuaaaauuaaugaaggagcaacguacuagagaaucuacaaacccauuucaaaugcaaucauguauacaaacaaaucaaugacuauuccacaaggugcauuuuaggguuuaucauauugaaacacaaugucacaauaaaauaucaucaucaucaaggaaggaaauauauucaaagauacugcugguuucagugcuuuucaaacuuuaauucacacacaaggacaaacuuugucuuuguuacuucuuucaagugaucgcccuaaaauggauaacuggcuauaucccagcauuuugggaggccgaggcaugaggaucaccugaggucaggaguuugagaccagccuggccaacauggugaaaccccaucucuacuaaaaauacaaaaauuagccacgugugguggcacaugccuguagucccagcuauuugggaggcugaggcaggagaauugcucauacccaggagguggagguugcggugagcugagaucgugccacugcacuccagccugggcgacagagcaagacaccaucuuaaaaaaggaaaaacaauaaaaauaaaauaaaauaaaauaaaaugaauacuaucuuuuagaaggucaagaauuuucagagcuugcgaacugaguucuguacaaaguaacaagcaggauuuauucucauucagaaaaagggaguuucacuuguuucuuuacuugauaaucaacucuuuuuuucuauucuaaauacuaucacaaucuacaguaauguuuauguagucauucauucaagaaacaauaaacuaaauaccuacuaucauuaucagggacuaaucugggugauaugaaaacaaagaaaaaaaaacaauucuagcucuaaagaauguaagucuucuggacuaaauuacaacaacaauaaugaaguggcaaaauaguguguucaccguuauuuaugaauccuucaacugguuccucuauuaugaaaaagcaccuagcaaucuggcuuaagcucuugcauauucagcaacuucuuuaguaccuauaagcccucauuucuauucuucucuaauaaaaugguuuaagaauuggccacaugagucuaacauauuauucaaauggguacugaauaucaacuuaaaauuaagaaaguaauuuuaaaaauaucccuguaacacacacacacacacacacacacacacacacacacaccccccaaacuacuaccuuauaaaacagguagauuuacaagugcacauacacuuaccuuuacaguguuaacaagcuguccaucaauauaaagggcugcaguacuguuuuucaacaugccuuugcucauuaccaggaccaaaugaugccacugucccucaaugauaagcucuccacaucgaaagcgagcacagcaugggagaauuucauaaaaugaggacucuucacuaaaaucaucaacugaaauaaaggggggaagacauaaaaacuuuuuccaacaccaucccuauucaaauuauucauaucuagaucagcauguuuugacuuuauguuaaaacaaaauaaugaugcagacugauuugaguaauaauacaacucuggaaaaaaaaaugauaaugcggguugggcacgguggcucacaccuguaaugucagcccuuugggaggcugaggcgggcggaucaccugacgucaggaguucgagaccagccuggccaacauggugaaaccccaucucuacuaaaaacacaaaaauuagccagguaugguggcgcgcgucuguaguuccagcuacucgggaggcugagccagcagaaaugcuugaaccugggaggcaagaguuugcagugcugagauuguaccacuguacuccagccugggugacagagcgagacuccaucucaaaaaaaauaaguaaauaaaaauaaaaagauaaugcagacagaagauaccuuauucaugcaauacccuuaccugcaguaaagugaaaccuagaauguauuuuugcucucuucugcucaagaaauauagguauaaucacauaaaguuacaaugaacaaaaguuagcuaaugaaguaaaaaauacauaaaaauaaagagacaauaacguuaugauaaacacuaaaaagagacuaguugacacccaaaacaaaaauaaacaagugggacuaucucaaacugaaaagcuuuugaauagcaaaggaaacaacagagugaaaagggaaucuauggaaugggagaaaaauauuugcuaacuauguauuucauaaggcaguaaugucaaaaauacauaagaaacuacuagaacucaauaguaaagaaacuaauaaucaauuaaaaaugagcuaagaacuugaauagacauuucuccaaagaaggcacauaaauggcagacagguauaugaaaaaugcucaauguuacuaaucaucagggaaaugcaaaccauaagcacaauggcauaucaccucacaccugucagaauggcuauuaucaaaaaaaaaaaguguugacacaaguguuggcaagaauguggagaaacuggaacccuugcgcacuguuggugggaauguaaaaugcugcagcugcuauggaaaacaguacagacguuucucaaaacacugaaaauagaacuaacauauaauccagcaauaccauaucugggcacuuaucuaaaaucacugaaaucaggacuucaaagagguaucaguacuccccuggacagaugaguagauaaagaaaaugugguacauauauacaauggaauaauauuuagccuuaaagaagaaaauuuugcaauaucugacaacauagaugaagcuuaaggacauuaugcuaaaugaaauagccagucauagaaagacauauacugcgugacuccacuuauaugagguauuuaaaauagccaaauucagagaaacaacgaaugaaauguuggucgccaagggcuugagggaggggcaaauggggaguuacuaaucaaauggcaggaaguuucagugaggcaagaggaaaaaaagcuugagauuugcucuacaacacugcaacuauagucaacaauaauguuguuguaugacaauaauguuguauaacaacaauaauguguuguuaacuuuuugacauugauuugguuacaguauggguuagaaaaagaaccgagaaaaauguaaaguuuauucuugcuauaugcuaugcucaacgacacaagaggacaacuaucuauuauuaguggcuguacuguccauaauaaaaggcaguaagaaggagaugauuuacagcacagacuagugauuuguugauccaaguuuccugcuucaucagacaacuuugucccacguauauaaauauauucugauuugcuaccauucuacaauuacuuccugacuccaaucuggcuccuuuuugcuacccuauauguuaccagaccaugcuaagaaauaaugguuucauauuaauuuaauuuuauuguuaagcugaacaaaaauuaauuuaccuuuuaucaguacuuaacaaauggcaagacagcgguggaaaaccagauuuuaaauacucauuuuaaaaaaaauuaagaagagcuaaccuguaaccauauaauuuaaagcagauccaguauuuuucacugcauguacaaacaaguaaauauacugaaaguaaaauuuaugugauaugaagaagaaaaugcaaauaaaauauuuauuucuauuuuuagaaucuuaaaauaucugcacauacuuaaauaccaagauuauauuuuagaauggcaauucagaauauaugucuguugauaagacuauuacacagguaaaaaucuuauccaugaggugacuugauauaggaacugaauaaacuaggcagaaagcaggguccuaaagccuugaaaggucuaguguuauggaccaauggaggugaaaguaaauaugaacauaugggugaaacaaggaacuugucccucuuccuucccugguucguagacuguaagucuucucaaguauugaagaagauauuccuuacaaacauuugugagaguuucacuuucugacuuagguuugaacuaagacauuuccagcacugaguggugugucaggauaucucagugagccaacugguuuaugacaacuccuaaucuccuaggcaucuuaauggguuacagcuguucggagaaugaauccuggcaauacuaaugcauauguuaccgucauuucuaaucauauauggacuauagcagccuggcaaauuacauuuaguaauaaaaaugagauaagaguuagaaaauauuuuccuaguuuacagauuuaucuccagauccacuccuuaacuuucccauuaaauucuagggugucuucaaauuccccauuauuauucacuuuucucguuguuucuuccucagaccauucauuuccucuauucaugcauuuauaaguuuacauaauaucugcaugccuaauacauucuagguacuguguuagaugacagggcagcuuagauuacaaagauaagcagacaaaacaaauuaaaaauuaaaaucuaugaagucuagauaagagaugaagauuauuaaacaagugcuauggaagugggcacagggaggaagggaagauuugagaaauauuagggaggcauauuacaguaagacuuaguagaaagggugguauuuucaaguugacucagguuucuaguugggcuaacuggcagugguugugucauuuaucaacacaggaaaacagaaagagauguagguuuuuuguuuuuguuugaaacugggugucucuccuaggcuggagugccauggcaccuucacagcucacuguaaccucaaacucaugggcuucaccaauccuacaccaccucagccuccuaaaggagauguagguuuuauaaagaagaaauauuagaaucugagauguuuauuggaauacuguucauauggagaugucuaauaugcagcuggaaauaugaggacauagcuugggacauagacaaaugaaaaaaaaacuuugacuucacaguccuugagauaaaaagacuuaaagcaauacuaguucauuauuuuuucccaugaagagcuggucaaguacaaagaucaaaggugaaacacuggagaauacuacuucugaggggcagauagaagagaaagcgauugaaggaaauugcaaaacaaagaucagagaaauagugaguauucucaaaugcaagacuggagguaguuuuaauuaggacgaauuagucaacaggacuacaugcuacuaaaggggcaaauaaagcgucauaacaagaauuuuaaaguacuaacuauauugaugccuagcucugugcuagguaccaugaggaauacuacaaccuuacaaucuaauuaaaagacuaacauucauauuauauuaauauuuauugaacaccaaccacaugucaauuaauaugugauauuauuuuacuuagcuaaaagaacaaaauuagaugaccaaaaaaaucacauuuauacaaaaugcuuauauucuugagcaaagaaaauuaaguaaauugagauuuauauuuuaaauuauuuaucauuuagcaggaucuucaugaaugccuugaguuuggaguucuacuguacagcacuguaaagucauggcauguuggagaaaacuaaggaauuagaauuauaaaauaguauguauuacaucuugaagguaagugauggauaagguaauugaaauguuauuguggcuagcacaguguggcacauauggcaggcaggugcucaaugaauauuaauuaauuaagcagaauucacagccaaugauaauccuuaccaaaauacaucaaacaagcaaccugcuuuccuaggaaaagcugugauuucuuggcaaguagagauuaguccuuauuagguacucacucccuccacuguuuuguaagucucuuuugaaagugccuuaaaauucacugguaagcaauauucaauguuuuauguaacuuguucuaugcuauaauaauuuaagcugaaaaguuauuauuagcuggacuuuuaaaauaaauacaaaaaugaaguuuuaauacuucuauaaucaaaagaagaaaacaaaaaaaaauacugaccauaauuuuggaggaguuccucuuugguggaaacaaucagagaucggucuuuugcugauagaacuauugcaaggcacacguaauguugcucagaagaauuugcucggcgcacaacaguaagaagucugacagggugguuauuuggaggagaacuaaaauguucaauacaaaaccagcuagaguaacuuaagccggagggaggagggaagaaucuuucaccuacaguaaaaauuaaaaaaaaaagucuguguugauuaauauuuauauuuuuuaaaagaugccaacaaaagcaaauaaacucuaaauuauauauaaucuacuagaaaaaaaacucauaagcagaaagcaaauauuacuuaccagaaccaaugccacugaccacagccccaucaauaagaccuguugugacgguauuauuuguaggagcauuaugaggggccaaacugggcaaaaaaagacaucuauuaaagaaaagacaacauacauauuagagaucaaugacuccuucucuuaacacugugcacuuaccacagugaaauaacugccaguauuuaauggugacuagagaaaagaucauggaauaaaucuggaugccucgcaaagcccuucccuucuuuuaauuauguaaggguaucaaaagacauaauuuuaaaaucucccaaaauaacauuuuuaacuuaaaauaaaaaaaaaugaagauacaaaaugcauauggcaacauacucuaacguauaaacccaaucaagacauuagaacaauuucaucacugaaggaaaacucccaugugccccuuacugucacucucuuguuaccacugauugcuuuugacuauucccaaucauguuuuaaucuauuguuugauaaugacccaugauaauauucuuaaaacacagagguuucaaucaauauaagaaucccacaaacaacuaguauagauaaaaauuaugaauuaacacucuaagccugggcacaguggcucacgccuauaauccuagcacguugggaggcuaaggugggcagaucacuugaggucgggaguucgagaccagccuggccacuauggcgaaaccccaucuccacuaaaaauacaaaaaucagccaggcgcgguggcgugcgcccauaaucccagcuacuugggaggcugaggcaggagaaaugcuugaaccugagaggcggagguugcagugagccaagaucgcgccauugcacuccagccugggugacagggcaagacucugacucaaaaggaaaaaaaaaaaacaaaacucuaauagcuaacagaucuagcuaccagaucuauuagcauuugugucuauuuuaggcuguugaacuucaugaauucuuauagauuuuuuagauucauuauugccauuucuguuacuauaaucuuuucugccacuugaaauaauuuauucauuugaagugacagucauugaauauuuauaauguauaaauuauuauacuagguaauuugaaggauagaugaugauaaaacccaaagaguuuucaaucuaauuuuaauuuauauauuaucuauacauuuauauuuauuacauuagauguuggcagacuuuuucuggaaagggccaaaucauaaauauuuaaugcuuugugaaccaggcagucuccaucaugacuacucaacucugacacucuagcacaaaagcagccauaggaaauauaaaugaguguggcuguuuuccaauaaaacuucauuuacaaaaaaaaaaaaaauuugcaaaaguguuacuaacaaaacagauuugguccaugggccuaagauuuuggauuccuaugucauaucaauuuauuuuguauaacaaacaaaaauaauuaaauguaguaaucuuaaaauagcaugcucaaaaaacucaauaauuaaaaaauauuaaguaugguaaaauauauuuuaauuaaguauauuuaaaaccaaagaucuauuuguaaaggcaaguaugacgcauaaaaccauaaagguuggcuuccuugcaaauuucuuacccaaacccuucaagugaugugucaaauucaacaaaagcuggaguaacugaugacccaugaagucugaugucaugugggguugucauggagaccagacacuucacccuggucagggguacaguacuuccuuccgcagauuuuaccaggcucuugcuuauccgguaaugguuaucuucauguaagcuaaaaacauuaucaguacccagaccuuccagagaugugaucauacuaccuguaagucaaggaaaucucuugggaaaaugucauauggaauuucaaaauaacuuuacaaggcugauuuauuuguaaauaccacuucaguuucaauagacaauaauuuuuuuuuaagugccaagaucauuauccaguuuuaauguacauuuacuuuuaaacuuaauagcaugcguuuccuuuuuuacuaaagcaauaugcacacugcagaaauguuggaaacuagaguauaaauaaaaauaaacaucucaaauaauugucaucaaagccacugauacaauguaauuuaauuauaaaucucaguuaauaguuuacaaaucaggaaauacuuuuauuucauaaaacuaugauuuauuaauucucuuugagggaaaaguaaacaauuuuagaccauuaaaaugaaaagaaauaggucaucuuuauuauaaaacaaauuagagauaaauggcagaaacuugcuucucccauuuuuuccccauuauuaauucuuuccuuacaauuauuagaacuaaaugcaugaucguaaaaguacuuuaauuuaaagauucccauauuuauaaaaaggguaacaauuucaagaauaaaaagacaaauucuaaacagauugucauuaucucuccagggacacauuacaaauguaaugaagaaaauauucucucucgaaauaaacuacaugaguauaggaaacuguuuuccuccuaaaugugcuggauauucaggcaacuacaaagauauuucaaauauucucuuagggaaaggaacuauuuuuguuucuacucuuagcaaaggaaaucacaacucaauucuuauuuauuuauuuauuuauuuauuuauuuauuuauuuuuugagacggagucuugcucugucgcccaggcuggagugcaguggcgcgaucucggcucacugcaagcucugccucccggguucacgccauucuccugccucagccucccgaguagcugggacuacaggcgccugccacugcgcccggcuaauuuuuuuuguauuuuuuagaagagacgggguuucaccauggucucgaacucccgaccucgugauccgcccgucucggccucccaaagugcugggauuacaggcgugagccaccgcgccgggccuguuucccuauuuaaauaauaaacccuucucuuucuuugcuuucacaaacuucuugaaauaauauucauccccuacaugauuuucauucauaaaauaaaucaaaaaagggaauuucaaaacuuacuucucauuucugguucauaacucagugaacuugguuuguggacccuauauuguuuuagcaguuuuuugucccaggcaccacaauuuaaaggacuugccaaacguaaaaacucccuaagaaagagacaaagcaaaguuauuccuugauugagauuauuauauaauucauuaaccaaauauucagaaaaagaauuuaauaaauuccaacagacuaauuacaauaaaaaaaugcaaaguauaauaaaacaauauaguguuaguuuuacauuuaaucaccauauagcuauauaucugacacauauuuuuuagaauguuuuuuagacaguuauuccuucguugagaauauuauaauucauaaaccaaacauuuucaaaaaaggaauuuaauaaauuccaacagacuaauuacaauacaaaaaaugcaaguauaguaaaacauacacaguguuaguuuuacaucuaaucaccauauagcuauauaucugcuauacauuuuuauaaauucauuuuuuagaaguuaauaauauuuaagaagaaccccaacucaaauauuucuaaaaccaaacucaucaccuuauauccaaacccagggcauuucuuauguucugcaucucacugaaauguguuuuuguuccuucuuuaacuuuccauauucagaaaaucagaaaauccugcuauuucuacucauaaaaauauggaaucugcucuuuucucucauucuugcugcuaucacccagaccauauuauuuuacuauuccuaaaacagagucuuaauuaccuccugugacaccaauauugccccaacucaauccauuccucacuauagucaguaucucacagaacuuaaaucuacacagugucacucuauugcuuaagacucuuccauggcuguccauuucuguaguugaaaacacaaaacagcuagcauucaguaccauacaugagaugauuucuacuguacucuccagcuucacugcucccaucuuucccgcaaucauaaauucuacuuaagacauacauaaaacuucugacugccuaagaaugcuguacuccuucucuacccuggaccaccauauuuguuuuucuuguuggggaaaaaaaucuugcccuuacuuuuucaccugauuaacucucuuccauacuuuagaguuuuuuauuuaucaucauuuuuuugugugugugagacagccucuugcucugucacucagacuggagugcaguggugugaucauagcucacugcaaucucaaacucuugggcccaagagauccuucggccucagucucccaaauaacaaggacuacaggcacacgccaccaugcuaguuaauacauauauauauauauuuuuuuuuuuuuuguagaaacagggucucacuauguuauucaggcuuauuucaaacugcugaccucaaguaauccuccugcguuggccucccaaaguguugggauuacaggcaugagccacacugccuggccucauacuuuauuucauuaacugucauuuccuccaggaagccugcuuugagucacacuuccaaaagucucugccccuauauaaacucuguaacacugcuauuacgaacuuaauaaacaauauuuucauuuccugcuuaucugcauguauucuuuacuagacgauacauuuuuuaagagcauaaacccuccauaaccugucauuuauaacaucauguuaaaaaaaaaaguagaauacuccaaauuuucaacucccuacagcaggaaacaaaaaaggcuuacaaguuagguuugccaguuuuucauguagaacguuagacacaauuaguuuauaaucuauggcuuuuaaguagcaaaguacuuguaccaucauuugacuucuuuuuucugagaacucacuaauugugaaaacugaccauacccaaugguugauuuucauugcuuauucuauuuaucuaacuaugcaauguaaguuaucugguaaaauaguagcauuagguaugggacaaugucucucucucucucuguguguuucucuacuuuuaaaguagcagauuaccaaaaaggaucaggggaaaaucucaaugcuauuuucaaaacuuuaggacggugaguacaacuacaagauaauggaugaagugaguagguccaucucacucaucuuggcauuauaaaggccgugaacacagccugauacaacaccauuuaacaaauguuuacugcauaaaaguuucuuaauccacaaucaguuuggagucaguuuuaaaaacuuacaaauaaauuucaaccauuuuuaagaaagcuccuaaaaguuuuauaaaagaggaguacucuaauaauaaguuauguaacagcaguguuauagaguuuauauaggggcagccuacccagacuuuuggaaggguggcucaaagcaggaggcuuccuggaggaaaugacagauauauaugaaucauucaagaaauacacauauguaaguauauauuucuugaaugauucacaaacucugauacauccauacuguggaacauuauucauaauaaaaagaaaaaacuacugauacauguaacaacuugugugcagcucaagagcaauaugauuagugaagagacaaucugaaaagaucacauacuguauaacuucauuuauguaacauucucaaaaucagugguacccaaccuuuuuggcaucagggagcgguuuuguggaagacaauuuuuucacagauggauuguggaggaugguuucagaaugaaacuguuccaccucagaucaucagguauuagauuauuuagauucucauaaggagugcccaaccuagaucccuugcaugcacaguucacaauaggguucacgcuccuaugaguaucuaaugcuacugcugauuugacaggaggcagagcacaggcggaaaugcuggcucacccacagcuuaccuccugcugugcggcccaguuccuaacaggacauggaccaguacugguccauggcucggggguuugagaccccugcucauaacgacaaaacuauggagauggagaacagaucagugauuuccaugggcuaagggcuaacgauguugggguuaggggaguggguaugacaauaaagguagcacuagagaaaucuuugugacaucguaauuguguggugauuacaugaaucuacacaugauacaauaacagauaauuguaugugcacaugaauacaucauaccaauaucaauuucuugguuuggauacuguaguauaguuauguaagguguaacuacuggaggaaaaugggcaaagagcacaggaaaacucuuggaucuauauucacaacuuauggugaaucuauuauuucaaaauuaaaagguuaaaaaguauuucuuuaaaaacuucuuacauaugaaaaguuauuaaauauaaaguaaacgcaugacuucauuuuuaaaggaaagugagagcuugcuagauucaaaugaaagaaauaacugauggacagaaacacuaaaugauuacuaauaacuagauuuauuuguuucuaagugccauauuuugaguauuuuguccauuuuuguuauauuuugcccauagauaacugaauauauguccauuaaggcaggaauucuggaaucauaaggacucuagaaacugacauuacuaauuguggacuauuugaguaugaaagagaacuuaccucaacaccauggguuccagagccugagaggcuaaucguucaaacauccgcugcaggggcgggugcagugagugguccucaucagccaaugcagcacugcaccucugcagcagucgugcaugaagaccagcuucacacaugacuugcugguuccuuucugugugcaccagggauuguaaaauauuugccacggcaaguugaagauccaaagcaugcuaaaaucaacaaagaaauccacacagucaggucauucuuagugagaaagaugacaauucuuuucacaugaagcauaccuuuuuaauuuuuuuuuuuuuugagacggaguuucgcucuuguuguccaggcuggagugcaauggugugaucucgccucauugcaaccucugccuugcagguucaagugauucuccugccacagccucccaaguaacugggauaacaggcgcccaccaccacgcccaguuaacuuuuguauuuuuaguagagacaggguuucaccauguuggcuaggcuggucucaaacuccugaccucaggugauccaccugccucagccucccaaguguuaggauuacaggcgugagccaccgcacccggcagaagcauacuuuuuuuuuuuuuuugagacagagucuugcucugucacccagguuggagugcaauugugugaucucggcucucggcucacugcaaccuccgccuccuggguucaagcaauucuccugccucaguccgccgaguagcucggacuacaggugccugccaccaugccaggcuaauuuuuugcauuuuuuguauuuuuaguagaggcagaguuucacuguguuagccaggauggucuugaucuccugaccucgugauacacccgccucagccucccaaagugcugggauuacaggcgugagccaccgcgccuggccagaagcauaccuuuuaauaugaagucucuauaugcuuccaaauacauucagauaaguaacuugcuuagagcaauauagcaauuccagaacagguuaggcaaacauguccuauuuuaauuugcuagaaguacaggcagcuggacucuauucucuuccaagccuuuuguauuacaugacuauaugacuaaaaguaguucuauuuuuauagaaauagcagggauaaaaucuucuuaauggugggcagauaacuaguuuaaaggcaagccuauuguuuacaucugugacacuuuaggccuuagaggcuauauaacauuuuaauaaaaaucaucacccaaacuccaauucgcucaaacucuugagugcaacaagucaaaacagacaaauagccucaauguaguaucuucagucauuuuuccuucuguauuauucguuagcaauguccacugcugagcaggauuuauaaggagaaacagaauuauucuagcaccagaagaagccaccuugguugucuuuguaaugaaugaauuagauucuaaaacauacauaucuaccauuuaucaugaaagguaacacucaaauaaaaaaauccuuuuuuuuccccuucagcuacuuuaguauguaauauuaacuuucuuccucaacccccuagcucauauaaucauacucacauccuuucauucauuucauuacagacgggaaggaacuaacauauucaagcuuacuucuggcugugucacugacccaacagaggccaguagguccagcauggcaagcauggcuccaggaugaaugaugacugcaucagaacucugcagagaugaaguugucacauguaguuucaggucggcaacauuuuuaggaggguaaacagggggaguugaaacagaaugauaugcaugccuauaaaaaaagaaagaguaaauuugguauugaauuccaaucacauucucuuccucuucaguuacuuucauccacugauaaccaaaaagccuuguuagaaaacaccuuaagguugggauagaaaaaaaggaauauauuaucaacucgaguugauauguguguguguccgcaugugugugggugggugugugcagaccauguaacuauccauuauucauagccuuuauaugauuuuuacuuuuacugauuuacuauauggauuguuugauuaaaaaaugacaccuguaccacaagauguaaagaacaaguacaaucacagugauucaaagcucuagaagaugacaguuccaauaauacgugaugagagaucaaauuaaauuaauucccucagugagauuuuaucuuuugaaauuaccuauauguguuuuaaccuuuccuuagugcaugaguaacacaaucaacaacuaacugggucagcugagucaggguugucucagagucuaagcuauccaagaauaaauauauuuggcauugugggaguuuuccuuuagcuuauuuggaacuacuuucaucuucugcaucuauccucauuaucacugaaaauauucauugcaacuuuuaaaaacuugaaagcaauuuacagaaaaaguuucuaugaauuagaaagcccagccauguccugaauguacacauuucuucucaucaaugaucucuacuuucuauuucauacuacucaucuacaauucaugaauuuugcacauuuugcaucuuggcacuaagaaacagaugcuuguggcuucagccuaugggaacucuuuguuccaaugaguuggucucagcauaauuugccuaaugcugagcucugucacagagagcaaugcaguuuuagcucucugggacaagagcagcuugggaaacagaugcuuuacgucacugauuuaguagcaaagaauuggcacugccgugguuuaaaaaaaauaccguucucuuuuuaacagggauucuaggaaaauguuccgcuuuacuuauaaaaaggcacacaggcucuccuaguuuauuuaaaaggcagcauguccuuuacccauucauguuuucacucccuguauucugccauuuuucauucaaaaagauuuaauuucuaaacuuacuaagaaaaauauucaaaauguguauuaccaacaguuauccuccuccuauauugcucccuuuauucuuuuaaauauuuugauccaucuagaaaaaagauucauaauuuaucuagcauguaucagaaauaaccacugaauuccaaaauuucauuaaacauguuuucauugcauauacacacauacgcauagauucuaauugucuuauuuuaguuauaggccuuccaaaaucauuucuaaauugacagauuugaugagauuuggauuuaaauuacugauacacucaggaagaaaucuuuacaucuuuggacacugaacucuuuacuaacacagguugaguaccccuaauccaaaaaucugaaaucugaaaugcuccaaaauccaaaacuuuuuaagcacccacaugacgccauaaguagaaaauuucacaucugaccuuauaugauggaucagagucaaaacacagucaaaacuuuguuucauguacaaaauuauuaaaaauauuacauaaaauuaucuucuggcuacuuguauaagauguauaugcaacauaaguaaauuaugugucuggacuugggucccauacucaagauaucucauuauauauauugcaaauauuacaaaauccaaaaaaguggaaauuaaaacaauucuggucccaaguauuuuggauaagaaauacucaaccuguauauaauuauuacaguaguacauuuuuuaucuuauauaagaaagcaauauucugaaaaaggaauuacauucauuguuuucaaaccagaaaaauauugcaaacauugcugauaucuaaaacacgguauuuauuaacuaaaauuagguguauuacaacaggcauuauacaaaauuaauucugauuaaaucaccuagguaucaccacagguaucaccuuuuaaauuuuggaauuaugguaagcuuauuaaauggcuaauucccaagcaagaacuaaccauuugcaaagauaggauaaaauuacauuucauaauuugguugcuauuuaauauuuugaccuaaauucucauauauauuuaagauucaucuaccucuuuugggaauacauaauauuuaaauucugaaucugcuuugcuuaacuuaucaucagguauguagaggcacuaaguaauggaucccauguuugaagaauaacaaguacuugccaccuuuuguuccauugcaguuauauucuguagaguucugauuauuauuuuguauucacuucuucuaacucugauugaacacuguucagcuauaauucuguucuauuauuccuucugaauaaucaacaaugaaaaagguuuugaguuuuaguuuuccaaauauaaagucagcuaguucauuuucccccaauccuuaaaauaauuagagaagaaucuccuggauacuacaugucagacaaguaucacaaccucaaaacguccuuagcaucugagaguguuccacaagccauaaaaacacagucaaauuuugguuucuccuuuugccaacaaaacaguauguuuugcuacaagaaaaagaugucuauaagcugauguaauuuguugagagguucuagaaacagugugacuuaaauucuaauuucaagucacuagacuugaauuugugaaguaaaaaacauaauauucuuuacuagcuuaugauucuuaccauugagcaaaauguaugcaagcugaauagaauggcaaccugaaaaugucaacaaucaucuuaguauuagcaugaacaguaucagggacuuucuguccuugggguaaugucaacuuguaagacucauggagaauucacacggauuagggcucaaucaacuagcuauacugauuuagugacaguuuucccuuaagucaaagaccugguuaucucuacauggagcuacacuguaaaugaugacaauauguuuuugauuuaaggccauaaguaacucuuuaagaauaaaaagagaaugcuguuuucccuuugucaaauuaccauuucaauaaauagaaaguucugauguauuuuuggaaauggagucucgcucuguagucuaggcuggagugcagugcggugaucucggcucacugcaaccuccgccuccuucguucaugcaguucuccugacucagcuccugaguagcugggauuacaggugcacgcugccaugcccggccaauuuuuuuuuuuguauuuuaguagagaugggguuucaccguguugccaggcuggucuuaaacuccugaccucaggcaauccacccgccuuggccucccaaagugcuaggauuacaggugcgagccaccgcaccuggcccugauguauuuuuuuaaguauccuuuuaaucuguguauuuuuauuuuguggcauuugguuaauacuuaaaaaggacuaaauguuuuuaaacagcaaauuuuaaggcuuuacucauuuaugauauaaucaccauauuuuuaaauugugauuuuuaguaauuuaaacuacuaauugaaauuauuucucuaauauucaacaauuccuugggcucaugaacaaacauaaauuuucaaacacacacauuuuuuaccucgaccauuuuagcaacagaaaaauacacgauaucaacucaaauuuaucuaguuuaucauuccuugaauuaggaacagcuuuuuuaaaaaaagaaauugcaguuuuuaagcacaaauauacugaacaauccuauauucauuuaagacuauucugaaccaugccauaguuuguugugcaaaguaagcuauaaguguaaauuuaagagaaaaaugaaauuacaucuuuucauauaccuaauauuacuaugcaaauauguugaaauacugaauccguaacaaauacuuuugauguacuaacuccaacuaucuucaaguuucaaaaucugaacaacaguaauaagauuaaaacaacaauauagcagaaccuugggauucauuuuuuaaaagccucaaugaaagaauauuaauguaagaguuaaggacuuauuuuugguuaugaggaaaacaggaaaaguaaugaaguauuuggggccaacugcagaccaugaucauuuuaugugcagguugcaucaaucaacuguaguuuuuaaaaaacugaguagaauuuuuuuaaagguaguuuuaaaaagaucaacuagaucagcuuagagauuuacagagcacugaucaaaguaaguauugggguggguuuuuuacuaacuuuuucaaagcuuagcugugagcauuuuucauaacagcaacauacuucaauugguugaaucugauggagaaaauacacaguuccuuucagugcuaugaaauucauuuuggaauaacaguaaaaaccaacaaaugaucccaacguuuaaaguaaaaaauaaaaaaaaaaugaaaaauaaaaaaaguggaaaaguauucuacuuagagacauuaaguccacauuucuaacuuauuuuuaauaaaagacauguuuuuucuauaacaaaaauguguaguuuaguuaugaaaacaguuggaugacaaaauuauauauguccuucauaguuucauagcaucaacacauuuuacucucaugaaaaacugauaucuuuaaaaucuaaaaacaccccccaaaaccccaaaaguaaaaacaaaacaaaacaaaacaaaaaaaaacugaaaucacaaaacacaaucaacauguuaacauaaauaagcacagaaaaaaaggaaccccacacaaauagagacugacuucucuuauaugaucaguaccuuuuccuggacaaagcugguguaccccaaggagaggggagagaagacucacuugucaggcaaggagggaucuguucugcacgacuacagacaacaaaacagacagggugguuuagagagguuagaagaagagaacaccagguuggcaguugguuaguuucacaagaaaugccaguaaaaguuuaauaaggaacaucuuccauauucagcaggaacaaggaacaagacuacaacacaagcacugaaugaaacagaaaagcaugcucacggcagaugcuuauuccauucauguuaacauuuaacacaucuguuaaacagggugcucuaagcccuauuuuugacagugacuaaaaaugauguauucuaacuaggauaaguagaaaucaagggaaaagagguugaaucugaauacacaaauuuauauagcucauuccuagaacacuacacuguccuguguuuucgauaaauuaacuauacauaugcauuuuacuucaagauagggaaaagcagaaguuuaaugauuuuuuuuuuuacaauuguugucaaagcuguuuggauuuuuaaauguaaauacugaggacuaagaaaucuuguuaagaagcaggaaauaucucaguugauacuucaaagcagauauuccacagaaaaggacacaaaaccuauuacaagcucuauccaauguaguuacauggucuauugaugagggcaguucauuuauuuuauguaguaaaacuaugguaaguuaaaagcaauaacacuuggggcauaaauuagaaguauuauuuucaaagugacaucuucauugaaaacacaguugaagcacugaaaauaagugaucuagaugaaguggcucuccuacaaucugccugagaacccuggauucccccacuguagaaugugucacacuauauguaauuguuuauuuaugugucuacauuuuagcuaaaagauagcaaggaccaagacagcccuguguagagcugaauccucaaugccuagcacagugacuuggcaugcagcagcuuuuuguuaaguacuuauuucaugaaggaaugaguaaauauugagucugauggccucuugaacuugacgguucaagacacugacaccucucuuugggaacuauaucauuuuuugaggaguaugauauguggagaaugauggaguacgugucuggaaauaagaauaaucauaaugauguucuauugauaacacauaucaauaaguccagaugcaccuuuugaggcuaaaaagaaaaaaaacaacaguaaacacuaucauuaaaggaaacuucauagaaacuguuccaauaacugcaaugagaacuaauugaaccugaauuuacaaauaguacacaggcuuccaugcuaaaaaaaaaaaaaaacaauaccagagcaagaguaauauucaaaaauaaagugauacacuucaaacaaauaggagaagagucaucuguuuucauauucuuuuggauuaacucauaauucaagucuuaauguugaagucaugcuuaguauacacccuuuaauucagaggacagagcagagccauaccugucaaaagaaucuguggcuacuuuguaaagauaaauaaaaaguuuacugcagugccguaacgugggugacacugauucuauugagauuacaucuuccucuaaaagucuuugaaauggcuguguauuugaggggaagacauucauggcgcuuauuuuucuuaggucugagaagcagccaagaaaucgaacagcaucugccaacuucucauacugaaucucuguuuugaagaaaugagaguuggcuggcucauagcgcauugcugcagucaacgugcagaacacagugugaagaaguucaaacacuugauucugguucacuuucucccagccauucuuggguggacagcucaaagaucuuuccauagcaacgagcaaggauguaauguacacaaauccuccaacuuuccuaaaaacuguucuugaacgauggcuuucucgaaggaccgacaggagggccuacaggagacaaaagaaaaaacaaaugaaaauacacauaauucaaaaaaaaaaaaaaaccacuaugcauguauauggagguuguacauucugugaaucugacauguuuuuaucauuuacccaauaaacgguccuauaaagcauaucaaauaguuugcuaauuaaaaaagccacauuaaaugcugaagguaauuuuaggaaacacuaucacauauuucuuugauagaauaaagcuacauccaaauauuggcugaaaagcuuuuccagagucuuuaacugauuaugacaucaaugaauucagugacuuuacaaaguaaguaaaauauaucuucuagucuaguuuuacacaaucaugagaacuuaugacuguguguauacaaacugauuaauucuagaagggaucacagagauggucagagcagccaagaucugaggucuuuugucucacauaaagugaccauauucaugcuuuagaaagcagauucacuuuagaagacuuauuaaacauucucuuuugcaaaaugaacugaagccuaaggguugaaaguauggcuuuucccaaaacagcuguaagcuuuaaaaaagaaaacaaguaaauaaguaaaucaaacauuuacuuucugaacugucauaauuuuaacuuagcuuaugauuuuuuuucuuuuaaaacacaaacagagucaugcucuaucacccagcuuggagugcuauggcaugaucuuggcucacugcaaccucuaccuccuggguucaagcaauucucgugccucagccuccugaguagcugggauuacaggcacgcaccacuaugcccaguuaauuuuuuguauuuuuaguagagaugggguuucaccauauuggccaggcuagucucaaacuccuagucucaagugauccacccaccucugccucucaaagugcugggauuacaggcgugagccaccgcccuggccagcuuaugauuuuaaaaaacacauuacaaaaucaccuaauauuuuaucaggcacuugcuauguacuaggcacucuaggugcuuuuaugcacuagcuuauuuaauccuuucaacaauccuauggguaagguacuauuauuauuuccacuuuaucgauaaggaauugaggcccaaugugguaaaauaacucuccaaagacuauacaacuuauaaaaugguaaagguagaauuuaaaccuaggcagucuaauuacccuacuccugcacuuaaucaugacauuaugccccaaacagcaagcugaaaucuuuuucauggauacagugggcuccuuugcccucuguuucauuaauuguagcacaauggguaucuacuauuacuuaagauauaauuucuaaucuguccaaucaucgcauuugaaaaagucauuuuuuuuuaaaagaucucacacauuucuaaugguaucugaagaaugaaaaggcuacauacagguugaauauccauuauuuaaaguguuuggcaccagaaagguuucggauuuuggaauauuugcacauauacaguaaguuaucuaaacauaaaauucauguauguuucauauauaccuuauacacauagccugaagguaauuuuauacaauauuuuaaauaauuuugcucaugcaacuuuaccaucacaugaggucagguguggaauuuuccacuugucagcacucaaaaagauugcagcauuuugaauuucagguuuuuggaugagggaugcucaaccuguauuaauauauuagucaccuuuugacauauacuguuucagaaguuaugaagauuucauuguucacaccuauuccuuaauauuuuaaaagacagaaaauaugcaaucuguauguaaauaaaauauaaaaacaauguuucuuccaauagucuucaaucaauaaauuuacauuuuaguaucugguaacaauauaguuaguuucccuaucuugucaaauuuaauaaacuauaugaauacuuaaaauauuucauauuaacaaaagacuuaacacagacauguaugcgcaugcacgcacacacacacacauacacuccuuauaacacaggcugaagauggcugaacucaggaugcuuggggucauauucugacuccaacauuaaaaaguauuuaaccaucccaguuacuuaaccuuucugugucacaguucccucuuauguaaaauggaaacaacaauaacuaaccucaaaggaaauacauguaagaacccuuagagaagugcccggcauauaagccuaucacuaucaucaauuuucaaaaacauacugggagaaaaauaugacaaguauuauuuuauagaugaggaggggugaguucaaaguuaaaguaacauguacaaaaugcuaucacugguuagaauuaugacugagguuagaaaaacugcugcuuacgaaucuuaguccaauaauuuauauuauguacuucuggacaggcccaccuccuacuuccucaaaacugguaucuguuguugcucugacauuaucccaagcacaaucucaguauucgaaaaauuucaaauaccaugaauaauguaacuucccacuuacaucaauaaaugaugacaaguagcaaacaccaaagcugcaaugagaucuggaggcugcuugguuaauuagacaaaaucagcuauauauuacuuauauuugcauaaauacaauucauacaauucaaauuugugcaucaggagaauuuccaugacaugucauggaaugucagguuuguguauaaauaauuacaaauuaaaugacauaguucugugguauaugucaguugaauggaggcacuauguaauuacaaauuaaauuacauaggucugugguauaugucaguugaauggaggcacuaagaagcaauucugaaugaaguaaaaauggaaauugaaacugagaacccacauuuucccuauuggcucucagcgcuacuuuuucccuucaaagcagaaugccagagcuagcucauaccggcucucaagaggucaagugccauauuuucaggaauuuuguaagucaguuguuaaacguacaaucauaauuaaaaauuaaguaacaaauuuacaacuaaguauuuuacagacaaaauacucaaaacucaucaguuucuaauuauuuucugaauuuuacuauuaucuaugcuuuuacguaucugcaugaggaaaugcuauauaaugguguacuacugugcaacucuuuccaauccacauucaguggcacauuaguugacugaauaggccacaaugugaguauuuauacccuggaaaucaguaaaugcaaaauaucaugacucucuccugcccucuuccagccugagaaucaguuacuaacauuaaccagaacacugccucaaaauuacgggucagccaauuacuucuuguuggcuuuacuuaccaauauuuaaaaaauccaauuaauaagguaccaaaagaggagaaaaugguauguuaaaaaaaaguuggcaaccuuagcaucuuuugaagccaucuauguucucccaacaauuccuucaaauauaaaauguucuucaaauaucgacacucauguggauauccuuuuugucuaacagauaaauugcggugagauuaaucuugcuuuuaagaugcauauucaaaauugucauuauacaccaucaaaacaugaugaaauauaugacagcauaaggaaagaaaugcuauuuuuucauuaccaaugaaacauuuaauugaauaaaaguaaaagaaaauagaaguaauaacuacuaaugucuguggcuggaaugggguauguaggaaacuaguauaugccaccccaaaauacgccacuauggcauaaggauuauuuucaguugaaggcaauugggaagaaguagauauaagaaaacucucugccauccccuauuugaugaagucagacccuucccagccuggagacagcaaagaaaugcacacaacaaacuaccaacuauucuuuaucuaccauuuauuugccuucccacaaguugauaucccuagaguccguuuccuuuaugucaucauuucucuaaaaauguacuguucuuugcggagaaugcuauacaguggucccccuucucugcaguuuugcuuuccuucguuuuaguuaccugugcucaaacuuggccuaaaaauauugaaugaaaaauaccagaaacaacaauucaaaagucuuaaauuguguauuguucagaguaacaugaugaaaucucacacugccccacaccacugugacucaucccuguguccaguguacauaugcugcaaaagccaccugccuguuagucacugagcagagucucgguuaucagagcaacuguggagguuucccagucccuguguucaaguaacccuuauuuuacuuaauaguggucccaaagcacaagaguagugacacuggcauauuguuauaauuauucuaucuuauuauugguuauuguuguuaaucucuuacugugccuaauuuauaaauuaaauguuaucacagguaugaauauacacaggaaaaaaacauaguauauauagcauuccauacuaucugcaguuucaggcauuucuggggggucuuagaauguauucccccgaagauauggggggacuaccauacaaaauggaguucuaagccaccucuuugagaauuaguuaucuuucccugguuguuucccacgcacauaugagguagacauguuaauaaacuuguuuguuuuucucuuguuaauuugucuuuuguaacacuggucuguccuaguuaagaacucagcagguagaggaaaaauaauguuuuucucaucuacaggugagaguacuaguagaggaagugaaaggagauggagaucgggucacaagggccuuggaagcaagguuaaacacacugguuugucuguuauuauuuuaaugucauuuuagacuugaagaaaaacugcauaaauaguucaaagaauucacagauauccuucauucagauucuugaaaaauuaccauuuuacuuaauuucucucuuucuccccuucccuuuuccccuaaaagcuucaguguuuuucaaaaaaaggaauucucuuacuacucacaguacaaugcucaaaaucagagaacuaacguucaaacaauacaauuauuuuaucuacagaccuuguguuuuuuccaaaucccaauaauauccuccauagcaaaggaaaauacaaguucauguacuauauucaguagucacuucaaccucuacuuuuuggaacaguuccuacgucauuuuuaauuucauuucaucuccuuuuucuaagaguuuaggccaauuauuucauagaaaguccuccaauuaggauuuaucugauguuuucuaauaaucagauucauauuauauacuuuugggaggaaaaaguacaaaaaugagcugaauuuuucucagugcuuccuaucaggagguguaugcuauucaucuguccaucacuggcaaaguuaaugcugaucauuuaguuacgguaggguccauuguaaagcuaauauuuuagcacucgaaauuaagaaauaucuuuuaaggauaaaauuuaagaguacgcaaaaauccuuucacuucuaaaacuuucaucuacuaucuuuaguauccagugaugaauuuuacuugaaucaauuauuacuacgauaguucauaaauugugauuuucuuugacuuuugacuauaaguaagaguuuuuccucuucucuauuuguuugauuguacuuacuuaauugcuuauuuucuuugaucucuucuuuacuuuuucaaggcuaacugaaauguuuuaggcucauuuuguuucuuucucugcccucguccuggaaucaaggaggccugaauccuuacaacggaaaauuguauuuagaaaccuugcaucaaucaauaaauuaaagaacauaaauuuuaauggacuucuuucacuuuacucagauauuauuuaaauacaagagcagguuuuuagucacagaaagagaaggcuaugucucuuuuuauuaaaacaacuauuauucacagcagauaagcugaaagcacagcuuuacaaagagacuacauggguucagaucuagacuccucuaccuacuagacagacauauagaacuugggaaaauauuucaaccagucuguguuucaguuuacaguauguaaagcagggacacuaauaguauuuauuuuuaucauaaggauuaaauaaguagaugcagauaaaugcauacaacaguacuaauagaaagcagucaauaaauguuagcuacuauuauaucuggaacuuggaaauuuuuaaaauauaucauuuaauauuuaauagucuacuuuuccauuacuccuuacuugcauuacuaaauucacuucuaaaugaaagugaaacauucgauuauaguuugauucuaaaaauuucuuacauaucauuucuuauaauaucaauaaccaguaauaugggagaaugugaguguauaaaucuguauaaaacaauggugcuguggaaauaaaacggguauugaaaucugggggucgguucuacuaauuaaaagucacuuaagugaacaaaauccauguuauaugauuucucuaaaccuaaguuuucucaucugcaaaacagggugcuacuuaauuuauaguauuacuaaggaguaaaugauaaaagcauauguauaacuccugguauauuguuugauaucuacuagaauauccauuacuuacauacauacauauaugcaugcauguguauaaaaugccaaaucuaacauucauuucacagaugcauaacacuaugagugaauuuaacugaucagaaaauacauauauuuaguauuaauuaagauccuauacuucacuaauauuuaauuuaagaguuccaguaagucaagauaauuacugaaaagguuuaucagcagaaguaaaauauauacugaaagacauaaaugacuggaguuuuuccaaguuccuaacguguacaaaguugugagguuucuuggguaauuuggauuuuuuuuaauuucccugucucuaacuuaaauacagaucaucuaaaaauaaccacagauuuuaguaguaaaagaagggaaacacauuuaucaaacuuacccuuaaaauaucagucuucaacugcaauuccgucgguggggcugaaugcauuagccccaggagagugcccaugucaucguccccauuuggggagagcaccagcuguuggauagucaucaaggcaugcugccggcauugaggguacuuuacuauauuaugugcacaucuugcaccuccaaauucucgaaaaauuccuugaaggaaggagaaaaaguccaacaauggcuacuuuaaaauauucugagacaagucagaugaauuaacauucaguuauuuuuuguagguaaaguaacucauaauaauguaaauaaaaccuacccaacuauuucaccuuuuaaauuacaauacaaauuugcacaguggguugucagcaaagguauaugcaaauuuucucuacauuuccuuaaugcaagauuaaugccgugauauguucaccauguccaagcucucaaaaucuagaacauucacaagucucuuaggcagacccuaggagacucucuauuguaaucaacuuauguaaaaggcuuucagaggaacaauagccuaaauaaaggagauuuaaaugaacauggcuuccaaaauaguagcaagaaaggaauggaauaaauuauuccaccaugggaaaaauuacaaggaaccaacauguuuuguugcacagguagagcauaagaacaaaaagugacaaauucuguaacagaaguaugugucauuguuacugcuccaaagccuuuacacagauugacuuacuuaauacucauccccuaccauauagagguaaggcggucaaagucauacagcuaguaagcaacagaaaaggauguaugccuacauagcccagcucuguaagccugugcuccugcucacaagugauacuguucucacaucaaauauuaauaucauccuccaguauuaaaaaaaugggcccagugacugaaaucacuaauuaguauuuccucuaaguaauucuucuaucccuuacguuuuuagggcaucuuguuuauaucucuauuaugguuuauaacaaacagucuuacuauuauugcuuauguuuggucuuccaugacuacuggauuuucuccugauuuguguuucaauaaacguuuacuaaaacaguguauucugcuauagcagccacuguccucucugcuuaguggcuuucuauuuguuaacuuuauaaaaauuauaagaucaugaagucagucuaagccaugugcuugagauucagcacauggaauuugugacauccuuucauuaccugaaggccuguuuaguuaccuccugguugucaguuaggacccacuagauaaucauaauggcuaauauuauuuaaauacuuaaacuaugaguaaaguacuguuuuaaaugccuaacaucacacagcuaguaacaucuuucauacugggaaaagaaaaacugaaaagaauuguaugaaauuguuuggcacuuugggauauguacuaagugacuuuuagucgugcagaguaagcucuccaauuguccaaucucuuccugugcaacuucuaggucgucucaaggaaagcuaauuugcuaagcaaauuccuguuagucuaucuucauuauguuucugauuaucucaguuaacuaaaccuaguuaguggaaauaagauuaugcauuaugccauagacaaaauguuacuauaguauccacuaaaauucaucauacucauuguuucaauuaccuguuaaauucauucaagucuaucuuagcauuugccaaauuuguaucagacuaauuacuucuauaauuaugugucuacauuuuucuucacuagauucuaauucccagggagcaagaaugaucuuaccuuagcaucuagguguuagaauaaucuaacaccuagcuagcaugguaccugggauacacaauauauuuuaaauaugaugaaugcugaguuucccugcauucaggcaaacagucaugcauuugggcaugggguucauucauccauggcuuuccauaacacuuaaaauauauuucaagcuccuuaccauggccuaaaaagcucccuaugauuugagcccagccuacuaaucugaacucauuauuccucucaaguuguacugaacuuauuaccugagaguuguuugauguuaauuaaaaucucaaguaaucuuuuuuaaaaagcaagagugauauuuuauaaauauaguuagguuaucuguuaaugacagguagaaaaguauaaaagagaaauugagaccaaaauuaaacaaaauauuuaguaaaguuaauuaaccuuggagagauuacguuuuauuagagaaucauuguucaguauuuccugaagguuguaacauuauaauacucuaacuuguaguacuaaaaauauucuuuaaaucacuguguaaagaaaauauuuuagaaagaauuuaaauagcaacuuauuugaguaagaguguaucaauaaaaaauuagaagaauacuuucaacacaagacacuauaaaaagcaauuuaaacaucauuuugaaauaguaacaaucuuauauguuuugucaucaaggugcuccugauggucaaaagcacugcauuuuuagggacaugacggguaccaucacugaaucaauaguuuuuucucuaaagugacaggaagauuucagaagcaagaauaaccacagaagauguaaucagugguaaucucccaaaguauuugcuugcagcuuuuuaaauuaccugcauuuguguuugauccuugaagaagcacugucaaggucuccauaaccaauaaagccagguguuuuuggucuucaacugaacuauuauuucuugaguccccuaaaaaaagguucaaagguccaaauuacaaaagugauaagcuuauuuuuucuugauuccguuuuacuguaauaauuucuuuauuucuucaguauucaguuuuaccccuaauaggacagauauaauauaaucuuuaaaacgaugcaugcauccaacauuuggcaaaaguaggcucaaaaucaauauuaacagauuuuauuucgguaugcuugcaaguggccguuauccaauaaauauuaaaaaugaaaaugcaaagguuaaauauauccucuucacagaggguuuuccuaauaaaggaugucaacaggagaacgcuagauuuugauacaccaaaaagagagaaaaguucaugaauaaagcuaucuauucaaccuguauuaauucacauuuaauacuuauuaauugccagauacuacuguacuuuuaucagauuuaucagagagguacccaaugauaauacauuguguauauaacaucauuaaauauacguauuugcucuguacaauaaaaacacauugaaguaacuauacauuuaacuauauuuauuaguuguaauuaauaacaaaucugauuauuuucagaagcuuuuaaagcucgcucuuagaagcacaaggcaguagauacuagucauguggaucauacauguuuucccucaguuuuuaccuuccuuuaaacucucuccaauacacucacauaauucuagcuuccuccuccucaauuaccuaacagagguugaaugaaccuguaaauuuuggaaaauacaguucacuaauaugucacaauaaugcacauuaggaagucauugaaaucaauaaccaaagaaugggaacaagaacaaaaaauucucuguuuugaaccccuuuucaaauaaaaauaaaauuacagacaauacuuuaccuuguucauuuagugccugaguuggauccuucaacagggcagcauauuuaugcaaaagguuuaccaugaccuccaaaaggccaaccucccugaacacgucuuuaaauauguagucaugucuuguaaacuuaagaaguguuuucauugcaauaaugcuacagugauaagaagagcuagauuuuaagaggauacugacacuaauaaguucuuuacaagguauauaauuuaagcuaaaaacaacaaacuccagcaucucaaaguauuuguuuuguacuucugggaguuuagaaaucuucucugcaaacugugacaaugugugcugugacucuaggaugaaguaauuggcauugucagccauguaaauauuugugauagcaucaaggaugauuugggcaaggaagcugguuuuugcuuuuaaaaaugcauucugaagaacugcaaaggccuggacguuucucacacugugaccuagaacagaaaagaaaaacauaaaaguagguacuaugugauauuuuaaugauggcaaacuagucuguuuaaacacaucaugaauuauaacauuuaucaauuauuuacuaagaacauaacccuguuuucacaaaaggucuuauuuuucuucaucagguucaaaucauuuaauuaaaaauaacaaugauuaaaacuuuaaugcauuauuaugaauauuucaauucaaaaauaguguauguugaaaaguuagacuguuuuagagggaauaaaagcauauuauuauaaacauccaugcuucagaguuuagagugguaguuuuauuaucuaugagauugauuuugacuauaaggacagcugucucucaauuuaaaaagacuuugaggcugaagaaguuacaggccugagagcagcaauaaugaagcaggaaaacaggaggggaaaauuuuucuaaauuccaguuuuccuuuauaauuagaacacugugauuuuuauaaauuuuaagcuggaaguuuguuuuguuuucuagcuaacaguacaauuucuucauauagacauuuguuaaaguaauuuauggccagcuauucaaacguaccaaauggggaaaaaaaaacuuuauacauggcucuggugaggcaaauuagugacaauaauuauaaagaaauuaagacagaaaguucuauuugaaguacaugaaaauaagcagcuugccuguaaaaggaguccccagaacaauaccuauuaggaguauauggcauuuccaaguaugaccaaaaaauuaacauagugucugacagaauaagcuggauuucagaaagaguauaaaccagagaacuaccaaaauuaguaaauggagcagaaagaacacucagggcugggggcaguagcucacaccgguaguccuagcacuuugggaagacugccugaggccaggaguucuagacuagccuggguaacauagcaagaccaccuccauuucuacaagagauuuaaaaaaaaauuuagcuggggaugguggcaugugccuguaguucuagcuacucaggaggcugaggcaggaggcugaggcaggaggauugcuugagcccaggaguuugagguugcagugggcuaugaucacaccacugcacuucagccugggcgacagaaagcaauccugucuguaaaauaaacaaacaaacaaacaaaaaagaaugcucagaaaucuugacuucgacauuucuuaaaaacacaggaaauuuaaaaaaucuccagccuauauaugauuucaauucucuaauuucuuguuuauuacauguauggcaaauaccaaaaauuuaucuuuguuuccugugucuaucagucuaucuaaguuuguuuuuugguuaccuacauaauauaaaaaguaaagaugucuggaaaagaauaaucaacaucucagcagcuuuucaaaaaaauaguucaugugauuauuaauuuauauggaaaaucaaaagacuuagaauagccaauaugauucugagaagaaagaacaaaacuggacaacuuaagugaccugauuuuaaggcuuauuauaaagcuacagcaaucaagacagugugguauuggcuuaaggacagguacauggaucaaucaaacaaaauucagaaagugucucagauauauguagucauauaugauauuuucaacaaagggucuuggcacauucagauacccauauuaaaaaagaaauccuuacuuucuacccucuaugauaauaacuuaaaauguaccauagaccuuaauuuaaaaguuaaaauaugaaacacuggauaaagaaaaaaucagaagaaaacauuagagaucuuugugaaucugaaguaaagauuucuucaauaggagaaaaacaaucacaaaauauuauuaaaaugaaaaacuggacuucaucaaaauuuaaaacuuccauuucucaaaagaugcguuaaaaaaaaaccagcaagucaaaacuaagagaacacacuuccaaaauacauauuaagggauaaagaacuuauacagaauaucuaaagaacucuuauaacuccaguaaaacaacccuaucaaacaaugggcucagagaucugaaccaagguagagaaacagauggugacaaagcacauaaaaaaugcaaaacuucauuagucaauuauaaaaaugaaaauuaaaauaacaauuagacauuauuacauacuuaguagaaugucuaaaauuaaaaggacuaacaauaccaaguguuacugacagcgucaagcaacuggaacugacauuacugaugugaaugcaaaaauuggacagccacuuuagaagauacucuggcaguuucuuguaaaguuaaacauacauuuaccauaugaucuagcacuuuaacuacucuguauuuagcuaaaagaaaugaaaacguauguccacagaaagauuuguuuuauauaaauguccacuguagcuuuauuccugauagucaaauaaauguccaucaacuggugaagagauacacaaauuguggacuauccaaacaaugaaauaauacccagcauuaaaaaggaacaaacuucugauacaugcaauaacauaggugauucuccaaaguauuacaauauucuccccauuuucaugguuuuauuuucugugguuucaguuacccaugguuaauuacagucugaaaacauuacauacaauaagauauucugagacagagugcucaugcucuuaagagagagcacacauuuacauaacuuuuauuauuguguauugcuauaauuguuauauuuuacuauuauuguuguuaaucucuuacugugacaaauuuauaaauucaacuuuaucauauguaugauguggaagaaaaacauagaauauauagggguuugguacuaucugugguuucagguauccauuggggaccuuggaacacauuucccccaguuaagaggggagugauuagauagaauccagauacaaaaaaaacuauauacuguaugauuacaguguauuaaguucuagaaagggcaaaacuaaaacagacuagugguugccagggcaaggguuaagguggggaggacugacugcaaggagaacaaggaaacuuucuagacggugaaaauauuccacaucaugauuacgguggugauuacacaaccauauccacuugucaaaacucaucaaauucaacacucaauugaguagauuuaauguacacaauuuacaccucaauacugcuagaaaauguaaaagacaaccuauuccacauucuuucuauaauggaauacagcuauuuccuaugauccuugcaauaaugcuaaaaguaggccaugagaaacagaaaauuuugaguuauacaggaaacucaaaaugauguagcuucacccauucacuuuauagaauauuaugccaauuuuucugaagaagaaacugauguuuagaaaaguuaggucacuuaugauuacauaaauucugacucuuagggcaucauccuuucuagauagccuuacuuucauagacauuaugucacuggauucucaccauaacccugggaggugcuagguuauauaauuauuaucccuguuaugaaugagacaaaaccaggcaaugauauaugcacaagauuaauuuugcugcauuauuacaaaauuaaauuguugugauuagcuauuaugccaauaucaacaucacauugauaaaccaaaugaaacaacaauaaaguauaaaauaggaaguacauugcugcaauauuuuuauauuaauucauaggaagauuuaacuguagaaugaucaagcuggaaucuauaaauuagaaauuuucugagaagucucuauuuuuuuuuuuuuuuuugcuuuuaagagaaagggggucuugcucugucacccaggcuggagugcaguggugugaugacagcucacugcagcuuugaacucccgggcucaaaagauccuccuguguagcugggauuacaggugugaauugccacacuauuuuuuucuugauaguaaauaaaaugaaaccuuaaaucacuuagggaaacauggauuucucccuauuuacugcagagacucauuuaaaagguucuaaacaacuuauguacugagggcacaucauauuacacugaugacgccaucuauuuucacugauuauagacuguuaauuucuaacucauaacauauguauuauaaauuuaaauauguauuacaaauuuaauacauaacauauguauuauaaauuuaaauaaccagacauguuuguauuuauuggcugguuaaauuuuaaauggaaauaucaugauccuauugaauacuuaguaagugacagucaugugaauaaaaacuauuagaggccuccaggcucagguuacuuugaaaugauuacugugcauuuuuugaaaaauaaaauacauaauaaaacuaacuugcauaaguauguaauuaaauauuauuaggauccaaauguuuggaaaucuagacuauaaaaauuuauccuccgacccaaaugaaauaauguaaccuccguacauagauuuugcuuaguuuuaaauaaaauacaagcaguuauacuucaugcuguccauagucagccgcuguauccauggguucugcaucuguggauucaaucaaucacagauggaaaguauuaaagaaaaaaaaaggugugguugcaucgguacugaauauguacagacuuuuuuccuugucauuauuuccuaaacaauacagcaaaauaaguacauagcauuuacauuguauuugguauuuuaaguaaucuagagauuauuuauuuaaaguauaugggaagacguguagguuauaugcaaauacuauaccauuuuauaucagggacuugaguaucuguggauuuugguaucggcaggggguccuggaaccaaucccccacagauacugagggaugauuuuaugucuuaauagguacagagauuaggcugaaaauugaguucuauccacguaaaguagaaaugcacgaagugccaacauucaaaagaagcauguuuugauuaaauuguuugaauguuaaaaaauacuguaauauaaaucuccuuguuugauuuuauauuuuuauaauauuauuuucaaguauuugaucugcuagauuaaagguuauuacuuaagaaauacuuaaaccauuaaaaaaaaaacaagcuuuaagggaaacuauauuacuuuuauauauauaacagaaacaaaaaguaauauaccaaaauaagacaaauucauucuuucucuauuucucucaguagcacagaagggaaaaaacaagacucaccuuugccugcaggcugagguacugcaaauccaggcaauaaaaagggugccccugugguaauaccagcugguuuuaguucacugacaccauauguuguuagggaaguuaucagauuaaccagaucuuucaaggcaucuuuggauucugccucuuuugcuuguuccaaucuagaaaaguaugauuuagaaaguauuuuuuuucucuuugguuguguucucagauuuaacacaaaguauuuuucaauuuuauaugcaguaaauaaauguauaaaguacucugggaaguacugaaagaacacuggggucauuagggaauuaucuuuuaaccacggcuuuccugagaacacaaaauggguugcaacaaauacccuuuaaaaaaaaaaaagauuuauuggguauuuccccuuaaaagaaguaauuauucucauuaaaauaaaccuggagaaugccaaaaaguaggaaagaagaaaaaguaugauuagccucacaaacacauuuaacauucuuauucuuaagcuuaucuuuuuaauaugaaaaguuuaguuuuuacaauauuuauucucauacuauauacaguauguuguaaccuauuuuuuuccuuuacuagugcuguauguguacuuccacacauuaguguaagcuuucacagguaagcuuucaggggccaugcagagccaaccacacauuuggggagugagaguuccaacagcuggcauaaugcaaaaagcacuaauaaauaaaaucuugucuacaagauuuggauuauaucuuuaggaucaauaaacauaaaugaaauuauuguaucagauuaccaacauuuuuaaggcucuuaauaucuugccaaccuacguucucaaaggauaaaucaauuaauaccccucuaguaaugugaagugguuauuucaucaacuuucauauguauuuauaaacuugcauauauaugcaaaaugauauucuuagggguuaucuaauaucaacuagcagcaacuagguuaaauugguguuagaaauaacaaguucuggccaggcaugguggcucacaccuaaaauccuggugcuuugggaggcuaaggcaggaggacugcuugaggcuagaguuuggcaccagccugggcaacauaggcucuacaaaaaaaauaaauaaaauauagcuggguguagcuacuuaggaaacugagauaggaggaucucuugaguuaaaaauuauaucgagcuaugauuaugccacugcacuccagccugggaacauaaugagaccccagagggagggagggagggagggaggaagggaggaaggaagggagggagacaaguaaguuuacaaaacaguggugucuuauaauagaucaaaugauuuaaaaauaauuaauggcccaggaauagcugcugaaaaauggugaguaucuucuucuuaagaaaaucuguaaccagccacuuucuaaguaugugcacgaaccauuugaaauggaaaaggggguuaaguaacacauuuugaaauuauuaauuuguuucauauacacaguuguaagguuuuauuccaucuacauaauuauucuuauuaaguacauuaauaaaaagacuagaaguacuauaaaauaaagaaccaaaaauauaauuaagaagaguuuauacuuuaagaagauauuaauuaguuuaucuaaauucuucucccucagcuacuaaagagcagauuuaugcuucauaucuaaccucugacuucaucauguuugugcccugcauuuggcaauuuaacucuaaauucacuuuuccacucuguuggcagaacaggaauaaaaagaagggaauaggccaggugugguggcucaugacuguaaucucagaacuuugggaggccaaaggauugcuugaggccaagaguuugagaccagccugggcaacacagcgagauccugucucuauggaaaauguuuaaaaauuagcuggguguggugguacgugccuguaguccuaguuacuugggaggcugaggugggaggaccauuugagcccaggaauacgaagcuacaguaagcugugauugcaccagaaaaagaagggaguaaagccagguauacauuaaauaaguguuuccuuaauuugcuuuuccuauaaccccaaaucacauuguuuucuuugauaaaaaagacugaguagacauuuaaaauacauucuuaaauugagcagucuuaccuaagcaagagaucacaaagaaaauuauauccuugccauauccgaaaaucauccagaaguguuugggaaacaucgcuggaaucuuugaggaaacaagaaagcccagcaaacauuucgacaauuucuaggggagacaggucaucugauugcugcauauucugaacacauguagauaaacacucuuucucuguaagaauagauaauuaaauaaauaugcauuauuccugacaaucgcuuaaaaauuuuuuaauuguuaacuguuguuuaaugaaacauuaaauuuuaacauaucuguaaaauacuaugagauaaauguaacacauucuaaaagucaauauaagagucauaugcauugggaaagcacugccucuagguaguaaacaaaggauaauacagaaauguguugaaaaauaguugacauguauguaccugucauuuuuucacauauuuugauguuuuaucauuaaacaaauggccacugccaaaugauauuuuugaucuuuuauauugauauaguaacaagaugaaaaaagcaaaaaaacuaucuucuaaguuuaagaagaaaaaucuaguaauuaguuaaaacuuuaaguuagagagaauauauagccuggcuaacauggugaaacccugucucuacuaaaaauacaaaaauuagcuggguaugguggcacgcgccuguagucccagcuacucgggaggcugagguaggagaaucacuugaacccgggaggcagagauugcagugagccaagaucacgccacugcacugcacuacaaccugggugacagagcgagacugucucaaaauaaauaaauaaauaaauaaauaaauaaauaaauaaauuagagagacuauagaccaaugagauacagaaauacuuuaggaaauacaauuuuuuaaauuuuauuuguauaauauauuauuaguuuaaaacacaguuauaucuuaucccugacucugaggauuuguagcauuucaaggaagacuuucacuuucuuaucuuuggugguauguauuuguauaaagaaacucacuguuacauaacaaaagcuaagauuuaacagaggaaugggaggaaauguguauuuaauaacugacucauauauuagguacuagcuuucacauaugucacuuaauaaauguaagugaacaaauugguguauuaauuauuuugaaagaguuucaggacaguaauaucagguaguucucaacuugaugauuugacuuaagauguuucuacuuuaugauggugugaaagcaacauguauucaauagaaacuguacuuuauguaaccauauaagcauuguuuuccacuuucagaacaguauucaguacauuacaugagguauuuaauacuuuacuauaaaguugauuuuguguuagaugaucuuacccaacuauaggcuaacauaaguguucuagcuacuuucaggguaggcuaggcuaagauaugauguucgguagguuaaguguauuaaaugcguuuucgacuuacacuauuuucaaauuaugauggguuuauugggacauaaccccaccauaaauugaggagcaucuguguauauaccaaauaaguagauugcuugagaugcuaaggcaauugucuccuauacagacauuuuaaaagauagcugaauauuacauauacuuuaaaccaacagugucuucuuacugcugauaaagaauccaccuaauuccaucuaugcugcaugacagauuauuaccuaguaacuuaugcaauaucuucagaaagacugguuacaggauaucaaaaaaacuucuuuuuuauucaguaaaagaagagagaagaauaggcugugacacagaacuuucauuacauuaugauugaauuuacacaacaaugaaauuuuuuuuaacuuuuagaaauauccauuguuggccaggcgcaguggcugacgccuguaaucccagcacuuugggaggcugaggaggguggaucacaaggucaggaguucaagaccagccuggccaagauggugaaacccugucucuacuaaaaauacaaaaaucagccagguaugguggugugcaccuguaaucccagcuacucaggaggcuagggcagagaacugcuugaacccgggaggauggagguugcagugagccaagaucgcgccacugcacuccagccugggcgacagagugagacuccauccaaaaaaaaaaaaaaaaagaaauaucuauuguucagaacuuaugaggagaauguuuuacauuugaaaugccccacagaugaaaaaaaauauuuucuuuucucugggcaaauuuauuuuuuauuuuaaagaacaagcuuuagaauacugaaagauaaaaauaaaucuauuauuaaaugaagaaaaguggaagaaauuuagaacacuuaaauauauaaagagauauucaccaugaauauacuucacuacauugacacuaagaccaugacgagauauggucaugaggacuucuccagcacucuuucuccaaggcagguuauagggagggcaccaagagguuauugcacugaauagaagcuggagaucaucuuucugagccagcuccuccgcaggggaaacaaaacugcacaguuucacuaagaucuaaaaaauaaaacaaaacaaaacaagaguguauaagcaaaaaucaaauaaucugauuuaaaaaugggcaaaugagcugaauggacugcucucaaaagaagacauagaaauggccaacagguauaugaaaaaaugcucaacaucacuaaucaucagggaaaugaaaauuaaaaccacaauaaaguaucaccucaagccaguuagaauggcuauuaucaaagauaaaaaagaacagaugcugguaaggaaguagagaaaggggaacuccuauauacuguuggugagaauguaaauuaguacagccauuaugaaaaacaguauggaggauccucagaaaaguaaaaauacaacuaccauaugaucuagcaaucccccuacugaggguauauauccaaaggaaaugaaauucguaugucaaagagauagcugcacugccauguuuacugcagcacuauucccaauagccaaaauuuagaaucaaccuaaguauccaacagaugaauggauaaagaaaacauggaauauauauacaaucuaauacuauucagccauaaaaaagaaugaaauuuugucauuaaaggcaacauggauaagcuuggaggacauuauguuaaggaaaauaauccaggcacagaaagaugaauauugaaugcuuucauucauauguagaaguuuaaaaaguugaucucaugaaaguaaagaguagaguuuugguuaccaaggguggauaagggaaggcgaguggggcaagcuaaaggcugguuaagggauacugaaguauaguugggaguaaguucuaguguucuauagcacuauagagugaauauuauuaaaaaaacaauguauuguauauuuuuaaauagguagaagaaugaauuuuaaauguucccaaugcaaagaaauaauaaauguuugaggugauggauauauauacgcuaguuacccuugauucgaucauuacacauuguauacacaaaaauuauuacacugugaccuauaaauauaugcaauuauuauuugucaauuaaaauuaauaaugaaaguuuaaaaaccguaagaguguauguaaguaaauaaauggcugauuauguuaugacaguaaacuaguccuacuuauaucaccugauuuuuuaaaaaacauuuacuauccucucuucacccuaauauuuuugcauaccguggcuugaaacaagauaaaauagcauugcuuuuccaagucaacauuuuauuuuucuaacuuaguucuuuaauuuuuaguuugccacuggcgaaauguaauuuucuucucuaaaaaggacaguuuuagaaaaaaaaggaaguaaaaauagaucuuuaaaagcaaagauauuuugaaauuuuuucaauuuucuauacaaguaauagaggauauuagaguauaaauaaucuucauuucagaguauuuuaaaucuaguugccaaaaaccuaaagucuggcuuucaaagaagacucaagacuucuuaaguacuggaaugagaacuuauucuuuaacugugauuugcagaauacauacuacacaagagcacacaccauuaagagccugccacuugggaauucagcaaugguuucugcccucaaugggcucuuucuucuaauaccaguucagguuaggaaaaguuaacuuuucuucucuuugcuaaauuuucucaucuaaguauuuuuuaaaauauauaguaugaaugaaauaacuauaacucaugacaucauuuuauucucuugaaaaagagcgcuucaugaaauuuugguauuucagcaucaguggaaaauagcagccaggugugguggcucaugccuguaauccuagcacuuugggaggcccaagguaggcagauuacuugaguccaggaguuugagaccagccugggcaacaugguaaaacuccaucucuacaaaaaauuagcuaggcaugguggcaaguuacucaggaggcugaaaugagaggaucaccugagcccgggaggucgaggcugcagugagcugugaucaugccacugcacuucagucuagaugacagagugagaccuugucucaaaagagaaaaagaaaagaaaagaaaagaaaagaaaagagaagagaagagaagagaacagaacagaagagaacagaagagaacagaagagaagcgaagcucaauagagagagguagcugaaauaucacauuuuaucugagaaaacuaggccuuccuuuuccuauuucccucaaaugcaaaaacuugcuuagauauaaaagcuuucuaauucauagcugccaaguaucagaaaggaaaaaaagguuuaagaauucauaaaaacaauaaaauauuuauaaaaucaguaaauaugguacccuucccaccaaaugccuggagaaacugcuggauaccaaauguccauuaauauguguaauaugucaucaucuuuuaccauaugugaauacagacaguuaaaugcaacaaaaaaguguauucucagagggguguauuagugauuauaguuguuguugguucugacacugccuuaugugauuagcgagacaaaugccaguuuuccaauuugguacauagaaaacaaacccacaaauaauaaaauacuuuuuuacaaaucaaaucacuguucucaaacuggaugcaaggauuucuugaauuuguugacuuauaagauaacugguucaucuuuauaggcagaaggauucuuacaaauaaucuaguacgauccuuucauuuuuacagaacagaaaacuguaaagucaauuucucauuccuggcugggugugguggcucacgccuguaaucccagcacuuugggaggcugaggcgggaggaucacuugagcccaggaguucgagaccaaccuggccaacauggugaaaccucaucucuacuaaaaacaaaaaaaaaaaacuagccaggcaugguggcacagcuuguaaucccagcuacuuggguggcugaggcacaaaaaucgcuugaacccaagaggcagagguugcagugagccaagaucgcaccaccgcacuccggccugggagacagaccaaaauucucuccaaaaaaaauuucucauuccucuucugccucuacuaaccacuuauauuuguaagaacucuguuacaaaaguccaaccaaguguggcagagcaauaacuggccacaucaacaacaacaaaaaaacugaaugccugcaugaagcauuaccaaaugcuaaagucccaggaaaccgucugucacauaauacaaacguagggauugcaucuauuuuaaaacauuuaauaaguucgugucaauugguuuccuagacacaaugaugaaaacauuagccugcgaugaggaacuaaaacaaagaaagugauacacuaaaagcagcagugaacuaggaguugggagagcuagguuuuuaucacugucacuugccuacuauggaucauaaaccggaauauuaguuuccacaacuguaaaugaggaguuugauuuaaauuauguuuugagucccuuuuggccuuaauauucaaugacuucaguaugcuaaagugacucccacaugaucgaaagucagcaccugguuuucaaauagaaauaauuuuuuaaaaaacuuugcuaugcuuauguagguauuaaaaguauaaaaugcagauuccauuuauuaccuaaggcauuaguucuuuaaaagggguuuauugaaaugaggcugcuauucuaaucagcaaagauuaacccaccacauucaucggcaauaucuucaagcagcuauaauuccuaugcgauuuacuccuucauuuauucccauugcuuuucuuagccaaucuaauucaggaaucagauagaucugaguucuaauccuauuccugccauuugcuuacauaaucauuuuggggaaaaacaaaagcucugaagucgugggguuaucuugcaaauugagaugugagaugagaaauguuaaccacaagcacaaaagugucuaacagaucaaguguucaauaaacauacugauuuaguauuuuacuugauaaucccauucauuuacuuucuaaaacugucuuggucucacucucuccuguccuuucaucacuagcagcucuaccaaacagagucauccuuacaguaaagagcccagugacaugaggugagccugcaaccauuacucuauacagcucuaucuuuucuaccccaauccacuguucucucuauucgcuuccuacucucaguaguggugaugguggcaguggcaguaaucacaguuacuucuccuuccuaucuacuaugugcuaagcugaaaaucguaccuuuacauauuaugucauuuaagccucaaaaaaccuuuuagguagauaucauuuucauuuuacaggugcgaaaucugcaucuuagaugacuuugcuuuagagaacuagaucuaaacauguuguuuuuaacuguugauuggguuaaaaaaacauguaacauuuaccaucuuaacuguuuuaagagugugguacaguaguguuaacuauauguacacugcugugcaacagaacuucaucuugcaaaacugaaacucuacuccuauagaaaaauaauucccuuuucuucuuucccuuaguuccuagccaccaguauucuacuuucuguuccaccuguaugacuacuuuagauauaucauauaaguggaaucacgcaguauuugucuuuuugugucaaauguuguuuuuuuaauacuguauuagaccaauggacagauuauauucuauauguuuguuugcuuguuuugacaauuuucugccaagaaaggauaucauacaugaugacuauauuccugggcuagcuaauaaaggucuaucacacauuuguuaacccacaaugcuauuaaaagaacagugcuaacagugggaaagaagagccuuacaggcagggcagaggaggaggcagccaccaccaaaguaaacugucuuuacaagugaaauauuuauaagcuggggacuuccuguauauaaacagcaacuagauagaauuuugagacauuauaagaaauauuauccaaaucuuuauaucauuuucaaguuuuccuugcuuaguucauuuuacagacauucugauauaucaaaaguaaucucaauggcuggaucuguucagagaaacaaacuugcuaaugccucacucaaauauuccugaaaagaauauuucaauauuauuucugcagauucaaaaaaugugacaauuauaugagauaaagucauacuaucauaaauaaaaugaaauaugaguuaaaaaauggaauauguaaaacaucuauuuaggaaguauacccacuucccuuuaaauaggguggagguaggcaaauagcaccuuucauaccuguacaaaaacuuucuggaguaguccucgacguucugcuagagguagcucauucugugcaccuccaacugccucaggcacauguggaaggucaaaaaacagauauaaacauuuaaccaggguggaaggcacugacauuguugucaugcaguccacgguuuucuggaaaacaagccaauaaauaagugaauagauagacacaacuauaauugguacagccaaauaauucacaaauguuaacccaaaaauuauauauaaagguaacuuuuuaaaaugcauguaagaauuuaaaaaugacuccaagugaagaaauauacaacuaugcaucugaacaauuuugcuuuaaucaaauagugagauuuuguuauauaguaaauuaucaauuaaauuuaauauuuauuuauuaaaaagcagcauguuucggaagcauaagcuuuagaauuuagaaaaagacacuuaauaacuacgaacuucagcaaacuacuuaauucuccugagauucacuugccuuucuuauaaaaauagauagaaugauacacccuucucauggcuaacaugagaguuauguaagauaauacauacaaagaaacauuaagcacuaaauuguauauucauugcugcuuuacuauuauuuuuaucuuuauucuuauuguagauuuuugaggcuggaaagacacuugagugauaaagccaucacugacacaaauacaucucuauauuauuuucaaagauauccagaggagaaacucuagaccuucuuacaguacauauuucaacauuguuaaguaugauauaauauuuaucaaaauuuuccauggugcaguuuggaacaagaaguucaacugcacuagagaucaacagacugguauaaucuguugauuaguuaguuuacuuucucagaaaacauuuauugaguguccagggaaugucaggcugugugcugggagcugggcaugcaaagacgaagcaucucuguccuucaaaagaccacagucgacuggaauuauuagaguccuaaguaacuaugacuuaaucucuuaagacuucagucuaacaaugguaguauauacaggcuaauauaaaagggauugacuaacacugccaggaauggcauuaaaaaggauaaggaauuaaaauaaaaagggaaagaucaccuggaagauacauaggagguuaggccauaugguacaguauuuuugaagaaacacagauuccaaaaaugcugacuccugacgagccacaauaauaauggcuaaccuugaauuacuguuuacuauauaagaggcauaaggcuaauaagcacuuuacauacaucaucucaccuauuccuuaagucaaccccaugacuucauuuguaaaaugauccuuauuucacaaaugaagcaacugagguucaucacuuacauacccugcuuuaggucagacagcuggcuaaguggccuacaaaguguguaugcucaaugacuuaugaaaauagucucacauuuuauuuucuuggcagugaugacccagugaaguguuacaaacaaaaaguaaaagagcuagauuucagaaaauuagcuggugguaauacagaucauaaauuaaauauacagagccagaaggaaaggguaauugggaaacuaaccccccaaaccacaugagagauggggccggaacuaaugcaauaguagggugaugaagagaaagcuucaagacuaucccuggcaagauguggccccuuucuacauacccaacauaccauuucuugucucaaauacucuaaaccuuuuguucuauucaucuacgauuauuucuuaacacuuauguuaccauacauuuaauguucaguuuaaacaucugcuaugucucaaaguuuacugaacuccucaucuuuccuucuacccucacuuucaaaauguuuaacucucacauuucuauuuucaauagcacuauauaugccccauuauuaaauauuaugguacuaucuuuuucugcuucaucucuuacaucuacacauugagucaggaccauguuuuggucaucucuguguaacacugcuaccagcagaaaauggcacucaaacaagguagcuccaaacauaacacugaauuugcuuuuuaaauguaucuauuuccagauagauuauuacuagguuuagcuggccacuaagcaaagugguaugauguuucauuuucauuuauuguagauagauuuaaaguauaacuuggcaucuaaacuuguaauuuuuuaagugauuagguuuuuauagaaaauaugaauaaauguagaaaacuguauuaaaaguuaauauuacuuauauuaaauaucaauaguaaauaucuaaauuauauaaaguuuuaauagcaaauaaacauaugcuauucuaaaccaaauuuugguauaguaacauacauacauuuacagcuaccaucaacagcaaacagaacugagauuuuguuacucauccaguagagucagauacaugaaaacaauggucuacucugggaccauuugaagauuacuuacaauaaccaacccucuccauuugccugagacugugcaguauccugagaugcaggccuuccuauccuaaaaccuggaaaaucccaggaacaccaggacagguugguuacacuaauucccugaguuaaaaaaaaaaaaagagggccaggcacaguggcucacgccuguaaucccagcacuuugggaggccaaggcagguggaucaccugaggucaggaguucgggaccagccuggccaacauggugaaaccccgucucuaccaaaaauacaaaaauuagcugggugugguggcgcgcgccuguaaucccagcuacucgggaggcugaggcaagagaaucgcuugaaucugggaggcggagguugcagugagccgaggccgcaccauugcacuccacuccaggcugggugacagagcaagaguccaccucaaaaaaagaaagaaaaaaaaaagagagaaaaaacacagcaaacaaauaaaaagaaaacagaucauuccgaggacaaaauucuaagagauaauuacuuuggguuacugacagguuucaggauaugguuaccaagacguaugcacuguaucugcuguggccagucacaugguacaauuauguuacaguuaaguagguccauuauuacaugaugagaguguuugaaaguccacuguaacuuagacaacagacauucccaagauugguacugacuuugguagguaauuauacucuggauuuuagaaggcugaauuaaccucuuucauccccaaaacaugaaaggccaaaaaucagguauccaaauagcucauuaaugagcacaugcaacauauuucaugacagauaauuacagcugauuuggaggaaauaaaaagcaaucuccagaauaaaucaaaugagaagaaaauauauauuauccuaaaaaugucaauguuuccuuauuucccauuaaaauuuaaaacuauuuuccaugucauuuguucuuuauaagcugaguaaccuuagauaaagagugauuuuuuuauuuuuccugagccagaguuucccuaacaucagugacaaaagugcuggccugggccugauggacccagagcuccugagcuacuugccaccagccagaaauaguccaucuguuugcccagaaugcucuacaaaugguaucauuaaaauaauuuuuuuuuagagacagggucucacucugucaccgaggcuggaguggugucauuauggcucacugcagccucaaccucccaggcucaagcaauccucuugccucagccucugaacagcugggacuucaggugcaggccaccacgcucagcuaauuuuuuuuuuuuuuuuuaaagagauuggggucucucuauguugcccagacuggucucgaauuuccgggcucaagcaaucuucccaccuugaccucucaaagugcugcaauuacaggugugagccucugagcccagccacaaaugguuauguccuauguguguuacaacauaucgagauggaaaacacugcucuaagccaugcguuuccuuaugaguaaaaugcaucgaacaucaaacuccuugcagagauguuaugagaagcaugaaauaauguuuuaaaaaaguuagaagaauacaaaugauuaucauaguaucucauuuggauauaaugaugaauuuaauaauaaaaucacaagagaggcuauaaaauaaagacgcugaguuaucaaacaugaaaacuaagaacuuaccugaccagaggaagcuaacaaauuaauugucguuagaagcauccagccucuacuggcuucuucacucugauuaaucucuaggaacugaacuauggcccgacuugcagccucuauaaaaccaaagggaaagccauuaagugggggaaaagucacauauaaagagguucuucuuuaaaaccuaccaaggaaaugaaaauuuacuaagcacauaauuauaucagcacuauuacauauagaaaaacuuuaaaaauagcaauguuuuaaugguauucauaaaccuuuauaucauuaauacagaaauguaaaagccaaccuauauauuucaggaaaaguuaugacaggagcuaaucaaaaagucaugaaagaggugaaauuugagcuaaaacuaccuggaaaacaaguacauguuuguccaggaaguaggagugauuaagggugcagagaaaauaagagcacagcaauaaaacaagaguggcuagaggaaugagccugacacauacagaucaagacaaagaacugugauaacacuuucuuaacauuauagaagagcacuguuuagaagugcagucuaauaccaacaguagugauuuaaaaaauagagaugccuaauuacgaaggaggguaagcuacuggcuguauuugauuuucugggcaagagggagcaaaugcaguuucuugagcaaaggagaugaugaaaggauuauacuaagacuauuaaucuaguaguaauguguaugacagacuggaaggcuaaggagaauggugagagggaaauaagagguuuccuaaguaauacacagaggaauaacuugaguagcucagaguaggaagagagaaacgugaaauacauaagacagccaaucacagaacugcagacuuggaagaaucuucaaaaguaaauuuaguugauuauauuucuuauuagagagaagaguaaauggagaagucucuaaaucuguaucuaauuucaucagcauggcuugccaauuuuuacaguaacauaugauaggaguuaaaauugucagaaaagaaguccaauuuggcagggcaugguggcucacaccuguaaucccagcacuuugggaggccaaggcgggcagaucaccugaggucaggaguucgagaccagccuggccaacauggagaaaccccaucucuacuaaaaauacaaaaaucaggcagguguggugucaugagccuguaaucccagcuacuugggaggcugaggcaggagaaucacuuguacccaggagguggagguugcugugagccaagaucacgccacugcacuccagccugggcaacagagugagacucugucucaaaaaaaaaaaaagaaguaagucuaauuuguucacuaggaacuaacuggguaaaaacuaacauauacuugguggcucacgccaccaaggucaggagaucgaggccaucuuggccacuaacacagugaaaccccaucucuacuaaaaauacaaaaaauuagccgagugugguggugggcaccuguagucccagcuacuugggagacugaggcaggagaauuacuugaacccagaggcggagggugcagugagcggagaucacaccacugcacuccagccuaggcaacagagcgagacuccgucucaaaaacaaaacaaaacaaaaaacuaauguauacuuaacacacuucauaaagaaguagaaaguagaaaauaagauuuagguuaucuuagauguauuuuuucuucaacuuaacauaaaauaaaaguguuuuauuagauaacugaauacaagacuuacacaugauucugggcugggcaaaguuucaucuuuguaaacuuccauuugagggaacauuuuagcacgaaaauuuuaaaaacagauucuuuuuauugagucuuaacuauauaucaagcauuguguuaaguacuuguggguuuaacucauuuaaccuuuacaagaacccugugaguuauuuucuacuaauauauuccuuacaauaguauaaguugagaaaugcagaagauaaguaauuugccuacaaucacauagcuagucagugaaagagaucuggauagggcugagguugaaugauacagggagauuccaaacuccaucgacaaaacaaacuaucuuuacauaacaaauauauuuuacuauuuuguaaagaauagcauaacuguaucacuguaaaaaaauaacuuuuauuuucaccuaccaauuucaauaugugucauuaagaauauuucaaaggcaucucccacuuuuuauuuuauuauuuuugagacaaggucucacucuauuguccaggcuggagugcacgaucacggcuuacugcagccucaaucuccucaacucaagcaaucccuccgccucagucccccauguagcugggacuaacaguaugcaccaccaugccuggcuaauaaaaacaaaauuuuuuuguagagacagaguaucgcuguguugcccaggcuggucucaaacuccugaauucaagugauccuccugucuugguuucccaaacuacugggauuacuuguaccugggugugagcuacugugcccagccucacguuuuauuuuaaaugagguaagcagcucauuuuaaaaguauauagcauuuagugcuaucuuaaaaaauuauguauacuagcaaggaauuuuaaauaaaaccuccauaaaucaaaugguuucuuaaaacuuuggguaaaaaaugcccacuacuagucagaaacauacugggucuuuuaauuucaauaauauuuaacaaauucaaauauaaacgauuuaacuuaaguuuuuaagaguuaaugaaagaauauauuaauauuaaccuaucuuuagaguugucaaucauuugauucaagcuuuaucuuucacacugcauuucaauacauauaguuagaaugaaaaacccagaaaugaaguuaauaaagcccaggauuucauuaaauaaguaaagaaugcggacaaucuuaaaugcaauuucucagccuacacugagaguaaacaaacgaauucaauuagcauucagaacaaccagaaugcaaaacauguuaauaagugaaauacaaguuuuccuuugcaaaguccauuuaaagcguauuccauuuucaaauuuaugcuucacaaugauggugagucacauuaaugguauuauuauacuuauuuaauuaaugaagacacgaagcccuaaacacccuugcccccuccaaaaaaaaauuccacaaguuagucagaaaaacaauauuagaacucacagcuuccaugcuucuuuucauuugacaauauauaaccacaucuugggaaugaaauuaccugaagguguuguggcuuugaaauccuugggggacagcagggcacacuguuuuucuguuuaaaaaaaaaggcuggguugucuaaguagggauucacuaaauuccacuaaucccaccacaagaguacuggggucaacaucauccagucucuccauugcuggauugcugcccauauuggggauugcacuacuagguuuaacaguggcaccuagcauguagaaaaacauuaauaauaaacuaaagauacuacuuuaugcagguaggaauuuucugcuuugcugauauaaauugaccaugugcccuuaaacuuaagcagaauuagaacuggcugagcuaacuagaagagaugggggaaaaucuuaagauacacccucuauacaaucuggccacaacauuauguuuuugucaaauuaacugagucacuacuuacuuccagcaaaagccacauggaggcaaaggaccaagaaagaauuaagggagacaaggagacugugacuugaccuaaacguauaacaaaucauccauguauccauuuugcaacuugauauucccuaaaagguuuccauuuucacaaacuucagauagauguaaacaacagaacugcacauaagcuuguuuccuacugagauaucuacagcccauaucucaaguaaucugauaaaaaaaaggcugugucugugggugcugauuagguaacacccaaaauaacaagucuuccauagcaaauucagagggguacuggaagaauaaucuuguucuggugaacaacgaacacagccaaccuucaaaggaauaauaaaagguucacuucaccuguuuuuuuguagaaaaagugugugaauguaaauuaagacaaaauucuuuucaaugauaaccuccuauaaaauaaaagguuauaugagcuaucuaaaguaguccaacuuacagaagaagaaagcagaauggugguugguggccaggggcugaggagagggggaaaugaggaguugcuguucaauggguauaguuucagucauguaagacacaaaaagcucuagagaucugcuguacagcaugguauguauaguuaacagucuguacugcacacuuaaaaauugguuaagaggguagaucccauauuaagugcuuuuuuuaagcacaauaaaaauaaauaaaaaauaaagaugaaauauuaagaguuggaugauuuaggauauacuuaggcccugaaaaaucuagaacuuuuuacuagaaaaaucaauaggucacaaagucuccaugaauguauuuuugauaacaacacugaccaaaagaaucuuccaauguucuaaacuaaaaaugaaagaaaaaaaacaaggauucccauagccaggguaaggcuaacugaggagacacuccagaauuauguucuucucuccuaaaaaucaggaaggguggcccuucuaacucuacuccaauucucaaagcauuuaaaaaaaaaaaaggcagagaaauccuauguccaaaaucaguaaaaauuuaggugcuauuaauacacgggugaacacaacagacaauaaaauuaaauaaguaaauaaaauacuuucagaugauaacaaagcuaugaagguuaacauacaaugugacugaauagauacuaaaggguguggggacacaggauagaagaccuauuugagauacgguacuuaggaaagaucuuucaugaggaaguaacacacaaaauaaauugaauaucauaggauucaaagguuaaugaauuucacaagcuuaaaacuaaaaauuaugugaaauuacacaauaugaaaaaaauguaucuuaaaaaaucccuaguuaauaagaugucaucaaugaggaaaaguggaugaagggcacaugauccuagcuacuauuuuugaaauuuccuaagagucuacgauuauuuuaaacuuaaaaguuaaaaaaaauacuuguguaauucuuacuguaauuaacaaugagacaucuucuacuugauuuaagacaucuuucauuacaucuaaaaaauugcccuguggauguaaaaucauaaagggaguuaggaaaacaaaucuccacuguagcaaaauaucuuucuacaaacaugcagauuagguauuuaaaaauauaguaacagaggcaaguauaaauaaguuuuaggaauuuuuuccuaaucuaguaugucauucaagaaagaauggggauaccuaauuucaucagcguggguauuuccucacaguacugugaaaauggaugaauacauccauuaaaaugcuuguaaacguauuuuuaaaagguauaaacuuuuaagaacaagaacagaauaagugaaagcaaugaaauuuuggauauuaaaauagcagagagauucacgguuacugauuagcaaacccuagaaucuugaaguaauucaggaaaaguggaaaagcaaccaaacuaccaaagaaccccugagaggcucaggaauugguggcacaaugcaccuuuggaagcagaaguaaauaagcaacuacacagagaaggacugguggaaaauauguucaagagcaguuagacccaaggucccuacuacuaugugggcccuagaccagagguuuguuuguucacugaaaagaguaagagagggaguacgcauugaggggcacaaggcaccauguggacauacaaagguaaaauaaaagcuuauauacuaaagcuugaggucuccaaaccuuuccccuacuuugcuuccaaagugcugagucaggcauauaucuuccaagcagagacuggacaauucucugagcaccugcuuaguuuaggaaaaagaucaccaaaaaaacagccuagcaagaucaucuuauguugcagcccacagcugcaagcuucacacacaauuaaaaagcuuuuuaaugcuccauucuuauguaagagcagaugaucaagggugagacauguauggacauucucuaacauaagagacaaagacaaaaacaaauugauaaaaaaaccuuuuuauuaaaccugaaagaaacagauuauuuauggagacaaaaaucugaaagaaaaacaagaaaccgccgggcgcaguggcucaugccuguaaucccaccacuuugggaggcugaggcgggcggaucaugaggucaggagauagagaccauccuggcuaacacagugaaaccccgucucuacuaaaaaaaaaaaaaaaaaaaaaauuagccgggcaugguggcacgugccuguagucccagcuacccaggaggcugaggcaggagaaucgauugaacccaggaggcagagguugcagugagcugagaucgcgccacugcacuccagcaugggggccagaguaagacuccgucccaaaaaaaaaaaaaaaccaaaaaaaaaaacaaaaaaaaacaaaaaaaaccccagaaagguaagaagaaaaugcagccccaaaauaauagaaaccaguuaagaaagaacacuuagaaaugaaaaacauuuuuuaaaaugagaaaaauauaaugucacaaaugaaaaaaaaaacucuauagaagagauagaugauaaaauugaggaguucucuuagcaaguagucaaaacacaaagauagaaaaugagaagaaagauaagaaaaugagaggaacagucuaagaggucaucuaacuagaaggagaaaacagaggaggauaucauuaaacaauucaugaaacuuugcccaaauuaaaggauaugaauaaccagacugaaagaguucaaugaguacccagcacauguauaaaaauaggucuaccacaaggcauguuauuaugaaauuuuagaaaagcagggacaaagagaggauccuaaaagcuucuagaaaaaaaaaaauaggucacagaggaaaaaaaaaucaagaaucuacguagcuuucgauuucucaauaacaauguaagagccuaaauuauaaaagaaaauuuuuuaaauucugagacaaaaugauuucccacacagaaccugauacuuacuuaaaggaugacugauaauaaugcaagcagcaagauuuuccaaaaugacccugagugcucauccugggcugcauggaaggacagagcuaagacacccaccacugaccaucucaacccauggucaacuuucccaggcaauuaguagcuucuaaucucugcuaagaggaccuccuggauuacacagcuagcauucucaaacaacuccuauaaauaucuaacaaguauucaauggccuaagucauaggcaguuuaaaugucucuuuacuaacaagauuacucuugagcuuguccuuuaggaauggagaacaaugggggauggagaggaggagacagaaguaucucuccauuuaaacguaaaccacagcuguguauucagcacaucuccccagcacauguaucugugagaucaugagagucguagauaugugucuucuugucucuuauugacccuugguuuuguauuaaauacauuuccuuuucuauaauaaucaugcuguaugauguaguggaauuuguucuaaguccuggcagcugaaagguugucaggcuaaagguaucacuuuacuuacugaaaagaaaagaacccauuuuucacagcaauagucaaaaaauguuuaacucaggguaugucuaaaacaacaagcagaacaaaacccuaauaacuccccuguauccuuuuuuauaaagcugcuggaaaauaugcuuuaccaaaauuaggaauuaagggauucaggaaacagaauccacccccaaaaaaugaaaaggcaucccaggacaaugugaauagugauguuaaaauggcagcugugcacuggccuagagagcaacuacuacagaugacacagagaccccuaaguagcuuauggucuacugggaagaucaagacacaugcacaaugaccacccaggagguugagaagaaaaacaguaguucagaacagaaaaaaauuuucuuugccuaaagaaaucaaaaagcauuucaucaaggaagcaugacuuaaucaugcugacauuuagacauauugaaaugaggaaagauucuccuuccucagugaagcauucuaaguaaaugauuaaaauaagaguauacacauguuugaagacuacagacagcuggauuugguugaaauacagaaaagaaaacaagcaauagagcaggguaugcuaaaaaaaaaaaaaaaaaaaagaccagaugauagcuuugccuuaaauuucaugcugaggaauuuguauuuugcucaaagggaaacagaguauuuuaaaggguuaggguggaagugguagugguccaggcagaguagccuugagcagaacuacuggagaguugaagaugcugaaaccaggaaaagaaugugacucuaagaaagggaaagggaauggguaaaugaacucaaugugcugagaacaaggucuguuuuccauuuaauuuuaaugggacuuuuacagaacugcuuguucauucaaacaaaucaguuuuugcuggcuacuguaaaaauaccuguggauuuguuugaugcucuccuucgaauuucugucaccauuagucgugagacuuguguugugaacugcagaagaucagaaaauuuuucugucauuguauucggcggagcauuuccaaaaaccuguagauaagaaaagacauuguuaaugaagcacugacaaauuuuucuuuuuauuuugugaauuuucaagugugguaugacuugaaaaucaaguccagaaaagucuaccuacacaguuacuuugaaucuuaauauguugaaaauacaacgcuuucaauaaaucacaugucuagccacauuuccuuuuacauauaaauuuguugaagaaaugauuaaauaaaugaaaucuaagacccauagacauuauugauaaaauuugaaucaaucucacgaaaaacauuagaaauuauaacguuucuuuuuuuuugggggggacagauucucacucugucgccuaggcuggaguguaguggcacgauuuuggcucacugcaaccucugccuuagguucaagcuauucuccugccucagccugccaaguagcugggacuacaggugcaugccaucaugccuggcuaauuuuuguauuuuuaguagagaugggguuucaccauguuggccuggcuagucuugaacuccugaccucuggugauccgccugccucagccucccaaagugcugggauuacaggcgugagccaccacauccagccaacauuuuucugaggaaagcuaauuugagaauuuagagaaaaguuauaaaggaucuuugauggaguacaggcacacuggauggugaaaagcagcucuacugcuaaaucccaggcugacgucagaauucacuaaacucauuucaugucucagaauuuccucagucuaaucacaauaauuuacaaaacaaggcuguuaccaaaaaaacuagaaaacagaaaugggagggucaugaaacaaacuuguuuuuacacaaauuuuaaaauaaaugagcuuuagaauaaauaauucuuauuuuuaauuuuauuuaucuguuuuuuuuuuuuuuuuuuuuuuuuuuuuuuuuuuuuuuuuugagaacugguucuugcuauauugcccaggcaggucuugaacuccuggguucaagcuauccuccugccucugccucccuaagugcugggauuacaggugugagccacuauauccugccuaaaauaaauaauuuuuaaaaauaaauggguaugaguucagcaaagagaauuugagaaaaugaaaccuggacagaccaucauaagaaaagaaaugguauuuuaauggguauauaacuagauauauccugagguauuauuuuaaagaauauucuuuauagcugaaaggaaauucucuauauucuaaggcuauuauaguaucucucccuuuuaacagucauuacacaguaauuuauauuauuauuaccuauugaaaugucacuacaaaaggagaaaacauaauuuacucaacuucauauucucccaagccaacacucugccuuuuauaguaaugcucccuaaauaugguuguuuauuuauaugcugacugcccucacaaucaaauucuagagaacauucagggagcacugaaggagaacaugagaacauaaacuaaaaucaagaaggaaaacaaaacaaacaagcaaauaaaagacccagcuagggagauggacuggaaaagaaaacuaaauaaaaaucuaagacuggaaagaccucuauauuuuccauguauugguuacaaauuuuggcucaaagauacagaagagaaaaccugaucaaucacaucauucacaaugccuuuagcaugaaaaaauauauauauuuaaggaaguaguucuauuccucauauuauacuaguccccccuuaucugugagagguaaguucuaagaccccacuggaugccugaaaccacggauaguaccaaagcccguaaacacuguauuuuuuacuauaauacauaccugugauaaaguuuaaguaauaaauuaggcacaguaagagacuggcaacaauaauaauaaaguaaaaaaauuguaauaauauacuauucacaauuucacaaauacaagauuccuucuuauuauagaucucaaaaaccucagcacacaguuuuuggucuuuccuuauuaagucaagaacuuuuaccuuuucacuuaaaggaaggacuucucucuggcauacacaaguggccaaccccauaacuuuugcacuuuggggccauuauuaaggaaaauagaguuucuugaaaacaagcagcuugauaccaggacaauaggucucauaacugaggcugcuacuaagugacuauugggcagguggcccauaaaucauggauacacuggacaaaggaauaauucacaucccgggagggauggagcugaauggugucagauuucaaacuuaugaauuguuuguuucuguaauuuuccacuuaauauuuucagaccacagaugaccaaaaccaugaaaagcaaaaccaugaauaaggagggauuacugcauaauauaaacaauuccuuccaaagaucccaauaaaagaauauaacaaacaauguaauauccuucuaauagaaaauguguuucuuacauguuucuuauaaccucccucaaauuaaguugaaaaugcuaaaacaauaaauaaauucuacaaggguaucguuuuuuccagacaccuagucuguucaauaguuugacaaaugaauaauuuguaauaaucucaaaaucucaaaaaauaaacuguacuuuucaauacuuccucaacacauuuuuuuccugagauuuugauaaauguugugugcuuagaauuaaccuauacuacuuguuaaauaaucuauguuaccuguuaaauaaaccuccccuuuuuuuuuuugagauagggucuuacucugucauucaggcuggagugcaguggcgcaaucaugguucacugcuaucucaaccuccugagcucaggugauucucccaccucagccuccugaguagcuaugacuacaggugccugccaccacacucagcugauuuuuguauuuuuuguagagauaggaauuucgccauguuguacaggcuggucuugaacuccugggcucaacugaucugcccaugauggccucccagagugcugggaauacaggcaugagccacugugcccggccagaaaccucuauucuuuaacaaacugaagacugauaaaaauugagaaaccuaauaaugacacaucuuugaauagccauuccaccugugcucagagaugaguacauagccuuuuguuauugcuguugagacagaguuuuugcucuuguugcccaggcuggaguggugcaauggcacaaucucggcucacugcaaccucugccuccugguuucaagugauucuccugccucagcuuccugaguagcugggauuacaggcacccaccaccacacccggcuaauuuuuuuuguauuuuuaguagagaugggguuucaccauguuggccaggcuggucucgaacuccuggccucaggugaucugcucaucucggccucccaaagugcugggauuacaggcgugagccaacucuccuggcugaguacaugguuuuuuaauggagguguuuauaauauuccuauuacucaggguguaucaauguauauuuugcuccuaagaauuaguaugagguauuuuauugcuaauaguuauuaggacaacuaaacagaaccaauagcucauuucuugaacaguuguuaaggauauaauuauucaaccagucuucaugcuggguaaauaauaugcuguugaaaaugccaguaacuuuuuacacaaauccugauguuuacugcuuuauuuccucuaagaaauguucugacaagauaaauaaaacuggcuugaauuuaccaacccaaaaucaguacuacagaaaaagacuaugucauauuugcuaaucugaaaugaacaagcauugcuucuuaaauaagguuuauucacucacaaauauuuaucgacuuccuaguauaugugccaggcaauguucgaaggguccugaauacaaagguaaauaaaacaaauaugauuccugugcucaugaaacacaggacauuuuagcacagaagaccagugguaaauaaguugauuuuaaaauuaaaauuauuuaaagauaguauuaugaagaaaguaaaauaggguagcugaaagagaaugccuggggugggaagaagguugucaggaaaggucuuucugaagaagcgacacuggugccaaaggaugacacugacuaaugaggaaaaguuacaauccaaagagacaaggaaagaggguugcaggcagugagaucagagcugugcaaagaccucaaagugagauugauucugggguguacaggaaugaaaaugaggcugauaaagcuggggcauuuuguauaagaggaaaaaugguacaagauaagguuggagggauagaggaacuaaagcaugaaucugacauuguagguaauacugaauggauaagguagcaaagaaaauaguguaguuuuggugauugacuucaacaacugaaucuaaaaauauuauguauguguucacuacuuucaacaaguagugguauuucuugaaacuauacaaugcuuccaucauuuacauaaauguuugccaaagaggaugcagcaugaagcugggugucagaagguguagauucuacuucucacucucagggaguacugacuacuugucaaauuuuuccaguucuaggccagguaugguggcucaugccuuuaaucccagcacuuugggagguugagguggguagaucaccugaggucaggcguugagaccagccuggccaacauggugaaaccccaugucuacuaaaaauauaacaauuagcugagugugguggcacaugccuauagucccagccacuugggaggcugaggcauaagaauagcuugaaccugggagguggagguugcagugagccaagaugguaccauggcacuccagccugagcaacaacagagccagacuuggucucaaacaaacaacgacaaaaaauuucugguucugcagaggaagaaaguugggcaagagaacuggcaacacauucaacucaaaagggcugauucuagaauacauaugugaaauucauaacagauuaaaaaaaagguaaugaagaacaaaaaugacuucuugcaaauucacuggaaauaacaauuaccauauaauacccauuuaaaaucugcguagcacuauucaagaacuuggugucauuuaagucucauaaaauccuacagaauagguucuacuaguagccucauuuuacaguuaagaaaauuaagaguuagacaacuuaacuuaaaacaggaggcaauacagacagaauuuaaaacuacaucuaucugauuccaagccaggcucuucaucacucaguacuauauuuuucucaaacugugcaugaacccuaucacuaaacugugcauaguguucaucuuuagagaaaaauagcaugguuugacuuauuuuuaaaauaaucauuuuuaauauccaccuaaauagauuucagaagauuuccuggcaccucuucaaccaaauauuuuuggcacucagggaaagcaaauuaaugguguuaucuaauggcauucauaaaggcucaauauaaacuuguuacugaauagugcuauucaauaaaaauauauuaaauaugacuaauaaaagagagguuggaauguuuacaaaguuuuuaaaaauggaggcuuuuguuuccuaaauauguguuauaucuaaaauuaagucagacuauggaccaucauuaguccuaaaauaauuugcuauaaauaacaauguuaaaaaauuaacaaugaagauguaauugcauuauuucguaugguaaaucaguuaagauuucuuaucaauuaauauaaaugauuagggaaauauuuaucuuaugcucuuuuuguuucuaugaaggaccaucagaugagagucugagaagaacagaaugccuaacucagucccguccucuccuuccgggcuuugccugccucaugagaauaugcauucucaucugcucuggcuguggcuugccacuguccaguucugccagugacuggguaaguaaacaugacuauuucagggcugaauucagcaaguccuuuguugcacagacccaagccacauucuccaguaucaacuguauugguauuauguaauaaguaauaaagcugccacaaaauaauucaccugucugccuucugaucucucucuuauuugguucuaaguuugggugaccucucucuuaagucaacaaauuaaaaaguaaugauaauuuguaagggauuaaaaaaggacacuguauuacauuuacaugcuucucaaauauaaauuggaaauaaguuaaaaaauaaggggaguuucuuacaaaagaucuaauugguaaacauuacauuuuaaaauacacagcaaaauauaacaaauacuacaguaauuaacaguggcaguuaugaauuuuuagacaacuaaaaugcuacucauuuugaguaaguuuaaaccaaauguuuucuuugucagcuuuuguucuugggacuaaauguuaauuauuuuuaagaaugcugaauaaauauuauucagcuauuuucagacuucaccauaaucuuucaguuugagcaaaucaguaagagggaagauaacagcagccuccuuguaggacuguaaugaagacaacaggaggcauuucaagaacccagcaugagaccuggcccagaaaaaagacuuaauacaugucauuucccaacccaugucucucaaaggcaaaaaucaugcacugaaauaacacuauuaagcacacuuuaaaaacuagucuguagcuagauguccaugucuaacagcuuguucaccauuuagcucuaaucaagcaaagucucaaaaaucaacacugcaauuccuuuuuagcaaucaugguaagaacugguuggcucuagcaacauacugagcuauucacucaccauagguauuugucacuaguggacaauguucaagcacaaacggccaaauguuaaauagauauggcuauauauuucuaaauuuaauggaaaugguaucuaagaacaauuuuaguuuauuaauuauauccaauuaauaagaauuauuuuuaaaauaauacauuuuucaaauuagucacaaugguacagauauaacuuucuaucuuuucauuaguuaagaguuuacugaaccuuugugauaucaaaucacucauuauauuagaguuuuaaggcauugcauacacauauguuucuaaucaaccaauuaaaaacuuuugagagaauuuguuaauaguuaaugagacuuacaauaacauaggacauaagauaacuaagucaaacauuuuaaguagauagagaauaauuacuaaagcaucucauaucuacuuauuaaaaaaacaaauagucaugagauucuucuagucuaguagacuguggaagccuaacugauaaaauacaugggauacauauauauguaggcuauuacuuaauaauucauguuaauagccaagaacaauuccccuaacugcucuaaacauucucauuaccuuguaaacauuccuaagucugacagaaggaaauuaccucaaacuccucaguagccaacagcacaucaugacguuaaaguaaaacaaaaauaagauuuaaaaacaaaacaaacuuccagauaacaaaaauuauuaacuuccugguaauaaaaauuaguaacuucccugaauagggcuuaaaacaauggcuugucauaguucucucucccauuuuuaaaagagcuauuuuaaaccuuuccccaccucuucucacguuccuacucuaccaucuccucccucuaucauucucagcagauaaucuauccuauuauuucauaaguaaggaaauguacauucuauaaaugcguuaauguuucuauccucuucuguuguauccaacacaagcucaugggugauaugugaacuaaccuuccuggcacucuugcccuucugccuuaccagccuauacaaaccucaaucucaauaaaucagguauugcuuucucuacuuuuucacacaggccaguacugauaagguuuaguauaaauuuaucaucuccaaccuucacugagccaucaauacuaaucaauucuuuuauugcccccuuucaacucuuucuuucucauucauucccuuucacuaguauuuccaacaacaaaaauaauaaauucacguaacaaaaacaauaauagauacaauaauaacaauaauagguacacauuucuugggacaaacacuuauuaagugcuguaaguauauuaucugaauuuaacccucacgacaacccaauaagguugacauuauuauuauuuuacagcccagaaauugaaggugacuguuccuccccagugcaguagacaacuagaagucuaguuccuuacgaggaagaagagagauaccaccacaaaucaaagacaagaacacugauaugugaacacuggagauucagugauagucuaucuacugaacaugagacauacuaaaaaaauaaauaaauaauaguaaaacaacaaagaauucaaggaaauuaaaacugugauauuaauagcacaacauuacucuaaaagaacuacugcuugauugacagagguccagaaaagggggaacauauaagauauagaggagaauauucucaaagaaauauuucagaauauuuaccgagacugaacaauacaaguuuucagauuaagaaggcuuaagcugaagccacaauaaaauuucaaaauaaugagaagaggaagagccuagaaaauuucacacaaaaagauagaugaacagagaaaauaauauagacaacaagugagacuacaggggacagagccagucagagauuggggcacggggugaggggguggguguggagaaaggcaucgucaggggcauggagauagaucuggaaaaaggggagaagaaaaagagacaggggagagucagagacagggaaagaaauagggacagagaggagacaaagagagaaaugggaggacagaaagacagugauggagaagagaaagagagaugaaaggcauagagagagacagacagauaggaagaaagaaauggaaacaggggaaggcaggcagacacaggauaaaaaagacagacagggcaaggcagagaagaugugggagggacagagaaaggaggaggaaaaagagcgagagaagggaaaccaagaaacaaagacaugcagagaaagaaauugagacaggaagucugaggagaacaaguucuauaauaauggaaaaauaaagguaguauaguauaagguucaucuuugaauaaauuuaaauuuauaucacugucaguagagagcaaacacugaauacugcuuacacaaguagccuaacuauagggaaaggaugaggagggcagcauguaugaaugaguguauguauguauguauguauguacauuaugguuuggagggagaggaaguaaagaagcuaauucuuauauuccucaguaggaagucaauuaaaacuacacaacagcaguaaaaguauguuauuuaaaagucuuucauggcggcagcaauuaguggugaagagcaggagggaaccuauaagccugugaaacuaucugacuuuuuaaaaugauguauuugugaacuucugauaaacauaaaaaaguuauuauuauuauuauuuuugagacagaguuucacucuugucgcccaggcuggagugcaauggcgugaucucaguucacugcaaccuucgccucucggguucaagcgauucuccugccucagccucccgaauagcugggauuacaggcacgugccaccacgccuggcugauuuuuuauuuuuaguagagauggggucucaccauguuggccaggcuugucucaaacuccugaccucaggugauccaccugccuuggcuuccuaaagugcugggauuacaggcgugagccaccacgccuggccuaaaaaaauuguuauuuuaaaaauacccaacaagauugcuacauguaauuuacaaaacauaugaaaacauuaacucuauuugaauuaucuauagccuauaacuauccucuuacagcaucucuuaaacaacagcaaauuguaaugacuuuuuaaaguauacaaagggcuugggcaguugcaccauuugguguaauaaaaucaucacuuuaacagauaacagaaauaacacaauugauaauuuacaaucuauuccucuuccaaaucucaaccauaacagggccauuuuagacaauggcucacagcuugcacuuuaucuguuaaaaaucaaaaagucucacuaaauguaguuuauucugaccagguuucacaucaagucacacugcuuuauagcaaauugaaaacaugaaacgagaacaccaaacuucuuaaaacuaacucagccuaucauuuuuuucuaccuauggcuuaccaguaaccuucagauucuuguagugccccccagucccggaaggugugugucuggcaaccuggacuuacccuguuaaacacuggcagcaucauauacaguuucucuucuuguuccuucugagucaugugccggggaggauggcacaacuccgugaagagccggcggaggugcaucaguccuaaggcguugucuugugggcugcacuccuccugccucggccgccccaugauccucuucaccauguucaucuuggcugguuggugagacgcacuucuaauucuguaggaaaaugucaauacaugaacagucaaaacaucaucaucuugacuaggucaagcaugcauguaagagcuuauaagaaauuugcaaaauagaaaauucugucuaaaauauaucuuucuacuucuuuaaacagaaaagacagagaagcaaaauuugauaaaucccccugaagggcaaauuaugaaucucagcauuggaaguucuuacucacuuugccacaauuuguauaaaauguaaaacauuaaucagacaaguaauaaauguuuccaauuaguuuagucauaucaaguucaaaaauaaaggcgccgggaauaguggugcacaccugcaaucccagcacuuuuggaggccgaggccggugaauggcucgagcucaggagcucgagaccagccugggcaauaugacaaaacccugucucuacuaaaaauacaaaaauuagucagguaugguagugugcgcguauagucccaaguacucaggaggcugaggugggaagauaacuugagccugagagguuaaggcugcagugagccaagaucacgccacugcauuucagcuugggugacagagacucugucuuuaaauaaauaaauaaaauaaaaacauaaagagaaagagaucacaaaacuauuaauggauuucuuaaugguuaauguaaaaauaaugaaaaaacaaacuuuacccaaaucucaaaacaucuaagacagucaaaaaccccaaaaccucacaaaauuuucuauuuuuaguuauuuaauuuauaauuacuuaauuuuuuugcuagaaaauucaaguauacuuugaguacaugaagaauaguguaucuuauagauuaaaauaugcaaauugaauauaauacuauccuacuuuauccuauaaaucauaaaaggacagugaaaaugaucaugugacugaaaacuacuuucuaaaacuauaguuugguaagucauguuaaaucauuuaguggauaaugaugagcauuuuucaaagaagugaaauagaauagaaaaaaauagaagauaagaaaagaauaacuuguuucaugaagcuuauuucagauaaagguguauuacuguguacugaaucauaaugcaaaauguaucccuugcuggagcugcaguuaaaaaaauacacaaacuaaccauugaguuaaaguauacacagaaucaguaacaguaagcuuucagaaagcaucauuaccccuuuuuaaccacuacuaaugaugccagcaauuggcuaaguguagacacaaaaacaggauaucuuacaaaaggaaccaggaaggcugggaggacauucuggguaugcagaauuuggaugaagggccauuuacuuuuuaauccauagaaaagcaggcaacaccugagauuaauuuuuaauuuugcuacagaaccacauaugccaguaugccauuucuuaagaaaugaaggacuacagcaagguuagaguuuuauuuacuaaauaucugccuacugauuuuuaaaacuaagaacaagaauuucaaacacacuugcccuugagaauuuugagugaauuccauacuugacuacgggcauaugcugaggcacuguagcuaacaggaggacacgauguaacucaucacaggugaagaggagucagacaaauucugccuagaacucugccaauggcuuguuugcacugaauaacuacugugcagagagcacugagcacacucucaagugcccaacugcuggaaacagugcuaacacauaggcaaagggcuggggggagcauuuaaucugcaaaauaacagaaguuaguccaguucaaagauguccaauguaucuuauucuugaaaaauauguuuuccaaauauaaauauuucaacaaauauguuccaauaaccuacuaugugcugguauuuacaguccuggaaauccccagaacaaaacuuaaauuugaagugaacuauaaaaauuuuauaaauuagcuaacauuuuagauuauguauaguucugcuccuuuuccuuacccuguagcuagaguugauaaucuagagauaguggauaggacuuaggggauucaugauacuccaacacuucaaaaaaaauuuuuuuuuucugcugggcgcggcggcugacgccuguaaucccagcacuuugggaggccuaggcggguggaucacgaggucaggggaucgagacuauccuggcuaacacggugaaaccccgucucuacuaaaaguacaaaaaaaaauuagccgggcgugguggcaggcgcccacucucuccagccccuggcacccaccauucuacucucuacuucggugaguuugacaauuuuauaauccacauguaagugauaucauacaguauuugucuuugcaugacugguuuauuucacauuuaguauaauguucucaagguucaucuguauuguugcaaaugacagcacuuccuuuuauaaggacgaauaauauuccacucugugugcugcacacgcacacauacauaucugcuuuucuuugucauucuucugucaagggacauucagauuauuuccauaucuuggcuuuugugaauagugcugcaacaaacaugggagugcaggcaucucuucaagauacugauuucauuuccuuuggaaauauacccagaaaugagacugcuguaucauaaagauaauucuauuuuuaauuucuugaagaaucucuaaacuguuuucuaagguggcuauaccaauugauauucccaccaacaguguacaagagucccccauuuuccacauucuggccaacacuuuccaccuucuggccaacauucucgccacucuaacaggugugaggggauaucuuauugugguuuugaucagcauuucccugaugauuauuaauacugagcaccuuuucauauaccuauuagauauuugcaugucuuuuauggagaaacaucuacucaggugcuuucucacuuuuuaaucagguuauuugaguuucgcuaugaguugcaugagucccuuauguacuuaaauuauuaccuacaccaauaucaugaggcucucccuguuuuuaccuaguagcuuuugguuucagguauuauauuaaagucuuuauuccauuuugaguuaguuguuguauaugguguaaaauaaggucuaauuuuauucuucugcaugaggauauccaguuuucccaacaccauuuauuacagagacuaucuuucaccauuccauguucucagaacccuuguugaagaucagcugacuguaaaugcauggauuuauuucuggugucucuauuccauuucauuggucuauaugucuguuuucaugccaguaccauacuauuaagauuacuguagcuuuguaauauauuuugauaucaggaaaugacacuuucaguuuuuuucuuguucaagacugcuaugacuauuuggguucuuuugugguuccauaugaauuuuaagauuuuuuuuucuauuucuguaaagaaugcuauuggaggccaggcgcaauggcugaugccuguaaucccagcauuuugggaggacgaggugggcggaucaccugacgucagcaauucaagaugaaccuggcuaacauggugaaauccugucucuacuaaaaauacaaaaaauuagcugagcaugguggcacacaccaguagucccagcuacucaggaggccgaggcagggaaucaccugagccugcgaagcggaguugcagugagcugagauggcgccacugcacuccagccugggugaaagagcaagacuccaucucaaaaaaaaaaaaaaaaaaaaaaaagaacaagaaugcuacuggaauuuuugauaaggauuacgcuuaaucuacagaucauuuucgguaguacgaacauuguaacaacauuaacucuaccaauccaugaacaaaagaaaucuuuuuauuuaucaaugucuucuuuaauguccuucaucaaugcuuuauuaaaguguacaagucuuucacuucuuugauuaaguuuauuucuacgaauugcagucuuucuauugcuacugcaaaugggauugcuuccuaccuuuaagagaggcccccaagauaacaacucauucaaaguacgauagugaaauagaacuuggaugagaauccaggccuuccaacucccaguuaaguggccuucaccaggcuuacuuauauuagguaucaauuuuaaauuauaaaauacuuggaaacugugacucuaguuagcacguuuauuuauuuggcaucagguaacaaucagaaugugaaaauaaucuuuuuugaguuuucugaaauacauaaaucuuuuuuuuuucuuuugaaacugguucucgcucuaauacccagucuggagugcaguggugcaaucacugugcucacugcauccucgaacuccugggcucaaguuauucucccuccucagccucccuaguagcugggaugacagcaugcaccaccaugccugucuaauuuuuguauuuuuuguagagacaugguuuuguccuguugcccagacuggucucaaacuccucagcugaagcaaucugccugccucggccucccaaagugcugggauuacagguaugagccaccgcaccuggccucaacuuucauuuuaauuuuaaaaauacacaugaucacauuaugacaaauacuaucucacuauauauaacccagcuauugcaauaugguuauuuaauauuuuaucagauacaaaaggauacauaccaaucagaagugacaaagauucucuccuugaccaaacucuaguuaggcucuucugaauucuccucucaacuaggcuuggcuuuuagccuucaguguuugucucuacauuguccaauuagaaaccugcuaaguaaguuuagccagaauucccauccuaauaucugauuggguggccaaaucucccgccauccuccaggugauggaugucugaucacccuggccugccuucggcaaaaaucuuguuaggucaguuuagccagaagccguaauguuuccucucaguaauuuucuauccacugacugccccccaaccccagcccugcuacuuggcuauaacaugaccacuuuuccuuguucuuuuccaaguugagccgagucucucccuuucacugcaaaccccacuggaaugaucccuacaucuaucaugauggucuugaauaaagucugacacguugcucuuuuacaaaugccagagaccaggcacaguagcucacaccugaaauuccaacacuuugggaggcccaggcaggcagauccuuuaagcucaggaguuugagaccaguuugggacacaugacaaaaccccaucucuacaaaaaauacaaaaauuggccaggcauggugcugcaugccuguauucccagcuacuagggaggcugagaugaggggauugcuugggucuggggacauaaaggcugcagugagccaugagcaugccacuguacuccagccuggguuacagagugagacccugucucaaaaacaagugccagaaugaauaauuuuuuaaacaggagcucaguggguuuacugguacuucucaauuacucagauaaucucaaugaugggggaaaaaaucagauuccuccuuugcuccuaauguaccaaauaacacuucagcauaucaguuuucugaaccauggugggacaggauaauagggucuggagacagggcaucuaaggccaauauguguugacuucguaaagaugaaucaagguuaaacaccaaggucugggggcaagagaucuaaggccaacuccugcugacuucccaaagguggaucaaaaagaaaacaccugggucuggaacuuccaaaagcuaaaccaaaaggaaaugccccaucuccccaggccagaguagcaaaggaucaaaggcuaucucccuaacccuccccuuuccaccacguccuagauggaaggggaaagugcccuggaugggcugugggccaagcucaggccaucccuucaucugcauagggcaccaauucaccgcagccuuuaauuagccauggaccaaauccuucauccagauaagggguagcugauagggaccucaaaaggaacacuuaaaacccagaaaacuuuguaaccaggcccuugagccacuugcuugggcccacucccacccuguggagugcuuucucgcuuuaauaaaucccuguuuuugcugcuucauuccuucguuacuugugcuucauugcgugugcauuuuguccaguucuuuguggaaaacgccaaggaccuggacaucucacacuucaggccugcucucugguaaccauggcuuugucuacauuuaaauguuuacauuuaaaacauaauucagacgaagagguaacaugucuaaaauauucuucagcagugaaagagcagaaagaauaggcacuuaucaaaccuuuauaaacacacccguauaauaaaucagguaacuucaggagaaaggcucuaaacacccuugaaucuugaguuucuuucauuuauaaaaucuuuccucaugaacuuuuuauaaaacuuaaauaacaucauuucuguaacaugccaagcacacuaguuacauucaauaaauguuaucuuuucuuccuuuaccuugaucaugaaacauuuaauuuuuauaugcauuuuuaguuauuuaaacaagcaaagcaaaggaaauacuauaagccccuacagugcuauguuuuagagacuugcaaaaugacacaaaaaauuaaggaauaauuuauuucucaguuggauguagaauaagagguuuagaaagcaauaaagaaaagauaugcaaaauaagaacaaaccacagaagaauguuuucgcuuaauuuuaauguuaguaagcguuuucaaacuauuuauaaggauuauuguguauaagaacuggcuuucuaauacaaacccuauuuggguucauaagaaaaaauaauguuaggacugccagcaggggcuuauuuaaauagcaaugagauaauuacugcaaacccagauaguauuucuuaaucuaaucucuuauguuaauaagagaaaaccacuuuaaacuugcucacccaaaaucauuuaaacaguuuuccauuacuuaaaucaugauggguauagaucaaguaaauaggcuaaauuuuuaaaauauauuugucaaguaacuagcugcguuugaguagcucugcugaaaacuuuaaauaacuuuccuaacucuuuaauuauauaagcgaagaaacaaaacacacuagcuacauucaauaaauguaauguaagcucauauggcuaagugaaaucuuacaguuucaucaaagaauuauaagcaauuccugccgggcgcaguggcucacgccuguaaucccagcacuuugggaggucaaggcgggcagaucacaaggucaagagaucaagaucauccuggccaacauggugaaacccugucucuacuaaaaauacaaaaauuagccggggauggugucaugcgccuguagucccagcuacucaggaggcugaggcaggagaauggcuugaacccaggaggagguggagcuuuaagugagccgagaucaugccacugcacuccagccugggugacagagcgagacucugucucaaaaaaaaaaaaaaaaaaaaaaaaaaaaaaaaaaagauuuauaagcaauuccugagguuuuccuuuuucuuucuucuucuuaaucuuucuggaaaauccuuuacuuugaaaagcaaaggcaaaccucuuauacuuuuuaagaauaaaggcaaaacucugagaugaucccaacaaacuggguauauaaaccagcaaucuaauauguacaguacaaaacaaacaaacaaaaacaaguucuacauauaguccugaauuagaauuuaaaauuucuaccuucugaagcauuaaguuuucugucuuucaaggagagucauuaucauauuuuagcccagacuaugagauacuacaagauuagcccagucuauggacccaucauacuauauauacccugagcuacccaauuucucagauuuauuuaaacauuuuuuggugugcuuaauuuuuuuccuacagaaaaacauauuccaaagccaaaagcaacucaccuccauuuaagaauauuucacuuacauaaaauuuacaacagcaacuguugaaaucucccugcugccuuucuggaacccuuucuacaacagcucccaccgcuaucuugggagcggaaauugcaaccacuaauagaagcccuaaagguagauuuaucuuaauaguuaaaaggcaguuagguuacuugguaugauuaauacaguauaauucaauuauguuauggaauaaauaaacuuuggaaggcugaccugagauccccagcauucuccgaguuuuuauacauauguuaaaauuuuguauaaaagauuugcaaaaggauucuuguaacgcaauacuuccguaaaaugugacugcauaauacugacaaguugugcauucuacauacguuugcuaaccuguaguucaggucauuuagcuugguaaucacugaccaguauccucaguggaaggcacaguacagggagagugagcucaggaaugagaugcacuucagcugaccuaaaacuuacacaagauauaucccagaucuuggcaucauuaggaauuuauuucugacaucucaaauuccaaaaucucacucuggucuuuuaauccaucucccuuucucacucgcugaaucuguggucuucacuagaaucacuuauccuuugacuucucccaauuguucaauagaggugagacuauauuuaauucucaucaguaucuucacgcccccugcauuccuggccuauacaccuucucaacauguauucauaccuccaagaacccagccacaucauuucuucuuuucuaauuuuggguugcuggguacuacagagaaaacucuauaauucugcagacugguuacaauaaaaaguuauuauuuucuacuucuuuccauaaauaaaaacuaauaauuccaaauagauuaaagauguccauguaaagaaacaauacaauauuaguagcaaauauaaaaggaauacuuauacuuuagaguaaaucuuuaaaagggaaaaaaagacaaacuuauggccaaaaauaccacaaacuuaaaagauaagaaacaaauaggcaaaaaauauuugcagcccuucuaacaaaguauuaauaacuaggauauccauggaacucagacucaacuacccuagagcauaguagauauggaauacaaauagacuacucccaguaaaaaacacuacacaacacauaugaagagguacuuaaaaucacuaauccaagaaaugcaaauaaaaacaaaguacaauuuuucaucauuacuuugguaaaacuaauaggauuucucuucauagacagcaagaaguacuaaguaaaauggaaauuacuacacauauaagucaacaagaagcuauccuguagaaauauucacacagaucacaaagaugucauacaaugugaauuaccgcauuauguuauuauaaucauuugcgauacugaaaaaguuggaaacagucuaguccuuuaacagaucaauagguaauucacgguacauccaugucauggaauacuguuaaaagaacauguacuaauaugaaaagaaaaguuaaauaaaaaacaaaauaagggauuuagcaccaaaauguaaagagcuuugaaaucaucuccuguucuuacacaaaaaaccacuggaucaacucuaacucaaggacuuuucuuggacccaucaaagaacugaggucgcagggcaaacaaaccccagaaauccagagucacaggugaaaucagccuaccuggauaagaagucucugcagccaugaacugguaggaacaccucaaugguaagugggacaaacugguggugguugaaaguggacuagcaugagagggagaaaugccgggaccacaacuuuccaggguugcaaucacacuagguuuucaagaucugagaaagauccccucccuggcucaagcagagaaggggaagagugaguaaucacugugaaaugcucucagaguauucuccauaacaaaggccuacacugcaggaugaaagauuuuaucagagccuuaucuuuccugggggaagggcauuucuuccacuccagccccuuugccuucuggucucacuugagguccaggaagggaaaaggaagaauaaaggaagcaaagcccaggggaaacacuuggaaggucacagcccagaguccagguccacuaaaacacugauauuuaguaauaagauuauaaaacauuuccccuuccuccaaacuuucaccauaccaacagggcucuaaaaaaaaaaaagaaaugcuagaaaucaaaagcacucuaacagauaugaagaaugcuuugauaggcucagcaguagauggauacugcugaggaaagagucagugaguugaagauaggucaacagaaacuucuagaaagagaagggagcaacagcauauuuaaaguaauaaugacaaagaacuuugagaacuuugcaaaauuaaugacaaacaccaaaccacagauacaggaagcccagagaacgccaacaugauaaauaccuaaaagacuacauguaggcauauuauauucaaacugcagugaaucaaacauaaagagaaaaucauggaagcaugaugagguagggggauaacaggaagggaaaacacaguaucaaaaaaggaacaaggauaaaaauuauagugggcuucucaucuaaaacaugcaagcaaaaagagaaggagugaaauaguuuaaacauuaggagaaaagcccaccaaccuaacauaccaauuucccacccaccaaauuccuaggcauucuauaucuaauaaaauuauccuucaaaaaugaagaaagaauaaagacuuccucagauaagcaaaaacugagagaacuuguugugaggagaucuucucugcaagaaauguuaaaaguucuucaggaagaagaaaaaaugauaggggucaguaaauuguaucuauauuaaugaaagaaagaacacuggauaaggaauaaaugaagguaauauaacauuuuuauccuuuuuuuuuucuuuuuucuuuuuuugagacaggauuucacucuguuaccagggcuggagugcaggugcaaucccagcccacugcagccucaaacucccgugaucaagugauccucccaccucagucuucugaguaguugggacuacaggagcauaccaccacggccaguuaauuuuuguauuuucuguagagcuagguauuugccauguuucccaggcuagucucaaacuccuggcucaagugaucugcucaccucagccucccaaagugcgaggauuacaggcaugagccaucaugccuagcuuuuaauuauuccuaauugauguaaaagauaacugaauguuuaaaaauagcaguaauguguuggaugauuauagcuuaugaauaaguaagauaaaugggagcaauaucacaagggagaggagggaggagcugguaaugcuauugcaagaaaccugcaguauaccucagugauacaaagugucauaugaaggcagaucaagauaagcaaaaggugaaugcuggcaucuaggggaaccauuaaguuuaauaugcugccaggcgcgguggcucauuccugaaaucucagcaauuugggaggccgaggugggcagaucacgaggucaggagauugagaccauccuggccaacauggugaaaccccaucuauacuaaaaauauaaaaauuagccaggcgugguggagggcgccuauggucccagcuacuugggagacugaagcaggagaaucgcuugaacccuggaggcagagguugcagugagccgagauugccccacugcacuccagccugggcaacagagcuagacucugucucaaaaaaaaaaaaaaaguuuaauaugcuaagauaggagauuaaaagaaaucauagaaaaugcuguuaaaaccugagaaggcaagaaaagaagggaggaagaacaaagaacaaaugcaacaaauagaacacaguuacaaacaugacagauauuuauccuacuaaaucaauaaucauuauaaaugugaguggucuaaauacaccaauuaaaggauagagaaugucagaggggauuaaaaacucaaaucccauagacaauauaguaucuauaugaauguaacuuuaaacauaaauaaucagauagguuaaagguaaagagauggagagaaauauaccaugcuaacucuaaucaaaggaaagcuggauucuauugacuuacccuugaaauaaaaaagauuuuuaaaaaaagcaggaugcaguagcuaaauuaauuuuacaagauguagucuuucggauaagaaaauaguaucagggauaaaaagaggcauuauauaccgacaaagggaucauuucuccaagaagacauaacaauccuuaacguguauaggucuaaaaggaauauaaaaauauguagggcaaaaacugaacugaagggagaaagagacaaauugauuauuggaguuugagacagcacucauacauuaauugauaaaucaagcaugcaggaaaucaauacauauauaguuuaccugaacagcacugucauuaaacuagaucuacaguugacauuuauaggauacuugauccaacaacagcagaauacacauucuucucaaauucacgugaaacauucaccaagacagaccacacucugugcuauaaacacaccuucacaaauuuaaaagaacagaaaucauacaaaguaugcucccaggucagaauggaauuaaaagagaaauuuggaaauuaaacaacacacuucuaaauaaacauaugguccaaagacuggucaagagaaacugaaacacauuuugaacuaaaugaaaauacaacuuaucaacaugcauaaaaugcagcaaaagcuguucuuugaggaaaaaauuuuccucacagaacuaaauguauacauuauaaaagaagaacgaucuaaggauuaauaaacuacacuucuaccuuaggaaacuagaaaaagaaaaguaguuugagcuuaaagaaagcagaaaaaagaaauaaucaaaauuagggcagaaauuauugaaacugaaaaaaacagagaaaaucaauaaaaccgaaugcuugcucuuggaaaugaucaguaaacuuaguguaaaucucacuaacauaugacuggugucuuguucguuuuuuuguguuuuuuuuuuguuuguuuguuuguuuugagacagggucucaaucuguaacccaugcuggagugcagcgguaugaucagggcucaguguagccucaaccuccuguacuuagguaauucuccugucucggccucccuaguacaaggcuacaggcaugcacagccacgccuggguaauuuuuguauuuuuuguagagauggaguuucgccauguugcccaggauguucucgcacuccuggacucaagcaauucacccgccucggacucacaaaaugcuggaauuacaggugugagccaccgccccaggccugguguccuguucuuacagcuccuaaguuaucuucugauaaaccaagcagagaccgggcgagguggcucacaccuguaaucccagcacuuugugaggcugaggcgggcgaucaccugaggucaggaguuugagaccagccuggccaacauggugaaacccugucucuacuaaaaauacaaaaauuacccaggcaugguggcacacaccuguaaucccagcuacuggggaggcugaggcaggagaauugcuugagcccaggaggcggagguugcagugagccgagauugugccaaugcacucuagccuggcugacagagcgagacucugucucaaaaaaaaaacaaacaaacacaaagcagguaucauaccacuuuucugauuuaaaaccuguugauucccuauugucuaagaauaaauuaaaauacaauuuucagcaucauuuaccaguaagccaccaccucuuucacucuaaauucugccacacugaaaguaucucccagacuguuaggcccuuucaguccucuauguauuauguauauuguuuucucugcuaaugaugcccccuccucugcuuuuccaaguagucuaaaacucagcucuaaggucaccuucucagagaagucuuccccaaaucuccaggcaaguuuguuguucagcuuuuggccuaccaugaaacuuuaguuauacagucaugcguugcuuaacgacagggauacacucgagaagugcacuguuaggcaauuuugucuuugugcaaacaucagaaagugcacauacaaaaaccuagaugguuuagccuacuacaaaccuaggcuauaugguauagccuauugcuccuagguacaaaccuguacagcauguugcuguacugaauacuauaggcaacuguaacacaaugguauuuguauaucuaaacacagaaaauggccuguaaucccagcacuuugggaguccgaggcgggcagaucaugaggucaggaauuugagaccagccuggccaacauggugaaaccccgucucuacuaaaaauacaaaaauuagccaggcaugguggcacgcgccuguagucccagcuacucagggggcugaggcaggagaaucgcuugaacccaggagguggaaguugcaguuagccgagaucacgccacugcacuccagccugggguaccgagcaagacucaaacacacacacacacacacacacacacacacacacacacacacagaacauacaguaaaaauacuguagaaagauaaaaaaugguacaccugcacagagcacuaguuaugaauggagcuugcaagacugcaguugcucugggugagucagugagugagcagugaaugaacgugaaggccuaggacaucugaauacauuguagacuuuauaaacacuguacacugagguuacacuaaauuuauaacaaaauauguuucuuucuccaauaauaaauuaacuucagcuuacugaaacucuuacuuuaugaacuuucaaacuuucaaauuuuuaaaaaaacuuuuggacucuuagaauaacacguagcuuaaaacacaaacacacuguacagugguacaaaaauguuuuuucuuuauaucauuauucuauaagcauuuuuauauuuuaauuuuguucuaaguuuuaaaacauuuuuguuaaaaaagacaccaacacacauauuagccaaggcuugcacagggccaagauuaucaauaucacugucuuccuccuccauaucuugucucacuggaaggucuucagggacgauaacccauauggagcuguuaucuccuaugauaacaaugccuucuucugaguaccuccugaaggaccugccugaagcugucuuacaguuaguuuucuuuuuauaagugggaguauccucuaaaauaaagauuaaaaguauaguauaguaacuacauaaaccaguaacaugguaauuuauuaucauguauuacaugauuuauaugcauguguuauauacuauacauaauuguaugugcuauacuuucauacaacuggcagcauagaaggcuuguuuacaccagcaucaccaugaacacgugaguugugcuuugugcuacgguauuacaacacuuaugacaucacuaggugacaagaauuucccagccucauuauagucucugggaacaccaucauauaugccgucuguuguucaccaacauaucauuauguacugcaugccuguagucuguuacagaauauucaucauuaagagagacaguauaacauauuaguuacacaggcuuugcaauuaauuguauuacuaacuauuuaaccucaagucagauacguucuguguguaagauuccuuaucuggaaaaaaagaauaauuaucagaaccuaacucaugguguuauuuguagaaauuagguaauuuauuacauggaaagcacuuagauuaguauuuggcacaagugcucaguaagagagggcuauuauuacuguuauucuaccguaauguacauuuaccaguaaaugguuauuuauucccauuagcaauaauuuucucaauaaagagaaccaaaucuuauuuaaguuuguauccuuaguucauaguaagugguuggugaauaauaaauguuaaaaaaaaaaaacuuacauagaguuauguaacugguaagugacagcacuagauuuucuguucagauauucugaguucuggguguguauuuuacuguuucucacaaaaacuuacauauuacaacaugaaaaaauguuuaagcuuacaauuuacguauccuaguucucauccuaaagaaagcuuuugcaggacaucuuacguaucuccugauaaaaauuacauuaaucauuuguucuaaauugaaaaguuaccaacuugcuuagagauaauuucaugcuauuaaauuaucaauaucuugcaucaaacuauaaauuccuugaaagaaggcuacgcucuccaaauccuuuaacauauagcuaaguaucugguacauagcagaacugaaggaauauauguaugauugauucucauaacuuuaaggaaaaguacaaauuuuaaggcucuuuauuaucuagccccugcauaggccugacguucuucaugcccuacuauucuacuuuaaccacacccgucuacugcaggccuccuugcucugccugcacgcacccugagcccucuccugggggcucuccccgucuggcucuucuacauccagaugauuaugaaucauccuuuaaaucugagcucaacugucccucuucuaagaagcuuuccagcuuuccuuuguuguuguuuuucucauucuguugcccaggcuggagugcaguuacaugaucagggcucauugcagccuccaucuccugggcucaaaccaucaucccaccucagacucccagcuaauuguuuuauuuuuuuauagagauggggucucacuauguugcccaggcuggucucaaacuccaggccucaagugauccucccaccuuggcuucccaaagaguuggaauuaaaggugugagccacugugccuggcugaaagcauuccugaaucucccagucugacagaugccucaccgucuugguucccauagcauccuguguacaucuuuaucauugcauuuaucacaucauguaacuguuguuuugacugucuuuuucaacaccagacaauguaagauuauggaaggcaaaggucauauccuauucaacuuuuuuuuccugaauaccugacaugguaccugacaaauaagaaauggacaaaaaaaugauucauaaaugaguaaacggugcugaauaagaguuuagaagauaaaugauuuagaggcagcucaaggacuaguuaaggugauuuaaaauagaccaaagggggcaaauuuuuucuuuaaauuucuuaucuguuuauuuuaaaacaagaaaacuuagaagacaacuuuguuuuuuaugguuuguuuaaaaucaauuacauaacuaacaaaaaugaccauuuuuguuaagauuguuggguaccccauaauguacuuuuuaaaacauguucaguuaaaacugauauaaauucagaaaauaagaacuauuuaagagaaggcaggggcagaaggaaaaaaauuacuaacagagaguuagguuugggugguaaacagaugaugacaaaaggcaauaagccagaauccuccgcuggaaauucaagcaucaacaacauacugaggacaaggaacaucccaaagaggaaaacagcucacuagugucauaagaaaucaugacugaaugaggcuggaauguauguuaagaccuaaaagugaucaaaggaaaaugacaaaugccaaaagauugugcagaauuacacugguaaaaccucacaaaugaaaaaaauaugaauaaagcaaugauaucaacaaaaauaauaaugguaaaauagauguuggcuucuucacagauuaauuauacuauugauuaauuagaaugaggaguuuuauuguuauuuuacauuuuucacaaaauaucaaaauuuauacauccaaaugaauuuugcucuuccaauuaguuauguuggaaagcuauguauacauaaugauguugacaugguucgaaaugcuuuaaaaaauuccucucuacaaacugcuuuaagagcauuuuguaagcuacaucuuaaaauccguaucaucauacaucacguguuaccaaaaauggaauuucccaguguacucaugugcuuuaguuucaaaacuuccucaaaauaucuucugccuguuacuaaaugucaaauccauuuaaaagauugaaaauucaccacuaauaaccaaaaggcugcacugcacacucuguguuugcauccccaccuguaauagcauugcugaaauuuaauuccuuaagugucuacuauauauaaggaacuaagggaaugccgacuucaguuuuuacucugccgauaauguggcuauauucauuuuccuaaaauuucaaacagaucagaauacaacuuuccuuaaaagugacaacaauggcugcaauggacuagagacaaaacuuuugcaagguauaaaaaggcugcucaaaaucuggugggucccuaauuuugaagcuguaucuucugcccuagcccuccccucaucccaugcucauaccacaucaccuaucugcuguucccuggacacaccaugcaauuucaaacccuugaugcuucucccagauggucuuuguuugaaauaacagauuuuucuacuacauggcuaccuaucauagguaguucaugacuguauuuaaucuuaaagcaaugugaacacagcuauauaguaguaacuugaucauugauucaaagaaauauuuaucaacucacucccaacccaccugaauuucucucuguuccagccacgacuagcucuacuuucagcagcuuauauucacuauguucuugucaccacagcaauugaagacaucugaagacauuaauuugaaaagcaaaucuuuaaaaauguuuagaagaaaaugcuggaaaguacaaccucagguuaaggaagaaaugucuuaaaaugaaacaaaacaaaaauuauacauacacacacacacacacacacaaaauuggccuuaucaaaauuaacuucuguacaucaaaauaaaaaaaaaguaaacacaagcuagaaauugggagagaaauauuugcaacaucuauaaugaacaaaaaagcauuacauucaaaauaugcgaagaaugucuucaagucaaugagagaaaggcaaacaacccaauagaaaaaugaacaaaagacaaauaggcauuucacagaaaaggaaacaugaauggccacaaaaauaugaaaagcuacacaaccuuguuagucauaaaugaaaugcaaauuaacauaacaacgaguuaacguuugugugaggcagaauaauggccccuaaagacgucucuacuacauccuaaucucuagaaccuguauguuacauuauguggccaaaaggacuuugcaaaugugauuaaguaaagggccuugcaauggggagauuauucuauauuguuugagcaagcuugaaauaaucacaaagaaggagucaggagagagaaggagaugugaccaggaagcagagguuggagugauauggacaucagccaggaaugaggguagccacuggaagaugaaaaaggcaaggaacagauucuccccuagagcguccagaaagaaugcagcucuaugaacaccuugauuuuagcccugcaagaccaguuuuggacuucugaccuccaaaauuguaagacacuaaguuuguaauguuucaaguaagaacauggucauuuguuacaagagcaauaggacaucaauauacuauuguguaucaaaaaucaaaugugacaauaccaaauuaguaaagaugugaacaaauggguuauaaauguuaguaacaguguuuauggauuggcauuaucugguuggaauuaucuaguaaaauugaccauauacagaucauacgaaucagcaauuccacuuagguacaugcccuaaggaaacucacauauauguagaaggagacguauaaaguaacauccauaagcaacauugauuaaauuguaaaaaccugaaaauaauaaaaguguuugucaauaagggaaccauacauauauauauauauauauauauauauauauauauauauauauauauauauauguuuuuuuggagacagagucuugcucuguuacccaggcuggagugcagugauaggaucucggcucacugcaaccucugccuccuggguucaagcaauucucaugccucagccucucgaguggcugggauuacaggcaugcaccaccaugcccagcuaauuuauuuauuuauuuuuuaguagagaggggguuucgccauguugaccaggcuggucuugaacuccugaccuuaagugauccgcccuccucggccucccagauugcugggauuacagguacgacccacugugcccaaccugaugguaagucuuacugagcuucuucaauuguuugucacauauacacucaauugauguuuuucaauauagccuuauucaagauuucuauuuaauagccuuguucaagauuuguaauuuuuuaccauacauacgcaucaauugcuuaauauuacaucacauacuuuuauuuuaauccuucuauuucaaucuguguauuauucucuucauucacagacugcaugggaacaugagacucauuugugguuauuugauagcaaauaacguaucucccugugaauuauuuucuuaaaucuaaagaauaagaaaaaaaacuacccuugcuucaccucaaauauaccauaaagauaaacaaauaaagcaauacaguuauuucugaaaguacuuugcaagaaagacggccacaucuugggcaaauacucuuccuuucaccaaaucuuuuucucuuuuccucagccugucaaauuacauuccuuuuauuuugagggcugaauucaaaugucuuuguuuuccaggaaacaaccuaauuggccucuaacuagaauaugaucguuacaaucauuaaaaaaaaaaaagauuguuaagccaggugcaguggcucacgccuguaaucccaacacuuugggagggcgaggcaagcugauggcuugagcucaggaguucgagaccagcccgggaaacauaacaagaccccgccucuacucaaaauacaaaagaauagccaggcauguuguuguacaucugaggucccagguugagguaagaggaucgcuugaucccaagcggugcgugaaggaugcagugagcugagauugugccacuguacuccagccugggugagagaacgagacccugucuccaaaaaaaaaaaaagauuauuaagaucuauuauuaagaucuacuuuucuguuucuguuuuaaaguauguacauucguauggucguauuuauacucaacuauaaggacaugagaaacauuaucucaugcaaucuucaaaacauuguuaguaaguaguaugaaugggacuugaagucaugccuuuugacagcucuuugcucucuguaagaaugccuguuaugucugugcuaucaucucauauccgcucaucccaaauucacauauaauccucaucaccuagaaaaacaagcacugaguauccacaucaaggcucucagucaacagccaauauucuaguuuggucccauuugaggcuauuucucgcccuaccacagguauaauaaaagcauguuaggauuuauggagaguaucuccaauaagugcacagcuccaccaccacuccuugaagaugaaucuggcgugaggucaguaaucuguuucuuuauauucaacuuuuaguggcuagcacaguaccugacacacugaagaugcuuaacgaauagacggauaaauggauggauagaaugaagcagagacucuuccugcugacacaccuaacuuaucuuuuccacaaauuccucuauucaaauuauuuuaaauuauauguauauuauguauauauaaucugcucuuuauguauuuuuuagggauauauaaaugaaaaagauuaggaaacuuaugaaauuccuaaacacacuuuaaaauaaaaggugauacuaauaugacuaucagggacacaaaaauuacuugucaguggauuuauacccuuuguuaaucagaguauuauuguuucaccuauauuuuuuuuuuuuuugagacacagugucauucugucacccaggaugguaugcauggcaugaucagagcucacugaagccucgaccuccuaggcucaagugauccucucaccucagccuccugaguagcugggacuacagguaugcacauguggcucauuuuuucaguuuuuguagaguuggggucucacuacguugcccagguuggugucaaacucugggcuagagcgauccucccaccuuggacucccaaagugcugggauuauaggcaugagccaccgugccuggccucccuuauaauuuuugaauuaaauagucuacaaacgaaauauaaaaguguauuuauauucucauggcugggggaauacauucucacuaaaggaguugaagaguggagggguagacgaaaaggagagcaaaaaacuauguguaucuguccuuccaccauaucaaaauguaagaaugauuacuaucauuagacauguccuaauuacaucauuucucuguugaucacauguagccuauuuuaaaaaaugccuuuggggaagaaucagaagagaaauguuauucuuaucaguuagcuuuuuaauauauuagguaaaucuaucugaaacagugacaauauuugaaauauguggcuucucuaauuucuggggaaauaaguaacugaagugaauaauucuccaaguguaaaucaguuuaccauauuuuucuugguaagucucaucaucuucuuagaaggaaagcaaugucauaaaauauaaaauacuaccuugaauaaacuggcacagaaccccucuggcagugaggaacuauuuccuaggcuuauuuauuuuuauaacauuccauaauaagaccuaauucauauuauuuugaagagcaaucuaaaagaguaaugccuuuuauaucauuacugaaggauuaagcauaccuagcuguuauuuucauucuacuugucuccuuuuacauuuuacaauuaacaccucaacuagagcuggggaaaagggaaagacuauaaaacugaaaucuucuaguugaaauauuugcuaggagguuuagcauuuggagguuaaaauuaaguuucucaucuacuuauuguauuuccaauaucuaggcuuuugaauucaguggcuuaaacacaaaauacaaacuacaugaaauaaauguuuccauauaaagaccuaacuaccccuaaaaagcagacguaacguucuauuuaaugaucaaaauaaaauauauauguauguuuguggugucucaaaauuacaugcuaaaaauuacaauuugaauugagaauauuuuucagguagggaacaaagaaugcaaagacuugggacucaaaaagcuauagauuacuuuuuaguuuuucuuucuuugugaaauuacacaaaacaaagucauucuauggucaaaacugagucacgccaagacauuuaguugauuuugguuuaugcauauauuuauguuccuaguagaacauacacuaagucauucaaaaauauugagagcuauaccaguguugauuacuuaaaauauuucaacuuguuuuuuaaagcaaccuauuucuaaugugaaacuuauuauugaucuagguuuuuuuuuaauauucacuugauuuuaauuuuugacugauuuaaaaauguucauaccauuuaauauacacuuagaguauauauacacuuguacucucagacuucagagaaaagaauaacucauuuaauuucaaauccagaugucuccugaaaagcaaaaucuaacacuuaaauaacaugggaaaaaagagacccugaagaaauuacauuuaauuacaauuaaagaaauugaucaagaauuaacaauacauauaucucaaggaucauaaugguuacuaguuaaaaguguuaaacauaauuuaaauguacuuaggaaacauaacagguaacaaugaucacgaaacuugaaaauuaaauuauauaauuuuuagacuuugaaaauaaucuucuaccaaaccaugguaauaaaaucaguggcagaaugguauaacaacaaacugaccaagguagaggugagaaaucucagaggcagacccauauaucuaaucagaaccaaacaugugauaauugucacagaaaacgguauauaacaaucauguaaaugguacugagaaacuaacucacuaauuuuagaauacaauuaaacuagacuccucucuaaagucacauacggaggugcguucaaaauggauuaaagauccaaguaugaaagguaaacuauacagcuaauagaagaacauacauauucuuuguuguuguuguuguugucugaggugaagucucacucugucacccaggcuggaaugcaauugcaugaucucagcucacugcacccuccgccuccuggguucaagcaauucuccugucucagccuccugaguagcugggauuacaggcgugcaccaccaugccuggcuaauuuuuuuuuguauuuuuguagagauggggauuccaccauguuggccaggcuggucuugaacuccugaccucaagugauucacccgccuuggccucccuaagugcugggauuacaggagugagccaccacgccuggcaaauauauacauacauacauauacauauguguguguguguguguguguguguguguguguguguaaaaugaaucacguaagaacucuaacaggauaaauucaaaaucacuuaccguauauaaaaauaaaaugaugaauguaauuacuucaaaauuaaauauuuuggcuuagaaaggaacacuguaagccaacaaaaaaagagagaacacaauagaagauauuuaaaauauccaaaacugacaagaauuagaauauagaauuuacaaguaaugcaacaagaaaaauacagcaaucccacuggaaaaaaggcgaaaaauaugaacaaggaaucuggaaggccauuaaacacagagguguuagagguguuuuaauuuaauuaguauucagagcaauacaaauugaaacaaaaugccacguugcaccuaauagauuagcaacaaucagaaagcuggaaaaugcuguguccuuagacauguggacagaaacuacacacaugacuagugagaaaaugaacuggaucuaaagggcaauuuugcaucguuuggaaucuugcauuccucuucuacaucuacacucugaagaaauucucucauuggaagcaauuuuuuggaagcuacuuaagugguccaucacugagcaaaagaacaggcaaaccaaaguugauauacaacuauauauaguuauuuaaaaguauacauuucagauccauuuaaguuggacacgucuuagaaacauagugauggguaaaaaaaauuaaaaaauaagaugaaauacauuacaauguaacuuuuggaaauuaaaaauacauggacagaaagcaaacauuuuacauggacacauauuaacaaaagacaacauuaacuacuuuaaaaugguuguaucuguccuucauuaaauuuauaggucuuuaauaauuacuuugcaauacuucugaauuuaguucaacccuaaaaaucacuguuuuauauaaaaauauauuuacauuaacaacuaaaauuaaauacuuauauaccaaccaauucauuucuuaaguuagucucaagugaaccacauuuauuuguuuauuucuucuuuuuuuuuuuccuuuaauggaaugcuucacgaauuugcaugucauccuugugcaggagccaugcuaaucuucucugugcugcgaaugugagcacaauugaaccauguuuaaaucagauacauguauuuuuuucuaaagugauucuuagcuauuuaucaucaacacagccauuuugguccuuuuaauccucugacacaaaaaaaauuccuuaaaauaaauuucaucugcuuagcaaguaacaugaaaaauauauguauuuguaggaauauuuagagagggaaggaaggaagggaggaagggaaggagggaacugguuuuucaauagguauuagauauuaaauaaauugcacaacauuuaauagcaaaauaagucugagucucuuccagucuucagacaaaccuacccauggucuccaacaacaaaaagucaugcugggaauaccaacauuguucugguaguguucaauacccuagauuugccucuaauaaaaauagagcaauuuccuauuaguauuuuggagucaucacaacuuuggcauaaucucucagucuucuuaugaauauaugaugaaaauuaugguacagaaugaucacuuuuacacuauaauauucugaaacauuaauaauguauaaaacaucaaccauuaugcugaguaggugcuugggauacagugguacauaucaacaaccuggaacauguggcauuuacaccaugugccaggaaaugacaauucauuuaagauagacaugauaucugaccucguggaguuuagaaacugagugguagcaaagauuaugaagaaugauaaaggcuaugcauguuauaccagggaaacacaggaaggcuggggaaaaguacaucagggaaaccuaaucuagcuucagggagguggggcuguggggaagaagaguguuaggaaagagaagcacauuuuuaaaagaucgucaauuacagaagaaaacaaaugaauuucacuggccuauccuaagaccauucuagccaaucagauuuuugcagcuugguuucugcccauuggcuuguaaucaguauuuccaaguguaaaacaccagccauucuuuccuugaaucauuuuaagucuaaggggacagcaucaguaauuagcagcucaggcuggaguuaaucccuaaggaacucucauuuccugccucuaugucaguuuucguccaggaaauauagccuuaauauccauagccaaguacaaugcuagguauuuucacaaaaauuuauucauuuauuuccuaccacaaaaugguaugccuacuuuauacauuuaaaauauggaagcucagaguuuaagcagcuugccaaaaagauccaacaacuagcauuagcuaaaauuugaauucaagacauauaaguccaaauccaguacucuuuuauuaaauggaagcucuuugucuuuaugaaauaccuuuacuuaugaaagcaauggcaauuuuauuuucugguuguuccuaccaaagauaguacuauuuguucuuccuuaaaacauuuggacaaaaugaucaaguauuuuuguccccaagaauuaaaaaagaaaaaacccacaaaacccauguuuacuuuguguaucuuccaccaaggguguaaccagauuggugacaagaaauaugacucaugagcgguaucuuggcaaagaauucuuagcaucucuagauacaucugacacauaggggaaauguuacauacauguaacuacauuuucuuuuccuuugaggaucucccgcuaucuuuaauucaaaucugccacaauccuaacacaugccucaauauuaaauauagaauaauauucagaauauuaaggaaaucauuucuuggaagaauuuuucaaaggcaaauacgaauaaaaaacuauuguugagguagucaugguggcucgugccuguaaucccagcacuuuggaaggccaaggcgagaggacuguuuaagcccagaaguuccagauuauaguaaacuaugauugugacuauuagcaauuaaacacagcaauguauuaugucauuuaaugaguuaugagcaauucuuuuauuaaugagaaaaugagauaauaacuuuagaaaaaaacuccaauaucaagaguacuuaacuauuaaccuuauucuucugugaauaaaauaauauacuuucauauuauuuuccaaaaugaugacuuuugauuuaaaaaagauacucagguuccauaaaguuuuuuucuugcauauccacuaaaauguaaaugcaaaauauuucugcuuucaucuacuguucuuaccuuuugcuaaaugaagcuaaacuaaauagcgguguguuagauccagcuuguaccagcuuaugagagccgauggcuaaauuuucagaaauuuuggacauccagcugucaaacuacaaauagcuugggacuaaccaaggugagaauauuugcaacacaggaaucagcaaacacuaaaaauuggggcuuuuuuuuuuuuucuuggcuagcugguuguuauaaagcuugucaguauaucagcacugugcuuaggccacacuagugcuucagaagcuuguauuuuuuaucuucuuuucuucucuucuuuacuucucuuuuccuguaaacacugauuuuaugcuuuuauuuuuuccccaaaggccuugccuugaaaauacuuagacuacuucaaaaaguucagauauugugacuaacgaucuaaaguaaaaauauuuuuucaccaaaauauucucacagaaaguguaucccugaaucuugucugauuggccugauuuaucguauucuacuacuuuaaaagcaaugucucuauuucuugucagggugcuaagagcaaauuuuuauucccuccagugaauauugugcuugaagcuuauacauguauuccucauaaaacauaaaugcauaauauuauccauacuaaaaugugugcagucuuuugucugagcaauauauuuugugcaugauauuacacaucugcagagaccuuuugcauuaaacuacgaaucguuaugcaaaaauagaagacaaaauugauuaguucccuuuuacagaagaagaaauaaagacagguugaaauuucuguaaaggcaaugaaacuaagaaacaauguuuaaauagucucaauaugugauuaaaaaaaauucugguuugauucacaaaaaugcugcauuacagggacaagcaauagacuagcaagaauaggcggcagcaaaaaaguucuggugucaggcagauaugaauuucaaauucuguuccuaugaauuucaaauucuguuccuccauucacuaucuaugugacgucaggaaaaguaaaucaaacuacccuaagcuacauuuuccuuaauaguaaauggagaugaguaugauacuggcuuuauaauguuguaagaaaagagagucagaauauaugugauaugacuaccacauggaaggcaaucaauguuuaguuaugacaugauuagaauuggucacugcaaaaccaaccaaugacugaauuggaauuaagaaaaaaaauuaaucauuucaauaaaaaaagaguauguuccaaauucuuauagccaguauaugauaaauaugguggggauugcagcucaagauccaucguaccuugcuccuguaaugggcuuucauguauuacagaggcuauaaaacaaaauaagcaagguuuccacagacuccuaugcaaauagguucuuguugcaauuuagguucagccaaucaaacuuacuugccccagcuuuuuuuuauuuuuuuuuaacuagugucucacuguaacucaggcuggaguacaguggcacgaccauggcucacuucauccucaaucuuccagacucaggcaauccuccugccucagccuccugaguagcugguacuacagguacacaucaacaugcccagcuaauuuuuguauuuuuuguagagacagaguuucacuauguugcccaggcuggucuugaacuccugagcucaagauauccaccugccuuggccucccaaagugcugggauuacaggugugagccaccacacguggccuugcccaagcuuugaaaaggagaagugaagcagagaccacacugucaaugauauacauacauuuuuuaccugcaguguuggacagagauccuaguacccaguaauuauccugcuggcugcugggaggcagugcaugucacaucuauuugccuggucauaauaguuacaguaugacuggagcaagcagcaguagaggcagcuuucugccucugaacuguguguggcacugaacuguguguucuagagccgggguugagaaauuucucaguuaagggucagauagcaaauauuuugccaugcgguuucuguuacaaccuuaacacugccacuguagcgugaaagcagccauauauaauagguaagugagcauguauugcuguguucaaauaaauacugacauuugaauuucacauuuuuuucauuuuuaauuggagaaaguauuuuguuauguuguccaggauggucucaaaugccuggccuaaagcaauccuccucccacuuuggguucccaaguagcugggacuacacuacaggugccuaccacugugcccauugugaauuuauuaauuuuaagugccacaaaacauuauuuuucuuuugauuuuuucaaauauuuaaaaauauaacaaccauucuuaguuuguaagacauagacaagcaggugauaggccagacuuugcccgcaggccauaguuugccacccuacaacagucuccugauccacacagacagccgcagcucccuuagaaaccaguguugagguauaccacugggagauguuuuuaaaguuuaaccaugagcccaaaaucuguuucgucugcccuuuccucucuuccaugauuuuguaagccacuaaugccauguaauaaguauuuuccugcguaaacugcuagaccaaauuuuauucucugcaacuaaauccugacugauucauagugcuacauauauauaagcacuuuuuauuuucaaccaaaaaaaaagaaacccuuauuaucuuucagguguacaccauaaaauauucauuuacaaauuaauuuuaaugcauuaaaaauaugaguuuacaacuaaaaaacuauacacaacagaaugccauuuuaagaauacacuauuaaauugaaauuuauuucaaacuaggagcauaaaccaccuaauccacaagaaucuacagauuccgcagaacaccaugauaaauauaagaaaaugccuaaauaauaauuugaaaguauuuauuauguuugaaccacaaaaauaaaaaauuauauaaugggaaagaaaaucuguuuaccuccuuucagugauuagggaaccugcauuagauuacagaaugaaaaaggagaaaacaggagaacucaaaggacauuuugcuuauggaaacucuacuuuuuguuuuuagggaagcauaacuacaucuccaaagucuaugauggcucuagaguaucuuaaguggcaacugcauaaucuuugagcacuacauucauuucucuccaggcauugaaaagucaaauugggacagaccuucaguucacaucaguaauaguagaacuaauccuucuuggaagguacagcacagaauaacccugcaaacagaaauugucuaaagguaauuuagaaaaauggccuucaauuuuuuuuuuuuuuuuuugcaugcaaucccuaacauaagucagaaucuuuacuauuuuuagguugauaucuaauacuuuucaaccuaaguuuaaagaguuacaaaggauggcauuauaagcauugacaguuuuaaauaaaauaauuuaucauguuuuggaauguauccaugggaucuaaacauagcgucacaaucaacauccuccauuacauauauauauauuuuuaaguuauucuuuaacugucagaaauuuaaacuuauucugaaucaaaauucaggcuuuauguaaucucuuauaaagugugcaugugugugcgugcauguguguaagaaucuccaaaaaaaaaggacucuaaaaaaaaguauuagggcuaaauacuuuuuaaaguauuuuaaagguuuuaaaauacuuuuuaaaaaguaaccaucauuuuguuaauaucaaauauccaauguucaaaaucucauaaaugucaugguugauuuuuauagauauuuccuaugcaucagguucaaaauaaagaccacuuauugcuauuggcugauaaugucucuuaagccucucauauagaucucccaguuuauacugggcacaggaacucuguguugccuauuguuugcugaauaauuuauucaacaaauauuuauuaagcaaccacuauguguccagcaauguuuuagaugcuaagaauguagaggaagaacagaagccugcuaaagucuguguccuuuuggaguuuagauucucaugagacagagaauaaaauaaacaaagaaaucaauuaugucugaugguuaugaaaauaauucaguaagcuuuggaaauagaauguucccaggguugcuguuucaguaugcauagucaaggaauguuucucugagaaguucacagcagaacagaaaccugaaugaaugagggagcaaucccuaagaauuucuaggggaauaaaauuccaggcuaaggaacaaguaaaaccaaauggcuugaagugagauugugcuucacauggcugaacaacuguaaugaaaccaguagaguuggggagcagaauuagagaaggggagaguguuaagcucucaaaugucugcauugugauucaguguuuacuucucuucagcugcuuuccaucaacugagaccaaggagauggcucuauauacuaccuccucuauucugcugcuucuugccacucuuuucugcaaaaaaaagguacaucugugucuuucccugcagcuucgcccugccugagacuuuguaguccccuugcuaccuaccaugggagacucugugcuguguuuaaaaucuauagauauuugcauacuucccaauuugcuucaagguucacaauguuuggcagcucuucucauaaucugagguuugggauuacuguuuucuccucacuucacuuaaguuaaaagauuucuucccuauucuuuauucuuuuuguuauguucaguuagcauuaggcagaagaauagaauacaaauguuuuuacucagccauuuugaauggaauccuuuuccucaccuacugaugauaaauuuagaguagguacaccuacagaacuuaaauuucucaaucucuacauuuuuuauuucaauaucuagauuuuccuauuugaaaaucugagaaauucuagacuaccaacaucuacagacuuacaacuauuguuuaaaaaauaggcugggcacgggggcucacgccuguaauuccaaaacuuugggaggcugaggcagguagaucauaaggucaggaguucaaaaccagccuggccaagauggugaaaccucgucucuacuaauaauacaagaaaaaaauuagccagaugugguggccagcgccuguaaucccagcuacucaggaggcugaggcagagaauuucuugaacccaggaggcagagguugcaaugagccgaggcugcgccauugcacuccagccugggcgacagagcaagacuccgucucaaaaaaaaaaaaaauuagaaaaagguaauuuagcacagaaucaacuuuaaauguacauuaaagacucuauaaggaauauaaacuuagaaacuauaguaaauuucuaccaugauccuuauauucaaacuaaggaauaacaaaaggcaaauaaauguccauauucaaacggauaugcaaugaagagagaauaagcaaaauaucaaaacaauauauguuaaauaaauacagcauuauuacuuuugagaacauaaacucugguuauguugauaaaagcuuacucuguuuucuacuuuaaauaacggucaaauugucauguacuuauguauaagugauuugcaugaaaaguauucugaaucaucuaagaguacuuuuuaaaaagucagcucuuggccaggugcaggggcucaugccuguaaucucggcacuuugggaggcuaaggugggcagaucacuugaggucaggaguuugagaccauccuggccaacacggugaaaccccaucucuacuaaaaauuaggcugggcgugguggcucaugccuguaguccuagcacucugggagggcgaggcagguggaucaccugaggucaggaguucgagagcagccuggccaacauagugaaacccugucucuacuaaaaauacaaaaauuagccgggcauggggcacacgccuguauucccagcuacucaggaggcugagacaagagaauugcuucaacccaggaggcagaggaugcagcgagccgagacugcgucaccgcacuccggccugggugacaaagcgagacucagucugaaaaaaaaaaaaaaauuagccgguuguaguggcacacaccuguaauuccaguuauucaggaggcugaagcauaagaaucacuugaaccuggggggaggagauugcagugagccaaaauugcaccacggcacuccaggcugggcaacagagugagacugucucaaaaaaaaaaaaaaaaaaagucagcuuuuucaaauagguaaauauuuuucucauaauugauuaauaaguuacuaauaaguaacuuauuaaacucucucuucagaaauguaaaacucagguuagcuuuuauuaaacuuuaaaaacacuggcuuagugaccucacaugguuauaaagcaagaguucaaaaauuguauauguuaacauuuacuuucuuauucauuuaauaacacuuguuacaugcaaguacucugcuaguaacuagugauggaaagauaaaucaaucacacucuacccucuaggggcucaugguuaagugaaaaaacauaauagaagcaaugugauaaguauuauaaugaauaauaaaaaauaaagugcuauggagaacacagggaaaaggcaguuaacuaucaauagagaaaguaacaucugaacuaagccuuagaaauugaagacaaguucauucagcugacaauggacuagaacuuauuucuagcaaauaaacuguguacacagacaagaaagcacaagauacgcugcuggguuggccaaguaguucugcauaguuggaacaaagggugaauauggagaaaagcuggagaugaggcuugcagagaaaagccagucacaggaagagccuaaaaggccuuacauguuagacuaacaauaaacuguuaaguaggaggguuauauauguagagaaaauauuucuaaauauagugugauaugugggauagauguaucuuaaugaugcuuucagcgauaaaggcagugccaguagagguaaggguggggcacagugguaugagagauuacaaguaaugccacugacaaaggauuaacaaucuaggaaguagauaucuuucaggaucaaaagaaaaagagaucaagaggacucagaauuccagguugggugauacgaacaaugguagugccauuaauuaagcuggaaauaaauugaaggaauacaaauuagugcaaaagauaaaaagagacaaauuggaacauggcgaaauaaaaggaugaaagaggcugggcgcaguggcucacaccuguaaucccagcacuuugggaggccgagggggacggaucacgaggucaagagauggagaccauccuggccaacauggugaaaccccgucucuacuaaaaauacaaaaauuagcugggugugguggugggugccuguaaucccagcuacucaggaggcugaggcaggagaaucgcuugaaccggggaggcagagguugcagugagccgagauugugccacuacacuccagccuggcaacagagcgacacuacaucucaaaaaauaaaguaaaauaaaaaauaaaaaggugaaagaaaauguaaagcaaaaaaaucccaggacaugaguucaagagaggaaaaucagauguaugccccuaaauaacacauccaacacaagaaauaguauaccaaguaacaagcagagacccucaauuucaaggaaugugagguuguuuucuauuuuuccaaguagaaaaaacuauauaagcauauuuauaaaacuaaaaaagcauuuuuagccauuaagaauuuuuuuugaaauuuaauauaugcaugggguuuaaaagaccauacugaaaagaauacacaguaaaaguaaauaucccacuacagggcuccaguuucccucccuagcacugucaucacuaauuucuugaauaucuuuuaaaauauguuaaauauguguaagcauauagguguacauauaacauauauccuccuuuaaauagccuauuagaaacaguucucaagauacauuuucuauuuccuaaauaugauaguacaguaaucaaauuuauaaugguagcucuauaaaucaagucaauauaaaaaguccugucuacacauaauuaacagucuuuguuuaucaauaaauccagugauaguaaagauuaaaaacaaaaacccacaauuuuucuucccagagacugaccuuuagggaauuccuuggguaacagguucugaaugugugagcacaauagggcccauucgcuugaagguauuuuacucaaaacuugaaaucugggcuccagcuagaaagagggggaaaaagguuaugaauuaaucucuaauucagaauauuuuccucaacacagguagcccagguccacuaacuaucucauacaugaggacuuuucaaccuugguuggauacuggaaucaacuaagaagcuuuuuaaaaaaugcucugaugcccggaagccacacucuguucaaauuaagucucuggggcuagagccugggcaguguuuuuauggguuucccaacugauucuaaugugcauccgggguugagaaccacugccacagaaauauaaaaucauaugguauggaggucaccuauaaacuuuucagcuuguugcuaaauaacguaugaguauggaaaaugcacuuuuuuuauuuuauuauuuuauuuuauuuuuugagacacaguuucacucuugucacccaggcuggagugcaauggccugaucuuggcuuacugcaaucuccaccucccaaauucaagugauuuuccugccucagccucccgaguagcugggauuacagguguacgccaccaugccuggcuaauuuuuacauuuaguagagacagaguuucacuauguuggccaggcuggucuugaacuccuccugaccucaggugaucugcccgccucggucucccaaaggggaaaugcacuuuuaagauacuugggcaaagguggcucuaaauaaccagaguguuccuaacgcaggacaaagugacgcuggagagcccacaacacaggacucaauagguauucaccucacauuuucugaacaagcuuaaaaucccaggacaaaccuauucuggauauuucauuaugaaagaaacaggaucaaauauugaaaaucgccuuuaaaucuuccugaauuacaaagaaguuacauauuuagagauaacaacuauuaaaauuuaacugaaaagcaagauacaauuaacuacugcuugacugcaaaaaucaaaagugaaauaaacaaauuaaauuccuaacaaugacauucacaaaaccucuuuuauagggauuauaaccuauggcauaugaaagagccuaagcuggcagccacuaccuacauguggcuauuuaaucuuaaauacaaauuaauuuaaauauaugaaguaaaaaaucuaguuccucaguugcagacacuuuugaagugcucaacagcuauuaugugucuagugacuacuguauuagacagagccaauauaaaacauuuuaauugucacagaaaguuacauuggacaaugcuggcuuggggguaaaugaagccccaaaacuucauauuaaauuuguaaacauacauauauucuagagagaugaccuaugacuuuuauuugauugucaaaggagaucauguucaauugccacaccagugauucaagugccagugcccaagcccgcagaaaguagaaaagaguuuuuuuguuuguuucguccccaaauaguuaccucuuuuaaaaaagcauaucauaucaacaguagcacuucccacucacggauacagucuuucaaccauugcaugaagaugacuggacuacuauuagcacaaaauggucuucccaccucccugauguuguuaugguccuggggcuucacugcuuuuucagaagagaaaaaguaauaguaaaucauaaccagaaaaauagaccuccuuugcuuuauucaucaucuccaacuucauuagcuauugguauauccaagauuauuuaccugucuuuuaaccccaaauuccagcuuuuuguggcaaagggaaucacaacaaaauggaaagugaauucugcaucccucagaaaaaaacacaaacaacaaccuuccaucuguaggaugcuguuccuaagaagaauuccaaggauacuuggcuacuaaccuaagauuuaacaccuaaguuaucaucaaaaacuaacacaaaacaaagauacgaucucacaggugagcuucccuuauggauaaacagucuggguuuagcuuccauacugaaaaggucuggguuuggcauugaaacaaagucuucuaaagagacaucauggugugaugaguauagaguauauccagcuauacccaauuucuaggauacgaucaacugucuaauugauuuaaaaacuuagcaacuccaucucuaauccuuugcuccuaauacauaccuuuuuaaaaaggcaaccuccuugaaauguuugacugcaucuuaacuaauucaaacaaaaauuacuuaaaaaaugaguaugccuuuuaucugcaaagaaaaaauauauccaagccaaaagaccacacaagaauaugaaaaaaguaaaaggcaaaauagacccucaguguaagacaagaccaaagccugucuuauaaauuaggugagcuugcugcgugaacuauaacgucugaguucaaaaacaucccaugauucaaauguuauuaaacuaaguguauuuuaagucaauaaacuaaacguuuggcauuuucuuaucaaauuaaacauuuauuuauuauguacucaugauaaauugcaaucccauuccuaaguauuuaccauaaaacagggguuagcaaauuacagccauguaccaaaaucuagcccacacguuuuuguaaauaaaguuuuauuggaacacauccacauucauuuacuuacguauugucuaugacuccuuucacacuacaacagcagaguacccacaacagagacccuaaagcauaaaauacuucauccaguccucuacagaaaaaguuuucugacccuggcacuaaagaaauaaaaacugggccaaguguggugagucacaccuauaaucccaacacuuugaaaagcugaggcgugaggaucacuuaaggccuggaguucaagaccagccugggcaacacagugagaucccaucuccacaaaaaaaaauuaaaaauuaaaaacaaaaaauuagccagaugugguggcgugcuuguaguccuagcugcucaagaagcugagacaggaggacugcuugagcccaggaggcagaggcuacaugcaaugugacugugccacuguacucuagccugggugacaaagccaagacccuguuucaaaaaauaaagaagaaagaaaaagaaaugaaaugaaaacuuacauucacacaaaacuuacacacaaaaguuuauaguaccucuauucauuauggccaaagaauggaaacaacccaaauguccuucagcaagugaauagacacacaaacuauggugcacccauacaacucaacaaaaguaaaauaauuuuuuuuuugagucaggaucuugcucaaucucccaggcuggaguucagugguacaaucauagcucacugcacccucgaacuacuggacucaagcaauccucuugccuuagccucccgaguaucugggauuacagacacaacaccacaaccagcuaauuuuuaaauuuuuuucauaaagguggggucucauuaugaugcccaggcuggucucaaacuccuggccucaagcgauccuccaaaagugcugagauuacagucaugagccacugcauccagauugugaaugaauuauuguuacauauaaaaacuuggauuauucucaaaggcauuaugcugagucaaaugaaccagucucaaaagauuacaaauguaauuccauuuauaugguguucuugaaaaaaacuauuuugaugaagacagauuggugguugccagggguuagaggugagagagacugugacuauaaaggaacagaacaaggaaguuuuuugggugauaaaauuguccuguauccucacugugguagcaguuacacuuaucugcacauguaucaaaacccauaaagcuauauaccacaaaaaggugaauuuuacuuuguaauaaucuaaaaaacaaaaacuuuugaaaacagcaugauaguuucuguguuuauuugugcugugauaacagaauacaugaaacuggguaguuuacaaauaauagaaauguauuuccucauggaucuguaggcugagaaaucuaagaucaaggcaauggccgguucacuugucuggugagggcugcucucugcuuccaagaugaugccuuguugcugcauccucuggaggggaggagcguguguccucacauggcagaaggcgaaagggcaagaaaccuaaugcauaaaggcucguuuagaagggucuuaaucccauugauaagaaagcagccuucauggucuaaucauguucuaaaggcucuaccucuuaaugccaucugcuaugguuugaaaauuucuccucuccaaaacucacguugaaauuuaaugcuccaauguggcaguaauuagagguggggccuuugacugguucaugaggaaucugcucucacgaagggacuaauccauucauggauuaagguccucguggggaucagcugguggcuuucugagacaagaaagagagaccugaguuagcaugugauguccccuaccaccucaggacucuguagagagucccuuccagcaagcaggcccccaccagagggaguuucuugaucuuggacuuuucagucuccauaagcauaagaaauaaauuccuuuucuuuucaaauuacccaguuucagguauucuguuuuaagcaacagaaaacagacuaagacaccaucacaauggccauuacauuucaacaccugcauauuggaggggacaauauuuaaaucauaguagauaguuuaaagaaaaacaauaagauaacaaggaaacaagcucuaaaaauuuagagcaaauaauaugagauuuuuccagggaagaugagauccgaaaguguugucuggguuacuauacucuuggguuucaguccuggcuuuauaauccauucacaacggaacauuaaaucaauaacccaucucaguauuucccugugauuuuucugcacgcagucuggcagguugauaucugagggugaauauaaaguccugaaugcaauauuuccccugucaaauaugacauacugcaugaagaaauacugcaauucaaguuaucucagaauaccuccauucuacucuccagauuagccauaaauacaaaggcauggcuuauaucacaguugucagcccuuuucacacacucaaguuuucucacucugcugcucucaaagcucuuucccaccuccaaguucuuaggaaaaucuggcauuauauuccauacacacacugaaauacugugccacauauguuuuugcacuauacauggucugcaauuuucuuuagggaaaccagauuugcagacugcccaugagaaaucuguaaacugucaccuggaauuaaucaaaagguaaauuuaguaaauacaaaaucauuaucacagaaaacaagagguagaauucagugcuuucacagaaucaacaauaaaaacaauuuauaaauggguuauauauuuuguaaauccaauaaaauaguuuuuuuaaaacccaauaugaaaaacuggcauacgauuaaaaucucuggaccagacuaaaaacauucagacuaauugcuuccauugugcauaauuaacagaccaugucucaaguuaaacucuaaaagaggaagaacucaggagugaccacuaaucuucuguaaaccauuuuuacauggucaucaaagagaagaaacuuuuuagaagggcaaaauagaauuuucaccaugacaaaaaguacaucccaaagucccuagcauuuuguggugauuuuaaauguuagcaaguucuuugauauuccuacuuuuaaaaggaaaagccuuuuucuccauacccuuugaaugggacucacuuucgacaaguaaaauguugggagugauacuaugugacuuauaagacuaggucauaaaaaggauucaaacuguagcucugccauuaauacuaauuccucuuucagacuuauugucaggauuggagauagcauauguaaagucuuugacuuagugccagaauauuagaagccuaacaaauagcuucuaaccaagcacuuguaguccuuaaagucucccucaagauguguauuauuaggauuuaagaaugaaaagaguaaauuauguuguugaaugaaggaaagucacaaagugcuaaaaucaaaucacgaagaauauaaggacuuuuagaaaaaauuauuucuauuaagguugagucaaaugaaauugccauuuuuguuaggucagaaaaaagagaguaucaguaauuuuuacaguucaaucuaauacauguggaauaaauguuuucccuuugauauuaucaaacacauuaucacauauuucaaauaaauggaaaaccucagggaauauauaaucuaaauguaaaaauuuacaauauuuuccauagcagagcauauaugaagggaguuuguuugcgucaaacaaacaaaaagggaguuuguugcuucucacucuauggcacaggcuggaaugcaguagcgcaaucucagcucacuguaaccucugccucccagguucaagcaguccuuccacuucagccuccuguguagcugcaaguacaggccugcaccaccaugccuggcuaauuuuuguauuuuugguagagaucagguuucuccauguaacccaggcuggucucaaacuccugguuucaaguaauccgccugccucauccucccaaagugcugggguuacaggugugagccacugugcccaguccuauaauacuguuuuaauucauucuccuagucauuagacuucaaaaauauuucaaaccaaaccucaccuuagaguuucaucauuuaaaaaauuaaccuucuuugaagguagccaaguuaugacaaacugagaaaagcuggacaaaaacaauaucugaaauauaugaacauuaaagaaucgguuucagauauuuaagacacuacgcuauacacauguauauuuaugugauguguaucucuauuucucuaucucccuaucugucugucugucugucucucuccguccauccauccgcccgccugccugcccgccugccugcuauggucugaauauuuguguucccccaccucaaauucauguuaaaaucccaucucucccaauaugaugguacuaggagguggggccuuuggaagguguuuaggucaugaggguggaacucucauaaacugauuaguguccuuauaaaagcuccuuugccucuuccacaugugaggacacagcaagaagguccugucugugaaccaggaagugggcccucaccagacacugaaucugcuggugcguugaucuugaacuagaacugugagaaauaaauuucugucaugcauucauucauucauucauucauucauuuauuugagacggaguuucgcucuuguugcccaggcuggagugcaauggcgcgaucuuagcucacugcaaccuccaccuccuggguucaagggauucuccugccuaggcgaaacagagcaagacuccaucuaaaaaaaagaagaagaagaaaacugagacucagagagguaaaauucaaaggucacacagcuuggaagggcucuguuagucauucauucaacaaaugguagacaugguagagauguaauacuuucucaucuauuacaguaccauuacugccaaaaauuuuuaaaaauaaauaaauaagaaagcacguuuuaauauaaacuaauauaaacaaagcaaacuucugugcugcaguuugugcagguguucuuucugugcugugguuugucuuacaaagcaagcaaaauguggcccaugcaagcaaacucuaaaagguagaguuucuagggcuguucucucccuaaaaaagcucuuauucacucuacaacuuuaaauaccaucuguauaucuccuccuaacucucugagcuucaagauuguuuaauugauugccacuugacgucuccauuuggucacuuacagaugucacaaaaguaacaaguucaaaaauaaggcucacaccuguaaucccagcacuuugggaggccaaggcaggcggaucacuugaggucaggaguucgcacauuggugguaguggucccuggggcccagcugucuuuucuuuuaucucuuugucuugugucuuuauuucuacagucucucgucugcgcacacggggaaagacccaccgacccuguggggcuggucccuacacacaccuguaaucucagcacuuugggaggccaaggcaggcggaucacuugaggucaggaguucgagaccagccuggucaacacggugaaaccuuguuucuacuaaaaauacaaaaauuagcuggccaucauggcgugugccuguaaucccagcuaccugggaggccgaggcaagagaauagcuugaacucgggagguggagguugcagugagccaagaucaugccacugcacuccagccugggcgacagagugagacucuaucucaauuaaaaauaaauaaauaaauaaauucuugacuucccuuuucacugaccuccagucucauuuaagaauacugucauccaaccaacugcucaagccaaaaccugaguauuuuccuugcuuuccuccucccccacacucuucauguuaagucccauugguuccaccuacagacuagaucucaucuauccuuuucucucccaacacuuuagauccgagcugcgauuaucuuucaccugaacuacuauaauggucuuauuauuuuccugcuuucucuccuuugcagacaaagugcuuugggggcuagaggacagguaacagaaacuauaguauguaacuuuaaaacccuucgguggcuuucaguguguuuaauaaaagccauacuccuuaccauggcccuuuaaaauucuagauaucugaucccuuucuaccuuucaaacuucauuccacucucccccagacaucuccaggcaugcuuucaauuccucauacaccaacuguucacacugcagggucuucccuucuuccuguaaauuccuggcagggauaacuccuucaauuuucagcuucaaggucaccucucuugacaagccuuuucuggcaauguagaaguaccucugccuucccaugacccucuaucaccucaucugcauuucuuccauggucugcgcuuaacaucauuggaaaauaucuacuuauacauuuaccaucuaguugucuaccagauuaugaacuccaaguagacagaauaugucuguuuuguuuacuuauauucaccaccuaguaaaaugccugucauguaaauuuuucuugaaugagcaaguuaggaauauuagacuaaaaggacuuuaauuucuauacaauuuaaaguguuuuaagcuacaaauuuaaaagauaauuuaugaucuucucucaugaaguauacaaauauaacucagagacagacguguuucauuucuuaaagaccuaugacaaaccucaaagcagugaaguuugugucagauucauuuuauaggcaauauagaaccuaagacaugacuuucuuauuuucagaaucuaggugaaaaacugcaguaaaauuaugaagagguaccaacuagcucaaguaaauaauuauguuuauaugcaaaaugacuauagccucaaaaauauguguaauauuuuaauaaaagcauauucuuaaaaaaauuuaaccacagucaucccuugguauccacaggaaauuggcuccaggacccccacguauaccaaaauccugccaugcucaagucccuuauauaaaaugauacaguaauuacauauaaccuaugcacauuuuccuguauacuuuaaaucaugcuuguacaaccuauggcucaugggcugcauauggcccaggaaagcuuugaauauggcccaaauuuguaaacuuucuuaaaacauuaugagauauuuugugauuuuuuuuuuuuuuuuuagcucaucagccaucguuagugcugguauauuuuauauguggcccaagacaauucuucuucucccaguguggcccagggaagcccaaagauuggacacaccugcaaaucauuucuagauuacuuauaauaccuaacacaauguaaauccuauguaaauuuuuguuauacuguauuuucaaauauaaaauucuuuauuauuauuuuuugcaacaucuuuucccaaauauuuucuguccaugguugguugcauccauggauguggaaccuguagauauggagggcugaauuuauuuccauuuggacaaaaguauuuugcagagagagaaaauaaccuauuuuggucagguccaagggagaauaauaaauuacugucccauucuguguugguuauaaauauauccacgaauuuuaugaugcuccucuuuucaaagguagagucuaauuaauccccucuuaauuauggguuacacuuagcaacacguuucuaaggaacagaauauggaggaagugacuaugugugaccagauuauaaaagacauuaugacuuccuucuugcucucucucagauuacuugcccugaaggaagccaacuuccacauugugaaaacacuccagcaacccuauggagggguccacaugaguagaaaccaaagguuucugcugacagcuaguaagaaauugaggucuucugucaacagccauguacgugagccauccuggaaagugauccucuagucccagucaagccuuuagauagcuacugccaacauccugacuacaaccuuaugagaaauccuaagccagggccaccuaguuaaaccacuccuaaauaccuggcccacagacacugugagauaauaaaugcuuggcuuuucuuaagcgacuuaacuugaaucagcaauaaguaaucuauauucguucaagcaauaaucauugaucugugccuacuauggcccagucacuguaccaggcccuacagacacagggaaaaaauaagacucacugucuuacagggauagacgggauauacaagaggauagaggauaguauagcaacacagcauuaagugcucuaaacggauaaauagaaggcccuaccucaacacccagaacacaauaucaaguuucaaaagaaggaagaggaagaggaggaggaggagaagcuguuuaagggggaaagaguggguguagguaugcauaucuacauguaaggugcaaggaaagugcagaggaugacaaaugaagggacuggagauauauauaaguaccaguuggauaaugaaaggaugccauacucugagcuuuaacuaaaggcaauaaggagacacugagaauuucaauaaaguaggguaagauucacauucuacaaagaagacucuugcugcaguauggaaaacggcuccaaagggccuccucuaauacagacaguuaaaaggaaacugcagcuauccaguuuagguagaaugauggccugaaauaucuuagcaacaagaaguaaaaaagcaguagacagauucaacagacauuuagaagguagaaagauagaacuuuaugauugauuuuaaaauuaaaugccaucaauaucuccagaacacuaaaaaaggaaaaucaccauaauaugcaaauauucagaacaaauaaaagaacaaucuuuauugguauacauggcaaacccucuaaacucaaaagaauccccaacacauucugaaaguggaaaugaauuuuaaaucaguuguccaaaaagacagaacuauaaauucaauaugaggaaggcauaaauggcuucgcauaauucuaauguaccucaucagaaaccucaauagucauuuacaacugacaagcccaacucuuuguauauuucaacuuuuuuuauugcuaguaugaaguauagcucuuuuucuuucccuuuuagaauaaagggaucaaggagauacuguauuaccucuccuugaauaucuaagucagauaugccagaauacaacacauuguccuuaucuagcucaagaguucuuaguguucuaagguugaaacucuucaggacuucagugagcauaaauuaucaacauaagaacucuuucuaagcuauaauguaagcucuuugagggcagaaaucaugucuuaaacaucuauuccuagcacuaagcccacugcaucuaaagcaaggaaaaauucaaaagauguuuauugaauggauucauauuaaacuaaauacuaggagucuauuccuacgcacguauccauacacacacacacacacacgcacacacacacaaaaauauuuacugacggaauuuguuucauaauacagggauagaguaaaugcaugggaauguaauaaaacaagaugggccaauauauaacuuuuuagaacugugagauuuaucagagaaaacugaaaguaaacaagggaguuacagggagggcaucuauuuuauguauuugguucaugggguaaaauaaacuaaaauacauuuuaaaagguuaaaauuaugcuuucuugacagauuuuugccuuuaauuuauaacccaguguucuuguuacaaaauauuuauacuucauaauucuaaauaccaaauaacuuauuuuagaacuaugguuaaaguauuguaauaaaaaaagaaagggcacaaauguacuacagaaaaauaaaaaaaaauucauauaauaacaaaguaagagaaaaugacaucuaauguucuccuaauuuucuguuugcuguugcagucugaaggaacacaagauuaauuagauacuuguaacauaaaaauaaccuaaauacagucauucauauuuggcuuaggagucucacugccagcucuuuaguaaaaauuauuccuuauaaaauacuaauauugucuuuuaugaaaucucaagauuuucaguaaguagauagcuucuggaacuaaaauaaaaguagcauuuaacauaaaauugaacaauuuacuagauuacgugacuuauuggucuuuucauuauugcauuuuuucugcaagcaagacaaauauuuucuuuuuugucuucaugcuuuugucucuaauccucaaauuuccaaagaaaguuacaauaugaauuaaauaaccaacaacuugcuugcuuuaacauuuuuuccuaguauaacuccauaaguauucauaauaaauuuaauauuugccauucuuuuuggaauacugucaacgaaaugaaacuauuaaaagcaaaauucaaagauacacagucagcccucugcaucuguggguuccacacuguggauucagccaacugcagaucaaaaauauucagaaaaaacaaauuccaucuguacuaaacauguacauauuuuuucuugucauuauuccuaaacaauacagaauaacaacuauuuauauaacauugacauuguauucgguauuauaaguaaucuaaagacgauuuacaguauacaggaggauacgcacagguuaugugcaaaaacuaugccauuuccuaucacggacuugagcaccuacagauuuuggugcuugaggaagguccugaaaucagucccccacagauacaagggaugauuguauauuagaaacauuuuuaaaggcacacauuaaugguaauaaaauauccaauuaaaaauaaaacauuuaauauaauaaaucaaauauauaauauaauguaaucaaaacaguaugguacuagcauaaggaugguaauauggaccaacagaauggaacagagcccaggaaaaaacucucacauauauggccaacugauuuucaacaagagagccaagacuauucaauggaggagaaggcagucucgucaacaaaaccagugcugggaaaauugaaucuaccuuaaaaauuaacauaaaaugggucauagaccuaaauuuaagagcugaaacuauaaaguucuuaccaaaaaaaaugggcaacuccucaauguuuuuuguugguuuguuuuugugauggagucucacucugucgcccaggcuggagugcaguggugcgaucuuggcucauugcaaucccuggcuuccagguuaaagcgauucuccugccucagccucccaaguagcugggauuacaggugugugccaccaugucuggcuaauuuuuuucuguauuuuuuuuuuuuuuuaguagagacaggguuucaccacguuggccagacuggucucaaacuccugaccucaggugauccaccugccucggccucccaaagugcugggauuagaggcaugagccaccaugccuagcccaaugguuucuuaaauaugacaccaaaaccacaggaacaaaauagauaaacuggacuucauaaaaauuaaagacuuuaguacaccaaaggacacuaucaacagaguaaagcucccagaaugaaagaaaauauuugugaaaucauacaucugauaaggguuauccagaacacauaaagaaccccuauaacucaacaacaaagagauaaacaacccaauuuaaaaaugagcaaaggaggugggaggaucacuugaagccaggaguuugagaccacccuggaaaacauagugagaccccugccucuacaaaaaauuaaaauauuagcugagcauguggcauacgacuguaguccuagcuacucaggaggcugaggcaacaggauuccuugagcccaggaauugaggguuaaagugagguauaaucgcaccacuacacuccagacugggugacagagugagacccugucucuuaaaaaagaaaaaagggcaaaggagcaaauuacaugaacacacauuucacugaagaagauauauacacuugacccuuaaccaacacagguuuaaacuauuuggguccaguuauaugugaauuuucucaauaaauauauuugaaauuuuuuggagauuugugacaauuugaaaaaucuuacagacaaacuucauagccuaggaauauugaaaaaauuaagaaaaaaguaaguaggucaugaaugcauaaaauauauguagauaccagucuauuuuuaucauuuuuuaccauaaaaauauauacaaaucuauuauaaaaaguuaaaauguaucaagacuuacacaugcacagacuguaguacauggugccauucauaaucaagagaaauguaaacagugaagaugcaguauuaaaucauuaacugcauaaaauuaacuguaguacaggcucuacuaccaaaauaacuucguagccaucucuugucgcuauagugguaagcucaaauguugcgaguauucauuaaaacacugugcgaugcuaauuaucucugccagagcaguuugucucuccaguaaguuguauauggcaacaaaaugugucucaagguucaugcauauauuuuucaucauguuuagcucaauaucauaaaccuugacuaacaccguggaacucauacgaagugccacuagugaugcuggcuguguucccaagaagcagagaaaagucaugacauaacaaggaaaaguugaauugcuugauacguaccuuagauugaggucugcagguacagcugccgacuauuucaagaaaaacaaaucuagcauuaaggaccacuguaaaaacagagagggaaacuggugaagccaucacugcagcucugccagaaggcacaaaacccugcacuguuugcaaaauacuuuuuuaucucauaaugaaaauccagcuuuauugugggcacaggguugcuauaagaaaggcauauccauggacucuaauaugauuugagaaaaagcuaagucauuauaugacaauuuaaagcaaaaauaacaugaaggaucuaaagcugcagaauuuaaugccagcaaaggauggcuugguaauuuuagaaagagguauggcauaaaaaugucaagagaacaggagacgcagcuucugccaaccaagaggcaacagacaaguucccagacauuaaaaaaaaucacugaggauaaaguacaucugcccagguuuuuauuguagaugaaaguacccuauucuaaaaaaaaagaaaaaacaaagcuuaccaaggacauuuauuacuauagaaaagaagugagcaccaggauuuaaggguauaaagggauagacuaacuccuguuuugagcaaaugcaguuggguuuauaaucauaaguguccucaucgacaaagcugcuaaacccugagucuugaagggaaaagguaaacaccaaaugccaguauuuugguuguaccacaaguagggcuggaaaugagagugcuuucuggauugcuuccacugauacuuugucgcugaaguuagaaaguaccuugccaguaagagacugccuuuuuaaauuuguuugguauuggacaaugcccuuggccacccagaaccucaugaguucaacaccuaugcauugaagggucuacuugaacccaaacacaacaucucuaacucagccucuaaauaagggcauuauaaagaccuuuaaggcucacuacucuauggaaaggauugccaaccuauugaagagaacccugacagagacaacaucaugaaagucuagaaaaaugacaccauagaagaugccaucauuguuacagaagaagccauaaaagccaucaagcucaaaacaacaaguuccuguuggagaaaaauguucccagauguugugcacgauuucguaagauguaugauagagcugaucaggaaacugugagagacugcagauacagcaaaaaaggugaggggugaaggguuucaaaauauggaucuuggagaaacucaaacgcuaguacacaccacaucagaggaauuaacagaagacaacuugaugaagaugagugcuucugaacuaguaccagacaaugaggaagaagauguagaauaagcagugccagaaaaaaaaucgacauuagacaaucugaagaaggguuccgauuauccaagacuucuuuuaugacauggacucuucuaugauacaggcacugaaacuaaaccaaaugguggaagaaggauuggaaaagaaauauuuuuagagaaauaaagcaaaaaaaaaaaaggaagaaaaauuauaauguauuucuguaacaugacaccaagugugccugccucuccugccucccuggccuccccuucccuucccuuccaccuccuccaccucuucugcuucugccacuccuaagacugccaagaccaaccccuucucuuccuccucagccuacucaaugugaagaugaugaggaugaagaccuuuaugaugauccacuuucacuuaaugaaugguaaauacauuuucucuuccugaugauuuucuuaguaacauuuucuuuucuccagcuugcuuuaagaauacauauauuauguguaacauacaaaauacguguuaaucaacuguucauguuggugguaagccuucaacaguagguuauuagggccggguguggugguucacaccuguaaucccagcacuuugggaggccgaggcgggcggaucacaaggugaggagaucaagaccagccuggccaacauaguaaaaccccgucucuacuaaaaauacaaaaaauuagcugggcgugguggcaggugccuauaaucccagcuacucaagaagcugaggcaggagaaucgcuugaacuuggagguugcagugguccgagauagcgccauugcacuucagcccgggcaacagugugagacuccgucucaaaaacaaaacaagacaaaacaaaacaaaacaaaaaaaaauagguuauuaguaguuacauuuugggagagucaaaaguuauacauaaauuuucgacuggaggggcacuggcaucccuaagcccugaguugcucaagggucaacuguaucuugucaguaagcauguguaaaaaugcucaauauaauuuagucauuaggaaaaugcacaucaaaaccacaaugagacaccauuuaacaccuauuaugauggcuacuuuccaaaaaaauggaaaauaacaagugcuaguaaguauguagagaaauuggaacccucauguauugcuagaaaaaugcaaaauggugcagccacuguggaaagcaaguuuagugguuccucaaaaaguuaaacaaagaguuaccauacaacccagcaauucuguuuucaaaagaguugaaaacagugacucaaacagaauuuuguaugccaauguucuuaucagcaauuuucacaauagugaaagguguuaaugacucagguguguguaaacagaugaaaaaauaaauagaaugugguauacacauacaauagauuauucuuccauaauagaaaugaaauucugauacacgcaacaacauacaugaaccuugaaaagauuauacuaagugaaaaaagccagacucaaaaugaccaauauuguaugaucauacuuaauauaaaauaucuagaacaggcaaauucauagagacagaaaacagaauagagguggcuaggagccaggagagagaagaaugggaauuauuaccuaauggguacagagcuucuguuucagaugaugaaaaacuuccggaaauagauaguggugaugguuacccaacauccugaacauauauaaugcugcugaauuguacacuuaaauauuguuaaaauggucauuuuuagguaguguauauuccacaauuuuaaaaaggcauuuaagauugaauauuauuccugaaacagaauuuaauuugaucuaaagucuaucaccacaaaauuuucaggcaaacauaaacuaauauaguacuagcuucaaaguauauauucagcauuaaaauaaggcauccaauucucuggccacacuaaagaagccuauaaaugaaccccaaaggauuuguuuuuauagcaagaacuugguauucaagccaaguuaaacucacaaacacuccacagcaauaaaagccaaguucauugcagacuugagaucuuuaguugucuauuuuuacuguuucuauuuccacaucuagaauucucucuuuaagccagcuuaaaaauggggcucucaagagaaaaauaugugcacucaaauuuuuaauaaucaaaacuguagaaccucagaguaguagaagcuuuaaguguacagaccucaauuaacaggaacuggggaaaaaagguuuuaauuauacacacauaccucuggcucacccccacaauguguugcaugcuuuuggcaagugccacaaaaccaauuacuuaccauguuguuuucuaaucaggaaugcuaugauuuuccacaaacuaaugaagaaccuguuucauaauaaacuuaguccugaaauuauauuuuauguuucuaauccaccgaaguagaaccuugucauauauuuagggguaaguauuaaucauaaaaauaucauguuuuaucacacuggauagguacaagacaacuaucuuuuuuguggacaagcuguaauuucagaaaacggaugaacgacauuauaaacuaaaaacagaacgacacaaaaauaacaggucaagaaaugcaaaacacaggcaaaagguaaguucaucaguucaucuaguaaguucacaagagaugggcagagaaaaaauaaugaauacaguucuaugcagcaacauccucccaucauuauacuaguccucucuauccucuucuugccauucagcacucugucaugccaugaucacuaccacugcuauucucaaugagaaaaagaaaccaaauguggacuuuacuuaugcaaaugauuuacaaucauuagaugaagaauucacugauuuuccuuccugccucuguuacaaguauuuccugaagaauacugccauucucgcauaugauuaccagcagcaagugacugaucaguuuguacucaggcaggagggaaaggcuauucugacacucuaaugcagcacuucaacuggaugucaauguaucaagaauguuguuccaaauagaauacaagaacuuaaaauuaaaugaagaaaucccagagcuccacugaucucuagucauucugccaaauuaaucauggacucuugauaaauugaaaaugaauauacugaauuaauaaaacaauuucuauggaaguuaucaaaugaaaguaauauaauuucaguucaaaauaauuguaguacagacaaaauuccauuaagcaaauuagaauuuuugaguauuuucuauguuacauuuagacucuggcuggcaaacaucuauaagcucuuuuuagacucaaugauaaaagauguuugcuggcucuccucuaauaacauuaaaccaugaaaaagagaugaauagauauauauuuuauauaucacacaaaaacauauacaugaaacgaaguauauaucuaugaacagauacauauuuuauauaucacacacacgaaaaauagaugaauagauaucuuuuucgugugugugugcguuuaaguggaaagauauaacuuuuaaagcaucaaucggcgccaagcccucugaauuauuucacuccuuugugguaauauuacuaguuucugaccuauuaucuuuuuucuauaaacuucaguuucauggaaauggugaaguuacagaagccuaaaagaggucaggucuggugccaagaccauugaaaagaagccaagagagccucggaggccaguuggccaaagccuacuaggcugguccaaaccuuccucuuuacaaggauaauucacaauaacugaaaacguauaaucuaagucauuuaguagggaaguuuuaaaagaaaugauaauuacaaaagcuaggugauagauacauaagcauauuuuauggauaucugaaauuuucuauuaaaaaaguuaaaaguaaaauaaauuaacuuacauauucuauacauaauagcagauuuuuuucucauucaggcuuuacaauguaagacugcaggacaaggauaaauagagcaucugguagagauaaccaucucauuccuuuucuauuaaacacagcaaauucauuucaaacucuuuauguuuuuuacaacuaugacucaaaaugcgagggcaauaauaaaaaucauuagcaaauuugaauauauauauauauaaauugggaaugguaaaaaccaccaaaagcaaagucaaaagacaaaugagacaacugggagaaaauacuugcaauauacauuacagauaaagaaauaauauucccaacauucaaagagcuuaguaauaauuuaaaaagaccaaaacuccuagagaaaaaugaaagaagauauagacagacaucucccccuauauauauggcucugauagaugggaaaggauguuaaaccucacucauaauaagaaaaaugcacauucuaacuauaccaaaauaccauuucuuugcccuucagauuggcaaaaauucaaaagcuugacaauagacucacuugguaaggcugugggaaaacaggcacucucauacauugcugaugggaaugcaaaacaguacaaacccuauggaagggaauuugguaacaucuagcaaaacuacauaggcauuuaccacuucgaccuaguaauuccacuccuacauuuauccugaagauacaccuccagcaguaugaaaagacacaagguuauuaauugcagaacuguauaacuauaaaaugcuagaaacuaucuggauacacaaacauagaaaagaagaugaaugaacugguguacauacacacaaaagaaugaugacgaccucuaugaacugauauggaauaauuuccaggguauauuuuccagugaaaacaguuaagugccaaagugcuuacacagacaauaugcuaucuuuuguguuggaaaaaaggagaaauaagaaaacacacauaucuacuaaucauuauaaaaggaaacauuggaaagauaaaccaaaaaacaauaagguugguuaucuagcaggguagcauguuguuuuuguuuuuagugauauacgugaaacaauucugaaaccauuuuagaugguacucguuuagaccaaaugaguaaaauguuggcacuguugggagcccauguucucauuauagaaaaagggagaauuggagguaucaauguaaauucuuauuuugaaaaaaaaaauacccauauucacauauguauauccauguuauaugggcauauacaugcaaacacaugcgcauauuuguguguguguguauauauauauagauauauauauacacacacacacauauauauauauacacacacacauguguacauuuucuaguuuguucccugauagggcccagaagcaaagauauccagcaauaacauauauaccaaagcauccagaucuugguuucuaauacuauuacccaauaagaaggacuaaggcuccuaggagaaaugacugacuccagugcugggcaauaaaugcacaagaugaaacuuauuauaaagagugaaacuaaugacuugcuuaaaaaaaugaugggaacauguaaaaggauacaagagccagcaugaagaagaugccacuggugaggacuggaacaauuuuagcuccaaaauauuuaacaguagugaaauguuaagcauuaagggaaaaauaggaaaccauaaauucaaaucaacaauaaauaaaacaauacauauagauaaauagaagggcuccuauuacaguagaaugcugaguaaugacugguaaaugcagagagaguaaaucauuauuuugcaacuauaauaguaaagauugauucaagcaaguaucaucaauggaugcuacauacaggggaugaaauguuaugaggagcuguauauuuuaacugucuuaaagugucucccucccaguagacccuuuauuaguugcaaggaacauguaguaauaugguuuggcugugucccuacccaaaucucauuuugaauuguaguucccauaauccccacaugucaugggagggaccuggugggagguaacugaaucauaggggugguuaccuccauguuguucucaugauagugagugaguucucuagagaucuaaugguuuuauaagggacuuuuucucuuuugcucggcacuucucucuccugccuccaagugaagaaagguguguuugcuuccccuuccaccaugauuguaaguuuccugaggccucccagccauguggaacugugagucaauuaaacuucuuuccuuuauaaaucacccagucucagguauuucuucauugcagcgugagaaugaacuaauacacauaguaacuauauaguggaaaaaucagacaaugaaauggucaaaauuuccaucacaaaugaacggcagaacagucaguaccuauagauaugauaugcucagaaagauauauuccuuauguaauauuccauccaggaauguauaaccuaaaaucuuaucaacagaaacaucaaacaaauaaaaaauaaggaacaaaaaauaagaaaacgaacaaaaaauaacuucugaaaagggagagaaaggaugacuguguacuuuuaaaaugucauauaauaaaagauaaagguugaagaauuauucuagauuaaggguacuaaaaagacaucaaauauaaacgcaagauaugaucauugacuaauuccuacacuggaggagaagaaaacugccauagaaggcacuuauucagauaacaaaauuagaaaacggaagauuaaaguaauguaagaauguuaagucuacuuaaguuuuuagacugcuaauauaagagaugauccuuauucuuagaaaucuacacaaaaacauuuaggacuaaagggccauaauauguucaauguaacucucaaauggcuaaaugaaaagaauaaauguaugcaugcauguauguuuacaaauauauacauauaaacaugcacaaagugagaaagaguaauaaagcauuugggacaaauggcuaacaauagaugaaucuggauaaagggcaacuggaugcucuuuauauuauuuuugcaacuuuuaugcaaguuugaaauuauuuccaaaaaaaucauuauauucaggaacuaacacauuauuuuucucccuaaaaucuguuccuucuuuuauaauuccuacacagcugaacagcaccagugccaacuagucaucccacuagaaacuugacaguuaaccuagauuacucaauaguuucaucauuuccuuccgguucuauaacucccacaacccaaaggagaauuuccuaagggaauaucauuaauaugaccuuuuuuuuccuccaaucauaccaaauugguguaggaccuaaucacuuagcauuucucgucugauuuacugcuacaaucuacuacugaucaccguuccuccagucuuggcccuaaaucauucuacacacugcuacagagugaauucccccaaugaaauuugaauaugucacucccuguauuucuuaauuuguccuaaauauagguaggaaagaacuuaauggauuaacuugaaaaaaacccaacacuaauaaaauauauuauuuuggaucuucagaagcaaauaagcaaaaauuacugcccagagauuuaaaaagcugguauaacauaauugauauagucauaaaacaacugcaagagccuucucggacccaaucuuaaagcaacugcuauuaagcaauauguucagugccuuuuauacaaauaacauaagaacccuggaagaaggaaagguaauuaaaagcauagaagggaaaagaaauuuaaggaaaagaagggaaggaaaauaaaugggaaaguagaaaauugaaaagaagggaaggaaaaaguuaaaaagguaagggaaaagaagaaaacucuauuaguaaaacagagauuugucuaguguuaaaauguuagcauuuuaagaauuaacuaacccucucucaauuauuccuaaugaaauagcaagcauaaucagagaaaaguauuuuuauaugucuuuaucaauaucugacauuuuaucaaauguuacuugaggacaguauuauucauaaucaauauauauucuauuauuuauaagcaaauauggaaccaagucucuauugcuuucauuuuuuuuuuuuuuuuuuuuuuuuuuuuugagacggagucucacucugucgcccaggcuggagugcugugacacaaucccagcucacugcaaccuccaccuccuggguucaagcaauucucugccucagccucccuaguagcugugauuacaggcaccugccaccacgcccggcuaauuuuuacauuuuuagcagagacaagguuucaccaucuuagccagguuggucuucaacuccugaccucgugauccaccugccuuggccucccaaagugcugggaucacagacaugagccaccgcaccuggccugcuuucauuuuuagauuuucaauuucucaguucaaggcaucaauauauaacuauacauuuauuguauauaaaaauauacacauauauagcauauauguauaauauacauaaaguuacacaauauauaucuguauccggauucuaguauucuacuugagcaccuacaccuguagauuuuagcuaucaguauaagguuuuaaguaacuuuuauguugaaugucaaguugcacaauaacaacaacuagauuuuauaaauauaaacauuuauugauauuuuacacugagaauauaaaauacaacagauagccaaauauacauuaaagagucuucucaggacaaaaagcuugcuucuuauauuucuuuuccaguuuacagaaggaaaagaaaacaaacuaaacagaggcaauaaacaugucacacuacggccuccucuccccacaaaaaguuguuuuaaucaucacauuaauuuagucuuuuuauaacaaauaacacuuguucuuuaaacuuuaauuuauuaaauuguaagugugaguaguugugugucaggacaggcagaguaaaggaucaaagaucaauucagucuauagcugggcucuuuuguuggauuucuauaggucuaagcauguaaauauggccaacaguacaggaagacauuuuuuuuuuuuaaucuuauugcuuuuaccgaggcaaagucuguuuuguuguuuuugcugcuguuuuuugagacagggucucgcucuucugcucagccuggagugcaguggcaccaucaaagcucccugcaaccucagccucuuugacucaagggauccuccugccucagccuucugaguaauugagacuacaggugugcaccaccaugccagugaucccccugccucagucuccuaaagugcugggauuauaagcgggagccaccacacccagccaaggaaucccauaugcaacagaguuauuuaauuuacucuuuguauauugcuuaaagcauuaaaugauagcuaaaaaucgaaguguuuggccuaucuucuauucagcugggacacaugcugugagaucuuugaacuuagaaaagcaguuagccugucucuuuagguuugcaaauaaugaggacaaaaucaucauagucuuuugggguaaaugaguuaagaauaugacaccccaaaaugccauucuggcauauugacuauuuaaguuaaaggcacuuaaaaaaacagcagguacaagaagaucauucugaccaugcuguuucuuaaaaguaggagaugaaauucccaugugaaagaugcccuuccuauacuacaaagaaaacagcauucuuaucaucaagaauaaaaagaugaggccaaaggaaaucuggacaaacaauuguuacacaaauucuuaacaucccaaccacuucucugcccacuugacuacccuagcccaagcccccccaccuuauuacauuuuuugcaaguuacugcuuuuuguccaauucaguauauaaguguuugucucucacugcuucuuugggucuucauuucuuuauaggguuccuaugccacauaaagcuuuuauuaaauaaauguguaugcuuuucuccuguuaauggcaauuuaauucuugggcccaacuauuacccuaagaggacagaggugaaauuuugccucuccuacaggggaagagauucuuaauaauguucauaucaaucucuaaugcuaauaaacauucuuaguagcugguucuauacaccaugccccaagcaugaaaauaaaacuuucaggccagauaugauggcucaugccuguaaucccagcacuuugggaggcugaggcagguggaucaccugaggucaggaguucaaaacuagccuggccaacauggugaaaacccuucucuacuaaaaauacaaaaauuagccaguugugguagugugcacccauaguaccagcuauucggggaggcugaggugggagaaucgauagagcccaggaggucaaggcugcaaauagccaugauugugaguuauauauuauuuucccuaaugccaaacugcaaaaacuguaaucagcuuauuuuuuuguuaauagaaacauuuauauaaauaaauuccuacaagcuacauuaaugggggaagcacucaggcuauaaauacacacauucacauaggcaacagugauuuagggcacagcccuaagagauuaaaggaaucuuuuuucuauacaaaaaaaauaauugcaauguuuuaauaccuaacaauuagaucuauuuucuuaaaaagcagauuucugaaaaguuauuuucuagcguuuacaauauuucuuaggauacuaucauugcagagguuucuacaauguaaaaugaauagaaauacauacacggcuuuauauccauauucuauuuccuaggcauuggcuaauuuuucuguguaggacuuuauucuuuacaaaggcauuucacauuuaguugaccauuuaacuugauccucacaauaacccugugugaagaaagcuaacauaugccaaguaccuaccauaugccaggcuccacucagcguuuuacaugaacuaucucuuuaauccuaacaacaaucacaugaaguagauacuaucaauuccauuuuuacaaaacagaacauugagaauaagagaaguuaaguagcccaaggucacaugcuagaaaccagaaaaaccaggcuuuagaaacaggucugucugccuuauacucaauccucugcucuuucaccuacacauuguuguuccaucaucauaaaggaguaaacauucagaggaaaagguauacuugaacaaggcugcuuagcuaguaugugguaugaacaucauuuaaaacuaaaauccucugcuucuaaaacuuuuccuacuauaguaccuuccaacuacagaaccuacacaaucauuauaaagcauaaagauauagccaaaguguaagaucauggcuccaaauuugcccuugaaaauuugcaagaaccaguacaauauacuauuacauguauacuuccaugaaaaaccucauaccuacaaaagguuuaaugcucacaaucuccuuugcuuuuccaguagcaguuaagcucagaagagaaaaucuaaagguguuucuucauucauucagcuacuuagcuagcacagaauggacaucuaacccucuaggugcugaggacugugauuuccaagucucuucccucuuuauuaaguaacucaccuagcaucaugccucagugccauaagcauuuccuuuaaccucuuucuuuuccuauuauuuuuccaauuucuacucuauuagccucaaagaaaccucucuuaauuguucucauuuguuaacuucaaccaaguaauaacuacuucuagucacuaucuaaugcccugggaaguuuuuuaaaaaaaaucucauguggcuugcugcucccauggcaggaauacuuucugacuucacuaggcagacccaggaagaaacaaauggacaauguggauuuuuacaagaaaguuggucuggacucuucaaaaagucaguauuauuaaaaaagaaaggaagagagaaagaaaaagagaggaagagugaaagagaaacaggauaagggaaacuaaucuagauuuuuuaaagaauaaacagcacauaagcaaaugcaauauguggaccuuaacuagauuguuguuugaaaaaagcuauaaaggaaguuuugaggacaacuggagaauuaagauauggacugaauuuaacacaguauuauuguucuuuuuuacauaugguaauuaauacaguggucauguaaacaacguccuuuauuucuaggagaugcauauuaaaguaugaaguuuuuaagagugaaaugucauaaggucugaaauuacuuucaaaugguccagcagugccacaccccucucuaaaauguacauauuccacaagaauauauguggcaaaauguugguaauuauugaaucaagguugaagguguuuggauguucacuguauuauucauuaaacauuuuugcauguuuaaauuuuucaaaauauaaaacuggguuuaaaaagguaagggagagacuaaaccauugggcagucuauacuuguuuucagauuucuuugaaauggagucucucucugucgcccaggcuggaguauagcgugaugucggcucacuacaaccucugccucccggguucaagcaauucuugaacccgggaggcagagcuuucagugagccaagaucgcgccaccgcacuccagccugggcgacagagugagacuccgucucuaaaagaaaaaaaaaaaaaaaaucaaugugauguggccauacaaacaucaggcucuauuuaauaaaucaaaagucuauagaaaaaggaaaaaaguuucacaacagaagauaaaguggugauuaaaaagauuaguguuucuaagacugaaauuuuaaguaucacuucuucaaaugaaagaaaauugaauuagauuuuaaaaucccaaaacucuauuuaguaauacaauuuuauuuugcuacguauuuuuuucugauuauaaaaacuuuuuauacuuuguaauuuaaacuucacaucaaguaucuuuacucauuuacauuuuccugaguucccuuccagcuuuuuaaacucucucaacacauguuuucuuucuaauacauuugacacagacuuucauuucugggugauguuuuucuaaaucauaaaauuugcaacauuauuuuccucaaauagucuaaagccuaaaaucuagucauaaaucuaugcaguuccagaaguuuucguaauaaaaaggagguauauuauaaaacagaacuuucagcucaguauccugguaacagcauccuaagagcauaagcuuaaaccuuccccuuugccauaaucaauucaacagaccuuccccucugccauaaucaauucaacagaguuuuuucuaagaaaaaaauuaucaauuguucaaagauaagaaugccuuccccaguccacuacaggcauaccaaaagaaagucuuaaauuuuuguaugauuucugcuaacccugcuaacaaguaaaaaggaauaccacguagaaauccuauuaaauuauguuuacuuaauuucuguauacuaugacuuaaacguccaaaucuagugagaguuaaaaaugucucaacauuucuaacaaugagguguuuguuuacuauuaaauguauucuauuuacaguaauucacaaauaauaauuaaacaacuacuuauaaaaauaaaccacuuguaaaaucacguaaaaaucaugucaucauaugcuuaagaagucaugcuccaucuaaccuaaugaaguuuuuaaaaacaaccuuuucuccaugaacuugagauauucuuagacuaaauuuacuaaagaaauguuauuccauauguuacacacacacacacagacacacacacaccuuauagauuaacucauacagauaaugccaacuaggucaaauuucacuuccagaaacacaacuauacagccuuccauaagaagaauuacagaaagaacccauaaaauaaguuuccaaauaugauggugguugauuuggaguaucaacaugacuggauuaagggauacccagugaaaugguuuggcuuuguguccccacccaaauuucaccuugaauuguaauccccauaauccccaugugucaagggcggggccagguggagguaauuggaucauggcggagguuucccccaugcuguuguugugauaaugagugagucucaggggaucugaugguuuuauaagugucuggcauuuccucugcuggcauucauucucucuccugcugcccugugaagaugugccuucagccaugauuguaaguuuccugaggccuccccagccauguggaacugugaauuaauuaaagcucuuuucuuuauaaauuacccagucucagguauuuucucauagcaaugugagaauggacuaauauacccagauagcugguaaagcaguaauuauucucaaugcuucagcaggcauugagcucaucccauuucugcugaaagacaaaaccaggugguauggaauuuguuuagaaugauuggggugucccaggugugucugugaagguguuuccaaaggagauugacauuucagucaguggacugaguaaggaagaucugcccucaauaugagugggcacugucaaaucagcuggggacccagauggaacaaaaaagcagaagaagggugaacuugcccucuuuucugaagccaggaugcccuucaucgucugucccugaacaucagagcucuuuguucucuagccuuuggauucugggacuagcaucaaccccucucccuccuccgugcuugacucucgagcccucggccuuggacugagaguuacagcauuggcuuccuugguucugaggccuuuggacuuggacugagucaugcuaccagcuucccugguucuccagcuuccagacagccuauggugagacuucucagucuccauaauugacuaagccaauuccccuaauaaauucuuucucauauauaucacuaucuaaauauauauucaaucgauagccugucucucggguaacccugacuaaaacacuauggauuuuuccaucaguguaaaugguaagaacugcuagcuggaugauaugguauauaugauuguaccacuacauucuguaaaaguaacuguaauugagcaguacccuuggccaguuugguguauuaaauauccucacauauggcagcuaauuccuaauacuuuauaauaccuuaguuguugaaaaugaccacaaacaaguugauaaaauuaagguaaucuuaauaaccucagaccucuuacucuuaaauuuuuuuagggaaaugagauuagaccucugcauauuuuaugagaaauaucauguuaauaacguagcgaagugaaaagucacacgccacuugaauaagucuacacaggaccaaaacauaucucauuuuauacauacuaguacagccucaaaaguggcucccaaugacccuaccuccugguauucacacccuuguguaauccccucuccuugaaugugggcuggaccuagugaaucacuccuaauaaacagaauauggaaaaagugaaugcaugccacuuucgagacuauauuacaaaaacacugggccuuucaucuugcucaccgucucuuguuagcuugcacuaauggaaguugaugccauguugugaccugcccuacaguaaaggcucaaguggcaaggaacugaaauuagcuucucaaaaacagcccacuaaggaacugggucccuuaguucaacaaucagugaagaacuaaaugcugccaauaaucacaucauugaauuggaagcagauccucccccaggaccuucagaugacaccacaggccuagcagauauguuaggugcagcuuugugagagauccugagccagaggacucaguuaagcugcacucagauucccgaucaacaaaaacagauaauguuugcaguuuuaaucugagaaguuuugggguaauuuguuauguagggcaauagauugaauugcgcccccccccccaaauucauacguugaaauccauaccgucaguaccucaaaaugugaccuuugaagcuagggucuuuaaagagguaaucaaguuaaaaugaggccaucagggugggcucuaauccaguaugacugggguccuuagaaaucuggacacaggaccgggcgugguggcucacgccuauaaucccagcacuuugggaggccaaggcggguggaucaccugaggucaggaguucgagaacagccuggccaacauggcaaaacccugucucuacugaaaauacaaaaaauuagcuggauguggugaugcacaccuguaaucccagcuacuugggaggcugaggcacgagaaucgcuugaacccaggaggcggagguuacagucagucaaggucgcaccacugcacuccagccugggcaacaagagagaaacuucgcuuaaaaaaaaaaaaaaucuagacacaagagacaugcauagaaggaagaccgugcaaagagacacagggaaaagauggccaccuaaaagccaagaaaacaggacuggaacaaauccuucccucacaggccucaggagccaacccugcaacacuggcgucagacuuccagcauacagacugugagaccauaaauuccugucauuuaagccacccacuucuuaguacuuuguuacagcagcccucacaaacuaauauauguggcaauagauaacacacauauacuuaauucaaaauaacuucuaucaacaauaccaaaauuagccuccauuuaggacucaaguagaugcccaaaggucuuuauuaagaaaaaagauauuaguccauaccggaaaaucuuaggaccacagauauuuuagugagcugggaccucugcagucauauaaucuaaucuacucauuucagaaauugaugaugauaauaauaaugaugugccaggaacacauacauuaauucuuuauaauaauaccaugagcuaccacuaucauccacuccuuuuuuaagauguagaaauugauguccagaaguaaaggucacaaagcuaguacguggcgaugccggaucugaauaaauugaggugcacagagaaaaaguaauuuacccaaaaucacaguuggcagcucagcuggguaccuaauaguaugucuccuauauucaaaucuuuuuucucaaaaagucaaaugaaaaaaguuuccuuucucaaaauaucuuauugcacuguaccauuuuauucaugauagucaaauaaauguccaucaacugaugaaaggauauacaaacuguggacuauccaaacaaugaaauacuacccagcauuaaaaggaucagaaguuuuauccuuuuuaauucuggguaacacagaugaaugcaauaacauggauauaacuuuaaaguauuacaauauucccccuuuauccaugauuucacccuccacgguucauuacccacaauccaaaaauauuauauacaguaagauauuuugauagaaaccacauucacauaacuuucacugcaauauuuguuauuauaauuguuauauuuuauuaguaguuauuauuguuaaucucuuacugugucuaauguauaaauuauacuuuguuacaggcaaguauguauagaaaaaacauaguauacauaggguucccuaguaucugugguuucagucuuccacugggggucuuggaacauaucccucucugauaaggggagacuaucgcacauguggaagaaguacuacuauaucuuauuauuaguuauccacauuucaguaggaauaagugagaccuuuuucagagaacagucuuuaaaacaaagaaagccaaugcaaagcuuuuaaauuaccaugcccuaagccacaauuugucuaaagguaucugauugaggaaucagagucuguuccggcaaaucaguauugagugcuuaguuagccuuucuuugggaucuggauuauaagguauuaugcuugggaggcaguggcaagcaggcuucaccucacaaagaacagcaaugugaugauagcuaguucccaaagagagaaagaagaaugagaugaacaugcagagaagagacacucugcugagagccugcgggaaaucugauugucuuuaguccuggguucuuauuugcaguccagcugcauuucuguucuuggauccuguggcaucuccugggacacuccaaaaguuuucccauuuuugguuaaaauaauuugauuacuugcaaucaacagagaaacaacaugaucaaaaagguacccucucuaaagcugaagaacauuauugaaaaacuaauaaccucauguaaaaaauaaacuuuuuaauaacaacaaaguaaaguaaagcauuaaaacuaaggguagccacaguacucucaagggccucacaagacaguuuaauccuuaaacuagucacucaaagaaacuacaauacaauggauuaaagaguuucaaagcaugugcuuuaaaaacaacuacauuuuuccaggaaaaaacaagaggaaauuaugcuuuaaaaauaugacuuucaucaucuguagguaccuacaagaaaaguaauauugauuuaaagccaaaauugaaacugaagauaacuuauucuaauguagcccuguuuuggugcagaaaacuaagagccaacaagcaaagaaggcuugcccaagcuuaccagucaucagugguaaaggacgguugaaacccaacuccugaaucacaagucacuggucuugcugcugcacaauaacgcagcaaagacaaucacaauucuguuccuggcuccuuuuucaacaaaaaaaaaauccuaaaacugaccugauucucuguucugggcuggcaugaaccugcuuagaaaugauaagaauggcaggcacuuucuuccugaagcagacguggagaaguauuauaccugaugaaggaaaggaaaagaaaacucaguuuauguucagaauauacaucaugagucauucauuuucuacugauucucuuuaccuccuuacuuguugucuugcuuguuuaauaauggaacauauagcacuuuauuuaaaauagauuaaauuugcuauuaaagauccaugaaaaauauaaaguuauuuaaagcuggucucuacagaccaucugauuucacuucuucauuuuacugauaaggaaacuuugaccuggagaaauuaugcaaagaaucaaugacaacacagcuacuuaguguuagagccagauucagaacucaacccuuaccacuuccaguccaguacucauuuguauaucacagaccacacagccucuuuucuuggagaaaaaauucaugcuauuucucuagguguauuuuucaugcaucucaagauaaaugcgguauagagcugaauugauuuguucuaaauuaaaauuuuaaaaauugcugccucauucaaaggucauacucuagucucaaguuauuuggguugccuuauacaggauauauaaauguuuccuuucauuuaccagucaauauuucaauaugaaaacauuagcauaugaaucaugagaucuaguuucuuaggccucuaguaacucugcucucaacaaguucuauaguguagucaaacacauuuugguccuaaaguucuuuaauucaaaaaggaggagccuggacuaauuccuaggggccuucuaacucuaaaauguuauaccaaagaauagcaucaucuuuaaugacauucgccuuuucagaugagcuauguguuuuuguuauguaacuuuauuuguuaaacucuuuaaucguauuauuauaguucaaacaaaaucauucaaaaucauugaaggcaauauugccuucaauagacagguaauuauucaaaaaccuaaccaauaauaaccuaguuuugcugguuuaucucauuaccuggcugguucuauuacagaaacccagcuagaaguaggagaaaaaucccucuuuuuaauuuuuauuuuuaauuuuuaccuguacauaguaaauauacagauuuauaggguacaugagauguuuuaauacaggcauacaauguguaauaaucacaucaggguaaaugggguguccaucaucucaagcauuuauuauuuuuuuguguuaugaacauuccaauuauacuuauuuuuuaauguacaaauuauuaacugucacccuauugugcuaccaaauacuagaucuuauacauucuuucuaacuaugcuuuugaacccauuaacuauccccgcucuugccccacccacuacccugcccagcuucugguaaccaucacucuauucucuauuuaugaguucaauuguuuuaauuuuuagcucccagaaaugagugaagacaugcaaaguuugucuuucugcaccuggcuuauucugcuuaacauaauguccuccaguuucaucuauguuguugcaaaugacaggaucucauucuuuuuuauggcugaauaguauuccaauguguauauaccacaauuucuuuauccauuugucugcugauagacacuuaguuugcauccgaaucuugguuauugguaacagugcucauaaauaugggaguguagauaucucuuugauacacugauuuccuuucuuuuggguauaaaccugguaguggggcugcuggaucacauggcaguucuauuuucagguuuuuaggaaccuccauacuguucucuauaaugucuguacugauuugcauuccuaucaacaguguacgaggguucccuuuucuccacauccuugucagcauuuguuauugccugucuuuugcauaaaagccauuuuaaugggacgaguugauaccucauugcgguuuugauuugaauuucuuugaugaucaaugacacugagcaccuuuuaaugcauguuuguuugccauauguaugucuucuuuugagaaaugucuauucugaucuuuugcucauuuuuuaaaucagauuaaggaaaaguacucuuuaaaagucuaccucuuggguaguuucuaagaaauauccugaauuauuuccucaaaucauugaucuaguuauucauccaauaaguuuuuacugagucacuugccagauggcagauacauacaagcuuaaugagacagaaagcuuuaaaacaagauaauucuagugaaauacugagugcuguuaggaauucagguggcaguagagaguaggcagaauuaaugacaugucuccuaaauuaugacuucagauuauagcuuaucuuuuaauauauuaauuauuacauacaacaauuauuuggaacauuuuaaauucaaagcaaaauaauagaaugaacauccagauaccugucacccaacucaagaaccuaaggguaaguuauugguauuguucuacuaauuuguuccuccuccauuccaugcuccaccucucuuauccccaccacccccuguaaccgcaauccuguauuuuguauuuaucauuacuuugcuuuuuaaacaguauaucacauagguacaucuuccugaacaauauaguguuccauuuugcuugguucugaaaucuaucaaaacgguaucaaaaucuauccuccugucuuguaggauuugguuuuuuaauucaauauuacguuucuaaaacucacccaacguuguugcauauaguuguaguucauucauuuucacugcagaauaauacugcauuguacaaauauaucacaauuuaauuauccguucucuugucaauagcuuauuuuccccuccaaguuuuguuuugcuauuaugaacauuuauguuaugaaaguucugacaugugucauguuccacauguguccgaguuucucuuaaguacaugccuaagaguuagggaguaaucuuaaauuuaacuuuucaugaugaugccaauuuuuacuuucccuaaaguguguuuggcaauuuauaacuucacuaccaaaagguaguagcagaacuaccacaucuacagccucuccaacguguaguaaugccaacuuuuuaaugcuggguauagaauggcaucuaauuguggucuuaguucgcacuuccuugucaauuaaugaugcugaguauuucuucauguuucuuggcuaucucauauuuucucucguaugaaaugccuauucauauauuuuacccauuuuccuccugacuuauuugccauuuucauauuguuucauguguauuuuauauguauuuggaugcccauuacuugguuuuaccagucuugaccaaaaacaggcaauuguugagauaagggagcagaagcaaaaauagcaggcggccagaaaacuggcaacagcaaguuagaguaccaaugauuuccucaacccauuuuuuaauauaaauguaaucuacagacaucuuaaaguaucagaaaucuaaaauauuauaaaaucaaucuagauuuacaaucuuucauuuuaauauaaacucagccaagaacaaaugcuacaaaaugauuucaguacauucuaacuacaauauguaauauaguauaauucucaggaaucaaguuuuacacaggucacaauuaagaccacaauuuaaaguucccauuuugacccugacauuuuacauauuuuuacuucaugcuuuccuugccuccaauuuagaguaagucaguuacauugucagaggauuaaguuuaaauguauaugcacauauguauaaaaacuaaauuuugaaauuaaacuguguacauugaaaugccacagaaaccugaauuccagacuuagcuagaugauuagcuauaucucccuggccuaucuaugucuucugaguugguuuucuuauauuaauacuuaaaauggaaauugugcugggucuuaucauacucuuuggguggggagugguggcucacgccuguaaucucagcucuuugugaggcugaggcaggacuaucacuugagaacagcaguuugauaccacacugggcaacauagugagaccccaucucuacaaaaaauuuaaaaauuagcugggcaugguggcaaacaccuguaguccuagguacuuaggagucugaggcaggaggaucacuuaaguccaggagauugaggccacagugagcuaugaacgugccacugcccuucagccugggugacauagcaagacccugucucuuuuaaaaaaaauuauuuggcuugaagaucaaugagaaaauuuuuuuccaaauagcccagaaagauuuuguggagucucuuuccaaacuuuauacaaaguagccaguuaaacuaaauaauaacaaaaaauaaauuuucaaaauuuuuaacaagcaguuuuagaguccuccuaaggccucccaggacuccugccagguaaucugaugaaaugcaucauacaagaaaaaaaaaauucaaaagccacaggcaaucagaagagaacuuccagaaucucucaugacauuuaccuccccaccugaaucuguacccuuucacugaauuucaggauucacaucaaaaucuaaccccucuacuuugcuacuagauguuacaugccuagaacaccaaugucauugcucuaggaaaucccacuucucucuccuacgucaucaauuuccuccuuccaauaaagcaaaaucacuggcaaauacauuuccaaucauuagaaaacaaacaacaaaaccucucgacuccuuauaugccucuagaugauggccaauaucuuugauuccuuuuuuagcaaaacaucacaagcuuguacuccuugucuacaauuauacuuccauucaaauuuaacacacuccaauuagacuuuuacuacacaacaucacugaaauucaaggucaucaauuaccugaauauuguuaaauccaaaggccuauuaguucucaucuuucuugacuuaucugcagcauuuggcaugacauaucacaugcugauacacuuucuuuuauuggcuuccagaaccaacucuauugguuucauccuaucucaucgaccucuccuugucagcguucuuuccuaguuccuccucuucucccugaccuuuaaaguuuagguuguuagccuucuucucuaacccacuggcaaguacuauugacuuuaucuacaaaaauacugagaaucugaccacuucucgccacuugcauaguuacuauuuuggucaaagucuguauugucccucacuuggauuuuugccauagguuaguaacuggucucccaacuucuacccuuguccuauuuucaaguccuuucucaucgaaguagccagagugauccagacaaccuaacauaaaucauaaaucguauaacaucugcucccaaaaucucccaguggcuucccaucucacucagaguaggccauuuuuuuaaaaaaugacauaaaagaaccuauaaaauuuggccccuauuaccccugacuucauuuccuaccaacuuccuugccauucuuuuuacaggccaggcacauccuugccuuggggccuuuauacuugcuauucucucccuauaugcuuuuccaagagaugauuacaguagacccuuccuuaucuguguggguuggggguuggauauguuccaagacccccaguacauuuuuccccaugcauauauaccugugauaaaauuuaauuuauaaauuaggcauaguacucuuaugcuuuggggccauuauuaaguaaaauaaggguuauuuggauauaagcacugcgauacucugacagguguauuucccuucuauuccuauuugucuauguccuuccaugaaaauguaaaaucuaugagggcaaugguuuuguuuaguuuaaugcuacagcuccaaugccuaaaaaagaaucuggcacauagcaggcauccaauuaacauuuuuuaaaauaaauaaacaguuacucucuuaaggcuaaaaaugggaaucuuuccuaguuuauaaaacaagauaaucuaaauaauugggggacaacaacuagauuuuugauguaaaagaaucauucuaaaauuucuucaaaagauaauugauaaugaugauaaccucaaaauauuuuauuagacauuguaacugauacuuccauaaauuugauaaauuaacaaauaguuccccuuauuauuagguuuuagacucuggccguccacagaaugacucauuucuuucccacuaacugcugucauauuuaacaaugguuggcaugcagggccguaacaccagcacacaggaaaauauuacaaaaauguucauuccaaacugguuccagagaaagaaccaagcucuuuauaaaugaggaaagucuaaaaauaaagggcagauauuuuuaaauguuuucaauauuuuguuugaaaauaauuccaaacuuacagaaaaguuaguaaaaauacaaaaaucacucauacucagauucagccauuacuaaugucaccucuuuacuuuuacauuugugcuccugagcuuuuacacuuucuugcauucauacacacacaugcacacauacacuuuuuuuccuggagcaaaugagaauaaacuauauacaucaagcccuuuccuccucuucuuccaauguguguuucuuuagcaauacuuucucuuauaaggaaagcacagugaucaacuucaguaauuauaacauuguuacaauauuuuuaucuauucuauggucuauauuccaauauucuaauuuuucaauugauccaauaacauccugcaugguauauuuucccccauucaguauaagauccagucuagggucagguacuguuagugguucucucuucuaugccuccuuuaauuuggaacacuuccauagccuuucuuucucuuuuaugacacugacuuuuuuaaggaccacaguucccuccccgcuuuuuaaaguagaacauuccuuauuuugcacuugucgaauguuuccucgugauuaaauucagguuaugcagucuuggccagaauacuacagaggagaugauguguccccucaggguguccuaucuggagucacauggugaccaucugccccauauuguuguuggaucgcaccaaugcauaaucacuauauuaucccuugcaauuaguacacagucuguggggugaugcuuuaagacaucgaaaauauccugcuucucaucaaaauuucucccucauuuaguuaugacucuugcccuaccuaauaucuacuacgcuagcuacaaaauaaugauuuuuccaacucuaaagcucagaguccuacuggaagaaagagccuuccuuucuccucuauucauucacuuauuuuuauuaucauuauggauuuauuccuauuucuaaugguucauaauuuauuauuauacuuacuugauuauuaaauuaucucaaauuuggcuagcaggaaugccaauaggcuucuugugacauguucuuauuuaaaaaaaaaaaguuucuauuuucucgcauugaaaaauaauccaggcucacaugguaugugcccuacccuauccuagaaucaucuauuucugugaggagcucugguuccuuugacuugagaaugguauuacagaauucuaauuccaagaauuuggaguuagguaugcucuuugccucuuagcccuuuuacuggacagagcuaggaaauguaugaaugcaaauacacauacaaauuuauguacauaugucuguacaugcaauuacauguacauauauauuggcuuaaaacaucaugaacucacugauaccuucaauuccaauccaccugcacagaauuuauuaugccuucucccaccccauauuugugugucucuccuucuucagggagaacccucacuccaacaaccucaaaacauuuacucaauccccaauacaccuaaaaagucccagaagugcuauguccauaucacuaugaaaaguaaaccuaauagaaugaguucaagaguugccugcaacccgucucuuucaacucuacccaagcugacgguauaugguuauaguuauagcaccauguuauuaguaauaaauuacuuagauuuacucuuuguucccucaauggggguacaauacuaauuuaaaauacauucagguucauuuguuucaguggauuaggauucuccccauuuccguccuuauuuugaauacugaaaaaaacacacuaugaaaagccaaaacuauauuuuuuaaaaaaagguuuacuuugaagugucauugccucccauaaaccucuggccccauuaccucucacuaccccuucuuuuuguaaagucaagcauauauauguauguguuauuuucccuuuuuucuuacauaaaagauagcacacuauauauucuuguuuauacuaaccagcacaauccagauugaagaaagcucuucccaaagccuuuuauaagauacaauauccugauaucaaaaccagacaaagagauuaagagaaaaaaagacuagaaauuucauauuuuuugugaacauaaaugcaaaaacuuuuaacaaaauauaaggaaaccaaaucuggcaacauauaaaagggguauuacaucaugaugaagugcauuuauccuggaaaugccaggcuaauucaauauucaaaaaauuaacauaauuuaccauuaucaauaaaauaaagauuaaaaaccauauaaucucaauagauauuuuaaaaaucacuugcaaaauucaacaucuauuaaugauaaaagcucuacuaaaccaggaauagaaugaaacuuacucaaccugauaaacagccucuuuaaaacagauauagcuaacaucauguuuaaugaagaaagacugaaugcuuucucuuuuuaacauauacuagaaauccuagccagugcaauaaggcaugaaaaauaaauaaaaggcaaaaauggaauggaagaaguaaaacugucuuuauuccaggcagcaugauuauauauauagauagaaaaccccaaagagucuaccaaagaaaccucccuaaguuaauaagggaacuuggcaagacugcaguauacaaaguucaauauacaaaaaucaauuguguuucuacauauuaacaaugaaacaacuaaaaguuauagauaaagagauagauagauagauagauaguaccauuuauaauagcacccaaaacacaugaaaugcugaggaguaauucuaacaaacugugcaaaaucugucuacugaaaacuauaaaacaaugaugaaauaaucacuaaugagauaaucauugauaacaaugaugaaauaaaccaaagaugacuuaaguaaauagagagauacucuauguucauggauuuggaggcaauauauucaaggaaucaguucuucccauauuuaccuauagauucaaugcaaucccaaucaaaauuagaguagacuuucguuuuuggaaaucaacaagaugacucuaaaauuuacacaaaaaagaaaucaagaauagucaaaacgauuuggaaacaaaacaaaauuggaggacucauauuaccugauuucaagacuuacuaaaaagcuacaguaaucaagauaguguggcagugguaaaagcaccuagaucaauggaaaaggacagaaauuccagaaacagauacacacaaacauggucaauugauuuuugacaaagaugucaagcaauuuaauagggaaggaaaaauuuuucacuagccagugcuacaguaaucagauauccacaacccaaaaauaaauaaauaaauaaauaaaacucacaaaaacuucagucaacccacacaucacacacuauauacaaaauuuaacucaaaccaaaucacagacauaaauguacaaucuaaaacuauaaaacuuccagaggaaaacuucggggaaaaucauuguuacuuugaguuaggcaaaaaauucucuaacaggauauaaaaaguaaaaacuauaaaagaaaaaaaugggcaaaguggacaucaccaaaauuaauuucugcucuucaaaacacaguguuauaaaaaugaaauuaagccaaaaacugggagaaaguauuuguaaaacacauaccagacuggaacccaaaauauauaaugaauucuuuaaacaauaaaaaaaaagcaaacugauuuuaaaaagaauaaaagaugucgacacuuacuuuuaaaaaaaggauacauacagcaaacaagcaaugaaagcucacuaccauuauuuaugaaaagcaaauuaaaacauuuugaaugcugcuaugaacauuagccuuuuuguggacaugugcuuucauuucuuuuauagauauacuuaggaauggaauuuauagauccuaaugaauauguuugaauuuaugagacacuaguugacuguuugcuaaaauggcuauaccauuucaccaggaaugaaugagaagaaacuucuaguugcugcauauccuuaccaaacuuaacaucaucagauuuuacaugcauuugucauucacauauccucgguaaaauaucuguucaaauuauuuguucauuuuucgacaggguucuuugucuucuuauuauugaauugugagaguucuuuauauauucugguucauauccuuugccaaguauguauauguuuugcaaguauauuuaccagucuguggcuaaccuuuuuauuuuuuuuuaaauggugaagcauguucauuuugagaaauuucauuaagcuucaacuuacaauuuguuuacuuuuacuuacguauauacaguaaacuugaacaacauggguuugaacuguguuguccaauuauauguggauuuucuucugccucugccacaucagacaagaucaacuacuccucucuuccuccuccucuucggccaacucagugugaagacaaugaggaugaacaccuuuaugaugacccacuuccacuuaaugaacaguaaauauauuuucucuuccuuaugauuuucuuaaugucauuuucuuuuaacuaacuuuccuguaagaauacaguauauggcugggugugguggcucacaccuguaauccaagcacuuugggaggccgaggcgggcggaucacaaggucaggagaucgagaccauccuggcuaacacccagugaaaccccaucucuacuaagaauacaaaaaaacuagcugggcgugguggugggcaccuguagucccagcuacucaggaggcugaggcaggagaauggcgugaaccagggaggcggagcuugcagugagccgagaucacaccacugcacuccagccugggcgacagagcaagacuccgucucagaaaaaaaaaagaauacaguauauaauacauauaacccacaagauguguauaaaucgacgguuuauguuaucaguaacacuaucaguaauuaaguuuuggggaaaccaaaaaaguuauaugcagaucaacuacacaggaggucacuuccccuagccccaacaugguucaaagaucaacuguacuugaauaaauuuauugaaaaacaaaacaaaacaaaaaaaacugcucuuuaaaggugacaaaaucaucaucaacuaguaaauagccuaagggugauacaauuuggccuacacauacuaaaaacuggaaaauaagucuuuacacuaccagucaugagccauucauuguguugggucccuaccagaggcacagacauaaagucuaaaauuagcaaggaagaguaacuguugaaggccucccucuuccaauuugaccucugaauuauaaacauuccagauuaggauauauggcacuuuuguuaauuauagagcaaauuuuaaauggaaacuuuagguugauggggaaagcaaagaaauucaacuuaaguauaauuacaugaaaaacuaacucguguaaugauuuucaauaagcaccugauugucaaauacauaugcuaaaacaaacaauaagacucuaaauaucuuuucgcugacugaauaaauagcuuuauauaaguauuauuuauuagucuuuaauuauuccaaaauuaucacuccuaacuuuaagaagcaaaaaucagccaggcaugguggcucaugccuguaaucccagaacucugggaggcugagggggauggaucacuugagcucaggaguucaagaccagccucuacaaacccauucucuacgaaaaaaauuaaaauaaaaaauacaaaaaauuagcugggcaugguggcgcacaccuguaguaccaguuacuuggaagguugaggugggagaaucacuugaaccuugagggaggagacugcagugagccaagaucuugccacuguacuccagccugggcgagagucagaccguguaucaaaaaauaaacaggcugggugcaguggcucaugccuguaaucccagcacuuuguggggcuguggcggauggaucaucugaggucaagaguucaaggccagccuggucaacauggugaaacaacgucucuacuaaaaauacaaaaaauuagccaggcaugguggcuaagacaggagaauugcuugaaccugggaggcagguugcagugagccgagaucacgccacugcacuccagccugggcaacagagugagacuuccucucaaaaaaauaaauaaaaauaaauaaauaaauaauacauauagucacuggauguggcugaaagucuuaaguuuugggaacuuauagaauauauuauuacuucuguaguagacacuuccuggaguagcuggaaagcuuauaauccuucccuuuucugugucaugaucaauggccuugaaaagaucaaaagauaaaaaagagggagauucucagaauagcuacuugaaugaaccucucacaacagggucacagccuaaaaaaauuccugucccauguguauguucaccagaauucugcuaacaaaucaaaauacaaagccucuuaguaauugaguggauaagaugacccacaucacagaccaacucauacuccuccagccagccugguccuugcucaauagguucaugaaaaccaccagguggaaggagaagcaguuaugcaagggcaaaucugcacgaacucauuaagacugaugucacugucacuacuguugagaacacauuugccugagucccccaaagagagacuacuucuuagcagguaaauuauaacaaacccuuugcauuacagaaauggugauggcugcuuuucacuauaagaaacaccaauucugaauuugucucugccagcaccaccauucaagauuaagugaaugcuucauauaaaucacacucacagggccucugauccaggaacucacuucaaauggugaugggcagaugcccagggaccucacuagucuuaucaaauagacucuuauucagacacagcuguccucacagaggaguaauggcauuuugaagcuugacaugcaaguuguugcgccaccugaaaccuucugauauuggggugcuguccuauaguacauaaaauaagcucugaaccacccacuaauauaugaugucucccauccucccaucuccggaacacacuggaugugggaacguggugaugguggaggugguauauuucaucugcuuucaaaguucugcuucuugucucaagaacucuggaaucuguugaucuagaaauuuuauuuaguacccaagaaugaaauacuuauaccaagaaacaaaauaacuguuucacucaauugaaagcagaguuuuauuuccucauaacaauaaaaaaacaagcaaaaauggaggcuauagaauugacagaggugacugcuccugaccaucaaggagaagacagguugcuacugcacaccuggggcuaggaagaucaugagaaaagaacuugggggaaucucauauucucuggcagugccguacacaguguuaaugugagugaaagauuaucacaauucuauacaguuggaacuaccaaaccucagacccuuuugggaaugaaggacugaguuagcuuccuagaaacagaacccugauaagccaggacacuagcagaagguaacagaaauauguaaucugaagugaaacagguuagggcuuugugcucagauguaaaacuaaggacuguggccaccauuuauuuccuuaauagucacuggugugugauaaguacccuucucuuucccuuuaaauacauuuucucuuuauuuccucuuccuuucccucaagcaugcagauggcaaguuggcaggaguuaaauuuagguuguaaaauaucaagaaagaaucacaauggaaccaggaggcagcaugauaucacucagagucaguagcccuauggcacugccucuggauaugguacuucaacuugcuuuuugcuuuucucccacuggaaaaacugcaucaauacaugggauagcaggguuaucucuacuaguggggaggaaagcaaagggaaagagacaggaaaagcagugguuaagcuaccaaagagugagauguucuagacaccuaggagggcugcccagcuuuugacuuccccuucuuugggaaugacccccagcaccgagguauauuccuagcgcgcuauacaucauaagucugcauacccuggcucuaguacagacagacaccugaucugaacgagguuaauuuaauccuuucauuuuuuguuuuuuuuuuugagacagagucucgcucuguugcccaggcuggagugcaguggcgugaucuccgcucacugcaagcucugccucccagguucaugccauucucccgccucagccucccuaguagcuaggacuacaggcaccugccaccacgccuggcuaauuuuuuuguauuuuuaguagauacggaguuucacuguguuagccaggauggucucgaucuccugaccuugugauccacccgccucggccucccaaagugcugggauuacaggcgugagccaccgugcccggccaauuuaauccuuucuugauggaauauauaaauugaagaugcaaggcagagagagacuaaaucuuuacagcaaagucaccuuaauagcaggagucuaggaagaagguauaaaaauuccugcuaggggccgggcacagugacuuaugccuguaauccuagcacuuugggaagccgaggcgggcggaucacgaggucaggagauggagaccauccuggcuaacauggugaaaccucagcucuacuaaaaauacaaaaaauuggccaggugugguggcacgggccuguagucccagcuacucgggaggcugaggcaggagaaucgcuugaacucgggagguggagguugcagugagccaagauugugccacugcacuccggccugggcaaaagagcgagaauccgucucaaaaauaauaauaauaauaauaauaauaauaaaaauaauaaauaaauaaaauaaaauaaaauaaaaauuccugcuaggcugggcgcaguggcucacacguguaaacccagcacuuugggaagccaaggcagucaagaucgcuugaguccaggaguucaagaccagccugagcaacauaucaaaaaaccccacaucuaccaaaaaaaaaaaaaaaaaaaacauuagccaggcaugguggcaugugccugaagucccagcuacucaggggcuuaaggagggaggaccacuuacuugagccuggaagguaaaggcuguagugagucauaaucaugccacuguacuccagccuagaugaaagagugagacccugucucaaaaguaaauaaauaaauaaauaaauaaaauuccugcuaaugagauccucaaagcaacucugauaucuucuguucaagacccacuuguucaauccaucauuccauucccaguaugagucccauuaauuccuuuuccccuccucaagcuaguaagugucaacugacugcaaccaaaaaaaugcuacuauaacuuuuuauaggaaguaaaugaaagguguggagguucucauuuuaaggucaauuuaucauaaucaugcauuuuccuugcuuccucuuauccaacucagaaaauaaauuccuaaaggguaauuuugccuuccaaagugugacaugagaacccucaugccuaacaugcuuuuucauauccuccuauuucacaagaaagcauauuuacuucaguguguaaguuuguucauuuuagcagcaguucccuguuaagacguuaguaugaggcaucagcaguucuuugcaucucgugaugccauaccaaugccaauaaagcagacuaaaugauuacugaucaacaauacuuaauaguauauagaaaaaaaaagauacuuaguaguucaucaaagaaugucaagcccagccugucucugcucuccaagugccuggcuucgccugucacuuaaauccuagaucaccaauacggacuugugauagaagauguuuuugcaguuucgccccaaucuuuaauucuggaucaagucaucacuaacauuacccagccuucauacugcagauuagauaguuaggauuucuagcucguuaugaugccuacccuguucuacuccuuccccuucugcuguccuuuuccuguuuauagcucagcuauuauaacuaagcuucugcuuagacacuuuuggaggucccuagucugaucccuuccuggcuuuucucuuccuaggacugagcagucuacuuuaaauucccaaucccaaggacugauagcuagaguccaguacccacagacagaauuaucugguggccacucauacauauauaagcauguauguuugcauucauuucgucauuuacacacacacacccuccuauuucagauuccauaugcuucuuccccuugaauucccauuaauagguugacugaauuauucucuggcuguuuaccccuggcacggccuaccaaaaagaacuuuuccucagcgccuguaguuaguuaagguuagauugaccuuaacaugcagcacuauaccuuaaauguggacugauucuagucuguccugcauaauaguuaccucugcccuacucuacaacuuggccaugugcucccauaucacaaauacaacaaagcucuaucaaauuuugagauauggaaaagguaagcaagcucacagaauuuuaaaacagaaaauauacaaaagaaaaaaguuauuuucuaaauggcauaagcuggaaacuuggcaguauaguacaauuaaaacaauaacauaauauaggaaagaaucccacacauuuacacgcccaaauuuauuuuucaaucaccagauaaauuuuaaaauaggagaaaugacaaugacuacauuacauuuuguaaauauguucuagauuauagcauauugaaaaggccaucugauucccaagaguucuagaagcaauuucuuaaugcaaaacuuaagguauaucagagcaaugaaagaguauauauaucuagucacauaaaucagugccucuucugaacaaugcugaauucuucucuaugaaacuuauucaauuucuaauucucuuuagugccaaaaaaugggacuccuaucacuuucuccaaaaucuacuuuuguuauuaauauuacaccuucauuaaaguuguuuccucugcuuucucuacaaccuugauuccuagcuaaagaucaagccacagaugggaucaccgccaaaaaaacuaccaaguagucgaaaacucaaggacaaaaguaaauauauuuaccucaggccccuuauaagccaacagaacugcaguaagaacaagugcaguagauaauaaagaauucuaaauacuguggcuaaggugggaagccaaugacaucucaaaaauagaugcuguucgcguauguuuauugcagcacuauucacaauagcaaagacuuggaaccaacccaaauguccacugaugauagacuggauaaagaaaauguggcacauauacaccauggaauacuaugcagccauaaaaaagaaugaguucaugugcuuugcagggacauggaugaagcuggaaaacaucacucucagcaaacuaacacaggaacagaaaaccaaacaccacauguucucauucauaagugggaguugaacaaugagaacacauggacacagagaggggaacaucacacauugggagcuaucggggguuggggggcaaggggagggagagcauuaggacaaaucccuaaugcaugagggguuuaaaaccuagaugauggguuaauaggugcagcaaaccaccauggcacauguauaccuauguaacaaaccugcauguugugcacacauaucccagaacuuaaaguuuaauaaaaaaaaaaaaagguuacauuauuuaauauaggcuaaacuaguauaugaacucuuugaaagaaguaauagcaucucaucaucuuaauaauuuuaggcgggcaagguggcucacaccuguaaucucagcacuuugggaggccaaggcggguggaucaugauguuaggagaucgagaccauccugauuaacacggugaaaccccgucucuauuaaaauacaaaaacuuagccuggcaugguggcaugcgccuguagucccagcuacuugggaggcugaggcaggagaaucguuugaacccaggaggcggaggcugcagugagcggagauagcaucacugcacuccagccugggcaacagagggagacuccaacucaaaaaagaaaaauaguuucagcacacaaaguagacacugaauaaacacacugaaugaaaaaguaaaucaagaguugagaugguuaguaaagugucaaauguacucagcuuauacugcaauacaaucacugcagaaugucaauuacuagggagggccuuacccuaaggagacaaaguguaauguaagugcugagaaacucacuuuuuccaaaaacuacucccuauucauuaauaaacacaaugcaaaaugcaucucacauuggagauuaauuucauguacucuuucccucuugccaggcaauuauuuaccucuauucuaauuuuauauuccuaugacccuuuccucacaggaugcuuaauauuuaucuuuuaaaaguccauuuuauuacuuguuuauuugaauaggaauucucuguauuucgggcauccgggaaugaguuacuggucaacauguuuaucuucuauuuucuucguuuguuuuuaucauauuuuuuccaucaacaugaacauacaaaaaucuucaaaacugcuguucacagacaugcuuuccuuuguaacagaagucacaguggguugaacucucaugaagaaaacagauuaucugaugccagagcagucuuuacuaauuuaauuacuuuaccaucuuuaaaaauuuuaaauaaaaauacaauuuguauugauccuuuaaaugauaacagaugauguaauauaaaaaaucuaacuuaaagccugugcacaauacuuacuucugcuacuuagaaguaugauauauaucuauaucucaacaacaugccacacaugcuauauaguaaaaucacuucuaaacuuuaacaaaacucaaaaaagcacacagaugugaacguaagccaugcccgauguuaaauaacaaaaccaaaguaacaauuagauacugcaaugcaaccaguuuucuuccauuaaaauagugcuugccaaacaaaaucuucauuggacuggaaugaugcuuugccagaugacaucaggauaggcaaagccacuauuaaacccugugcuaaagugggugucaauaagcaggguaggaagaagaaaggcuggaauaugaggagacuuuuaaacaucuaucaacauuggcaagccacagucaaaaaguaguucauuuuugaugaaaguuuuagucaggcugagaaaauugaaagugcaagaaaauccacagagaaagaaaaaucagccuucuaagaaagacacaauacucuuuuccaagcuaugaauagagaugacaaguacuauuaccucagaaaagcaaugcaguacaacuuuucccugcccugcuccaaccacacaaauaccuaucagugguaguaguggccuuaaugcauuuucagcagcugccaugucuugacaggcuuccucacauccuccugaaaguaaaaacaccuaugccaacccauguggugguuaugcaaccuaagacaagcugggaaucacugaacuuauuuacucuggugacucagauauaaaucuaggucucugcggaaaaagagguggagaacauaaaagaauguaugacaccauuuuucauuaauauuuauuguauaacugaagcaaacucaaaagauuuucugcucucuauaggucugacaaagaaauuagcuuucagaaaugcuucagguuugaccagguacaauguaccaucugcuauacugaaugaccugaggcaaaaacaacaccccuuuauacagaacuuuuauuuucucugucuuuuucuugcuuuccucucaucauguugccauucaccaacaucuuacuuucccuucuucuuccagcuuauucuuuaaagccugccacugacagcuaccacucagcaaugcugaacuccacaacaucaagaaauuuuuuucgaugcuauuccacucagaaauaauuuaaacauugcaacuucaaaaaauaaaacagcaaaauaaauacucaucuugaccaaaaaaaaaaaaauuucuggauuuagcaaauuaagugaaauauauaaauuacaucugucauuaauguagcagaucaaacuuaaaaagcauacaugguagauuggugcagccauuauggaaaauaguauggaggguccuaaagaaauuaaaacuaggauuaccuguaacccaacaaccuuucuucuggguguauacacaaaggaaaugaaaucaccaccucuaauagaugcauuccucauguucacugcagcauuauucauuauggccaaaguauggaaacaaccuugguaucccucaacuaucaaauggauuaagaaacuaugguguauaauaaaaaauggaauauuauucagccuuaaaaaaaaaagaaggggaucuugucauuugccacaacaugaguugacccgaaggauauuacacuaugugaaauaagccagacaccaaaagaaaaauauugcaugaucucacuuauuaucugguaucaaaaaaaaaaaaggucaaauauucacagagacagagaauaaaacuaguuaugagggucacgguugcgcagaggaaaugggagaggugucucaaaagauacaaaauaguauauaugcaggaugaacaaaucuaaagaucucauuaacugacaauguauuguauucaggauuuuugcuaaaugagcaggucauagcugcuuuugacacaggggaaaaauggguaauuaugugagaugauagauauguucauuuguuucaccauuguaaacauuuuacuacuuauguuaucucauaacaucaugugaauaucuuaaauauacacaauaaaauguauuuuuuuaaaaaaagaauacaugcuagggaagucauacuuaguacaauuuuuaugaugaccuaguuguaaaaugcuucaggagcaagaguaagauucucauauuauaaguauuuuuuuuccuaaguaucuuacauuaucccuaauccuuuucuucuuuacuuaaauauuauauuugggcuaauauuuuuccccaagaaaccuguucugauucacugagagugaaaucuaucaauuuuauauguccuauaauuuugauauaaauaaauuucacaauucccaccaaagaaauuugaucaaucccccugauaugcagaucaaagaucauaucuuaggguucucuuaaucaguucaaucgaaaauaaucuuucuacucauuaaguguccauagcacuucugcaccucucagacucaucaaauaccauucaauuauguaucuaccuaucuuaucuccacuauguuauaaaguuauugagggcagaacuacccauguguaaagcguccaugcauaguacccgugauacccagcacaaucacaauaaaauauguuaucaucuuuaggaaaaaaagcuuacagaauuauuauuauauagcauaacaucacuugagagucuauuuacauaggaucauuauuuugggaaauaagaacuagguucucagguagcaaguuuaaucccugauacuugaucuaauuuagucccuacucauuacacaaauaaaucaagcuaaauaaaauuauuaagcaaucaauacacaaugauuguucuacaaauaacugauauagaguuuauuuuuauuucauacuuauuuacucaacuauggcauuuaucaucuaaaucaccuaauacuguguuuuaaugggcaaugccauggggaaagaacuuggacuguagggucaaagagacacaaaaagacuccaggcuuuaaucaaagaaaucugacuauaaauuuaucuauaaauuuauagggauuucuagggugaacagaaaaaagaaacauaauaaaacacauauuaucauucuuucauuuuuaguaaacagucuuagaguuccucagaguaacagugaacauuuauuuucuuaauuuucugacauguuuacugucuauuuacauuuauucacucaacaaauguuuacugaaagucaaucauauuccuacauuaugugucuagagagaaaauaaaauuugcugaaauauauuauacaaugucugguaauguuuuauagcugcuuauuuagcugcacuauuaauuuuuccaaacucucucuagaaucagcacagugacagcagauacuuaauaaacacucuuuggcuaacugcucaauauuucuugcuuuauuuguuacauguuaagaaagcucccaguggccaggcacaguggcucgcuccuguaauuuuggcacugugggaggcugaggcagguggaucacuugagcucaggaguugaagaccagccuggccaauauggcaaaacuccgucuuugcaaaaaauacaaaaauuagccaggcaggguggcaugccuguagucuuagcuauucaggaggcuguggcaggaaaaucgcuugaacccaggaggcagagguugcagugagcugagauugugccacugcacuccagccugggcgacagaacaaaacacugucucaaaaaaaaaaaaacaaaaagggagcgggagcucccaguaagcgaauaugguagugacuaaauaaagaagaacaguaaagaggaauuaagaagaaugccauguaauuaaaauuuuuacaugacuauaucuagggcugugaaugaauuacccuguggaaacaaucagccauuugucuaauaccuguugcucuucuuacaggaaaugcagggaagaaacauacccugggccugcugccuacggacauaaggcacagaucugaauuuguauacacaaacaucuucauccucugaagaggacaaaaauaccaacauucuuguauuuuccaacauuuuucaaaauaaggucacuaugcuuuuaguaauaaaauauaaaucaguuauuguacuauaguuauaagauauuacuaauggggaaagaaagauaggugaagaguacguggagcucuauacuauuuuugcaacuucccaaguuuauaauuauuucaaaauuaaaaauuaaaaaaaucaauaagguaaugcauauuuaauaaguguuggagaaauuaaaacagguauauuaaauuguuuuucuaaacucaaacacuuaacauguacuaaguaacgaauauuuugagaaaauacuuguggaaauucuauuuaaaguguugaauccuaggcaggauaauuaaucaccuccugaguuauucaacuuauaaagugaaauuuauguguguggauguuuuacucagagcaaggcaauaaaacuacaaguuaaugugcagauaaacaaaucaguuguccuuugaaaaaaaaauagcacauaacaaaauaauuuuggcauaauuuuuucauagaccaaauaacagcuauguaucaaauuccuacuuuccucaggcuaauauuaaauaaguuggccuccuuuaagucuauauuggcuggagaacagaaggaaacaugcuaggaagaaacaucauacaggaagaggaagcugggccugguauuaauuggcugagcagcugguucaucaaguguugacaacauaccaauuacaacaugucaaaaaucacccugucacaugaucuccacucguaacacagguaccaaaggcuuaagaaacugaagaaagcugaaagaauccaugucagaacucaaugaucgcuauuauuucaaggacccagaguggaaagaagagccaaugcaugaagaaccagacgccagacaggcuagugguccuacccaaagacacagcucucuacuggcaagggaagaacaagugucuuuuaauuucugggccucugaagugccauuaucaauaggcacuaaucuuuuauagguaguaguaaugaauacuuuaaagggauuaggccauucacaaaagaaucaaacaacuguaauuauuuuuuaaaauccucacucauuuauaguccucuaaacucccaaauacaauacuuuaaauccacuggggcuucacauguaccuaguugauacaaaguucccaaucuaagcuugcaaccucaucaaaauacauuauuauaguaccaccuaugucaguugucuuuacuaaguagggcuucaguuuuuuuaaggcuuacaaguaucugcuauuggaucagcauaaugauaaaaaggguugucuccauacaccuccaagccuugagcuugcuuaauuacugcagcacuugauaaccaugguguucuuuugugaaauaucacaaaacaaugacauauuauuaagcuaaaucauauauuauacacaaauauacuaauacaugaauagaagcaggugacaaugguuuucuuaaaaaaaaaaaaaaaccuuuauggaagaaaccacaggccuaagaaaaucauuaauaauuuuccuggaguugagaaaacuaaugugcuuauuuaauagugagaccacuuuauagagauauaaaaccaaggcccaacucagucauaagcauuaaaacagcaacaaaaccccaaacugaaaacaaaaucucagcacuuuagugaaauuacaguuuaguuggucaaaauauauauagugccugcauuaagugggcuaacagauacaaaguauuucauauaccaaaaaaaaaaaaaaaaacaaaacuacaaggcauaucauaaugagacuucucacaauggacuauaacgcuauggaagaucaauaauccaauauuuuaucaucuauuauacacaaucuauuggacacaguaauuuuugauuaaacaaaaaugagggguaagugacucauaucacuaacagacauugcuuuaauguuuugccucaagucuuacaucuucugcagauacaguacuuaauauaucucaaugucccuucucugaagguucaaagacgugaagguaauggggucagacaggacaugaaagccugcaacaagaacuggggaauuuggaguuaauggucacaguuuuaugacccuaaugauaccuagaugucucagggaucccugaaagguccgugguaaggccugauacuuuuagacucaaaaaucccaaagcccugcaccacugcagucaaguaaauaaaucaacuaguacuuccuuguucaaccaaaugaaacacaugaagaaauaucauuaacuuauuucuggugcugggcuuuucacauucugcaggacucauguuucacaguuuauagaacugauauucuagaucuauuaguguuacaguuauuaaagauuugggggccaaguaauaaauuaaccugaaaaaauuccaaccaaagaaagaaaaacagaagugugaaugagccaaaacauucugcaaugaacuuuauuuauuuaacuuggagauaaauuauuuccacauuucuuugcuacuguauuucuuuauuauuacauuuauuuauggugaaagaaugcaucucuaaguauuuggcauuucuugcgcauaagauuaguggaaagauaaggcugucaggaaacguuaagggauuuuggguucauuuaacccauggguuucagggaagcaguggaaaaggcagaggcugguacaggaaugugcacucaaucauuuaccaaguauuuacugagcaccuacuguguauagcucauugcaccagcacuaaaugcacaguggucagcaaaacagauuccauguccacaugaacuagcaguugcuaagcaaugugguuggcaucuccuacccaguuuucaaugauuaauccuauguuuaagcaguucuauaauucaacaaacauuaauucaaugaaauaaaaaaucagaaguuuuuuuuuaaaaaauuccaguuccucccauccaagaccucagccuaggguggagagacaaauaaaccagcuauuaaguuucauaauaggaguacaaccaagagugcuaagggaacauccaggagggacaaccuaaguacuauuccagguagaaagaaaggcucagaggcaggagagcuuggcauacuucaaaagcuucaaguaggagacaggaaugcaucucugccaugcagaggaugcaaucuaggcucaaacacacugagcucagaagucaaaguccuaacacuggccuacccaagacuaaugacaccuccaucaccuugaccucaugguucaccuccuuccagccaaccccuuacuguucugugaaugugccaagcacccugcuucagagccucagcacuugcucuucucucaguccuacaauucucacucccuuggcugccucaaaucucuucuaauggaccuuuacagagaggccuucugauucagaccucuauaaauggcaaacccacccauacuuuagcaccccaaugauuguaugaugucacugacaguuauaauaauauaguauauaauguacuauguauuauaauaauugacaauuauugacaguacaauugacaauaguaauacuuguuaucuacuccccucaccacuagaauuuaagcucccugauauagcgcuaucacccagcacugugccuaacagacagcagacacucaagucuuuuuuuaaaaaaugaacaaaugaauggcugucagagaugugacuggagaagcuggagccagguuacaaagaguuuuuuauagacugcaaccccauguuuuagcgccucuuugauaaugacuuaagaucuauucaagaauuuuaagcagaaaaaaaaagguauacuggaaagaccacaauuucacauuuuaaaaaauuaaaacaaaaaacaauucauuuuggaaagagugugaggguaaucuaugagaagacgugagacugcaguuaaguagaauauuuaaaagaccucucuaauacuucagcagggaaauacaggccccaaaauugucuucuggcagguggagguugaaaaugauaaacauuuagaagauaaaaacaacuggaccugaugcuuaauuaaaugugagacgugaggaagacugaggaguggaugaugacugccagucucaaucuagugacagaacaggugcuaacagcauuuacucaagcugaggagauaggagaagaaaauacauuuuggaagaacgauuaugaguuacauuugggccaugcugagguugacaugccuguguaaauaucucagcagauaugucuaaaccagcaguuggacauaucccagcaaaaaaucagugguucagaugucauuaauacuugucacacaaacaaaacuugaugaacuucauggcagcaauaaaaaucaaauacacuuaacuaggaauaaacauuacaguauuagaugagaauuagccuaaauguuaaaaaaggaaggcuauaaucuuaucuauauuaacgcuucuuacaagaucuggggaugaguucaaagauaauaugaucgaauuaugucagucuaugaauguuagaaauaagcaaacuaccaaaaaauaccucaauaguauaguaaauguuuguuuuuuugguuuuuacccuaguuuuacuucccauuaaccuuccuaauuucaacugagauuggguaggggcaauaaauguaggcuuuagaggccuguuauuugaaaauaauauuccugauauguuugcuauuugcauuuucucucaucucuggauaacugcacauucuauuaaugcuacacagccacuuccccuaacuacucaaccuccagauuucucaaugaagacaaugcuuccuccuggaaguccuuccaaacuuugaagucugaguuccaugcccaccccaccuccacaccauauguaccuaccuacagcauccacaccucacguaugugauacccuauucaacagucucuuccacucaacuguaagcucuaucaugauaaggaccuugaauacuacaugcacaagacauucguguauguauacgaacaaauguaugaaucaaugacugaacaaauuaucuauuuuccgugagaacuguugagauguuuaaacaaacaucuuucauuauuacgggguacucaaacugugaauauagcuauucuuauuuacagucuaacaugacuauguauuuuacaagguacucuucuuauuuuaaaaaaaagaaggggucucacuauguugcccaggcuggucucgaauuucugagcucaagcaauccacccaccuuggccucccaaagugcugggauuacagauaugagccacugcaacuggcagguuacucuucuaaggguuuuauuucauaucaucuucugaaugaaugauaucuuauuccaacggggcaacccaguauucuacuacugaaaauuaaauguugauaugagcuauguguaauuuaauccuuuguccacacuaaaacuacgugaaauuucaaagacagauuuuggccaggcacaguaaucccagcacuuuugggaggccgaggcgggcggaucacaaggucaggaauucgagaccagccuggcuaacauggugaaacccugucucuacuaaaaaugcaaaaauuagccgggcgugguggcggaugccuguaauuccagcuacucggguggcugaggcaggagaaucgcuugaacccgagagguggaggcugcagugagcugagaucaugccacugcacuccagccugggugacaaaagcaagacucugucucaaaaaaaaaaaaaaaagauuuugauacugugguuucagaaagaguaguaacuaacuugacaguccucaagauuuuaaaauaaagaacaauucaaugaguuuacagaacuuggugaaaucccaucaaagcaaauuguuggcauacagggagccacaaagaaucuuuuuuucccuuuaaguccaaguaaaauugaaaaaaaaaauucuuuaugauaaauuuuuuaauucuaauuuucuaaacaaagcuuuaucuaccuguuuaaaaugguucauuuuuuaaauugcuaacagcuaagcauuagaauaauucccuaaugauuauuccuuuacaaaaaguaauuuuaacaacaugaaagaugagugcacaguaaaaacucaacaaacagccuuuaaaggcugcagccuucauagugagaucauaacugaugcccaagcuaaagaaaauuauuuuuuuauaaauaucuaucauaaacuuucuauacugagucuaaacacuacugaaaauaagaguaaaaaaauuuaaaggagaucacuacacauauaauaaauggcuaaaguuuuaauaacugacaauaccaagugcugauaaagauguaaagcaacugaaacucucagauauugcuguaggaauguaaaaugauaucaccauuuaggaaaacaauucaguaguucaauaaaaagguuacugauauuaauaaauauacacuuauccuaggacucaaaaaucccacuccuagguauuaacucaagaaaacugaacauuuuugucccucacauagaccuguaugcaaauguuuauagcagcuuuauucauauuugaucaaaacuagaaacaacucaaauguccaucaguuuaugaauggaugaacaaauuguguuacccugguguaaaacaauguuacucaacaaaaaaaggaacugugcuggagcuggcugguaccagcucaugggagcccauuguuaaauuuucaggaauucuguaagcugguagcuuaauuuaggccauagugacaguguuuacacuacaaugauuagcgaaugcuauaaaucagagauucuuuuuuuuuuucugaagaguauguuguuaagacauuucccagcacaucacugaacaaaauacugacacauguaacaacuuaauaaauaucaagcauuacgcuaagugcaagggaacacgaaaggcuacauaauguauaauuccauuuauauaugccagacgagauaaaacuuuaagagcaucaauuaaauuaacgguuuucaggggcugggaguguagagguagaggacugacucaugacagggcaugagugaacuuuuuagaguaacggaaacguccuuuucuaugucuugacugugguggagacuauccaauuauagacauuuguuaaacuuuuacuuucacuacauguaaauuaugcuucaauaaacauuacucuaaaaaauuaaaguaggagccauuucuuuuuuuuuuuuuuuugagauggagucucacucugucacccagguuggagugcgguggcgccaucucagcucacugcaaccuccaccuccccaguucaagcgauucuccugccucagccucccgagcaucugggacuacaggugcacaccaccaggccaagcuaauuuuuguauuuuuaguagacacggggauucaccauauuggccaggcuggucuugaacuccugaccucaggugauucaucugccucggccucccaaagugcugggauuacaggugugagccaccaugcccggucgccauuuauuucuuaaucauuucauggaugauaaauacaccacacacaccaagggggaacuggauuuaucaguguaaauaucaggaaggcagauuuugacucgacauaaauagaaauauagauuuaaaauguaaaaacaaacaaacaaaaaaacaaaaaaaaaaaaacggccuggcacgguggcucacgccuguaauaccagcauuuugggagacagaggcaggcagaccacuugagcucaggaguucaagacuagcuuggccaacaggguaaaaccccgucuccacuaaaaauacaaaaauuagccaggcgugguggcgagggucuauagucccagcuacuuggguggcugaggcacgagaaucucucgaaacccgggaggcagaaguugcagugagcccagaugaugccacugcacuccagccugggcaacacagcaagacuccaucucaaaagaaaaaaaaaaaaaggucaagaaaaaaaaaagaagaggggaaauucguaaucacaggaaauacuaaaaucagagguggaugauccugccaaagaugcuguagaaaugacccuaguucgggugugauuucagacuagcaucauuaacagagguuaguaucauuaagaucucuucauacuggggguccagggcucuaaaaucuuaugauauuguaugcuaugauaaucucagauauacuuugcaauucuaacuaaaacaucaauuacuuauuuuaacaucaaucaaaugguauuaccgaucaaagucuaguauacccuguuuaugaaugcuggcucuaacuucagacagucuggguucacauguuggcccaccaguguuuguaugacuuuaaaacaacuuguucuauuuccccaucuguaaaaugggauuaauauuuuccuucgauuuaaaugagaauguguuagaaacaacgucuaugugcugaacucuuaaucacaaacauuucuugggcauaaucagaaaugaaggacauaaaucaucaaauguaauuuaaaaauuuuagcuuuccaaauauggaauauguauucuuuaauuuuauaucuagaaguucauaaucuuuuacagacccauauccuuuugagaaugugaucacccaacagagucuuuaucuaggaaaaaagcaaauauaugcuauauucugcauaugauuucugggaagccaaggacccucagaaguauaugcaugaaauuaagaaagaagcagggcaugguggcucacaucuguaaucccagcacuuagagaggcuaaggcaggaggaucacuugaggccaggaguucaagaucagccugagcaacacagggagacccucaucucuacaaaaaauagaaaaauuagacaggcaugguggcaugcacauguaguccuaacuucuugggaggcugugggagaaggaucacucgggcccagaaguucaaggcugcagugaaccgugaucgugccacuacaccccagccugggcaacagggcaagacccugucucuaaaaaaagaaauaaauaaauaaauuaagaacaacugauguaaacuuuuaaaauugcaaaguugagcaguggaauuuaagaaucucuucaaagcagagaauccaacuaauauugaaauauacugucauuuacuuuuucaaaaacagauuaugcaagaguagaacauuguauuuucuaacuuaucccuccuuuuuggaggugauacaaauuuuuugaaacauuuuuuuuuuucuuuacaaaaauuguuuucucuuuguugcccaggcuggucucuaacuccuggccucaagugaucccccagccuuggccucccaaagugcuggaaugacaggcaugacccacugugacccaccaaaagcauacauauauuucagaugaauccauuuuaacucauggaaagaaacuagcaguagaaaccucuuucuagcagcuugagauagaaugguucaaaguauuaacauacuuuacuauugcucaaauaucauaggaagaguucucaauucuaaugcaauauauauuuuuaaacauaaaaacauaccaaccuaauuccuauacuuaagagucucaugauaaaguuuuauuuuuuuuaaagucggauuuuuuuacuagacuuaugcacuaauacaacauguuuuucuauaaauuagcacauuuuuaguucuguuuuauguuauguuuguuacgucgccugauagucgaaaccaguuguucucaaccugcuaccaaauaccaaccuggaaauaugccacuauuuaaaaagcccgaagaauaggguuuuguuuuuccuuuuuaauuguuugguguucaaacuacauaguaaaccaguuggcaaccauuacugaacaaaaauaguuuuucguaugcaugagcaccauuuuccaacagaaaacacuuaaccauuuuuaagguacuggaaguccaugcaaggguucacauaugcaguaaauauccuuucaaucugguuguaucacauuguuucugugaaaggaagaccugauauugcagaucucacaauuaaaugguaaaaaucaaugaaaaacugcaccugaggcucaaacacuagccagauggccuuugguuggaaaggucucaucugcuucuuaaaucccgccguaacugugaauguuugcgaugccaccacauccccaguacaagagaacuggagcaucucuggcuccuuccauaaucgaagggcuuccagcguagggcguagggggagaggcccgaagcccuggagacagcgcccgagggauggaggccgcgcucggcugcgcucagguccggguggcuccgggagcugagaccccgcaggaugcagcgggggggggccagggccugauccccuaccccugcgagccagggccgccuacgcccccacugcuucccacagguaacguccagcccucuccuccccuaucccccgaaauaucccgguuccgcuccgcuccgcucgccgcccgugaccccgaccccgacccguccgcgacggcgcccuccccaggaggcagcggaggacuagggccaggccgcccacccuggcggcggcggcggcucccggccaaggcggacccuggggaggacagcagcugggccgcggccugucccuagggggagcgggcgcagggccgcgagugggcagcgccuccgccccgcacgaacaaagcggccaggcgcgccgggccgaggcagcaccgccucuccgggagcgcggggggcggggaggauggcggggguacucaccugagggccggcggagggcgcgggcgggacaggcccaggagacgggaccgcggcgggccggggcuccgcgccgagggcgcacgggcuacggggaaggggcgaccggcgcgacguccgcggcggggcccgggagccccgcgccgcgggccgggggccggggcccgagcucgauucugcggccgc

SEQ ID NO: 191491 - RNA, 206053 nt, Homo sapiens
gagcuugccagccagcuagcgagcgacgggcgcgcgcggccccugcgcacucggccgccgccugcgcgcguugcggccgcagcugcaccuuugccuccgcgguuccgcagccgagccccgggaggaggcgcuccccugcgucguccgcacuugcgcccuuucccaccgcaacaggucaggggagggcggaggugacgagggcgcccgacccgggacuagaggacggaagggucuggaaggugagcgcagcccugcgccacccagggcugggggucgauccgcccggcccccgacgccgccgccgcggacuucucggaagccgaggcucuccccgccucucugccggcuucccagcacgcugacucaagucgcuggcguucccacuuuuccggugggagcccucggggagaacgggcuagggcucagagcucucaccgcccuacuugcgaucccgcggcagguagcgcguagaaaaacaggggacggggacaugggaagagacccaugcuccucccucacgcgcagcccccaagucagacguuugccugugcaccccgcguuuugcggagagcugucccguuguugggaccugcuacuugaguugcguaaugagucccagaaguuucucggggggagggggcggggaaaagugggguucuucucuccugcaccccgggacccuucccugugccugucguggagagagaugagggcuucccgccgcgucucgcugagagcaggagggaggcgugugucggugguccguagccuccggggaggaguuggagccaccuucugagacuuaacuucagggacagagggagaggcgucuuuaguaugggacugguuaauuucucuugauaaugcuuuuuucccucgggugucccauccucuguggccgucgcaaccccacccuccgacggugcgagcgccggagccagcgaaugagaggggagagaagguggagagugugaaucacacguuaccuuaguguaaugguaguugcauuaauggagcugcgacgggccugcgggcgguucgauaccguccggcuaguuuucucuucccggagcuucuccaccaccagcacccgcaaauuguuaugcagaucaucccgggaaggcacuuggcuuuggagguggagauguguccgaaucucccuugaaccagucucuguuagggggaaaggccuugcagccaagugauuuguuuuaaggguggagccggagauaauuuuaaacacccucccccuuggugcacguugcggggugugacucaccacggggaaaucagacugauuuaaaaccuucagugcaaacuuguaaauuaaggcgaagacccaguguucccugggacaguugcaaagugagaagagcucagaaacugaagcacagaaacguuagguaggagucugagaggcguggagaauuuugcuugugcaagauuauuucagagcaaggucgugcgguguguguagaagguagguggccguggguuaccucucucagaccugcgugguguuggccucuggguggggauaaaagucacgaaaaagaccuuuggacccagagucuaguuuuuuuucuuuggggccgaagaauaccuaggcauggcccuguuucaguguuuacuuccucugucuaauguauuuccuuagcucgccuuucaucuuuagugggaaggauuacuugaguggauauuccggaaguagauucacaggagaauggaaaauucuggaugguuugcuugcuuuaauuucaagguguugucucuuguggauguugggaaguauuguacuugaauauuugaagauaaauauggagaaaagcaguggugagaacuaaaggaaaaugauccaaggggagaugagagaaagcaacaaaauacauaaguaguacguaaaacuagagaaacucacuggaauuaagccauuuuuauggagagaaagaaccaaggaaauaauuugggauagauuuggucacuuugagacaaauagagauugaagagugggacuuuuggggaaaaugaguuuagauauuggagacuuuucuuuuuucaaauauaacuuacaaggauguugaggcuggagaugugagacuugcagguauguugcugugaauucuuugcuuuucaccugcaagaaaaugaacuguuaaauauuaaucugccuuauucacuguaacaauugaauuuguggcuuuggcauuugcuuaacucuucaacuuugcaaaacuauaauuuugaagaaucacaguguguuaaauuagaauacaaagaucauuuagagauugaaaauuuaugacaaaaguccaggccauuguaaacauugcuuucuccuacaugcguaacaggcaugcauuuuuugccaccagaaucacuaaucuacuauaggguaauaagacuauaucaaaacuagcugucucuucuguuuccucuccgguuuaacugaauuuugcagagcugguugaggugaaaguuacuuuuuuaauugacugagaacuugcuuaauuagguuuuggauuaaauuuggaagagacuauucaauuaaaauacauauauauuuaucaggcaccuuuacaagucacuuuauuuauuuuugagacagguucucacucugucacuuaggcuggagugcgguggcacgaucauagcucacugcaaccuccaacuccugggcucaugggauccucccuccucagccucccaaauagcugggauuacaagcauaugccaccaugcccggcuaauuuaaaaaaucuuuugguagagauggcuugggguggggguggggguggggggcucccuauguuacccaggugggucuugaacuccuggcucaagcaguccucccacuuuugccuccucaagugcugagauuacagguggaagccaccgugccuggccuacaagucacuuuagccaggugauuguuuaguugaaguuucauauugccuugaaaguugaaaagaggggugaaaaaauugagcuuagaaaggguaaacuuguuuucaauauuuuuugaaaagcugauggaaggaguucuauguucaacucuguaauuugugggcccaaaguuccuuuauuucaaggcucuagaccauuaacuaauuuuuugggagauugagaaaguauguuagagagagugcaaauuaaggaaccucauuggggccaggugugguggcucacgccuguaaucccaacacuuugggaggcugaggcgagcggaucacuugaggucagcgguucuggaccagccugaccaauauggggaaaccccaucucuacuaaaaauacaaaaaguagcugggcaugauggcgugcuccuguaauuacgcuuccucgggaggcuaaggcaggaaagucgcuugaacccaggaggcggagguugcagugagccgagauugcacugcugcacuccagccugggccacagagcaagacuccgucucaaaaaaaaaaaaaaaaaagaaaaggaaaaaaguaaguguauuuaccauaaauauacagaguuugauuagugauauuuuccucaaauaauaaauucaacaaugguuucugaaguuuaauuggcaguugcuuucuaguagucucuuuuuuuaagacacaguagaagcuuauuuaauaguguugauuuggaucuuagauuuuaaaauagauuacauaaacucuguaauccauuuauuaaaauucuaccacagcauggaaauaaaugugaaauauguggcucuuuguagguacacauccauuauucaugauuguuuauaucuggacaacagauuguuauagacuugacaccaugagaccccaaggucaucaggguugcuaauaggaguuucuguuguaugccuuaggacagaacuucaguaguauucccgaagggaagaaaaucagcugauuuucuuaaauuaucuggcccauuuuaaacaugacuaaggauuucuugcuagagugacuuuuuccuauuaaaagacugagauuauugugacaaauagugccugaaggaaucaauuacaucauuaauauaguaucucauauucauuccuaauaccgcguaaguauugaguagcuucugugagccagacgguauccuaagcauuggagaaauugugaugguaacaugaucaagaaagagaaagggccugugcagguggaacuuauauuggcacuucacuguuuaccaacagcuuucacauggcauaaucauuuaagccuaauugugacucugaaauuggaauucauuuuccauuuuaaaaucaggaaauugaguugaagaaguuaagugacuugacucugugacucaaagccuggugcccuuucuacuaugguacacuguguuggcuauguugaugugugguuuccuguuuuucaagaauuacagcuugacucuaaaauauaaauaguguuucuccuuggguaaguaauucuuucugaucacuaugggaauaaaaacaaguauuuucauuuaggauuuugaacauuugugccuccaaaggaaaaaauuaugcaaaccuauuuaacagacacgugguguuuauuugcacuagauaagaauccuuaccuuucuaaaaauuaaauagagggccuuacggacuagcugccuuagugcuugaaaacuauuauucaacuugugaaagcucaguucauaaauuuuuuagagcauaucccuauguaagucagaacauacucauaccauuuccuucuuauagauacagugaauaugugcagccuggcaguaguucucagaccuauaauguacuccugaaaggcuugugaaaacacaggugugcuccucuuacccgucccccgaguuucugaugcagcaggucuaggguaaugcccaagaauuugcauguguaacauguuuguggcugauauugaugcuguuauuucuggaacaacacuuugagaaccacugugguauagcagagaguuuaaaaagguuucugagucagacagcuuggguuugaaucuuggauaugcuaccuacuagcugucagaccuuaggcaaauuacuuuuuucaagaacuaugaaggcugagcgagcacugcugcuuacgccuguaauucuagcacuuugggaggcagaggcgaaaggaucauuugagcccaggaaauuugagacuagccugggcaacaaagugagaccccuucuuuaaacaacagcaacagcaccugugaagucugagguuuuacccuacucucaagcuaacuaaccugccacaguuucauggaccccuggguuacagaggaaugacuuuaucacucaucaagauagcuguagccagaauaucaacauuuucuuagacugguuuccuaagccccaauuuuccaaaggguuaugugaagaggggaagagagccaagugacacaugcaaaaacaguggguuguauuaacaggaagggaauccugaguuuuuaugagacagagucucacucuguugcccaggcuggagugcaguggugcaaucuugucucacugcaaccuucgccucccagguucaagcaguucugccucagccacucgaauagcugggaucacaggcaugugccaccacgaccagcuaauuuuuguauuuuuaguagagacgggguuucacccauguuggccaggguagucuugaacuccugaccucagaugauccacccgccucagccucccaaagugcugggauuacagaugugagccacugugccuggccuuccuaaucuuuuauaguugucaguaagugugucugcucuucacagggagauuuuaucuuuuuuuuauuuuucuuuccccuaaucauuagaaccugugaagggaggggcugggcaugguggcucaugccucuaauucuagcacuuugggaggcuaagguggguggaucacuugaggucaggaguuugagaccagcuuagccaacauggugaaacccugucucuacuaaaaauacaaaaauuagccggguauuguguuggacaccuguaaucccagcuacuugggaggcugagggaggagaaucgcuugaacccuggagguggagguugcagugagcagugaucgagauugugccacugcacuccagccugggugacagaacgugacucgguuucaaaacaaaaccugugaagggagaguuuuaucuugauuauacugcauagugaacaugcugcccuuagugcuaggagacuaucccuaauuuuccaaggcuguucaccauacaaacaucuuuaaagauaauuugaaacagccagguacagugccucaugccuguaaucgcagcacuuugguaggcugaugugggaggauugcaugagcucaugaguuugagaccagccuaagcaacguagugagaucucgucuccacaaaaguuuuuuuaaaaaauagccaggcgggccggccgcagugggucacgccuguaaucccagcacuuugggaggccaaggcggguggaucgcuuggaagucaggaguucgaguugagccuggccaacgugaugaaaccccgucucuacuaaaaauacaaaaauuagccggcgugguagcacaugccuguaauccuagcuacucgggaggcugaggcaggagaauugcuuuggggguggagguugcagugagccaagauugugccauugcacuccagcgugggcaauagagcaagacucugucucauaaauaaauaaauaaauaaauaaauaaaauaaaaaauagccaggcaugguguugcaugccuguggucccagcuacccaggagacugaggugggaagauugcuugagccuugaccuaggcuguggugagcugagauccugccacuguacucuagccugggcaacagagcaagacccugucucgaaaaagauaaucugaaacaaaaagacaauugaugccucugcuuguaaaaauaugcacaaauaccacagacccauggagaaauugucuccgaacaccuuuccaauccuccguuuuuuuuuuuuccuuauaaauuggagugagcaauauagcaauaucuucuuuauugaguaguugaacagaguaaagguacuaagauuuggcaaguucuuggagcagagcauaguaagugcuacauaaauguuugcuauuauuacuccugaaggaagagauuguguucucagucuuuuuuucuuuuuuaugguaaauauugucucauaagaugaaguaauugguuuacuuugaauaaauggcaaacuuugaguuuguuccaagaaacuuuuguaaggguccaaauucugaaaugaggacaaugccuuguacgauauuuuaccagcccacagggaaugagguagagacauuuucuaccaauauccaugugcuuuucuguguuuccuagcuucuuuaugguuacacagaaucaggugacucaucuguccagauaagcagugagucacagauaagcaauaaacauuuauuuauuuagcauaaguuaacuccagauaguaaguaguaaguacuaugaaaaaauagaaguguggccagcacugcuauuuuccuacucaguagccauuccuguuuguucuuguugucacuaaaagaacuuuaauugcuaagagacuacauuuguccagucuuagguaauagaucauguuuguucucagccaguggugacaguuuguaucuugauuuaccugcuuccuuuaaagcuagaagaaccugggugaccuaguucugguuuuuugaugguaaagauuuuuggcaaaaauagacaaauaugucaggcaaagccacaccuuccucuucuccuccucuucgugccuugaauaugaaugagaucucucguucauaagauggaccauggcaagcaugaagacaacaugcuaaauaggcaaagcagaaaaagucagaguuccugaugccucauugcauagcuaacaguaugccaaguagccacccucuucuagacuugcuguaggagaaacauaaacuucuauuaauuuaaacaguuauuacuuacagcuaaacacauuccuaacccauauaauaagcauaauggaguagagaguuguggguuggcuggagagaguccuugagggacagcauugucacauuagcuuugagagucaguggaggccucucugagaaugucauuggagcugagcaccuaaugaucagagggagccaacaauaugugggauguguacuugaguguagcguagcaccagaaccccguugaacaaaacuucaaaguguagaagagauaguuggggaaauuguauuccuuuauggauuucugagcuugugagguccaugugcauuggagagccuagaggaacuguagaugaucaggucaguuugggguccugggagauuaugaucucucccagggguagaucucucuacuagggguagaguucuagagaaucagacuaaaacagaauguaugucccaugacuuaucccuaacacauugccuguuaccaagagacuguuauuccuggguaaaggagaaguauaguugacgagggacuaacuagccuacaggccucugaacagaguaauuuuucucauauucuccuuuggaaacuagauugugguccggggacuggggagcugcuugcucuguuuguccaguugaaaaguucccaggcugggcucagucgcucacaccugugauaccagcauuuucgggaccagccugggcaacauggcaaacuccugucucuacaaaaaauacaaaaauuagccgggugcaguggcucauuccuguaaucccagcacuuugggaggcugaggugggcagaucaccugaggucgggaguuugagaccagccugaccaacauggagaaaccccgucucuacuaaaaauacaaaaaaauuagccaggcgugguggugcaugccuguaaucccagcuacucgggaggcugaggcaggagaaucgcuugaacccugaagcggagguuguggugagccaggauccugccauugcacuccagccugggcaacaagaacgaaacucuacccaaaauaaaaaaaacaauaauaacauaaaaugaaauaagccaggcaugguggcacacaucuguagucccaguuacucugaaggcugaggugggagguuuacuugagcccagaagguugagguugcagugagccaugacugugccacugcacuccagccugggugacagagcaagacccuguaaaaaaaaaaaaaaaaaaaaaaagucuucccuaguguguggaauugccccagcacaugguuuggccagccaaaaaaauaacuagaacaaccacuaucauuuauugaauguuuaccaugagccagucauugugcuaaaacuuuuacaaacauuauguccccgacgacaaucccaugaagccccuguauuacugaugagaaagcugaggccuuaagaagaauaauuuucuggagguuuuuuuuuuuuuuggacagucuuguucugucgcccaugcuggagugcaguggcgcgaucucagcucacugcaagcuccaucucccagguucacgccauucuccugccucaggcacgcgccaucacgcuuggcuaauuuuuuuuguauuuuuaguagagaugggguuucaccauguuaaccaggaucgucuugauuuccugaccucgugauuugcccgccucggccucccaaagugcugggauuacagacagccgcggcgcccagccucgaggucuuauagcuaguugcaaagcaggucuuuuaccagcaugugguaaagacucuugagaguagguuccccagaguguacuagguuuggaagcacuuaaugaccuaagugaacagaauauuugaaaacaucuugagucacuuuuuauauucaucuucucccuuuuuuucuauuuauguauguauguggugugaguguccauaaaacuuacauauauguguauauacucacauguauguguauacacacucuugaauuaugaauuguuugaggaagaaaagcaguuugauacacaugacauuuuaauuucugaauaaauuugguaagcaagagagggaggacuauagaaaggucacuuagauaguaauguacauuccugccauggaacauuccaaaaugaaauaaaguuugcaucauucacauaaaauuuaguguggauauagcugcuaccaugugucagugugcuagguauuuuagcuaggugauauaauauaugcuucucaguuacucuggaagguaggaaggucucuguuuuacacauaggggcauggaggcugauagagcuuaacuuguccaaggugaucaugcagcucacuugagccuagcugcuuucugcuguacagcacuacucuguuuuuaaauagagccaaguuaguaucuuccuuauuuucuuuuccuuuuuuuuuuuuuuuuuuuuuuugaggcagggccuuguuuuuucacacaggcugaagugcaguggugugaucacagcucacuguagccuccaccuccuggguucaagcuacccucucaccuuagccuuuugaguagcugggaccacagacaugugccaccuugcccagccuuucccaauuuuuuuuuuuuuuuuuuuuuuuuagacagggucucuguuacccaggcugcagugcaguggcacagaucacaguucacugcagcuuccuccuuccugggcucaaccaauccuccugccucagccuccucaguagcuaggacuacaggcaugugccaccaugcccagcuaauuuuucuauuuuuguagagacaaggugucacuguguuuccagggcugaucuugaacuuaagcaguccuucuaccuuggccucccaaaguguugggauuacaggcaugagccaccaugcuuggcccauggaggauuauauugaaagauugauagcauaacagaauaaaaggugaaaaugcccuuuuaaaucuccugcucuggccucuucaccaaagcucuucccuuuccagaaagcuacuauuaacaguuugguauaugcuauuccaaacuuuguguguaugcauaaacuuaaagcauuaaacaaaaaauuggcucacauuguacauuuuauuuagaucuugcuuagauuaacccaugugguucuuuuugauguuuuaaggcaucucauuaugauguaucuguagugcuccugagcggugagaccugggggguugcucacuccuucaguuuucuacuuaucagucccgaggacccuuuuccacuacagaucucuauggcuugcuccucacuuuaagucuuugcucaaauguuguguucucugaccacccuacguagaaccgcaauacccuaccuugauuccucucugcacucccauuuugcuuuucuaacaucuauauauuuuacugaaugugucuuugcuuaccuucuguaguauguaagcucaaugguagcaagagucuuuucuucacuauauuuuuuauguuuuuugaggcagggccuugcuguguuacccaggcuggagggcaguggugcaauuucagcucacugcaaccuacaucacccccaccccccacccacccccaccugcaucccuacucaagcaguccucccaccucagccucuuaaguagaguagcugggaacacaggcaugcaccuccacaccuggcuauuuauuuuuauauuuagcagagacgggucuugucauguugcccaggcuggucuugaacuccugagcucaagcauucagccaacccuggccucccaaagugcugggauuacaggugcacacccggcccacucucuuuauucuuaguaccuggcuuacagcagaugcucaggauacauuuguugguucugucagucagucaacaaacaagugaacucaggaccccucucagauugauagccacccaacagcccaaccugucuccuuuucuccuguuaucacucuccaccaaagagcccuaggggugggugcuauuggguugcaagcagguugagcaucuucacugggaggguaauguggggaacugccaucagggacucuucagaugccucuacagaaguguuaugaagaauaaugccaacaggaauacaauaguguuuuauugaucacuuacugugugccagcccugcaagucaagagagagaaagugugagcagcaaaggcagggguagagcuagcgaugcagagaaagagaaaaaggagaaagugagcgauaguaaguggugagggaagggaagggagacuaguggggauugaguuggagaauugagaaaacuugccuagggggccacuauugcuggucagaagagugacacauguuugacccugaaaaguagaucucugcuagugugaguuuaacuagaauauuuuaacauccaugcugcaaucuuuugagagaggagaaagaguggcaaauuaugucugcuaguauggaaacauguaguuagcaagucagcaauuuaaauuucauggagagggagauaaaagaccuuaucgggaguaagaauagagcugugaaggacuauauucaguguuucaaccucagccaaaguuguaacagccucuuaaacagaggcaaguuaaaaugauuacaaauuuaauguguguuuccauuuguaucaaaugguuuguccagucuguacuaagauaauuuaguaacauaccuuucuuugccuuaaggauguuugaaaaguaaaacaaacuauuuaaugcaaguuaggauaaguguagucaauuuauaaauacucacuagagagggaaaaggaaacagcuguagacaguguuaaccauaaagagagguuguuuccagaguuacccaagauaguaccaagacuaucugcccagauuggauaauaauuuuucccccaaauucagucuuguuuugaaagaaugcccaauaguuguuuuauuucgguuuuuguuuguuuuuuuuuuguuuugauuaaguaccuuuaaugaguggaaguaaaaucuuaagauugauugucacugggacccacuuuucuuaaguguugcauucuuaugugagaaugaccuguugauuuccuuucucuugcauaguugacacucuuaccuuuucuuccuuuuaauucuagugaggaugcugacacaaccugugaccuuaggcaaauuacuuaaaacuaagucuacauuucuugguuguuuuuuuuuguguguguuugagucuccauuuucuuaacuauaaaaugggauauuaguaucugccuugcaacuuuauuguaauguauuaaugaaaugccauuuuuaaaagggcuuauuuauauuuaacacaaugcuuggcacaaaguaggcaccaggggaaugguauuuccuuuucuccucccccuccuccuuaugguaaacuugugcacauuguuuucuugcugaaauggcuuugagaagcagccucacaguuaaaagugcaauuggccuuugauauauacuagauaguuuguucauacaacuugggaauuggagaaccauuuucuaauucaaaugagaacuuggaauucugucuccaauaaagcuucuuacaggucaugcguaucccugaauuuacucacaggcuaauguucacaggcuacucuuuguuucucuuucagaugaacagacuagccacuuugcauugacuggaaacaauggcauuuacagaaagagucaacagcaguggcaacagguaagcauagaaucuaugauucaaagacaugcugauauuuaauuuuauaaucuacuuuucaaugaauaaguuuggucuuuuucaauuuugcaacuuaagaacucacgggugcaagaaaauguuugaaauuuucaguuuucucuacaugaagucaaacuuguuggacuggcuacauauuuucuuuuaaaucuagcaaucgcugagucuguuaacucauuuuuuuuaaaaauguggauguuaauuuaaaugauuaaaucagcauucuaaugcuguguucaggauaacaagauugcacugauuuggggaaagcauacacauguucagccugugcuugaaauaaauaaacaaauccaucucauccugaaagcugugaaggagggaauuccuucauauuuguauuuugccccuuucacaucucucccuccaacucugcacacacaauuuagugccuucuugcauauaguaauugaucaguguugauugaggggaucauauuaacauuuugaagcaguuuuacauaauaacucauuugacauucggaaagaauuguuaucacugauuaguuuuuauuuaaaguauuagcuauucaaaaauauauauauauauauauuuuuuuuuuuugagauggagucucagucuguugcccaggcuggagugcaguggugugaccucaguucacugcagccuccaccucccagguucaagcaauucugccucagccucccaaguaucugggauucaccauguugaccacgcuggucucuaaccccugaccucaggugaucccccugccucggccucccaaagugcuggaauuacaggcgugagccucugcgcuacuccaaaaacguauuaaauguuuuuaaauguuacuacuaccccuuguaguaacauucuagcaauugcagaguuguuuuuauuguuacuuuuaucauaauuucuauuuauuaauuauuauuauuauuauuuuuuuuuuuuuuuuuuucccgacuggggcaggcgggcuuuauuccgggugcuggagagcugugggccccacuccucccccagaaugccaccggguugaggggcugagccucagcaggggugagcgcucagagcaggaaggggaugaugggcaugcgcaggggcggguagucccggaacuccuucagguagcugcggugcuugcccuuggcccagauggucaucugggugaagcccaccagggagaacagggccacugggagacacugcgucaugauggcgaaaccgauccaggaccccaccucguagguguaguuggggcaggacaccagcaggaagagccacgugaagggguucuuggugggguaugggaucuuccgcgucuuggacccagcgggccgcaggucccgcagggccauguggauggagaaguugccgagcuggcagaucacaaagauggcgagcgccaguuucaccugcugagcuccguagguagggggaguguagagagggugauugauguaauaggccauccacgcggcgaagccccaguaguaggugcaguucugaaagggagcagggcagggaugggacuugggccagcaccggacaaggcagaugcugcccaugucucaucccgagguauuauuauuuuuuuaagacaaaguuucgcuauuguugccccggcuggagugcagugccaugaucuuggcucacugcaaccucugccucccggguucaagggauuccccugccucagccucccaauuagcugggacuacaggcgcaugccccgacaccuggcuaauuuuugguagagacgggguuucaccauguuggcaggcuggccccgaauuccuaaccucaggugauccaccugccuuggccucccaaagugcugggauuacaggcgugagccgcugugcccagccauaauuucuauuuauaauagaauucuuuucccacuucuugcuacugcauuucacuagucuaaaaaauaaaaacauuauaagaaauguagacucagacuuauuuauaaugcaacagaauagaugauggugccugcaauuguggaccaucccaaauguucuccuacuucucccccuuucugguucauuuaggaaauuauucaauuccuggucaucauugugggcugcuaaacuugguuuacucucuccccucaccaaagggaagacaguuaguugacccuggcugcugcaguucacauucugcuagagccugggggaaagcuguugucauuugucuuuagguuuauucauaauguuggguuuacacauacguuuuacauuuuuauguaguuaaaugucuuguccuuuauggguucuggcuugauugugcuuagaaaggucuuuccuccuccaagauugugaaaauaaugucauguguucuuugcuggcacuuguacgauuucauuuuugcauuuaaaucagaacuuguaagcugguggacugugggacagaucuggucaacauauggguuuugguuagccugucacggaauucugaaagaaauuaucugccaguguuuuuuacauaacaaucuucuaucuucucaugaaaaauguaagauuuagcaacccugggcuugcauugucauauagcaaugcucagaaagaauugaauagcuucggcucuuuuaagcggaacacaggcuuucuaauucagaacuucccaauuggugugccaucaaaugcuuuucaggugugccacgauguugauuccccgccccccagccuaaaggucagccagagcuccuaucuaauuuccuccugcagacaucaucugcuuuguccguuugccccagagacuugaugucacaaaaaaaaaaaauugagaaagcacugacgcuuuucaauucguuacaguucucugcacagccagauucacacauuuaguuagcugcuugacccucuuaacuugcaacccauuuuacaucuuugacuuuuuaguauuuugauccacauguaguuaacuugaauauauauuguacauuucauauuaauaggaaaagguaaagaugggggauguuagggaacuuuuuuuucuuuuucuuuuuucuuuuuuucuuuuuuuuuuuuuuuuuugagacggagucucccucugucaccaggcugaagugcaguggcaugaucuuggcucacuacaaccuccaccuccagguucaagcaauucuccugccucagccuccugaguagcugggacuacaggcacaccaugcccagcuaauuuuuguauuuuuaguagagacggguuucaccauguuggccaggauggucucgauaucuugaccucaugaucugcccgccuuggccucccaaagugcugggauuacaggcgugggccaccacaucuggcugggaaccuuuuuuuuuuuuuuuuuaaagcaaaaagcuagacaauuguuucaucauuuuuuauuaaaucaccugucuuuucuccacagauacaaaugcuaugucuaaauuuuaucacagucuugggucuguuguugggcugucuuuugcuccauugaugugucuuuuggcaacuguggcauauuguuucacuguaucuuuauaugucauaauauugaggcagauucuuuguaauucuuguuuuuagaauuuucauagcuauucauucucaugcuucucaguguauucugaagucauucaucauuuucuagaaaauuuaugauuggcauuuugauuggaaucccuuggaauucaucaguuagaguugacuacuguaggcuauuaaaacgucuuccuauaagaauguagauaucagacuggugaaaauuuaaggagcugaaguaauuuuaaauuuuaauuguaagauuuucguggaggugauuuuucaaaaagguuuaguuacugauguugguuccuguguuauuucugguagaugaaucaauuauauuagguaaaaguauuaucauuggcaugauuaaaaagauguuuuagcuuaaaaccuaaaugauggguugauagguacagcaagccaccacagcauguguauacaaccugcauguucugcacauguauguaacaaaccugcauguucugcacguguguuuaacaaaccugcauguucugcacauguaucccaggacuuaaaguaaaaaaaaacaaaaaaacaaaaacacaacuuuuuuuuuuuuuuuuuuugagauggagucucacucugucccucaggcuggagugcaguggcgugaucuuggccccucugccucccggguucaagcguuucuccugccucagccuccugaguagcuggcacuacaggcacccaccaccacgcccggcuacuuuuuguauuuuguauuuuuuauuuauuuauuuauuuucaguagagaugugguuucaccauauuguccaggcuggucucaaacuccugaccuuguguuccccuccacccccacuacccacccccaccuucagccucccaaagugcuaggauuacaggccugagccauggcgcccagcaaaaagaaaaaagauacuuuauauucuaugacauauuuuuuuuguuuugcuaguuauuaaguuuggauggguaacugccccuuauaguaacauucuagcaauuacagagcuguuuuuauuauuuguuacuuuuaucauaauuucuagcuccucaccuccucaauaugcuccuuuuaguuuuaguaccuacuacaagugguaaguuuggggauauccuuuaaaaagcucuauuuuuaauacacaccaguagcucacuuguuuaaauguuuaaucaugauagguauuuaaucuuuuauuugcccagaaaaaaacauuaaauucauguggaacugguccaggacuaggauauauuugcaaaggaaacagauguguauugaguacgcagcucuaaucauucaaacuaaauugaagucugaacgugaacccuuacuuugcucagggcuaucaaaagucauaagcguggacagaauauuaauguaaugugcaaagacaauguuuuaguucuuacaaauaaugagcuuauucugugacuuccagauuuaucggcacuugacacuguugaauuugagcucacuuauauuucuucaccuuccuuccgucccccuuuuuaauaguucuuucuaaaaauuguuauuggagucuaacagacugaaaaaggcagacauuauuaguacaguuuagugcauuuucuuuucuuuuuucuuuuuuuuuugagauggaguuuugcucuugucgcccaggcuggaaugcaauggcgcgaucucggcucacuggaaccuccaucuccuggguucaagcgauucuccugcuucagccucccgaguagcuggcgcaccaccacgcccagcuaauuuuuguacguuuuuaguagagacgggguuucaccauguuggccaggcugggcucaaacuccugaccuuaggugaucuaccugccucggccucucaaagugcugggauuacaggcgugagccaccgugcccggccuaguucagugcauuuucauaaagugaacacauguaacagauuaagaccagcugucuagaacuccucuccuuuccccuuucagcuacuaccucccuuaaaagucaucacuguucugacuuguaacacccugcauuuguuuugucugcuuuucaauuugauuuaaauauaaucauauagcauauacuccuuuauaaaguuuccauucauuuugauguuuguauuaguuaaccuucaaacacugugagguuuagggguaaaauaucuacaugacuuuuggcucccuaaaagcuuaacuacuaauuagccuacaguugacuggaagccuuaugaauaacauaaacagcugauuaacacauauuuugauauguauuaaguaguguauucuuacaauaaaguaagcuagagaaaagaaaauguuauuaaaaucauuucuaggcaugguggcuaaugccuguaaucccagcacuuugagaggcugaggugggcagacugcuugaguccaggaauucauucgagaccagccugggcaacaugguuaaacccugucucuacaaaaaauacaaaaauuagccaccuguagucccagcuacugacagggguccaggugggguaaaggccugaggugggaggauugcuugagccuggaaggucaaggcuguggugagccaagauugcaccacugcacuccagccugggugacagagcaagacccugucucaaaaaaaucuuaagauaaaauguauuuacuguucauuaaguggaaguggaucaucauaaaggucuucauucucauccucuuuaugcugagugaaagaggaaagucuucaugucucugaagcagaagaaaauccaugucaauggacuugugcaguucaagcccaugggguauuuuuauuucuucuguucaauauauuuaaauaucuuuaucauauauuuuauauuaguauauuacuuauguaaucacuuuaccuuuuacauucuuuucccaucaacuucucauagucuaagaugauaauguaauuauccuuuuuguuccaccuugugacugucaucuacccuccagcuauucuuucugcuuuugguuuuaaauuauccagauuuccagauuaauagccuauuuuauuuuaugauuauuugugcccuugcaagcuuugucuuuaaaaugacaauaaaaguggaaaaaccaauaagcauuauuuacauuguuuugauugagaaggaaaaucgugucuaggauuuuauuucuccuccagcgucaacucaaauaccacuugaacagaauguucauauugauuaggacuaaugaacuaucauuaacugaauaaauuguucaaacgccaaauuuuaaauugcuucaucuuugaauagugcuuuugcuuugcuuggacuuucuaauuucuuuuuccuuauugaaagagagaaugugccuuuuugccauuucacuaacauguuccccuucuuacucuuuuguaucaacugcuugaaaugucucauuuucuccuuggaaucuugaaacuaaaauuaauuuuuacaaagugugugcuaaauuacauucuucugaaauugggcccagguaacugaagccagagaguaaaguugggauauauucugggaaauuuuuuacuugaggacagggggaaaacauguuaaaauaaaccauaagaaugaaguaaaugucauuucaggcuauaccaccaaaugggugggacaugauuuuaucgucuucugccauucagaguggguacugaaguguuuuaggagauuugcugagaugcuuuucaguuuuugggaagauuugagggauuggauuuuguuaaccuugcaucauauaggauggaauacuguagccccuggaagcucuccuuuucgaguuugaauugauguuuaacucuccuaauugagaagaauucucaauuauugaggaagcuacaagguguucaacagauuaacaccuauuauauggacagaucuucuuugugcaaguaaaucaagggccaaacuucuagaugcuuacuagagaguuuaauggcuguaggccauguuuuccugaaauagugauuggccugggcauuguaaauagugcacaccuggaauugugaaaugaggaaauaagguuuccugcauuuucaagugaacuaguuucuggccugauuuacaagugcaauaauauuucuuauacaaaacaccuuguuuucccucauuuuagaaaaugauugcuaacugauaaguaugugucauugucauauguaguuuaagaugagucacucaguuugauggguuuagaagaguuuagauucagacuuaccugagaacugaggaaauauuuuuuuggaauuaguuauuucccaaaaggaaagcuaaauuuugcauauaagaagacacugcuacauaguauuuacucuucuacaaguggcauagucaucuuagaaaacaacagaaguaacuuuauugagguguaauuuacaagcuauuuuaaguauacaguuuaauuuuuaguaacuuuacugaguugugcaaccauuacuacaauccagcuuuagaacauuuucaucuagauggaacuaccuguuuacaguuaaucccauuuucauucccagccccagguaacuauuaauccucaauaauuuugccuauucuggacauuuuauauaagugcaaucauacaauauguuaauuuuugugacuggcuucuuaggauaaaguuuucaagauucauccauauuacagcauguaucaguuuuucaguccuuuuuauugcuaaauaauauuccauugcauagaugugccaucuuguacuauucaucaguuaauggacauuuagguaguauccacuuuuuuguuuuuaugagcaauguuccacauauguuuuuauuucuuuugggcagauguuuaggagaggaauugcuugccucuaagguagguuucuguuuggagucaucuuuauuuuaagcucacaagccauugugccuggggucacuuuuguuuauuugcauguacuuuuucucugucuuuagcccugaacucccugcugaggcugagaguuggaggagaaugaauuaauauuaauaauuauuuugugccuucaguauaguggacacuaguccaggcauuuggcauuauaucauuuuaggugcuaaacuugguccaggugguagauaagaugaacacugaguugaauugcuggggauaacauugucuuuguagggauacuaauuuuauacugucuugaugugggaaagaaccauuuuucuuucuggaggccuuccauuauaacaguacuuuucuucugaagccauacuagucagccuacuuuaggaagaagagaauuucaguuccaguuucuccuguuuugcagaagcuggggaaccauuauuucaaaaucugagucauguuuucuaugcucuguaagguauucauaucaguagccuaauuuuacuggagaaagcaaaagccuggagagaccuucauagcugaguaugugaaucagacuguggggaaugcuggggcaacuaguucauuuuugguuggaaauuuuuuuuucuuuuuucuugagauggaaucucacucuguugcccaggcuggagugcaguguugugaucuccgcucacugcaaccucugccucuuggguucaagcaauucuccugccccagccucccaaguaucugggacuacaggugcaugccaccacaccuggcuaauuuuuuauuuuuaauagagacaggguuucaccauguuggccaggcuggucucaaacuccugaccucaggugauccucccaccucagccucccaaagugcugggauuacaggcgugagccaccaugcccagcccugagccacugcgccuagccugauuuugccauacuuaaaaaaacaaacaaacaacuauccuuuuuccucuuuuucuuugcugaacuauuuuaaagcaaauuccauuucacuucuucauacuuuaugugcaucucuaaaaauauauggacauuucccuacuuaaauacauacccgucucacaccuaauaaaauuaacaucuuggauucgucuaauaccuagucuaucucugaacuuuuucuuuuuuuuuccuuuuuuuuuuuuuuuuuuugaaacggaguuucacucuuguugcccaagcuggagugcaguggugccaucugggcucacugcaacuuccaccucucagguucaagcaauucuucugccucagccucccgaguagcugagauuacaggugcacaucaccaugccuggcuaauuuuuuguauuuuuaguagaaacgggguuucaccauguuaggcuggucucaaacuccugaccucaagugaucugcccaacucagccucccaaagugcugggauuacaggcgugagucaccgugcccggccccaaacuuucuagauuguuuuaaaaugucuuuuaaaauuguuuuuagccaggugcgguggcucaugccuguaauuccagcauuuugggaggccacgguggguaaaucaccugagggucaggaguucgagaccagccugaccuacauggugaaaccccgucucuacugaaaauaaaaaauuagccggguguggugguacgugccuguagucccagcuacucgggaggcugaggcaggcgaaccacuucaacccaggaggcagagguugcagugagccgagauugugccacugcacuccagccugggagacagaguaagacucucucaaaaaaauaaaauaaaauaaauaauaaauaauaaaauugucuucaucuugauccaaggaaaccaaaguucacauauugcauuagguuuuguuucuugagucuuaauccagagcagcauuuacucuauuuacuuguggggugggagcauuuacuaguuaaggaaacaguugcauguauguccuacuucuuggauuuguuuguuuccuauuaaugcguuuaacuuguuucgauauagcaguaguucucaacggaggacaauuuugucucccucucuuccaggggacauuugacaaugucuagagagauuuuuagucaucacaaucuagugaguagaggccagggauguuauuaaacaucuacaaugcacagaacagcccccaccacaaauaauuuccugguuucuaaugucaauagugcugagauugagaaacugucagccuaucccauguauuuccugaagaauggaaguuagcacuaaaagcuugguuagagucaagauaacucuuuuugcuuaaaauaguuaaauugcccaggagugccgguauucuguuuugaucuggguguugguuacaagaguauaucauuuugugaaaauuuauaugugagcucuacacuuuaaaaaauguguguuauuuuuaauuuuaaaaguuuacauuaaaaaaagaaaccucuuuauuguguugggucccuuccucuuuuugucugcuacuucacacuucuuaaauaguugaauaaaucuuuaaagccucacucccuuuuaaaguuccuuaauacucuuuuuuuuuuuuuuuucccaaugugagagacugguagagaugggggaaaaaaugggugccuuuugaacucauuguugggaugguugagugucuguuagggaagucagagugcugguacuuuccuugcucugcagaaaauugcagaguugcccuaagggagggacaccuaaacgauaaguaacguuaggccacuuggguuuuguguaaagcugaaaggagaaagucauuccagaugggaugguuugaaagcagagguuggcuuucaugagcuguggaauuugggaaaggggcauucugggcugaaagaaccagggaagguaaggaaugcauuaggggugugcugggaaccuuuucuugagcgaugucuuaaagccagcuucucuucucugucucugauaaauaauuggaaggaaaggcaaugaauuuuuuucugacaguugguucuaacugggggccagggccucguuugcaaaugaaaggacugcuguuggaguaguugaaaucacaaugggcccugacucuuuucacaucaaaguguaaaagaaucuccaggggugauaaaugggggcugcuggacucauuacuuguaaacaaagcugagggaugaccucuacauuuuuuuuuaauuaaaggaaaacaggguuuccuaguggugagcauggggcugcucuucguuugaauuuugacuguucacacuggaaaagaucuuucuuuaagguuacaagggagcugccgcuguuacccaggauuuacccugaaucucaaacacuacuggaaaaaugcugugccuaggacggcccagcagguauccugcauguguugagaauugaagugcaguggguuccgcugcguuguuacaguaaaguggaacagggcagaauuucugagugcugcuccucucaggagacugagggcuccuuuacuccuuuucccacccgacaucaggaggaaaacuccuuuauuccugugcaguguagaaaaagguccguuuuuaaguaaauucuuagcucuuuguaaaagaaguccaaaggcagugguuuuagaguuuaaagauaguauuucuuuauauuuguguaguuacaaggcuuugaguaugaucaaaacguuuaaccaaaacuaaaguaugugcauacuuuaugguguugaaagcaaugcuacuaaaaauaguacaacauuuuaugggauuaagauugcaaauugcugccuaaauucagcuugcaguuaaggccuaccuucaguaaacucucguuguguagucagcuccccaccaagcuuaucucuugcuguuuuuccacuuggcuccucuguugcagucaguccaagcccuaccagauuuuaaacaacuggaggucagagacugcccuuuguaaccugaguggaacugguaaggcacugggcacccaagaauucuaauguguuuacugacuuuccacauguuuaguaaucaccuucugagccuaucuuccaagcaaguuguaagacuugagaaaggagcagaggucacagcuggcaaggagcacagcaucccuggaugguugacagagacaagcuauccuccagaugaaauauuuccaacuacagaugagaguauugaaggccuuccauuccccuuugauaucagaauggugagaaugugggagacaccaccaguuaacccugccuucaugaguacagauacccaugaaaauauuuaauaagcgcagugaccagacgagaccugugcuaaguauuugauaggcaugcuuucaaucucguaacucccuaugagguuauguuuuacagaugaaaaagggaaaaggaagauacucaucaguggcuagcuuccuuccaucaccgaacccucaagucccuguucccuuuuugucuuuguagaagcugguggcagggauauacuuucugagcucugguuuaaaacucugaguuuugggccacagauccccucuagcugacucuucuuuuuugacaugaaugagauaaaaaguuguuccugggagauaguuucagcauggcuacaguagucagagaaacgugcaucuuuuccagugaaggaacaaagcugauuucuuugcacuggggcauagugggggugugggaagggggggcugagugaugggaauaggggucacuacugagucauauggcaggaaaaagaugaaaagauuaguuacccaaaaaaaaaaaaauuaaggaauggaggugguucccauccuaaauuagaaucuccccaguuugcguuucagagcccuuuucaucgccguggugagaugaugugugcucucucagagcacuuuguggucuguuacagcauugcacagaugucagguggcugcccuguuaauaaaucaaccucucaacgguuagaaguuguagcaguucucguuuuagauuaucuuucuacauccggcagaggcuuacugucccccgcagagcacuugguaaacgagauaugaaauuguccuuuaagaauggagguuuaauuuuccaguaggacagaguauucaauaaaugagaguggagacuauauuuuauuugucuaaaauauauguuuuuuaaaauguguuccucaauagcugguaaaggacaaagccagggaguugagagcaaaggguaugcacgagcugagauagcaggauauuuggaaaaguuauuguuucuuuuuuuuuuuuuuuuuuuuccugucucauguccucaaccuggaguagugacucuggugaguagaacacuucuuacaggcucacugggacccugccacuaaauuuucaccuggagaggcagccuaauuaagagagaguuugcuuugaaaucaguuagaucuggguuugaauuguauccccaugagacagguaaugcugggcaauuuucuuaaccucuccaaacucuaguucuuucauuuguaaaauaaggauaauaaugacuaaauauauacauuuauuuaaagcccauggagugcuugguacucaauagacauuuaauaaauauuaauuuucuucccuuucuguugacuugccuuugauaauuucagcauuuaggguguggagaauuugaacuucaugauguucauagaacaccugagguuuaaaaguuuggguuccauugggcaauauagggaaagcagccuucccaugcucugagacccaacucugaagcauugucugggaccagcgccuggcacuguaugugaacuguauaaucacguguuccugccaacuguggguucaagugaugaugagucugauuuuuguuacucuggaacuuacauuauuaagaguuuggguaauuugaaaugguaggugacacuaugaauuaauuucucaauaaaauucucauuucauauuuacuacuaaaauauuacuuuaagauauaguuuaggauacacaugaagauaaguauaggccaagcacgguggcuuaugccuguaaaacucagcacuuugagaggcugagguggguggaucacuugaggccaggaguucgagaccagccugggcaacauggugaaacaucaucucuucaggaaauacaaaaauuagccaggcgugcuggcaugcaccuguaaucccagcuacuugagaggcugaggcacgagaauugcucgaaccugggaggcagagguuacagugagcuaagaucacacuacuguacuccagccugggugacagagugagacucccaucucaaaaaaaaaaaaaaaaaaaaaaaagcauagauaacuauguguaaagaaacuagguauucauuuaauaauacuuuuuauccuuuuagguuaaguaaauagaaaucauauauuuccuucagguuaguuugaucuugaauggaaguucucuguucuuaauccaauauucauucauucaucaaagacuuuguggagagccuuugaugucaaaagugucaacuaggaacuagggagaggggaugggaagaaaaacugguaccaugggggagggaaggaacugggauggagguagauuaguccacagggaguucacauuagcgcuugcguucagguuacuauguguagguuacuaugugcaucuacucuuuuucauccaaugcuuuaaacuuuuuaaaaagcuuauuccuaguccaguauuguauuuuaaccuuauaaagaucuuauaggguaggucaggcagauaguuccauuugaaguuuaaagggguuaagugguuugccaaugaucucaggguuaauaaugaaacuguuuucucaaccuggaaugaguuuucucucccuuucccagcuccucagucuauugauaucuuagucauccuuuaagguucagcugaaauaccaccuuuucuuuucauuucuuuuuuuuuuuugagacagugucucacucuguuguccaggcuggagugcagcauugcacagucacgguucacuacagccucaaucuccugggcucaagugaucuucccaccuuggccucccaaaugcuaugauuacaggugugagucaccaugacuagacugguuuuuuuuuuuuuuuuuuuuuaguacaauuuuuuuguagaccugggaucucaccauguugcccaagcuaguucugaacuccuggccucaagcaguccuccugccucggccucccaaagugcugggauuacaggcaugaaccaccaugccuggguuguucuuuugguuuuuuuuuuuuuugagauggagucucgccccgucaccaggcuagggugcaauggugugaucuuggcucacugcaaucucugccucccagguucaagccauucuccugccucagucucccgaguagcugggauugcaggugcgcaccaccacauccagcuaauuuuuuuuauuuuuaguagagaugggguguuggccaggaugggcucaaucuccugaccucaugauccgccugccuuggccucccaaagugcugggauuacaggugugagccaccgcacccagccgccuggguuguucuauacaucuuuuuuuuuuuuuuuuugagauggaguuucacucuuguugcccaggcuggagugcaauggugcaaccucugcucaccacaaccuccaccuccuggguucaagcaauucuccugccucagcuccugaguagcugggguuacaggcaugugccacuaugcccggcuaauuuuguauuuuuaguagagacaggguuucuccacguuggucaggcuggucucgaacucccgagcucaggugauccaccugccucagccucccaaagugcugggauuacaggccugagccacugcgcccggcuguuauauacauccuucucguuauuccucuaucauagcuuacuauuuuuaaauauuaaauuucuguuugcauuauuguaugguuucucucuccugauuagacacagacuaauaaaacauuuaguaauuauuuuccuccaucucauauauccgucugagucguaaacaucuuuuauaccaaagaccuauuuaauccuucagcacuaucucuguguuuugcaaauaaccagcaauuaauaagugauuugaguuugccgcuauuggaguuauuguugcugucauagagagauggaggagugcugauguggagggugguuauaauggguauuuauuugaccuuucuuagaaaaacaacccaaaguucuuacucuguuacuaauggguuaacuuaguguugcugugaaagucuguaacuguuaagacaauuacgcauuguugacucaacuguugaaaacuacauuuuaaggcaucuauauaaagucuucagaauuauguaaacagugauuuacugcuaccuauuugucuucauugaccuuuuaaaaacaaauuccuugcacaggcaagccuuagagccaauggugccuacagguuaccuguauuucacuuuucggcuaauuugucaauguuuucucacagcaguguuuuugucuguuuuaaccaggguguuugguuuggauuaauguucaguuucuacacacacuugcuaagccucuucucuuauccaccuauuagcaaaagggaagugaaggguauagccuguagagggaauucccccucuucauuuugcauucuaagucuauaucuaggaaagcauuguagccaaaaaacccaggaguauugucuguauuuugaagauauuugcuccaagauggcucacagaaaaaaaauaauugauaguaucauuauuaggcuaaugggcauuuuugacuccuuaagaguuacuuggcucagucagucugcugguugaggcuuuggauuugcugauugcagcccauggguauuugcauacgccuucccuucucccaaggccuuucucccccaucagugcuugucauugcugaauucauugcaccccugucccucacacccacucacaugaccuucucauacuaaugccuuuucacacuugagcaagguuucuccuuaaugaagacaagaugcauuaaacuucccaauucagaaaauuggaggguaaugauauguaugaaauaaaguaguuucuuuuuaagagaacucagagcugucauccauugauucagggaaugaaugugguuuuuggugugcuguauucuccccucuuccccagggugguaguuaguuucuuuuuucuuuccuuuuuuuuuuuuuuuaaguucugggauacgugcaaggugguaguuucuacagugagauagugacuugauaaucugagaaauaugcaucuuacccacacacauacccacacccuaaauggagguacuacaguauauuuugcacuucaguaaaugcucagcaccuacugugugcagagugauauauauugaauuuugugugcggugcugucaauccuuccucuucucugauuucugagacacaaucuggcuccugugccuugugauucugaugaggcccucucaauuucucaccaaacuuccuuuugucuugcuugauaaaaguuggcauuccucaaaucucuaucucugacuugcuuucuuuuuauacuauggauuuucucuguauaaucuuucauagugacuucaccaucccccagugggugauuccaacaucugcauuuucaagccaggaaagcacuguagcucccccaaaagcagaaauauuguguauauuuugaagauauuugcuccaagauggcucacaggaaaaaaaaaaaaaucauaguauuacuaggcuaaugggcauuuuugacuccuuaagaguuacuuggcucagucugcugguugagccuuuaggauuuguugauuguagcgugugggcaucuuccucuacuucuccagagguaagccauuaucccccauucuaauuuaaucauuccuccucuucuguuccauaauaauuaggagagacuuccuuauauggggaaguuucccauacauuccuuuugcuucucuaguuaaaaacuuccagggcaccauaucuccuacacuuuagaguuugauucccuuagugugguguucaagcccuuuauccccugggccucagcuuguuuuucaagucucaucucccaucacuacuguccuucuaccaaccuuggugccuugcuuuauagaagaucucucaauuccauauacaggcuuuugucauucaaguacugugccuuggcauauacuauuccuuccucccaucccugcuucaucaguccaucccuuugucugucagugcuaucagggaaauacaggguuuuacaggaacauguaggaguaguaccucagcauagauuugaggacuaaucagagaagacuucuuggaagaggcaguuaggcagaacacugauguauguuuagaguugaaaaaauuggguggaggaguggauaaaagagagauguguguuccagauaaaggaaccauacuugugaagacuugggcgaaaagaaaaaacaaaacagaaguaaaccguagggcccuuuugaggaacugaaugaaguucacuguagcuggagcagagagcaccaggucaggaagugaucuggugagccaugcuaagaaauuugaccauguauuuaggguaaugggaagccaucaaacuauuuuaaauauguuagugguuuaauaugauuuuaaaaggucgcuugucaaauggagaauggaguuuagugggacaugggcaggagcagaagcaaagcaacccauuguggggauaugaaguaaguagugcaugggagagcugaagagaauccagugggcucuggaugauuuuuuuuuuuuuguaaacaaugagaaaagauagguagguuggaugcaugaaacagaagacucaagaacaauucuuaaucauugguuuugucacugggagaugcugaaagaugggaaagacugagagugguacaaguuccuuuuugaguaguccagguuugaaaugccugugaaaauccuggcaaguggagauguuaagugggcaauugguucucuaagucuagaguucauuggggaaggucugggcuuaagacacaauuuauucaguagaaaaugaaucacaguugugcaugagauuucccaacagaugagagugcucaggaacuugaacuacguagcaacuuagugggaacuaaguagcagagaaggcuuaguaaggagguugagauggagcugauaaagaagcugacaaaacccaggagagugcucucuuggccaagggaagagcagguggggagaagagguucagaacaucaaaugcuguuaaacuguggauucagucaccucuuccgugaaaccuccucucuuacccucaggcaguaauggucucccauuucucaaagauacaaccuuuuauuauggcauuuaaauuguuuuuguuuuuaucuuccuuacaagauucugucauuggacagcugauuaugagcuagcagacacaguagaaauucaaucaauuaauacauuaaauaauuuauagaagaaugauuauuggccucugccaccaagaaaugguuaugucuucuuagugauuugccugcuuuuugucucccuggauuuaggauguaguuuugaaaauaacauugacguuccuucauagacguucguacaguuuucaguauucacaauggcagaaguaugauauuucgacugugcccuauuuuuaugcugggcaaggaccucaagaacaaaacuccugugaccuuacauaggggucuuacacugaaggaguaugggaaauagcaacucuuguaaaaauaagcuggucagugggugguagguaagcugagggaaaagauuuaugagcaacauccuguucugggaucacugcuggggacggaagagggggagaaacugcuauauaaaucacgaaggcagcucaggaaauaaagucugccauuggagggucucagggggacccuucuuggauaucuuuugcauaacacaugggugaaggagaaucaacaggugucacuuuucucagcccaugugggggguuggugcuggguugggauaauucaucuuucauaagggaaaaaaggagcagaagaugacagagugagauggcacagugggccccagagucaucucuaguuuuguaauugcuugcuggauugugaagaaaaaaggagagagaaggggccauuuuguaggagcagaagauuguguucauuggucuuaggucucacgugguagccucuccacggagcgccuccuuguuccuucaggaaucugcaucagcuucugcucaguucaggauguguaggugacauccugucuugaccagagggugcauuuggcuugagacuuuuuuucuuuucaaaugaaagacaguugaguccaggcgugguggcucacgccuguaaucccagcacuuugggaggcugaggcaggcggaucaugaggucaggagaucaagacccauccuggcuaacauggugaaaccuugucucuacuaaaaacacaaaaaauuagcuuggcgugguggcacgugccuguagucccagcuacucaggaggcugaggcaggagaauugcuugaacccaggaggcagagguugcagugagcugagauugugccacugcacuccagccugggcaacagagcgagcuuccaucucaaaaacagaacaaaacaaaaaacaguugaaucgguuuaucaauaggggauuagauucuauguuaugauguaccuacaaaauagaaaugaaauaguuguuaaaaaaaaaaaggguaagauaggcccggcgugguggcucacgccuguaaucccagcacuuagggaggccgaggcaggcggaucacgaggucgggagaucgagaccauccuggcuaacacggugaaaccccgucucuacuaacaauacaaaaaaugagcugggcgccggggcgggugccuauagucccagcuacucgggaggcugaggcggaagaauggcgugaacccgggaggcggagcuugcagugagccgagauagcaccacugcacucuggccugggcggaagagcgagacuccgucucaaaaaaaaaaaaaaaaaagguaagauaguuuauaugugcaucaagauugcaugauauaguauacaaauuacagaacagaaucaaagauaucuuauuuuuguggguaggaagcuagagcuauaucuaccuagauaaacacauucauagaacaggucugaaagggggugcaccaacuccagcaacaugaaucuuuugggggaauauaauuauuuaguuuuuuuaauguuauaacuuuuaaaaaauuauacguggaaggguaauauuuguuguuuguucuuuucccauaaugugcauauaucaauuuuauaguuuaagauauuaaagugggccaggcauaguggcucacacuuguaaucccagcacuuugggaagccaaggcagcaggauugcuugaggugaagaguuccagaccagcguggguaacauggcaaggcaagaccucgucucuacaacaacaacaacaaagauacuaaaguggaaacacuuccuagaauguuauuugaaaaaaugaaggaaugaguccccauccugcuaccuccuuaagaagauaaaaauguugcuccuuuacuuaaggguacauauuuuuauuuuuaguuaaaaauauuuggagcgcuuguugcauucuagguauuguucuauguagggaggaugcaguagcaaaacaagacaaaggagauccugcuuuccuggaguuuccauccuaguguguauggguaaacauguauuauagaugaaaaauaaacaugaaucauaucaggguuauaaagcagguuuggugaggguaaagagugucagcuggaugaaggaaagguguucuguuuuauaucuagucaucaggaaaggugcugcugcuaagguuauguucgagcagagaccugaggaaguuugccagauagaacuggagcuggggguggagggaacuuugcaggcgagggggagcuugugcauaggcccugaggcagugugugcuuuguauuuuuguggaacagcaagguagccagugaggcuggagcagaauguugaggaggguguuugggaugagguuugggagcuggcaggaggccagauuguggagggccuugucggccguuggaaaguuguuggagugagagagaaagccauuugaggguuccaucagaggaguagcacucuucaaaugcccuuuaacaggaucacuugggaagcuuugugggguuuacacugcggugagcaugggaaaagcacauuaggggaaacuauccuugcaguggauggggauuaucuuucccucccauuucacuaauggagaaagucaaauguuuggcacaggaacauaaaacacuguaagcagggaccagguccugaguuuucccaguggcaacuucggugcucuguuuuucagaggaagcuaucugggaauuuccguuuccuagcaugcauuauaacauguuauuuuuaauagcuaggucucugaucaguuauugugacugaucucagucuucuugcaugaagaugaugccucugauuuaugauauuuucuagaauucugagucaguaugaguuagugucacuucuuccauaacaaggugggaaugcacccauacauuugguccuuguguugcuagcagauaugaauuaagcaguaguuuagcuuaccuuggaaccagcuguuccuugcagaugcacugauauuaaggguacacaugucuauuauaaggcugguaaauuagaguuugcuuuaucagaagcuuaucaaaggucugcugugugcaaagcacuaugcugcauucuuuuagagcuauuagauaaauagcaauacucuaucuuuaaggagcuuacagucuauuggacacuaugggcaaaaacacuaauguuagaguugcaagaugauguggaaguacaaaggagguagagaugaauuaugaguggacaguaugggaaagccuuccugaaugagacagcagguauuucaacuggguguuaaaguuugaaggggcgcuggguagguuggcuuaugccuauuaucccagcacuuggggaggcuaagacuggaggaucacuugagcccaggaauuugagaccagccugggcaacaaagugagacuccaucucuacaaaaacuucaaaagauuagucgggaauaguggcacaugccuguagacucagcuacaugggagguugaagugggagaaucacuugagcccaggaggucgaggcuccugugagcugugauugcauggcacucuaaccugggcagagccagagcuugucucaaaaaaaaaaaaaaaaaaaaaaaaaaaaaguuugaagagcagaaaagcaggcauuuuaugcuuaagggagagccagagaagugacauggaaggaaaaugggucuguuacauuuucuuccauuaccagaauggucuguuauagcugagguuaaaguauuuuuaagagaaaagaaagaggaaggcagugggaaaaguagauggaaccauuccaucuaagccugaacugucuacuaugguagucauuggccauaugugacuucugagcacuugaaauguggcugguuagaguagagaugucaugguauaauacagauuucaaagacugggaaaaaaaugugaaauaucucaacaacuuuaauuacaaguuaaaaugaagacaguuuuggguuauaaauuuaauauuauauuuauuuuaauuuaucuugagacagagccucacuguauugcccaggcuggagugcuauggugugaucucaggucacuguaaccuccaucuccuggguucaagugauucucuugccucagccucucaaguagccaggauuacaggcgugcaccacuacacccagcuaauuuuuuugaauuuuuaguagagacaggguuuugcuauguuggccaggcuggucucaaacuccuggccucaagugaucugcccauaucuaccucccaaagugcugggauuacaggccugagcuagcacaccuggccuaauauuauuuagauuuauuccacugcuuucguuuuuuaccuuuuuaauguggcuacuugcaaauuuaaaagugcauuaguaacccccauuauauuucuguugguuauagcugaucuagguuagggcuaguagcccuagaagagggauugaaagcagggugaacaagaaaaggaaagggagagaagaaacugaaaaaggacaaucucugggauuuguaagaguuuguguguguggggagggggucaaagauacugcuuguggcuucugaccuugguguugcaaucaacuuggagugcacugcugcacggaggcagugaagggugggggaagauuauuucacuuggggccuguugaucccaggcugugcuguagggagguuccuuuggcagccaacuguggaguggauuagcauuggcagagcuggagguggagagaccaguuugguuggaucccaugcccguuaacaccugggugcugcagccuuuuguauaagggggcaggaugagggugagguuucggugugguguacuauagacauaaucugcagaauugcuugguaguuuaugcugaauuuuacauugggcuucucaauucugccucaguuggucucuuaauuuuuuucccccuuaaauuacuacaccccuuacgguagagaaaaaaggaaguauguagguuaugguauggccaaaauuuuuuaauguauugaauuuggacugguguagcaacuugucuuuuuccuuauuuauuucuggaagcagauugauuugguaaagagaaaggaaguauccaaauaacaggucugcugauuucuuaccuagacucagcaaauguuuauuaugaggaccugccuuuuccagaguuaacguuuucuuucuuuucuuuucuuuuuuccuuucucuuuucucuuuuccuuucuuuuuuuucuuuucuuccuuucuuccuuuccuuuuuccuuucccuuuuccuuucccuuuuccuucaugccacagauacuuauugaagaucugcugucagaugaugccuuaaaaucugauagaucaaagaugaccuaugggagagaauacgagaauagaaaaaugggagucccuguucuguuuaaccuggcagauaagcacacagccagauugugaaacaaugugauaaacgcucuagcagaagagcaaauaaaguguuaaaggaucauagaaaacagcaaagugucacggaugaaaucuuucuaaugagaacccugguaauucuuuuucuuuuggggcccuuugggucaugccaucuuacuuggagcagugcuauggcagaauucaacuuauuuauuuauuuauuuuugagauggugcuuucgcuucuguugcccaggcuggagugcaguggugugaucuuggcucacugcaaccucugccucccagcuucaagugauucuccugccucagccucccaaguggcuggaguuacaggcacaugccaccacgccgggcuaauuuuuuuguauuuuuaguagagacgggguuuuaccauguuggccagauuggacucuaacuccugaccucaggaugcgccugccucggucucccaaagugcugggauuauacagucuugagccaacaugcccugcccaacucauuuauuuaaauuuuauccuucuuaaacuuuuuaguuuguuuaaaugcagggauuuauauuaaauauauucuccuucuguggcuguucugccauuguaacugguugcuaugaagcugcuguuuuuccaagauuugaagugcagaugaagguauuagacaggaaaugccauccaaaauugcuaacuucugauuuccugaaaggaugguauuuuuucuaauuagcaauagucauguaaaauauuuuaaaggccaguguugugaaaucacaggaaaacauuucauacauaaagagcuguacacgguguuuugcucacguuaaguuaaauucagaaaagagcuuuggugacuaaaacgggcgucguaauacaaaaaccaaguugucgguuuguggugaagguauuuugccaucguuucugguuucaaauucuaggcuuuuuccuuacccucuuucaucuuaugagugauauucuccagcuaacuguugccucuuccaucccccuguguccgugcuauaaagauuuuuguaaaaccaugacugcuugaaaaacucccuaauagaucauuaugcucccuaaagaaaacuauugcaagucucuuugcaacccaauacgcacuuaucucuuuagugcuuuuccuacuucucucuugugcacccuauaauacaaccucaguuuuugcuccuuucccccaaaagccauguuuucccauuccucuguguuucugaccauauuggucccuuccgacacuacuuuguuuuuuuagggaaauccuauuuaucccaccuuaaccucuuuuuuuguuuguuuuguuuuugagauagcgucucacucuguuacccaggcuggagugcaguggugcagucucuacccacugcagccuugaccuccugggcucaagccauacucccaccuccaccucccaaguagcugggacuacaggugcacaccaccacacauagcuaauuuuuauauuucuuguugagaugagguuucacaacauugcccaggcuggucucgaacuccuggucucaagugauccuccugccucggccucccaaagugcugggauuacaggugugagccacugugcucagucuuccaccuuaaucuuuauuugguuucaguccaacaaauaguuauugagguuuucccacaugcuguguguugaggauacaaaacucauuaagacagccuuuuuuuucuccccccaaggaacuaauacaaggaugcagguauauaaacacuuaauacuaccuccuuaucagaguuagguguugaaaauacagugacaaauaaaacacaguuauucuuuugcccccauaagguguauguuguauugggggagacagaagucaaauauuuaaaauugaccuaugagaaguacugugaagggggaaaagccccuuugaucugagaaaacaagugacuugagagggcaugaagaucaauuuuagauaaagaggagggucaggauuggccucuuugaggaggugacauuuuaaaaaagacauuuaaacaaguaauuacgguaucauauaauaauuauuauagggugaguauagcaggccuacgagaagaaguguaaauguaaaugaaugguuauaauacaguguguuaaguucaaugauggagggauguaacaaggaagggaacuucuguagugggaggggcacacagaguuuuuauugcccugcaguggaaggauguggggaggguuggcuguagggcuuuccaugcagaagcacagagguuuaaaacaauuuggguuguguucacaguauuuaacacaucuauacucacauucugguauuauuacuggcauuuugcauugcaaggagcccagaggcagguaaggaggcagagaggugggugguguagaaaggcgcuccgcauuauggaaucaaccauggaaucaaccuaggugccagugguagacuagauaaagaaaaugugguacauauacaccaugucauaucacgcacccaugaaaaagaaugagaucauguccuuugcaucaaugugcauggagcuggaggucauuauccuaagcaaacuaacucagaaacagaaaaccgaauaccacauguucucacaagcggaagcuaaauaucaaguacauauggacagaaagaagggaacaacagaccccagggcccuaccagaggauggagggggaggauugaaaaaugaccuaacauguacuaugcuuauuaccugggugacgaaauaaucugugcaccaagcucccacaacaugcaauuuaccuguauaacaaacuugcauguguaccccugaaccuaaaguaaaaguuaagaaaaagaaaugggcucuggagccagaacugggugccuaccucggugucucacaugcccauaccugaugucuagggcaagguuuguaacucuuugugccucaguuuccucaucuguaacacugaaaugaugauagcaccuaccuugucagguuauuguagugauuaaguaacuuaauacuuaggaaauucuuggaacaaugucuggcacacagcaagugcccaauaaaugcaggugauggugccugugggcauuuuauugcauggaaauaaucuuugaccuguuggaaauccaugaaggccuauuugcaguggaauaacuugaucauguuucuguuuuucaaauacaguaaguaguccccccauaugagacagauacauucuaagacccccagugaguccugaagucacagauaguacugcacccuauacacuauauaguauguauuuucaaucucauaacugaaacagcuacugagugacuuacaggugaguaguaucuguaguguagauauacuggacaaagggaugauucacgucccaggugggacggagaggacagcgagaaauuucaucacacuacuuagaauugugugcaauuuaaaacuuaugaauugcuuauuuguggaauuuuccauuuaauauuuuuagaccuuggaugacuguggguaacugaaaccauggaaagugaaacugcagauaaggggggcuucuguauuguuuuagagggagugugagcauguguguuaggagggggcuggaauugcauuucuguggauucuccaaccucaccuuuuucccucacccccugcauaauuaccuguuccuucaccuguguucccauggugucuuaucucugcuguggcguuuuccuauuguauuuuauagucuguguuucucauacuagacuggguccccucaggguguuaaggacuauguguuacucaucuuuacaucccauugccaagaauaguaccuaacacuggcacauacugggcacucaauaaauguuuguugaauugcuuugaaagguuuaccagggaguugcccuaacauaauucuggagaaagguccucccauagaagagucugggcacguugcuaugggagaguguuuucuuuguuucacacaccaaguauuuaucgagugccuacugcacacugugcugugaggggauacauagaugagucagacguguacucugcccuggguuguguugacuuaaucguggguggaaggaagaugguaaaugguugcugauagguuuaaugagaaauaagcuaugaugugguuuaguuguauuugggcuuuuguuuagaagcauaauuauuucaaucaaagaauguuagaauuuuuuuaaaaugaugucucauugaugguagcuuacuucucuuacuucucauuacauucacuuuuuuuuuuuuuuuuuuuuuuuugagauggagucucgcucugucagcuaggcuggagugcaguggcacaaccucggcucacugcaaccuccaccuccuggguucaagcgauucuccugccucagccucccgaagagcugggacuacagacgcgugccaccaugcccagcugauuuuuguauuuuuaguagagacgggguuucaccauauuggucaggcuggucuugaacuccugacuucaugauccacccaccucggccucccaaagugcugggauuauaggugugagccaccaugcccggccuacauucacuuuuauauuaugauagaaucugucuaguaaauuucauaguguaguuucuuuuuaaauuuuuauucuuuuggagacagggucuugcucuguugcccaagcuggagugcaguggugcaaccaauauaauauaaaguuucauagugagccugcuuguuucuuggauuuuaauccugaguagaaaugauuccacuuaaggugggauauauccuugucuguagccagaagaccuucaugagcucuugcuaccuuuucuuggauuuacuuuguaaucaguguugcguauuauguuuuacuggaggugccuaguuacaagguuuuauuacagcaguauuucuaaacauuugguuagucugucucugcuuuucccaccauaauuuucuagcacuuguagcucaccuuaucucccacuucccuuuuuaaauagaaaacaggcuuguucuguuuugaccagguauaacucuuugcucagacugucucuaaagcccagaaaacuauuccucuagugguccaaugaaguguuccccauugaaaguuugccucauguacucucaacuccaguggucuucaaaccacuggaaucacugaauaccgucuccuuugccucugccucucuuuuuauuuuuuugagacagaaucuugcucugucgcccaggcuggagugcaguggcgugaucucgacucacugcaaccuccgccucuugaguucaagucauucuccugccucagccucccgaguagcugggauuacaggcaugugccacgaagcccggcugaauuuuguaauuuuaguagagacgggguuuugccauguucaccaggcuggucucgaacuccuugaccucaggugauccucccgccucggccucccaaagugcugggauuacagggaugagccacugcccagccugccccugcuucucuuaacacacugggaagcuccugcuguagcaaaauccucaauaaauagguguugauuagaugaacugauacgaauaaaaccuaugugggggugggagaguuuuuaaauuacucagauuuuuaaggaggauuucaauaguccuuuuuaucuuugugaaaauuuuauuugaaaguucuuauuuuaaaauaucaaaccugucagaacagcuacacuuuuaaaugcuccuuuaauaugaaaagauacucagucaugcauaaaaagagagaugcaaaugaaaacuacauuuagcuaucauaucuugucuaucggaguggcaaaaaauaaaguuugacaacaugucuuauugaaaagguuguagggggaagauacugugcuuacauacauagcuggugggaacgcaaaauacuaugacuguauuaggagaauuugacaauauguagcaaaauaacauuugcauuuacccuuuggucagccaggcucacuucuagaaaucuaucucccuaggaaucuaacucuuuugagacagagucucacucuguugcccaggcuggagugcagugacguggccucagcucacugcaaccucugccuccuggguucaagugauucuccugccucagccugccgaguaggugggacuacaggcaugugccaccacacccggcuaauucuuguguuuuuaguagagaugggguuuuaccauguuggccagacuggucuugaacuccuggccuccagugauccaccugccucugccuccuaaagugcugggauuacaggugugagccacugcaccuggccccuaggaaucuaacucuaagauacacuggcaaaauaugaaaaaaauguccagaagucuauucauuacaaacuauauguaauagcaaaagaguggaaaaaucuaaauaucaauaaagaguuggcuuaaaaaacccagcugggcauggcgguacaugccuuguaaucccaauuacuugggagucuaaggugguaguauaguuugaggccgcagugugcugugauuaugccagauggauagccacugcauuccagccugggcauuguagugagaccccaucucuaagaaaauaaaaaaggaaacccauuugggauuucaacacacuagaguauuaauauaccuguaaaaggaaauggacuauuuucuacuguugcauaaucucuaagagauauuauuuuuuaaaguaagguauaggacaacauguacaauaaugcuaccuuuaguaaggguagaaaaaaaugaaaaugugcauucauuugcuuauauuaaaagaauaacgaauagaaagcaaacuuaaaaacugauugaagagaacagauggaggagagaacgauagaagcuagacuuuccugaauguaccuugcuuuguggcuuacuuuggaacuauuaaaugugauauauaauuaugaaauaacauuuuaaaaaguugagggaggaacuuauccuuuaaaaguugaaaguaauggccaggugugguggcucacgccuauaaucccagcacuuugcgaggcuugaggcacccccccccuccaccaaaaaaaaggaaaguaacaaugaacaaaugaacuuaacaguguuuuguuuguuuguuuguuuuguuuugagacggggucucgcucugucgcccaggcuggagugcaguggcacaaucucggcucacugcaagcucugccugccagguucacgccacucuccugccucagccuccugaguagcugggaccacaggugcccaccaccaagcacggcuaauuuuuuguguuuuuaguagagacagggcuucaccauguuagccaggauggucucgaucuccugaccucgugaucugccugccucagccucccaaacuuaacaguuuuuuaaguugauuauguaggaauuguaggcaggccuugcuuuguauaguucugauaugcacaaauuucaguuauuaugguuuauuuauuuucuuuauuuuugagauggagucucacucuguugcucaggcuggagugcaguggugugaucgcggcucacugugaucuccacuucccagguucaagcaauucuccugccucagccucuggaguagccugcgauuccaggcacccaccaccaugcccagcuaauuuuuguauuuuuaguagagaugagauuucaccauguugaccaggcuggucucaaacuccuggccucaagggauccaccugucucgaucuccccaaagugcugggauuacagguaugagccaggaccccuggccuaguuacuauguuuuaaauagcuccagcccccaacacggugguucagauuucaguuaggacaguuuauuaacugugcaauuucauaaagcacaaaguuugcuucuagcuuguuauaccacaaaucacuuuauaaauaacagacgugcaucacgaucucuaaccagucauucucuuccucuuaaagccuguuggugacuggucacuaacaucugcucuucaguuuauacacagacagcaaggcguguaguuguguugccugucucccaguaauaaacccaugugauauuuuacauaaauggaucaccaaaagaggaaauucgccaacagagaucaaagcacgggaaauaaaugagaagugacagcacugaagugagauucugcagaauguuaaugaaguuacagaagaaauagcugacugugggaaugugcagugaagaaauuuacugaaagucaacuuacugauauaaaugaggaaagucauugugaggaaaaggaugaagaugucccagaggaaguggugccucacaaacacuuuguauuagagaaacuugcagagagauuuuaccacauugaaggagcaaaggauucaauguuggaaguugauccauacuuagcagggaguacaacaguuugcuaaggcaaagaaaagauguucacauugugucagaaauuauaugacaagaagaaggcaagcgcuguucaaagaaaaaaaauuggcuuuuuuuuuuuuuuuuuuuuuuuuuuuuuacaaagugcuguagucuguuuguaucccccucccaaauuuauauguugaaauucuaacccccagagugacaguauucagagguggagccuuugauggugauuaggucaugaggguggaaccuucaugaaugggauuagugcccuuauaaaagaacuugggcugggcgugguggcucaugcacuuuggaaggcuaaggcagacagaucaccugaggucaagaguuugagcccagccuggccaacauggcaaaacccugucucuacuaaaaauacaaaaaaaauuauucaggcgugguggcaggucucuguaaucccagcuccucuggaggcugaggcaggagaaucgcuugaacccaggaggcggagguuguggugagccgagaucgugccacugcacuccagucugggcgacagaguaagacucugucuccaaaaaaaaaaaaaaaaaaaaaaaaaaaggaagcuuguuugccccuuccacugugugagggcacagguagaagacgccuucuuuuaaccaggaagugagccuuuaccagacacugaaucugcuugugccuugcucuuggacuucccagcuccagaacugugagaaauaaauuucuguuguuuauaagcaagccaguuuuuaguguuuuguuuuauaagccugaguuagacuaagacacaaagaaauagaauacuuugucaggccaggcacagugggcucaagcuuguaaucccagcacuuuaggagaccaaggcuggcagaucacuugaagucaggaguuuaagaccagccuggccaacaugaugaaacccucucucuacuaaaaauacuaaaacuaaggcugggcacagcgguucacuccuguaaucccagcauuuugggaggccaaggugggagaaucaccugaggucggaguuugagaccagccugaccaacauggagaaaccucgucucuacuaaaaauauaaaaucagccgggcaugguggcacaugccuguagucgcagcuacucaggaggcugaggcaggagaaucacuugaacccaggaggaggcagagguugcagugugccgagaucacgccauugcacuccauccugggcaacaagagcgagacugugucucaaaaaauaaaaaaauuaaaaaauaaaaauacuaaaaauauaaaaaauuagcugggcaugguggugcacgucuuuaaucucagcuacugagaauugcaugaaccccggagguggagguugcauugauccgagauggcgccucugcacucuagccugggugacagagcaagacucugucucaaaugaaaaaccaaaaaaaaaaacaaaaaacaaauaaaauacuuugucgccaggcgcaguggcucacgcuuguaaucccagcacuuugggaggccgaggcagguggaucacgaggucaagagaucgagaccauccuggccaacacggugaaaccccgucucuacuaaaaauacaaaaaauuagccaggcgugauggugggugccuauagucccagcuacucgggaggcugaggcaggagaauggugugaacccgggagguggagcuugcagugagcugagauggcgccacugcacuccagccugggugacagagcgagacuccaucucaaaaaaaaagaaaaagaaaaaagaaaugcuuugccaauguaucuaguguuuuaaaucauagccuacuaaauauuacuuuuuucauuucuuuauaaauguguaagugacagaauuauuagcauuuugacagaaauuuguaaaugcuguggacaaucguaauuuuuccuguugaugauuaagguuguuuggcacaguuucggcuuucauagucguuucuaugguccugcacuauuuuucaaagugagaacuguauuucaagugacccuuuuuuuuuuccaagugacauuuuuuuuucuuuuuuuuuuuuuugugacugagucuugcucuguugcccaggcugaggugcaguggugcaaucucagcucacgcaacuucugucuccuggauucaagcaauucugcuucagccucccgaguagcugagacuaggcgcacgucaccaugugcagcuaauuucuuuuguguuuuaguagagacaggguuucaccguguugcccaggcuagucucgaacucugagcucaggcaguccgcccgccucggccucccaaagugcuaggauuacaggcaugagccacugugccuggccaagauacaucuuaaggaugaaaaagaaagaaagcuggauacagugguuuaagcuuguuaucccagcacuuugggaggcugaggugggaggauugcuuguguccaggaguuugacaucagccugcgaagcauagcaauaucuugucuauauaaaaaauuuuaaaaaguagcugggcauauagucccgcuacuugggauucugaggcaggaggauugcuugagcccaggaggcugaggcugcagugagcugugaugaugccacugcauuccagccuggcagcagaaugagacuccaucuaaaaaaauaaaaauaaaaaagacaaaucuuaaaguguucucagcaaacauguuuaguaaugguauugguauuauuauuguacuuguuaagaaacaaauagagaaaagagauacaaacaaaaucaaacaguuuaaaacacuguaauccuaaauuuaauagaaaagggaaacuaacauguuuuauaaauacaaauauuaauaguaauauaauauauauaauuaugcauaauauauaaaaauauaauauauauaauauguauuacuauauauauauauauauauauauauauauauauaaaauuauauuuuaggccgggcagaggggcucacgccuguaaucccagcacuuugggaggccgagguggguggaucaccugaggucaggaguuugagaccagccuggccaacauggcaaaacccugucucuacuaaaaauacaaaaauuagcugggugugguggugggcgccuguaaucucagcuacucaggagccugagacaggagaauugcuggaaccugggaggcagaaguugcagugagccaagaucauugcacuccagcccgggccgacaacagcgagacacugucucaaaaaaaaaaaaaaaaaauguagcucggcgugguggcaggugccuguaaucucagcuccucgggaggcugaggcaggagaaucgcuugaacccuugaagcggagguugcagugagccaagaucacaccauugcacuccagccugugcgaaaagagcaaaacuccaucuuaguaaauaaauaaacaaaaauuaaaaugauacuaaauagcaaaauccaguaguuacuuuuggaaaauggcagggaacuaacucauaauuaaaaaaauaauaauaaaagaaucaagcauuuauccuaguuuuuugaauaagcuguaacucaguguaacuaaaugauagagaaaaaguuauuuacagaaaaaaaaacuaauaaaaagugauaacauuaucauuuugcauccucucucugaauaagcaaagauuaccacuaauugauaauacuguuagguaaagagcuggugagaaacuuuguaaugggaugucuuaaagugacuaauuaaacaccugaauccuuuuuuuaaaauuuaauucaauucaauuuaauuuaauuuaauuuaauuuaauuuaauuuaauuuaauguaauuggagaccgaaucucacucuguugcccaggcuggagugcaguggcaugaucucaacucacugcaaccuccaccuccuggguucaagcgaucuugugccucgaccucccgaguagcugggaguacaggugccugccaccacgcccagcuaauuuuuguauuuuuaguggagacaggguuucaccauguuggccaggcuggucuugaacaccugaccucaggugauccacccgccuuggccucccguagugcuguguuacaggcaugagccaccgugccuggcccugaauccauuauuuaaaguuaagauauuuuuaaaaagaguuaacuauugugccucuucucgugauuuaaugagguauagacuaaccaccuaugaaauagucuuuccaaaaauuuagacagaaaucugaucaagccaguuuauagaacauacauucaacugagaaacauguuaaaggacucuucuuggaugcugucagcaaaauucauaauguuagaacucugcagaaaaaaaaaauuguuuuucccccaacaaauaaaucucauaaaaaagaauauagauuauaaagaagccuaagagacauaucaacccuuaauaaaaggauccuguuuggcucugaacacacuaaugaaauuggaagaauaauuagauauuugaugcuaguaagggaaauuuuauuaauauuacauuaauauuaaguaauauuacauuaauaucaaguaauaaacauuuuagauaacauaauaguauugugguuauuauuauuauuuuuaaaaucaucauuuuuuaaagagagggucucuguugcccaggcuggggugcagugguaugagcauggcuugcuggguacaagugauccucuggccucacuguccugaguagcugggacuacagguacacaccaccaugcccagcuaauuucauauuauuuuuuguagagaugggggucuugcuauguugcccaggcuggucucaaacugcuggcaucaggugauucucuugccuuaaauccucaucuucaagccuauuuaaaacugaaaacccuuauccugaauuucuuaucaguaaaauaaggaagaggacuaaaugucuuugcugcuuucucugugcucugcucuagcuguuauauaauagccacucccucaugauuuccuucucagaaucuuauuauuauaauguauaagcaauaauguugcuuguggauaagacuuuauuuaaugcgucuaccucugggggcaggaacuucagggcucacgcuggaugaccugauugacccuaggaaguugcucuguacccucuuccagaccauuuguccccuccugagcaggaucugaacauaacagcucugggccuugagucaggggucauuuagggucuugauaaccaagaauguauagacugggaugaguuagacuugguggagagccaacccucuguguggaaguccuaauucuucaguaggugauaacugauuaauacccauguggaaaccagaagcaauaaccaccagagaguaguaaugauuuggcacaccacccccuuuuugcaaguuauuauuuguguuuuaaaaaucauucagucuggccaggcacaguggucaugccuguaaucccagcacuugggaggccgaggcggguggauuacuugaggccaggaguuugagaccagccuggccaacauagugaaaccccaucucuacuaaaaauacaaaaauuagcugggcaugguggcacacgcucguagucccagguacucgggaggcugagguaggaggaucgccugagcccaggagguggagauugcagugagcugagauugugccacugcacuucagcuugggggacagagugagacucaaaaaaaaaaaaaaaaauuauccaauuuuaagcuggggucauguuauucccgcccaccccccaaccccagaguuucugauucaguaguucuuuuuguuuuugauauauaauaauuguacauacuuauggaguuacauauacauuagauacauuuauacaauguguaaugauuaaaucagggcagggcaauuaggauguucaucacuuaaaacauguaucauuucuuuaugcugggaacauuucaaaccuucucuugcaacugcuuugagauauauaauaaguuauuaacuauagucacccuacugugcuaucaaacacuagaaccuguuccuuccaucuaacuguauguuuugaaccauuaaccaaccucucuccauaccccgccucccagccucuggugaccaucauaugguucucuacuccguuagaucaacuuuuuuuuuuuagcuaccacauuugaguaaaaacaugcgauauuugccuaucuguaggaccuucuuaagacugugaaacuguaccuaggaauccaacuuacaagggaugugaaggaccucuucaaggagaauuaaaaaccacugcucaaggaaauaagagaggacacaaacaaauggaaaaacauuccgugcucauggauaggaagaaucaguaucgugaaaauggccauacugcccaaaguaauuuauagauucaaugcuguccccaucaagcuaccaucagcuuucuucacagaauuagaaaaaacuacuuuaaauuucauauggaaccagaaaagagccuauauaacgaagacaauccuaagcaaaaacaacaaagcuggaggcaucaugcugacuucaaacuauacuacaaggcuacgguaaccaaaacagcaugauucugguaccaaaacagauacauagaccaauggaacagaucagaggccucaaaaauaacaccacacaucuccaaccaucuuaucuuugacaaaccugacaaaaacaagcaauggggaaaggauucccuauuuaauaaaugguuugggaaaacuggcuagccauaugcagaauacugaaacuggaccccuuccuuacaccuuauacaaaaauuaacucaagauggauuaaagacuuaaacauaagaccuaaaaccauaaaaacccuagaagaaaaucuaggcaauaccauucaggacauagaauugggcaaagacuucaugacuaaaacaacaaaagcaauggcaacaaaagccaaaauugacaaauaggauguaauuaaacuaaagagcuucugcacagcaaaagaaacuaccaucagagugaacaggcagucugcagaaugggagaaaauuuuugcaaucuauccaucugacaaagggcuaauauccagaaucuacaaauaaacaaauuuacaagaaacaaacaacaccauccaaaggugggugaaggauaugaauagagacuucucaaaagaagacauuuaugcggccaacaaacaugaaaagcagcucaucaucacuggucauuagagaaaugcaaaucaaaaccacaaugagauaccaucucacaccacuuagaaugaugaucauuaaaaagucaggaaacaacaugcuggagaggauguggagaaauaggaaagcuuuuacacuguuggugggaguguaaauuaguucaaccauuguggaagacaguguggugauuccucaaggaucuagaaccagaaauaucauuugacccagcaaucccauuacuuggguauauacccaaaggauuauaaaucauucugcuauaaagacacauguacacauaugcauacugcagcacuauucacaauagcaaagacuuggaaccaacccaaaagcccaucagugauagacgggauaaagaaaauacggcacguauauaccauggaauacuaugcagacauaaaaaaggaucaguucauguccuuugcagggaaauggaugaagcuggaaacuaucauucucagcaaacuaucacaaggacagaaaaccaaacaccacauguucucacucaucagugggaauugaacagugagaacacauggacacagggaggggaacaucacacaccagggccugucagggaaugggagacuaggggagggauagcauuaggagaaauacccaauguagaugacaggucgaugggugcagcaaacaaccuuagcacauguauaccuauguaaccugcacguucugcccauguauuccagaacuuaaauuauaauaauaauaauaauaauaauagacugaaacuggccaggugggguggcuuaugcuuguaauuccagcauuuugggaggcugaggcaggagaauugcuugaagccaggaguuggagaccagucugggaaguauagugagaccuugucccuauuuaaaaaaaaaaaaaaaaaagacugccuaacuugugggagacagagcaagaugccuucaggaggaaucucuggccgucuucuuugguaauauccaaagagcuuuggucagcguugauaucaaagcggugugaagaaaacauaaggccauaagacuaaucucuggagagcugcacacugaaggggaaccuaaguucuugagucccuggaguaccccaagugugguuucagagagggugccauucaugagcaacacugcuagccauuaguggccagcaagaaggggagugaaaggaguaucuuguagauggugacuuggguaauaugaaauugcugucaucaagguuuaucaaaaaaccaaagguuaaauauuacauguaggcaaugugaggcugccccaaaugguguguuucccaggaacuugauucaacucugagaauaaaugcaugaguacugagaaaacuguuuggguggaaaauauuuauuuauuauuuuauuuuguucccucagcugugaucugcuuauuugagcuuguuagaaauauguaaccuaggcugagcgcgguggcucacgccuguaaucccagcacuuucggaggccgagguggguggaucaccugaggucaggaguucgagacaagccuggccaacguagugaaaccuugucucuacuaaaaauguaaaaauuagcugggcgugguggcgggcgccuguaaucccagcuacucaggaggcugaggcaggaaaauuacuugaacccaggagguggagguugcagugagucgagaucgugccauugcacuccagagcaagacucugucucaaaacaaaaaacaaaacaaaaaaaaaccggcgcaguggcucacgccuguaaucccaacacuuugggaggcagaggcaggcggaucacgagaucaggaaauggagaccauccuggguaacauggugaaacccugucucuacuaaaaauacaaaaaaauuagccgggcuugguggcaggcaccuguagucccagcuacucgggaggcugaggcaggagaauggugugaaccugggaggcggaccuugcagugagcagagaucgccccacugcacuccagccugggcgacagagugagacuccaucuccaaaaaaaaaaaaaaagaaauaugcagccaacauauauagccuucugcaacuauauauuuguuuacaaaagagaaaaauacuguugaaauuguuuugacccagguucuuuuaaaaucgcuuuauagucacaaaaugauuguccuagaggauaccagccuccauaacuguggcuacuacccuuaagacucaguaacauuaacucucagcucugagacuuuuuacuacguuuuuuuuuaaaggaugugggugcaguggacaucccuuaacuacaucuuuaguguggcuugcuaaucaccacagagacuuuaguguugguaccugaaacaucuggaaaauaaaucaacaaauuaauccaacaggacuggguuuucauguuuacuucaaauugcuuuuuuuuuuuuuuuuuuuuacauccuuuuccauuauugaaauaugguagaugcuuugguccuauuuauugaauuuucuuucaaccuucagacacuucucgagaaaaccaaaccaaccaugauaauacauuacuauuuugccuuuugcagaagucgucuagcugagcuugaaaguaacaucaaauuugggagugcugugcugaaacauaucuagguaucaggaaaagugauuuuccaaaggcuuguaaaaagucauaggauucuaugacugcuuccucaagaguguaacaauagcuuaucaagagaggcugugcagcauaguggugaagauuauggacucucgagugcagggucauaucucagucccaccacuuaccaguuugcaugacugagaaaauugcccauuuucuuggggccucauuuuucuuaucucugaagcaaggauggugacauuguacuuggcuuaaaggcuuggaauuaauuuaauaugggugaagcacuuagagccaggaauauugugcaugcucaguaaauucauauuacuuacaaaauuaauuccuaacaccuuccuugccauuuugcuggacugugguaucuaagauuguuacuaagugucucaaccacguguacugagggaacauuaucauauuuggaagaaagucaucuuuaugugaauucccaagugacaguguagggacccauuaaguuguuaagcguuuuaaggcaugaagcuggccagcuuugaggugucagugacuuguaagggcacuaacaagucugucaguugggagcauaguucccagcugcaaguucucaccuugacaaaguuauaauuguauuagcaagggaagaccccuccuuucugagaacguaggaaauacuguaaaccugaaaaacucuguugcuauaacuucuguaauuuucuuaaaugaauucuuaaacaugauguauaaaaugacaagauuuaaucagcucaauaacauauaaauccuugaucgugaaaauauguauaauugguuauuaaucagcuuuuuguucucuagauuaauuguaauuucaagacauguaggauuuagaaaauggaguagcccuuucuuugagugaguaaguucuuagaagacaaagauuuuuuaaaaaacaugcuuuccuauaggguugcaugagcuuuagacguaauaaaugcucaauaaauguugauuugauuuaguuuuaaucuuccuguuuuacaugugaccuagguaggaaacagaguccacagccaagaagccucaaauaaaacuccccuaacuuuuuggaaggcagccucaguccucagauggaagguaaaauccauaccuccaauuagguuuugcuuggauucaaacauuugcuaggaauaaaaacagcacauuuacgacaggcuagguaucacagaaagugccaguaguugauguaaccucuuuuaugugugaggagaccagaucuuaguauaacuaauaagcugcaauuuacugaucauuguggcuugccuauauauguaguuuuuuucucccacaaaugaggaaaacaucccugcagagauugaggaauaucuccuaucuuccaguucuuaaauccuuccccuuuccugauauguguucaggaaaauuuagggauaguuucaagggcaggaaaagcccauaacucauagaugacuaugccacaauacuguucagagacuguuucaaacugaauaaugguaguaauuguggacacuugucuuugagaguuuauggaacuccuaaaugucauagauuuuauaguacugugcuucucagaguucaaugaguauaugaaucaccuuugaauuuuguuaaaaugcagauucugggcugggcaugguggcucaugccuguaaucccagcauuuugggaggcugagguggguggauuaugaggucaggaguucgagaccagccuggccaacauagugaaaccccaucucuacuaaaaauacaaaaaauuagcugggcaugguaaugugugccuguaauuccagcuacucgggaggcuaaggcaggagaaucaugugaacccaggagguggagguuugcagugagcugagaucgugccauuucacuccagccugggagacagagcgagacuccgucuuaaaaaauaauaauacauuaaaaauauaaaaaugcagauucugauucaggaaaucugggaugggaccuaaaacugcauuucuuauaggccucucauguuagagcugcugcucugcagccuuacuuuaaguaacaaggcacuaaaacacagguucuaacucaacugcacacuaaauugccagaaggcacuaaaaaagagucccccuacuaaauaaacuauauuuaaacaaacauuuguuuucuuacuugaauuaaucaaaacacacgaaguugcuaauucgacuuccugaucacugugggcucacuggugcuggcacacugaguuggcauaagcuccaggaaggcccagagcggaguccuucacacacuucucauggucaaauaugugguuuccuuuggauuuuuugaaauguuggaaauuguucauugauccucacuugcuccauuuguggaucuggaucagaguccacugauuguguaaugagagaaccccagauuaugcaaucugggggcagaucucaccugcaaacacauguguaaaaggaaaucuuagcagcugcaacuguagcagaguucuucacaguucucugcuucagaaauuaucuuuuggcugcauugguuuuggcugccuuucugcucaaacaagcaaacacuccccuugauccauccagcaucaugacuugauaugcaugagaacuaggagcuuguguuagguagagugaaggauaagcuaucagagaaggcuucugagaagagcugcauuuguuagaguuuagauaaugguaaggggucuucagcuggagcagagggaaaggggcauucuaaugaagagaaaauacugucugcaaagguugguggcauuagagaacuguggggcuggaggguguucaugggaaagcggggaggggacagagagagguuugguggaugauaaggcuacugaaguugguccaaauugggaaggguguuagauauccuguaagaaacugucuccaggccaggcaugguggcucacacuuuguaaucucagcacuucgggaggccaaggcagguggaucaccugaguccaggaguuugagaucagccuaggcaacaugguaaaaccuagucuuuacaaaaaauuagccaggugugguguugugugccuguagccccagcuacucaggaggcugagguaggaggauugcuugagcccuggagaccgaggcugcagucaacugaaauugcagcacugcacuucagccugggcaacagaaugagaccuuuucucaaaaaacaaacaggcaguuagaaaaaucuacccccuucccccucccccucucccucccccucucccucccucccccucuccccacggucucccucucccucucuuuccacggucucccucugaugccgagccgaagcuggacgguacugcugccaucucggcucacugcaaccucccugccugauucuccugccucagccugccgagugccugcgauugcaggcgcgcgccgccacgccugacugguuuucguauuuuuuugguggagacgggguuucgcuguguuggccgggcuggucuccagcuccuaaccucgagugauccgccagccucggccucccgaggugccgggauugcagacggagucuccuucacucagugcucaauggugcccaggcuggagugcaguggugugaucucggcucgcuacaaccuccaccucccagcagccugccuuggccucccaaagugccgagauugcagccucugcccggccgccaccccgucugggaagugaggagcgucucugccaggccgcccaucgucugggaugugaggagcccuucugccuggcugcccagucuggaaagugaggagcgucucugccuggccgccaucccaucugggaagugaggagcgucucugcccggccgcccaucgucugagauguggggagcaccucugcccugccgccccguccgggaugugaggagcgucucugcccggccgccccgucugagaagugaggagccccuccgcccggcagccgccccgucugagaagugaggagccccuccgcccagcagccaccccgucugggaagugaggagcgucucugcccggcagccaccucgucugggagggaggugggggggucaggcccccgcccggccagccgcccuguccgggaggugaggggcaccucugcccggccgccccuacugggaagugaggagccccucugccuggccaccaccccgucugggagguguacccaacagcucauugagaacgggccaugaugacaauggcgguuuuguggaauagaaaggggggaaagguggggaaaagauugagaaaucggaugguugcugugucuguguagaaagagguagacaugggagacuuuucauuuuguucuguacuaagaaaaauucuucugccuugggauccuguugaucugugaccuuacccccaacccugugcucucugaaacaugugcuguauccacucaggguugaauggauuaagggcggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccugugacccugccaaaucccccucugugagaaacacccaagaaugaucaauuaaaacaaacaaacaaacaaaaaaacccacaaauauuuauguugaaacuuaaacccgauguggcaguauuaaaagguggagccuuuaagaggugauuggaucgugaaggaucugcccucaugaaugaaugcauucaagauuaacgaguuuauggguuaccaugggaggagaacugguggcuuuuaauuuaauuuaauuuuauuuuuuugagagggagucuugcucuguugcccaggcuggagugcaguggcacgaucucagcucacugcaaccucugccucccggguucaagugauucuccugccucagccucucaaguagcugggauuacaggugcccaccaccaugucuggcuaauuuuuguauuuuugguagagacgggguuucaccauguuggccaggcuugucucgaacuccugaggucaggugauccgcccgccuuggccccccaaagugcugggauuacaggcaugagccaccacgcuuggccugaacugguggcuuuauaagaggaagagaccugcaguagcauguuugcaugcucagcucccucaccaugucacuuugggacucuagaguccccaccagcaagaaggcuuucaccagguguggccccuuaacuguggacuucccagccuccauaacuguaaggaauaaauuccuuuuuaaaauaaauuacccaguuucagguauucugcuauaggcagcaggaaauggauuaaggcacaugcauucuaaauauuuaaaaaugcauacuugggcugggcgcaguggcucaugccuguaaucccagcacuuugggaggccgaggcagguggaucacaaggucaggagaucgagaccauccuggccaacacggugaaaccccaucucuacuaaaaauacaaaaaauuagccgaguguggugacgggcgccuguagucccagcuacuugggaggcugaggcaggaaaauggugugaaccuugggggcagagcuugcagugagccaagauugugccacugcgcuucagccugggcaacagaucgagacuccaucucaaaaaaaaaaaaaugcauacuuaagagaaaaggauagaaaaaaacaggccuaagaagcugagugaggcugggcaugguggcucacgccuguaaucccagcacuuugggaggccgaggcugaggucaaggacuccagaccagccuggccaacauggagaaaccucgucucuacuaaaaauacaaaaaauuugccaggugugguggcacaugccuguaaucacagcuacuugggaggcuaaggcaggagaaucgcuugaacccagcaggcggagguugcagucagcugagauugugccauugcacucuggccuaggcaauaagagcgaaacuccgucucaaaaaaaaaaaaaaaaaaaaaaaaaaaaacaagaaaacugcguggacagcuuuaguaucaagagggcagaaguagaaccaauggaacagggcucuauuuuagcuucaugagagauagaaguuucuaauccucaucauuggccugcuguggaaggggcugccuuguaaugacaacagaugucccuggagacaugcaaacaagcuagucucgcuagaagaaagagcauucuugcauggagaaguggauuagaugacccuuaccuccuuccuggaacuaagacuugauuauaguuguuuuguuuuuagaauaauugugauucaguuuugugacuacaaaaacagguguguguucauuuuauaacguuuagacaauuuuuaaauacccagaagaaaauaacgucaucugacuguuccauucagagauaccuacugcuagcauuuugcuacagaggccccaucaaucuuuugaauacacauuucauucaauuuugaugaagugggauacuaacaaacauacuguauuguaccuguuuuuuuuuccuuuuaaaaauuauuguauuuuguaccugcuuuuuuauuaaucaaaaaacucugauacuaugaaugucuuccuugucauuaaguauuuuuuguaaaacaagagggugaaagcuuauucaguggagggggugguaguggugaugggaggaauuagagaucaguguuauaaauucagaaauaaagagaaguaucuaaagugagcucuucccacucccaucccucuacuuucaguaucucaagaaaucucugggauuuugguagcaauauguguggagaacaagccaggaaaaggaucucuaguuuggaugauuggugauuggcucauaaauuaggggccaggaggaauggaguggguuggaauuggggccauucagaugaauucuggccuggucuggccuugggaccauuucucaggcugucucuuucucuucccuguuucccuuuccuuuugaaaggcaucacuacuccuucgcacucacugguguuugcuauucaacaaauuauuaauguggcugaucuuauuuuaagggguuuauugcugaucuucacaguuaaaaaacacacgguaaaauauggaauguuuuaguuuuguguuagccaagucccuccugaucugcuuauaggaagcucucuuugaauucugccuucugcuuuuauucccaaggaaggaacuaacuaaacacacuuuuccccuagucuuuuuuaauuccuuuuuuugugaaggagauacuaucuucuuccuguauggagaaaccaccccuuacagacccuagaggcagcuaagucucauugauagauaucucucagcaucuguuguaacugcauccagauggggaggaucuuauuguguagacacaaugagaaaauguucuauuuuggacaaccucccaagugccuuuucaugcccaggaaaguguuuuggggcaucuagaacaaauagucuuggaguuacagagagaaguuuagguuggaguuacacauuuagagaguuacugaugauauuguacaagacagcauuuagauugagaagagacaaguaagguuuguuagaacucuauccuggauccuggaugugugagcagaaagaauuguaaaauaagauugaguugcuugaagucugcagagagccuuucaugggagguggucacuggcaucauaaaggaagccgacuucucuugguguaagaagcuuggcagugauggcagaaggagacugggugguagcguuuacagagaagaaaccaauguauugggagaaaugccuugugcugggacuaggguagagaaaauagaugaugagccuggagcauccuguaguaacagaaaggaaagggugcucgaaacacaaaaggauggggcaugucaaaggggcaaggagccaaccugaaggggcucccaguggccaaggcuggaacaauuugauaacaaaaucaaucauguaguggcuuaugauacaaaguucaaaggaaauaccugugagagcaugcucauauaaauaaauaauugaaugaguaaauaaauggagaagaggcaaaucuuucuuagagaagaauuucaaauauguauagcuauuaccaccccuuuuccugugucugcuucauucucucccuccuuugaagggaaaacagccaaaaccagauagaggaacauucuacgggauagccagccuaaacuucucaaaacugucacgaaaaacaaggaaaaacugagaaauaaugcaguuuuaggauaccucggguugcaucuuggaccagaaagaugucauugauggaaaaagugguaaaaucaaaacaaagucuaaaguuuauuucauaguaauagaccaauguugauuucucaguuuuggcaaguggucaaugguaguguaagauauaaacaggaaacuggcuggguggggguauaauccuuugcaacuuuuuuguaaaucuaaaguuauucuaaaauaaaacauuuauuaaaaaauaaacucuguguguguguguguguguguguguguguguguguggcagaggaagugggggaacuugagcuuguuuguagacugauaauaaguaauugguauaauuguaggcuaauaucccugauugaucaggguauuaggguaaggaagggcauguuuuauuaaugcacaaauaggaggagauauggaaaacuguagaccagaucagguaaagaaaaaaacauugagugaagagguaaaguugagcaguaauuuguauacauuuuugcuuguauaccuccuacaagaauguugaaaaacuguaaaucuuuauucuugaaccaaacaguugaaucagauuuauuuuauuagagaaagucuaacuucugauggcccuauacaucucauuucauaauucuaauuuguauauagucaggcauaggcaccuugccgcaggcuuguuaccuggauguguuuaaugaggaucuaucuauuaauauugauuuaaccccggggacucuccuccuacagagaacuguuccuuugggggccucagagguauuacaccuggaguaaugcaccauuuuaauauugauuugggguggaugagaggacugcuuuccuuuuucuacuuuuuuuuuuuuuuuuuuuuuuuuuuuggugacggcgucucgcucugucaccaggcuggagugcaguggugcaaucucggcucacugcaaccucccccucccagguucaagcgauucuccuaccucagccucccgaguagcugggacuacaggcgcuugccuccacgccuggcuaauuuuuuguauuuuuaguagagacuggguuucaccguguuagccaggauggucuggaucuccugaccucgugauccacccgccucggccucccaaggugucgggauuacaggcgugagccaccgcgcccggcucgugcuuuucuuuuucaaguggagaaaaccaagugggaagugagagccugaauccugguuguaagaaagaggacauuuguauauuaaggaucuagaaauagauuugcccuuaggucgugagaaucuccagguaaccccaguuuaaagauaaaggcagagaaccuggaaagugugaaauaaggauaggagggcugcuuuguguugaagucacagcugaagggagagccgguuaauuuccaguggugcucauuagcaguccuccuugcugucugccuucuggguaaugccuguuuuuauucuccuccauuaucuccucccucuuccugugucugcuucacuugagauuuucaauggcaaccuugagcacccuucucuuggcaaagugauuuuagcaguguccugguuaaacaucauuccauugaaaugaaguagcaguucuuaggggauuugaccuaugugacguuuagaccaaaaaugcuacaaaggguagaauuguugaaugaccauugugguacaaaugcauacauugaaugagguauguuagaauucggaauaaggcaaccuguuuaaauuuuuucuuuucuuuuccuuuuuuuuuuuuuuucccagagacggucuugcucuguugcccaagcuggagugaaguggcucacuguaaucucaaauuccugggcccaggugaucccccugccuuagccuccugaguagcugggacuacaagugugagccaccaugcccagcuaauuacaaaaauuuuuuuaguggaggugagaucuuccuauguugcccagguuggucuucaacuccuggccucaagugauccucccaccucagucucucaaagugcugggauuacaggugugagccaccaggccuggucaacucuuaaguuguuaaaagggcaaugaaguuuuuuuuuuuuuuuuuuuuuuuugagauggugucucacuguguugcccaggcuggagugcaguggugcgaucucggcucacugcagucucugccucccagguucaaguaauucuucugcuucugccuccugaauagcugggacuacaggcacaugccagcaugccugagacaggguuucaccauguuggccaggcuggucucaaacuccugaccucaagugauccacuuacuucagccucccaaagugcugggauuacaggcaugagccaccgugcccagcugggcaauaaagauuaacgggcgauuuuacuccuuauuuguaggguaaauugggucuguuagcaggagccggguccagggauucuuaaccugaaaucugcggagccucacgugcuuccuaaguggguuucaggggaaucaaauugcauggaaguuuaacaaagguuguacuucaguguccucaaauuucaucagaaagccaaagaauucuuugccccucaaagguuaagaaugccuuuuuguucaguuucacugcugaugaagaugguggguuggauacaaugguguuuucaaaacacuuggaaauaauaaugcccauguugguauugcaguacuuuuuuagccacauacaguauccaagucacaaaucauuucuccuguacuuaguaauuuuagauguauuauaaucuaguaucaucccacuuguuucaaauuacucccaugaauuuacauuacaaaccauuuugagagcccagggaaucucagguguaauucuaaucugguauugauuccauauaucuuuggggguaaauauuugcuguauuaaaauuuuuuuuccauuuauucauuuauuugagacuaggccuugcccugucaccuaggcuggaguucagugguguucucauagcucacugcagccaugaaguccugggcucacgcaauccucuugccucagccucccaaguagcuagaacuauauauccagcuaauuuuuaaauuguuuuuuaauagagacaaggacuugcuauguugcccaggcuggugucaaauuccugcccucaagcgaucuuuuuaccuuggccucccaaagcacugggauuacaggcaugagccacuaugccuggucuguuuccucauauuuaaguggugucagaucaauuaacauaguucaaaaaguauaauuuuaauauuaucaauguuacauuucuagccugugcuaaauggacauauuaugaguaagugcuauuaugaaguauuuuuucagcaauuaugucugauacuaauuuguuuauagcauaaaugaucacagucaauauagauaaaacagcaagagaaaaauggggaaaaacagccaccaaaaaauuauugagaguagacuuuugccugguuuccuugaauauuuacuauugcaaaagaaaauaugcguacaaagguauuuuguuguccgauauagauuucuuacaaaugaaaauaaauguuggccaauuaugguccuuagaaugauucaaggauuauaaaucaagacugaaccaaaaacuucuuaaaauuauuuucuaaauaagcaugaucuagguaaauggcuuucaaaugaaagcagaccacaagcaucaccuggagaauuuauugaaaugcguauuccugggaccucaccccacaaggauucuauuucaguaguucugcaacuaggaucuggagucuguuuuuaacauaugccccaggugguuugaccacauuuugcuaaaacugaaucuaggugcuaagagguuacauggaauagcuguaauauauaacaccuuuaauuaaaagaaggcucgaugaguguggagaggugagggagacauggaaguauuuagcaaaugauauagaauaaguuugcaccucaauuacugugaaacccaaagagcuuuuguauauguacauuuuagauauuauuuacuacauuaaaaauuaaaauugagguauuuaaaauauuuauuuuuaaaacccauuacauauugaccuaaauaaaacuuuuauaaaaccaauuuuccaaaauuaaaaaaauuauugagaaagaauggcauuauuuuacauucaugcaaaucucuuuacugucuggcuuaauagaagacagcuagauucucauacagguuauccaaaaugcuugggaccagaauuguuuuggauuucagauuuuuucugauuuuggaauauuugcauuauauauucuuguuccagugagcauuuccuuugagcgucaugucaguacucaaaaaguuuuggauuuuggagcauuuuggauuucagauuuucagauuugggaugcccaacccaaacagauugaaucugauucucuauucaauuuguugcaauguuguuuugguugaagucuauaaagaaaauccaacuucacacagaaagaggaugaguauuuuuaauaccuucuuugauauuauaccaaaacucuguaaguguuaguuucuuaaagguuaauugcauuguggaaucugaaaugagcuuuuuaaaaaaacuaaaccuuugauacauuaaaaucaguuggucuguuuugcacuuuuuuucaguggaucuuucauccaugcaugauuuugguuuuuguuugagagagagucuuacucugucacccaggcuggggugcaguggcacaaucucagcucacugcaacuuccaccucccaaguaucugggaucagagaugcgugccacuaugcucagcuaauuuuuuguguuuuugguagaaauggggucucaccauguuguccaggcucugguaucaaacuccugagcuuaagcgaucugccugccuuagccucccaaagugcugggauuacaggcgugagccacugcaccuggccuacccauguaugauucuguuauaccauuggucauuucaaaacuaaggcagaucuucucauauaacuuucaucacugucacucugaucucaucaggaaagucuuuaaguauuggcgaagcuggcaagauuauguggcagaugcaaaaagucuuccaaaaugcuugaaagcucaaauuucaucauuggcaauaaguacugucaauuguuuuccucaaagaaacaggcucaacuuuguucauuuuuaaugucugccagauacccaagucagaauaacuacaguuugugaauuguucuuucaaguaaaaaugguaguccaugaaaaaaaagcuagcucagcuugcaacucaauuacacaagugcuuuucuucuagacagccauuguacuuaagugugcaguggacugcuuccuggguacuucccauuuuaucacaaagaacaucaaaaagacccaugcucaagggucaagauuuaaugaacguaauaauucugacugcuugcuucauuaacgacaaucauaaaggaaacgcuuaaaaaaaaauaacgugugguagugaagaaugcagugacuacuaguuucauuugcugucacugcuuugguuagugcgaaggcgccagcaguuuccccauaauugcuuuugcaccaucagugcaaaugucagcacagugaaaagacaaugucuuuguguuauucuaaaaauaguucugaccucugagagggucuuggggacucccaggaaucuaguaaacacacuuugagaacccuugauagaggugccuugggccucccucccagcauugucguuuuagugccaggcauuaacauguuuguauuucacgacgauuuaguaauacaaucuggacuaucucuuuaugagacgggcaauguugucaugauucuagguagaagaacggagaguccacagugcaggcaguuauucaguauucaucuaagagucuucagcuccuccggugugcuggucccuaugagaugcugaagcacaaccucccuccauccuugcucauccaaguauuuuccugcuuuugaggcacggcuuaaacgcuuuccaugguccucugaguaggaagugauuucguuugugcuucguauaggacuuacuauauugcaugcucaaguuuuuuguuugcuucuugucaaucccuucauugcuuaagaccaaaaugagguacuauuuuuccuguaaucuacguguaguccaaaaaaggcgggcuguuuuguaaauauuugucucuauguaaggaaaucaaaacugaaagcggaguaacaccaaguaugcccguuucuugagcucaagcacuggaaggaucaaaaguagcgaacgugguuuacugccgcggucuuguuccugcucacugccgccucugggggccccauauucaacaaauauucaaauuggagcuggaguucugagcggcuggguacuguguauuccagcggugggugucuguacguaguuagaaccuggcaagagagcacucucgaggagcccgcaggcggggcucggccggggaccagcagggcuugucggcgcccaggcucugcccccuacccgacccugccugccgcuugccgccugccuuuggcuagggccgccgagcgcccugcccauuuaaguaggcgggccguaccaccgcaacuuucuugacaggggguaucccggcggacucggacaacuucaagugagcccagaggcaauuucuuuuccuuucuaacuguggcccgcguugugcuguugcugggcaggcguugggcgccggcggucuucgagcgugggggcccgcuggcuuucccuucucagaaacugcgccgggggcgcucgcuugccccggauucggacgcggcgcuccccgggcucgucugaagugcagaucgccgcagaggccccagugcccggauguccaucaggauuagcgcgagccaauacgggccgagcccggggcugcgccgaggacgcccggggcucgagagcagguagucccguaacaucggggcgccgcgccgggacgcguccccgcccggcuccgccaaauggugagcgcggcgcuggcagcagggcccgcggggugaaggcgcucauggacggaagaccccuggcucuauaagcugaauuauggcagcccagucaagguaagccgugcaccggagaaacuuuucaaacgcguucguggcgaggggagcugaagguugcgggggagggcagggugcggggaaggagacggacaggaagcagcuuugucauugccuucucaucauucccgaggcuguggcuugacuaaaugucagauaaaaagcaguuuggagaacaugcuggacaauuucugcacagcggagagagggauggaguuaaagugaagauuaaaguuagauagcccccuucuucccccagaacuguuauuuuccgggacauuaaguugauuucacuuguccgcccuugcccaaauuuccauuuagauucuuugugcgccuaccccucgguuuucuggauuucuugcuguugucucgaggggaaguuuagaaauacgauuaauguaaaacauaguucaccuuggagagggugggugagaauuugccuggugagugaaaauuuuacugcuagaauguacgauuccacauaaaacggccccgcuuacgugaaucugcugaguaggcaaagaccgggaacgcgccgggguggugaaggggagagaggauaaugaacugcaguugcugucagaggagcgcuauuguaagaaccugaagccccgucuuuccaugguuuguuacuguuuuuguaaugagcguugaagaagagugaugacaaggcauuagugauuauuaugagauccaaacuguucugugcgauuuuauuuuaguuuugacagcaguuggugcuaagggagacuuaggaguuauauauacauucucuuucaacuguguuuugcuagaaagcaguuuggucucacauauuuaaaguaguaggguucuucaagcugauauuugauguagaacagugauuuugggaggucucagaagacuuaacacgucugaagacucagaucauggagagaaauggauguuaaauguucauguuugggcuggaugagacaauguuuuuuuccuacgaaauagaacuuucuaggaaggaaagagcuucucuguauaaaguaccuccuaugugcuaccugcuuuuuauauuucuucuucucaacacagugguuuauccucugcuuccauuuuauugaguuuuaagaaagugguucuuaaucuggggccaaguaguagaacuuggaugagaaacacaaguugugucucuauuuuuguuaaccucuagcugaaauuuaguguuuuuuuuuuuuuuaaguaggacuagagauaaaacuauaguaccaguccuugugauguuaucacaauagaaacuauaugucuuuucauaaucuuaauacaauuguugcagaugucuucaaacaccuuuugugcucuccacucaggaaauuaaggaacugcuuuaucuugcuuaauucaguaguaaagaaaaacacuacuguaccauugauuucuuuuaaauauuuuaauaggugcuugucuauauaaucugguaccuuuguauucuuauguauuuuauuuaauguauuuaaaaacauuuuucugauagugcuguuauugucagacugcuacagagguccauggcagaaaauuaagauuaagauaccuugaucuaagaaguuaguaaaugcugugugacagaucucaguaauauagcgcagggauuuguacccaggugugagagauucaaugccagcgcucuuaaacuaaugauaaaaauaaaaugagacacaagcuaaauuggacacugcugugugccaggcacagcauuaagcagcuuuaauuggauuagcucugacucuucucaggcaccuaaauggguaaguacuuuuauuauccacauuuguuaguugaggaaacugagguccagccuggcuguuucuugccugaggucacaaagguggagcaacgccugacuccagaucugcuuugcacacuuccucccuuaugcuuccucuuuaaugcugaggugagauguuaaagggagcugccaagccucaguauaacaguacaaagaaugauuccugcuaaaauugguuguuuguaauauguaauaauccugaguuaucaguguggugguucaacuugccagcaauuaaaauaggagaauugugcuuauuucugauccucuaccccaccuuccgacaugcccuggaacuaggaacaaagccacaagacuguuaugucuguuguuuucuuagucuguguguugggaguauaucucacauuuuguaaaugugcauuuucuuugguuacaccuggaaugugguccaagcucauucagauaauugugcucugugggagagaagguaaucuuugagauccaaagagaauauauggagaagauucaagauauuuugggauuucagggaaacucuaaagcugggccacguugcccugaguaaugcuaagagaaaccaaaacaucaccugugauguaaaaucucagguagugaaaucuugaccauguacuacuacacauuaguguuuguuugcucuugagacaauuaauuuagaccgacagacucauuguacuuacagauuuguagcucaguguuuaagcacaccaguuucuuuguucauuguuuaguuugauuccugauuuguuauugaugggugauauaugacuaauuuuuuaugcaaauggauuaggcgguguauucccaucccuguaguucacuccuuaagacaagauacugucucccacauuuuagucuccccuacauaagcuagaaguacuuugaauugagagauuaccuaaguauuucuuggcuuguggacuuuuauaaauuaaggcuguguuaaaaccuaagaguaggaaauuuguuuuguggcugauuucuucucuuaaagcuggaagacauuucuugacuaaaaugcaauuaaaugcuuuuaaaauuuagauuuuugggggucauauuuugaaaacaauaaguauuugguuuauuguauuccuagaguugagaaagguggucacugagaaaugucuugucaaagcggauuguaugcugugucugggcucucagauaagugugugcuuucuuuggaaccuauaaacauaacagacacauugaauauauacuuccuuguggaaauugcaacaaacuugcuuucuuugaugugaaauaguuacagaacauggcuuuaguuacuggacucugauggaaagugcauccagacuauuuuauagaaguauaaaaacuagcaacuaguaaaccuaacaguuuauagacauauuuuuuuccugcaagaauuaacagugcuuuauacugaggagugguguugauggauacaguaaaaaggaggacuuugccugauucccaccuccgcuaacccucucauugaagcagaucccugaauucuagaaaggaaaauauacauaccuucaaauacuaucagggauuagccaguuuaaaaaaaucaccugggccgggugugguggcucacgccuguaaucccagcacuuuugggaggccgaggcaggcggaucacgagguuaggagauccagaccacugugaaaccccaucucuacuaaaaauacaaaaaaaaaucagccgggugcgguggcgggcgccuguagucccagcuacgcgggaggcggaggcaggagaauggcgugaaccugggagguggagcuugcagugagcugagaucgcaccacugcacuccagccugggugacagagugagacuccgucucaaaaaaaaaaaaaaaaaaagaaaaaaaaaaucaccugaugccaccugagaaccccuggcccuucuccacccuggggcagggguguaugcaugggaguaggggaguugaacuugcuucuuugggagaguugaaucugguggcugagcacggagcuucucaaaagaaaggauuuauagacaaacugcaguaggaaaguauguucagucaacucucccacaguuuuuaacuuuugaauuugucuaaaauuaaugaagcuuugaaaaaucaauaaagaagcaaagucagauugugcccaagauuuauaugaagcugguuuuugguggaucucuuugacucuagggagggaaaguuuuccauugcaaaaagcaaugcucuuaaacugguauagauccaguuuugcccugcccuaugccccgucucugauuuuugagcuagugauuaccuuggaagaaaauucaugaaugcaaagcagcuuugauuaaaaaugagccauuaucaaagagaauacugugguuuuggaaaguacaguucaaagaagagauuuugggauggaaauaauuuauguaguauuuugauccauugaauauucucacuuuuuccuucuugugacaccauuguaaacaguguccuugacagaagagaaacacaaacaggucucuuaagugauuucuuucuaguucauccugagagcccaguugagcuuccugacucacagucuagagcugcuuccaugauaaagacugaaggagcggugagucauuuuuuaaagucagcugauuuauggggauguuguuguuuuggcaaaacuaacucaagugaucucucgagauuuugcuggauuuuauaccauaccgugaaaagauauuccauagcuggauuuacacucuugaaaaugggguuuuugugcgugcugcaucuaaaaauuuuaaauuucaauuacauucaggaauaaaauauuauggaugagagagaaaucuacuuuuucaucuugguucugucauuuauuucuugugagccuccaaaucuauuuuuuacauaauaccuguaagagagaggaguuauaaagcugguuuguuaacuguugcuuugagguauauauaaacuuaguuuucuguuagcaaacuucuccauuucauuucuuguuuuuuuuuuuuuuuguauaacuauacauauuuuaguagagaugggguuuucaacaucuuggccaggcuggucucgaacuccugacaucagguuucuuuuccaagauaggcaaauaaacuuauucuaauucuguaugugagauauaguggaaauacaauaugcaccucuaggacaaaguuucuuggagacaugcuucuuggcucagaaauagaaacauauagugaggcuaaguauaaucucuuuguugugguugguucaguuacguuuuauugauauagagugaguacauaacuuuuacggguuaaaugauuaccaaucguuuuuacuuaaauguaaaaacugggggagcugaaguaguauuuucugucuccuucagaugguccucaauucauuuuauuaugaauauaaaguguucauuugcucauuugcucaaaauaacacagcagguagaaugcacagugucuugcucaaguacaaauguaucagaugaacuuuagauuuacacuucaggagaaaauauguauaacuuuuggugcuaaugccccagggaacuaaaaguaaagauuaacuuuaaaaccaugcaaauugcugacuuucugugucuuggcagugaucaguguugagaaucccuccccugugcaaacuuuuuccuuuucuuaucuguucacagugaguuaaagcuuaaccugauggccacagagccaacagaccuggcaucuugaaagucuuguucucugcugaaugucuguuuucuuguguuaguuuauuggcuuuguuuuuaauuuaaccagauugaacugcuaucaaguucuuuuuuuuuuuuuuuuuuuuuuuuuugggagacggaguuucgcucuuguugcccaggcuggagugcaauggugcgaucucggcucacagcaaccucugccuccuggguucaagccauucugccucagccuccggaguagcugggaauacaggcaugcuccaccaagcccggcuaauuuuguauuuuuaguagagaugggguuucuccauguuggucaggauggucucgaacuccagaccucaggugauccucccgccucggccucccaaagugcugggauuacaggcgugagccacccuguccggcugaacugcuaucaaguucuuaaggcuauugcugggagcaguaauuuggugacagauuuaauauauuaagagaaaaucccagggguaaacaucuuaucuaaaggaacucaagcagacaaaggguaaaauauuuuuauugacaccuagauugucuuuauuucgguauguuuucaaagggcacucacuguuugacugcauucuaaaaaguaccaagaauuguuuuuccuccgugguggcucauaugggugagggcuuggagaccugcaggccacaugauccuuuauuuuggugggcuggggaagaguuaaggcugugaugaagaucuuaccuuuuuuuuuuuuuuuuuuaaguauugcuuacugcuggauuggcaacuaaacaaauaaaaaguaaaaggcuauuuuaggggcaauauggucauaugagguucaggguucucaaacuugauuagacacaaaaaucaccgugggugcuuguuaguaugcagauucugcucccccucccccagagauucugaauggacagguucuggguggagcucugcugucuguaaggccaggggcgcagguaccaugcuuugugagauggugcaugugugagugagagagaucauauaaaccauguuguaugaugcuauuaaauuuugauaucauauaugcuuauaaauacacauuuuuccccuccuauugaaacagacuggagguugguagagaagguggauaucuacguccauaaaauuuauccuuauauuacaaacuguugguugaaauauccaaaugcgucuguguuaaaaaaaaaauuaaaagauaccaagaagcaauucccaguguuugaucauacagcaccuucccaagaauuguuucuucucaaggagcaggguauuuaauuuacuuuuuuccaugcguugugggcucccuccccaguuagaguuaacugcuaaguaucucucucucuaccacacacagcccaguuuaccagguggcaguuguuuuuguucccagggaaaaguuaaaauggugugaauuggucaguuuuguccaaacuuugugaaaccgaaaugaaaguuuuguuuuuuaagaaaagcuuugccuagggguacugcugaacaaauaauguucaacaagacauuuuaaauggaacuccuacugggaaguaaauguuaaaauuauagcagaugucacuuccuguaacaaaauucaggaaacagucuuugguauguggguguuguaacuuuucaauuuuuggaacuuuccuucaggaaacuguccugucagaagcaaagcagucaauaaaauaugaagcacaacuuaaacuauguuauacaguguaauuaaauuuugauuuggugcauauguuuuuguggucaagacagacccaagauuaucacgugacuuucauccuggauaauguaagucuggauaacuuguuaaauugcuucucccccacuucucccauucugguuacuuuaaaaauacagguguaucugauuuacucuggacuugaauuuauggaaagugguauaaaauuaauuaguucucauuguuuuguacaaaacuaugaaaccuguuuccucccuagcuuugcagaaauuuugucucaauugacaaacugucuaccuuagacauuucuaagauggccuauuuaguaaguugguagcuuugagcuuugauaaaaguuugaguccaugauauuaugguuuaagaaaauuuuuccuuaaaggaaaacagaacguguuauugaguuaauauugcuggguuuuaguuguuguuuauuugcugaaaggauagucauugguauaaaguaagcuaaagcucuguccuuuuauauuuuuucagguaauuuugaccuagcaauuacagcuauaggaauguuuuccuguuacucauuuacagucugugucucccucuccccuccagccuccuuuuagaguuaagacggugcuaacucuccauuuaaaaaaguguguaaaaaauaaacuuuguaccacaggggaaaaauuaggcaguaacauuuacuggcauuagaauagcaaaaggauaaaaugaaaccuaguguauuaccuuaauacauaauugagguuuugcaaccuaaaaauauuggaaagaauuauuaauguuguucagauugucugcuuaucuugugacuugguuuuaguaaaauucaaagugccacuggaacuuaguuuuuguuuuuaaaugggaacuaugcccagaagaugaaaaguccuagguuggcaguuagauugaauuugauaauucugucacugcugauggugugaguuuuuuauuuguucuuacccuuagggcagggaggggccuccucuuaaaaacaccuucauuucuuucuuauuuuagcagucauguuucuuuaaggguaaaguaaaaaucauuagguuuacuuaauucugaguuuaaauuuguaggcuuuauaaaaauucuugacaguuuaugauaagccuagcauaaaacuucguuuucucucugaggucacucguauucuguguugacauccuuaaaguauugguauuauccaugaucuuagaguguuuuaaagaaugaagaagucgggcguggucgcucaugccuguaaucccagcacucugggaggcccaggcaggcggaucaccugaggucaggaguuugagagcagccuggucaacauggugaaaccucgucucuacuaaaaauacaaacauuagcugggcguaguggcaggugccuguaaucccagcuacucgggaggcugaggcaggagaauugcuugaacucgggagguggagguugcaguuagccaagaucaugccguugcacuccagccugggcgaucuuuugguagcuugguguaaaugaccuuuuguggggaaagagggaagaggggaauaguuaaauugaaucgagguacguuccuugucacccagaucuuuuauaucuuuuguuauaucucauuuuauggguauuucuucccagcccaaguuuuuguaaaagugauuuuauucgaggucaggagaucaagaccauccugacuaacacagugaaaccccgucucuacugaaaauacaaaaaaauuagccagacgugguggcgggcgccuguagucccagcuacucgggagacugaggcaggagaauggcauaaaccugggagggcggagcuugcagugagcggagauugcgccacugcacuccagccugggugacagagucagacucugucucaaaaaaaaaaaaaaagugauuuuauugaagucuauuuuauauaucauaaaauucacucaugucaagugacaacucaguaauguuuaguuacuuuacugaauggagcgaccaguuuuagaacauuuuaucccauaccugguaagaucccuccugcccauuuacaguuaaucccgguccccagccccaccaccauaaccuacuuucugucucuguaaauaugccuuuucugggcauuucacauaguggaaucauaaauggaguaugaugguuucuugcaucugacucucuuuacuugcauauguauauauauuuuaaauuuaccagccucagcacauucuggccauacuugaauaauuuuuugagguucaucugugguguaccauguaucagugguucuauccuuuuauuacugaauaguauucuguuaauagaugugauggacagguugucccaauuuuuuaaaaaauugugaauaauguugcugugaacauuuacauacaagacuuuggacauauauauauguguguguguguauguguauauauauguguuuuuuuuuuuuuuuuuuuugguuggauagcugaagguggaauuucuggguccuaugauaguuuuuuguuugacuuuuugagaaaaugccaaacaguuuuucaaacuauaugccuagccuaacuuugaacugaucuaauuuagucaauuucuugcaaauuguuugcuaucuucauaguuauuugggcuaugaaaguagugguucugagaucugaucaauuuugcauuugauuauuagaaaauuauauauuguuuucaauuuauaugugaucuuaaaacaccgcucauuuucccccauauacaguucuuuauuguauuuuguaaauugggcuuuucgaugaagaaauucauaucgaggaauguuuaaagaaagccaaauuaaguuuaaaaugccaaugcaugcugauuauugucaaaguaguaaagaaaacuccaacuccacaacucauaaaccccucaaauagcagaauuuaaauauauuauuuguuaaguagaaauccuuuauuuuauaauugcaaaauggcccuauaaauuguuauuucaaugugcauuuuaaauaaaagcguucgggcaaaaaugcgcuguucucauucacuagagccucacaugcaaagauaaguuaucuaagugaagcgucuggaaauuaucguucagacuuggguccugccuggggaagguggugacuaugugcccucccuugaugguguacuccgacuucaguuaaagauagaucuguugcacaaacaaaaauguuucaugaaaugcucugaaaguaucuuuaggggcaugugugacguuagugaaaaugaaucaucuuuuuagcauucagucguucuauuuaaaaaaaaaaaagcugugaggcucuggcuagaagaugucuucauuucuuccuuuaugagccuuucaaguguucuuucaacuuggagagccucaaugcauuguggcaaguuacugaaaucugcugcucugcauauuaauuuaccugcguaagaauuauaucaguaucaacagcuuuaugaauguggccaauucacacgcauuaaguguuuuucauguuaucuguaaauguauugaguacuucauuguucacuaagagccaaccauuggugugugcagggcucugaguugguuuagauaaauacacugucucccucccuacaaggagcucauaguuuggugggagagacagaaauaagcaaacaaacugacaaauaaaacaagugcaaauuguggaaacacaguggcaaaaaacaggauacugugagggaauaauaggggguggggaauuggucuugguguggggccaggagaaccucugaggaggguuaccugaggcagagaaagagcaagccaugacacagagaaagguaauuguccuucuagaauguacauggaaguaaguggugaugguggugagaaggauggcuuuuuuugagacagaauuuugcuguguuggccacgcuggagugcaguggcaccaucauggcucacugcaaccuccaaggauggcauuuuuaaacagggauaaaaauguuaggaaaugaccgucauguggcaguuucuugaaauaaaaauuugauuguuuuagugguuuguaguucuaccaaaacuuagcccuguuuuuaauuuauuuuaauaaaggcaaagugaguaccauaacaaccuagcuaugaacuuuaaaauagagacuauaguuucuaaaacuuaggcuuaauuggcacauaaauguaaacacauuaaacaaguguugaaaagaaauucgagaggacauuuuucuuugggagccaucaaauaagggaugugguagaauuuagaaaggcccccaggucagugagguacaguuauaaggaagugaagauuuagacaguaaggagggcauuccaccuggcuauuaaauauaaagguuaauuuacaaaacaaccuuuuguaugugugaaggacuguuaugggaaguggggugaaagauggucucuaucucugccaaaaauagaucuugaagagauaaauagcaaagcccaugaaggaaaacacagaagugguguucuuuuuuauauauuuagcaauaggaaauaaucuucugccuuggauaguuuaggaaguagcagaugguuuaaguaccagugauauuaugauuauauauugguuuucguccaugguuccuggcccauaacucccacaguccuuguuagucuuuuguuauaaugguggggcacuuuaggccucaggagacagaaucucucugugaccuucucuuaucuuccuuucacuugcccaaggcaggacucuaaucuaauuguaagucuaaagacuuuuauuccagagaguuccugccccauacucuggaggaaggaaugcuguacagagaggccaagaaaaaucugaacugaaggguguugguugauuuagaucauacccuuuuuguccagucacauuucuacaugguugucaaucuugccuacacuaugaagucuucauaaaaggcccaagaggacugggucuccagagagcuucuggauagcugagcauguggagguuuagggagaguggugugcccagggagggcauggaagcaccacgccccuucccccauaucucaccuuacacaucucuucaucugugugcuuuguaauguccuuuacaauaaaccguuaaacguuaaguagguguuuccuugaguucugugagccacuccagcaaauuaauugaaaccgugggaucccaacuugaaaccagucuaucagaaguucuggagguccagaccugugacuggugucugaaggggucgggggggggcagucuuggggacugagcccucaaccugugggaucugacuccaucuccagguaguuguguagauaguaggaaaaucuccuccucccacguuugaucacagaagucuucuguguugacgauuguugugugagagcagaggaaaaacacagaauuuuuugaaaacagcaccuuuuucucaagggauucuguggcuucuugaaaaaaugugaucacaauaaacuacuguaggaacugaaaguuuuuguccuuuguguaucacagcuauauuuaauuacauaaaguugcuucaaagaucugcauucauuaucaccucaucucuuuuguacuucucuucacaguuauuuucaaaugaauguauugaguuauagaccuuuguggcauaaugauugcuuuuaugaauguuucacgaccauguaagaaagaacguauuugcuuuauuuucagaguccagagauaaaugugguuuuguaucuuauuucuguauucuuauuuugucuguuugaucugccauggacuaagagaugaauaaaagccucauaugaguacacugcuaucuuaaguuucuuugcaaauguugaugccauguuuuuguuuuguuuuguuuuguuucagauggagucuugcucuguugcccaggcuggagugcaguggcgcaauuucggcucacuguaaccuccaccuccuggguucaagggauucuccugccucagccuccugaguagcugggacuacaggcacgugccaacauguccggcuaauuuuuuguauuuuuaguggagacaggguuucacuguguuagccaggauguucucagucuccugaccucaugauccgccugccucagccucucaaaaugcugggauuacaggcgggauuaccaugcccaguaaugccauguuuuugaugcacagguagucaucauuguuaacgucgucuuuucaaauuguccuguuuggcaauauuaguuuuuaauguauucuuccagaagguuucuuugaguauaggugauauuucuuaaaaagauguguaucuuuuaauauauucugcaugcggauuuuauuuugguuuaaggagugauggaagauuucugaacccuuccucucuuccccaagacucaccauucuguucucuauauuuaagcgccaucaucaaauucacuguaccuuuguaugcguuuuaauauaugaucgggcugauugcccuucuuuacccuucugaggugcacucucagaauuuuuguggcuguuuucucauguaauuuuucugagucuucugucaaacaacuuggggccuuguaauaggaugacuuccuaacaaauuuguaaaaccucauccuguuuuucagaaguacuaaaguuuuaaauggauuaccguguucuuuguagauuuucauggaaugggaaaggcuaaaguagagggccagggacuccugagucacucaccagacaccacucauuuaucuuggagacauuagggaaauccuguuugccucaguuuauccagaaguaaaaauguacauuugcucuugucauaaaugaauguauuuuuaauguaacucuguaagaguggaaucauauuucuauaggugauuuacaucuggcuuuaggcagaagcaguguuucacaguaucauuguuucuguggauaguaucccacuuucuggcagacuugauugaaucaguaugccuuggaaauaauagauguaauuuaggcucuuuagaaucuuuuuuuguaguucaguaaaacaaaacuaauuguaaguuaauuguaauuaaaagagaaaugucuuccugaaucucaguaauuugucuaaacauuuucuuuuuguucccuuucaaucuuuuauuuaugcauuaaauuuuuucacauuguugacuuauucuuuauguguguuugauaagugauuuagucaacacauaggggaaaaagggguugggauuacuuuagacuguuaugauuuuugagauugucauuuugaagaggaacagauaaaucuuucacaucuuuaugcuuagaaaugccaugcuagggcgggcgcaguggcacgcgccuguaaucucagcacuuugggaggccgaggccagcggaucaccugaggucaggaguuugagaccagccuagcugacauggugaaacuccaucucuacuaaaaauacaaaaaaauuagccaggcgugguggcgggugccuguaaucccagcuacuugggagacugaggugggagaaugucuugaaccugggaggcagagguuucggugagccgagaucgugccacugcacucuggccugggcgugacacagcgagacuccaucucaaaaaaaaaaaaaaaaaaaaaaaugccaugcuaaaaacacuuuuaaaagucaaaaauagcccaguuaacauugacuaaagcaagguguuauuuuauacauugugcuaggagccaagguaguuaacagagauauuaacacacugacacuuagguuuaguagauguuccagucuguucaugaugcuggugauggaaaguauuacugaacaccauacuuaaaagcuuuacccauucauauuuauuuguaagacugugguagcugaagaaaaacuaguauagcccacaaaauccaaauaaaucaaggaccccucuacgauguuuucuucccgugcuuacagauauauauauauauauauauauauauauauauauauauaucuaucuauaucuaucuguguguauauauaucuguguguguauauauaugugcguguauauauguguguguauauauauguguguguauauauauguguguguauguauaucuguguguauauauauaucuguguguauauauguauauauaucuguguguguguauauauauauaauaucauguguguguauauauauacauaucacguguguguauauauaugcacacacacacacgaauguuagcaaagaacccaagcauugccucaauaaguaacguuagaaucauacauccaagccaaaaucuuuauuuauuuuauuuuuaauuuauuuauuuaauauagauggagucucuguugcccagacuggaguguaguggugugaucauagcuuaccgcagcauuagacuccuggacucaagugauccucuugccucacccucccgaguagcugggacuacaggcaggcacacaccaccaugcccagcuaauuuuuaauuuuuuuuuguagagauggggucuuucuuuguuguucaggcuggucuugaacucaggugauccuaccacuuuggguucucaaagugcugggauuaaagguguaagccacugugcccagcagacugaaaucauuuuauaacugugcuuuucaauguuaucuuaaaauuagcuggggaagaauucuguuuaguuuuuguuuuuuggugucagucucauuuaaaaauugacaaggaaaugaauggauuugugguaacugccuuuuaacuuuguaaauuuuaaccuaauguauguuuaaauuaucagaaauagaaaauucagauacuucuauacuuacugacuuauuauaaaaacugugccuaaacugaaggacagaaccacuuaaauuauucauuuauuugagaagaaauuuucuauuuuaauucaacaaugacuuuuuucacuauauuuucaugguugaacuggcuagaguggguaguuauuucaauagguguuggaaauuaaaaaaaguguagauaguuuccaguuuacugauuuucuuccaaaaauguguuugggacauagaaaauguuuugcagaagcagcaaggaaaaucaugugaugaagguuaggcccuaggcuagagccagaauguuucuuaacuugugccaaaauguccaacauuuggaauaauaauggcaaacggugcaaucacugaaauaaagcaugaaaaccaugcuuaaacaagaggguucguucuauacuuguguuagcuuuuagcuuuaggggguuuuguggauggagaaagaggagugguguaagggaucuuuaagauuacuuggaggagacuggaaaaaauggauucuuuggggcaggggcauuuccacugguaaaccugggcacuuuuaaggacagaggauuauguauaauuuugaucuaugguaauagcagucuuuuauuaagcaauuauuuauugagcauucuguuauguucugaucucugaaccaggaacuuugcaaaaugguaucauuuaaucugcaaggcagagcuuaucacugccauuauacagauaaacugaggcucauggcaagugacggcugauacacagcuucagaucuacuccagacuuacauguaaaugucuccuugcccuucauacauauauccauguggccagugacccaugauuuacugguggagcaaaggaaggcauagaaaauggaauauggguggggugucuguuuaucucuaaacugagcuauaacugaaacaaaaaaagaggaugagaguagggaaacaugguauguguaaaauuccucucagagugaagaaaugugaggucaguguuucccagcguuagccucugggaaguaagugccuuuucuccagcuugguuacugcauggggaauuuggagagagaugguaggguauuuguaacuuggggaacuccagcaauauuugggacaggggauguauguggauggaaccuuuuuguauaaaagaugugaaaucccuuuuacccuucauccuccuuuaggauccugcuuuuuuuugagucagagucuuguucugucuuccgaggcuggaguacaguggcgcuaucuguucacugcaaccucugccuccuggguucaagcaauucuccugccucagccuccugaggcugggauuacaggugcccaccaccacgccuggcuaauuuauuuauuuauuuuuuaguagagauggaguuucaccauguuggccaggcuggucucaagcuccuggacucaagugauccacccgccucggccucccaaaguguugggaucacaggcgugagccacugcgcccagccccgauccugaucccuauccugcuucuuuagaaaaaacugauguuuagaauaaaacauuuuuccaccccuucauuuuuagugugaaaugcaugcaucccuucaccucugcugugagauaccacauuuuaugccauccuugggauccccuuuuuucacaagguucucuuauccugcuccauaggcugccagcucuagugaccaucuauuguguuuaguauugaguuaucucccuuuuuagggaggaaagggauguaaugggagaggcauaggcagaaugcaggaaggggcaccaaagccugugcuccuuugccagcacuuggacuccagcuguguauauucauuaauaaugacucacaguuauugaacacuaggcacugggcucagcacuaugucugcauuaguuaauguaauuauuacaacagcccaaaacuuuuugguacaauucucaucucuauuuuagagaggacgaaacuaaggcuuagagaguguauggcuuguccuguuggcuguaccuggcagugacagcaucucagacgugccggucauaaauguagccauuggcaaagauuucccaugucaguuccuuccguccugcauuauugugguggcugcuaucccaguagagaaguaacacagugacuuugggaauauuucucauucucuacaggggugguucuccacaggggaggagauuuuacccuucccuaucccggggauauuuggcaaugucuggagacagauauggcugucacgccugggaggggggugugcuaccaucaucucagauagaggcuagggaugcugcuaacguccugcaauacacaggacagccccacccuaagaauuaccuggccccaagugucaauaguggagaacucucgcucugcagguuucgccuaguuccuaugcauggggauguuuguguuuccgagagcgucuguacauugucaucagacccuaaaucaugcuggccccaggugucaguuacuugaccuguauuugcuuaggacacaguaugugcaagacacuccugggugcucuguggguuacacagccuuacucuaccccucaccaccauguuuagugaguaaaugauuuacccaaagaaccacaguuaggaaguggcagagccuaggucugaauccuucacuaacuccagagaccaugcuuuuuuuuuuuuuuuuuugcgugguggugcaugccuguaaggcugaggcaggagaauugcuugaacccgggagguggagguugcagugagcugacaccaugccauugcacuccagccugggcaacaagagugaaacucugucucaaaauaaauaaauagguaaauaaauaaaauuaaaaauuugccaugcacacccagcuaauuuuuguacuuuuaguagagaugggguuuugccauguuggccaggcuggucuuugaacccuugacuucaagcgauccuccugccucggccucccaaauugcugggauuacaggugugagccaccaugcccugcugagaccauucccuguacucguuuacugugaugguaaccaaaauguuccaucguguggcauguugcugagccuccucucugccuccuucaguuucaacaaagucguggcaggagacugacaaacagcagucucuguguggggaccuugaguggccauccaguugcucuguaguaggaagugguagggaaguuggaggugaggagggcccguuaguagggaacugaggccagacuucuaaaagagcaaggaaagaauuucgaaugacaugguuccucagcaugucugcagggaggagguuuauugcagcagcauuuagaacuagcucagaggagaaauaaugggcgaagggagauugguacauauaagguaauaccuauuguauuacagauuuacuuauguaaaaugcuuuucuaaaaucugguucucucguauuuuauauaccagauguaacucaaacuagaugaaauagaaccauagacucaauccuuccuaaaagcucaaggcuuucuggcuugguaauuuuguggggaagcacuugcaggaaaaacacuuugaaauaugaagaaggaaaugugauuccggugguuucuuuauaggcccuaaaucaguacaggaagaaauaggacaagaaccagagaagauuaacuuucugaaacuuuacaaacagccuaauucccaaguagagaaaaguauauuuuaaagaaugaauacugggggaggaaaugagggaaggugaauuaagccuucacaguggcugcuaaggagauuacccugaaaacuucccaggugggaaucugaaacuuacuucuacaaauguaugcaugugucucuacuagauugcuuguaguuucccaguagagcaaaaagcagaagccagagaaagauuugaagguguuagguaagugcucuaguuuugcuuggcgugcaugcacggauacacauguaacaugcacacuucugcuauuucaguucugcugacagcugaugaaaucaugugucucacaaguuuaggaccacucuugaguuccuuuccuuccaaagauuugcuauaauauuucauagauaaauuugugcuuccaaauuacuccuuucugcuaaaaucugagauuuaaccagaagccuguaaauacccuagaggagagaggagagucuguuggaaaaauguggggcacacaacgauccuaccacaguguuuugaccaaauuuaauaguuuauucuugugguuauuuuuucuaacauuaugaacauuuucaaacauucagaaaaguuuaaugaauuucacaguaaaaagccuuauucucagauuauaaguacauauuaaauaguccuaauucaaaauccuaaacauuccaaaaucugaaacuuuuuguuguuguugcuguuggguuuuuuuuuuuuuuuuuuuuuuuugaggugagucucacugucgcccagacuggagugcaguggugugaucaaugcaguggcccauugcaaccucugccuccugggguucaagugauucuccugccucagccucccaaguaggugggauuacaggcgugcaccaccaggccuggcuacaaaaucugaaacuuuuugagugaugacaugacacucuaaggaagugcuuauuggagcauuuuauuuuucagauuuuaagauuaguagugcuaaaugccaguguuccaaaauccaaaaaaaagaaaaaaaauugaaacccaaaacacuuaaggucccaagcauuucagauaaagggauacccagucuguauuaacauuuuauuuuacuugcauuaccauauauucaucucuuuguugcuguguccauccauuaauguauuuuuauacuucuuauauaaguugugggagaguauacugucccguaaauagcuuguauaucauuaaaguucaguauuuuuuuuuacguuuuuuuuucuuuugguauaaaaugcagugaaaggcacaaauuuuaaguguacuggcccauuuugacagugcaugcaucuguguaacucauaccccuaguaagauuuggaacuauucuuaagguuauuuuuugguguguaucugggaagaugauuagaagaagaguaaacaaacacguaaccuguuuuauuuuucuuccucucagggugucauuucaauuuuuuaaaaccuguuggaugaguugugugugcuugauaauaccucauuuuguagagauuauuuaaauuccuugaggucucagaccaaagcucuuggauuaagguacguuuuucuucaccuagguugucucuugcugagaauuaaagauaaauuuuuuagaaccagcccuucucacacugaaggaaaguggagacucauguccauuuaagaccuccccauuuuuggguaacaguaaaaugcaugugacagaauauaacuauuacuaaaucauucccugccacucuaggagugcauuuauuagagaaaugcuaggacuauuggauuguguucuuccaguguuaugcuuuugaaguugugggaaggcaggcggauuguccccaaaggaggugcccuuaguugaugucugucauccuacacagguggggucuuuuauuucauggccagggcucucaaaggcuuccuuuuggccacaaugagagaaaucugggggugagugaguguccucccagguaaauuaauggugggucuguaaauaaccaggggccccagacugaaaucgggcagguuguaauuugucagauaccuggaugccuguuaccuguuucuuuuuauucuguuauccucuagcauuugguaaacuuugauauaaauauuguggccguuucugagcuacuuuauuguaagagaauaguugggaaucugugauuaggcuagaguuauaaggggaaacaaggucucccugagugcagguggggcauagagguuuuaaaugggaaggaauaggugauaagaauauguaagagguucacucuaccuccauuugaagacagagguuuaacguuaugaagacugucaaccuguuuccuccuuacacugucagccugacagaugucuuuuuauguacguaaagguauucagauccagcagugcauucucccaccagacuuuugaagaaucaggacauuugaggaacauuaaguucugaccuuuaauagcagccacuggcuuaauucuucauauuuuccaaaaaccacacccgccugcuggaauagauagcacagggaaguuggauggacucccugugccuugggaguucuuacucccagagugucuccuaguguuuccuuuugcugugcugugucccguauauccugucauuuccauuuauuuuauccucaaauuauaaagaauuguaguguuaaguccguuauucacuuuaagaugcagccagaacagugacuggagugguuucauaccucauggguuucccacacuuccaucaacacacacuucacaacaccuuggaggcauugugaaaaggucaagcuuuggagauggggaagaguccugaagauguugggugacauuguacagugaauggaggcugccugcuuggcacacuuuccaucacacaucacauuuugcuaaucuuuuggaauaagggggaaagacauuuaaaugagauaauuagagauaagaauggagauuuuaaucuuuucccugaagucaagaaggcagauaaggagaaauugcugucacugaaagacuguauauuuuacaagaaguuauuucagaagcagucucuauuccuuuaggcuuuaaaugaacuuaaaaaaaaaaaaaucaccccuuguguuucuuacuaauuuagggacuaguccaggggucaacaaaccuuuucugugaaggaccagaugguaaauauuuuaggcuuugcagcccacgcgguuuauguugcaccuacuuagcucugcuguggugggaccaaagcauccauaaacaauacguaagcagaugaggaucacuauguuccaaugaaucuuuauuuacaaaaauagguagcugguccagauuuggcccaugagccauaguuugccaaucccuggacuagcccauccuuuuauuucuugcuaacuuuaaggaacauuuuaaaguugaaauuuaaagauuggccaguguuaaauaugaaugguuaaaaaaauucuccccccuuugccgcuggcagucuuacccuucuuuaauuuuacuuacaagucugaaacacuggucuaagcaugucaggaaauaagcgaacaguuugggggugggaguaugcaacuaaauauucguuuaaaacuuacacugagcuuuuuuuuuuuucuuccccguuccauuucacauuguuaauguuggcucagcaaacagaaugauauguggaagucuugaaaacaguguaaaaucauuugaauuaggagguuaggccagacuucacagcaaagcucuguguaaccagcguccugguacucugugcagacccagugcugagugacucgcauucccaagauugagccucuuuugggcaaugaggagcaaaaggggucugggaauggugaucgguuuuguuugugugaucaucugaggccccaguugagugcauuugcauucuaaacucccacauccacacucgguucauuucccgaaaacugacaguuuuccacgugcacaguaauuugagaucguuguuucaggcugaggaaagcccacaggccguugucugggguggggguaggaggguauugcaggcucugaaagauaauugaggcacuccagaccaguggaguggguggcugcaagacguuaucguccccacagaguaucaggcaugcuuucggacccauccugugagaaaucugaguggaguaagacggaugcaaacacccuauggugaaugaucacuccccuacaaacuuaagugcugucuuggggcggaggccucuuucucucuuggaaacuucugcucaucauucaagauucagcucagaugucccuguucuuaauuaauuaaaucaccccaggcuccuccauuuagaguuccuguuuuucuccuuaguccuuuagcacuuguaaucaaccucuacuaucacucuuagcauauguuuuuuuuuuuuucuuuuguuccuccuccuucauuuguguaucucgcuaaauuguggaaucccucaccuuuuuaucccuaggucuagcacauaagaggaagucaauguuuacuggaaaucaggggcuuuucuguucucauucugugaggcuuacaaccuugaaguacagaaagccauagauaaaugcauuccuguucucaacuuugacguaaauaauauucaaaauacaauucuguuuugaagaaauuauuuuauaaacaggucuuauaaaauauaaauugucacaguguaucuggugguaauguugaauguuuccuuauuguuuacuugcaguggauauauuagugucugcuuuucagagaguagaaauggaaacuuuacagccuuaucaagaacuuaacauuauuaaggacucuaaaaauucucaaguguaugucuuucuuaauuacuugaacucucagauucuaauuuuuagcguuggcugaagguuagagggaugcuuuaagauugauaaauaccuuuuguuuuaugcaagugaacugccuauugguagugauggugaaaagaugauauauucugcauauaaauguugauagcugagccaaaauccagcccaaagaauccugacaagcuuuguaaggcucacaacacggcuuagcagaggucaaaugaagggagacuucugcagaaaaacaaugacuuacuguuuagcuuuaaggagaugccaauuauagcggguaguaggaggugagcugggguuaugaugaaaaugagaauauuuagaaacauguaacuguugcuuguuaccauauaaaauaccaauagauguuuccagcuuucuucuccuauaauaaucucccuguucuuccuacuugaaaugucuguggaaugaaauggaacaaaaugaaacugccucuaguuuuuaugacauuaagcuuucuuucuguagaaacgaguguggcguguguaauuaaauaaccaaagggaaagauaaccaagaucaagauauaaacaaaagcgcugaugguucuuuaaaagcauuuguauggacaacuuauuccuccuuuuuuuguuguugcugucugcuuuguguaauaugcaaauaagguuagguaucugcuuuguaguccauguguuguuugcuaggagccuagaaaaaacuucucaguuguaggaauuuugucucuuuuuaugaauguguccacagcagccuguuuaaaauguaauugacagugguuucuccuuguagcaguuguugauugggggguuggaggauccuugacauuuaauuuuggauauacucucccaugauagaaugagcuugaaguggagaguggaggagcccuacaauuuuuuuuugguuuauucaguaauugaaaaauguguugauggguuccuguguacucaguucaacaauaaauguuucaagcugugugcaggggcucacaccuguaguuccagcauuuuaggaggccaaggcaagaggauugcuugaggccaggaguuugagaccgaccuaggcaacaaagcaagaccccaucucuacaaaaauacuuaaaaauuagcugggcaugauggugcaugccuguagucccagcuacucaggaggcugaggugggaggaucccuugagcccagaaguuggaggcugcagcgagccaugauugugccacugcacugggugauagugagacccugucucaaaaaacaaaacaagaauaaauguuuuuucuuuagagaaauaaauugcaucuugccaguuuccuuaauauccuguuguuccccacuguucuuaucaauacacagacacuuuuccuuucauuuuccaaguguaagccuuuuccuguugcuuuuugcugcugguuagcaagucuaaaugcugagcauuuguucuggcugaagcugugcuugguacauuggcccaguuucaaagguuuuucuuauuguauguggugcaauugguucucuggaaugugugcguuagaaguucagugacugggagggacucuuccuuuuggaaugguaaauccuguccuguguuccaagcuguucuauagaauguaccucauucaguuugguguauguuugggauuuucuggugcuuaaauuaaguaacaguauauucacuuaguacauuugaucucuuaugggcuguagaaguuaguuguuucuuaaaaccaaauuugcuccugaauaauuugagagaagaggugccuuuuaaaaucaccuuggggacguuucagcaguuucuucuugaggcaagaugaauuugggaauaauuuguuuuucuuguuuucugugugggacuugaaaauuugauguuuuaaucaguuuagagaauguucuucauaacugccuguuuuuuuuuaaauguuauuauuaaaugguuaacuucaaaauuuauuuaaaaaaacuauugagucucuggaucuguauguagaguuagaugugcaaaaucucacucaaccaauauucauaugaccugauggguuagugcuggguaaauaggaucaagcgggaaggggugacugaccugcagccacaugcauucuuccuugggaugggugcagggagucagaugaugacggaacagaugagugaguaggcaggaucauuuuagauggggauugaaaggugaagugcuggagagcaccucugguggcggggacuggcugaggagccgauaguuauaaccugagauauuaguggagagagagcgagucuuccucagcuuuaggcacagagcaugcaaacggggauuagcgaugcacagcuugaccugcuccaggcaugaaaaggcagccagucuggcuaguauuccagggaggauagggggaggaaggaugcuagaucucggaagugugcugggaauggggccuuguuggccaggcuucuggauuuuaacuuugaaugcuauagcaaaccuguggagggcuuucagcaguggaaggaccgcuuaauuugccuugcauuuaaaauucucucucuggauccuguauuuucuuguguuguuccccaugauguauuuauagcagcauggagagauuuguuuauuguccaaguuuucauccuagagguagcuuucuaaaauuauucugaaucuguugauuuaaaacuaaauguguauuuucucuaaguguuacccaaacguaguaccuuuucuuuuacuguagagcacuugggguuuuaugacuaauuaauaaguaugguaaacugaagaauaaaacauguaacauuaacugauuaacacgugguguuagcugaggcaacucucuugguccaucuaagaaaggguguugucagccugccuucuagguuugauucauuugauggguaaaagaauuugguaaaaucaguuuuagguaucaaugagucacauuuugucguuagauaauaaauagacuggcagaauucagcagaauucugaaucauuggaaauugaguaaugcuugaauauaauuauuucagucaaagauauguauuaagcaucgcauuuauuaagcgcugugcuggguaaggaacccucggaauagucugugcccuuaaggagaagcucacagucuaauaaggaaaaucuguaggcacacauauauaaagucuaucuaguuuggguaaauauaaacguagacagccuagguaucccagaaauggaggcagggauacugaggaagacuuuugaaaggcaacaguuagagaccaggcagggagaagaucugugcuucccagagccucccugcuccuugugcuugaaggguagaaagugaggcagaacgcaggaagggugcucuuaccugggagggcugaggcuggcagaaguacugcuugaaauacucacccaggaggccuggcaugguggcucacaucuguaaucccagcacuuugggaggccgaggagggcagaucacgaggucaggagaucgagaccauccuggcuaacauggugaaaccccaucucuacuaaaaauaaaaaaaauuagcugggugugguggcgggcgccuguagucccagcuacucaggagguugaggcaggagaaugaugugaacccgggaggcggagcuugcagugagcggagaucgcgccacugcacuccagccucggcgacagagcaagacuccgucccaaggaaaaaaaaaaaauacucaggagcuuuaguccuguaggcaccagggcucccagaaagguuuuagguaggugaauaacaagaucagguuuaugauuuuuagaaaaaucagugacgcagcuuuguggagauggacaacccagaaagaggagccucucggggccacauuccaaaugagaagugaaguccauuuuauuugaauguuggaugcuucauagauuuaauacccaaaacauuuuuuaaaaguuggggaaugaauuaaaggaagaaagcauuaagaaaaagacuuuaagcuugcuugucuacauucuuaguuuguaacuguaggauuuuuaauuuuuguggcugucaugagagacuuucaccagccucauuauuuugcagguaugagaugugguccuucagggucaguugauagugugacaugaguggccugguaaugaggccagcacucugguugauccuaguacagaccagaagagcaggagaagagccaacacguauccacauuucugauuggugccaaaugagcagugccaaugaggcacugugcagcugugcucaccaggggccuuuacaacuaaaggggagacauaaauaacuagucaggugacagacuuuaucucagguuaaaaaaauugguuuaucucuguugccauuguggaggguaauuucuguauauccccuugcuugacugcugguaagcacuugacaucagucucagggacugaauuuucugaaauuugucaguaacaucaauacgcugacauugcauauaacauaaagacauguuuuauuaaccccuagcuguagauugccagacuuuugaggugagaagugauuuuuuuucacuggugugguuuguguaauuguucuauauacgugcuggccuugcucacucaguacuaguuuuuuauuuuuaaaauauguuuggaagaugagaggcuuggugugcugcacaugggaauacauuagcucaucugucuccucucccucugucaugcuacuuuucuguuggagcuauguauguccaaccacacaguuuuccuuacucccuuaaaaaccaauugaugaggaagacaaguucuuguguuuuucuaucuguaagguaaaaaauaccucucaaaauagacuuaugagaucuauuaagagaaacaaaauggguuauauuaacuaccccaguuaagaaacaucagcuacugguguuugaauguuagaacauauucucuaauauggcagcaaguaucugcuuuuuuucucucucuccccucccccauccccccuuuuuuugagacggcuucuugcuccaucgcugaggcuggagugcagggugugaccugggcucgcuguaaccucugccucucaggcucaagugauccucccaucucagcuucccaaguaguugggacuacaggagugugccaccaugcccagcuaauuugagauucugcuuuacgcagauggaucuaaaauuacuugcuaacagucuaagacugaguucagaacccaaaaucaguuuucagagcuucuaaugagaguuacugcaaaaaugauuaacacuccaguauuucuuuauccccagucugauguugcuauaguauaugaggcucuuuuaguuuuuaaucagaacuuuuauacaaauaauagaugcuuucucauugugaaaagaauuuaaaaacaacguuaacaaaaugcuccccaaaccacaucaccacuuaacauucugcacccuaaucccaugcugcuuggugguagguuguuuuuguuuugagauggagucuugcucugucacccaggcuggagugcaguggcgcguucucagcucacugcaaccuccaccuccuggguucaagcaguucuccugagucagccuucugaguagcugggauuacaggcacacaccaccacacccggccaauguuuuguauuuuuaguggagaugggguuucaccauguucgccaggcuagucuugaacuccugaccucaagugaucugcccgccucggccucccaaagugcugagauuacaggcaugaaccacugcucucggcccugcuugguagguuuuugugaaauguauccuuucagaccuuugcuacauauuaauaggcauacagaaguaccuggcaaguucauuuugaaagguaaauuaacaugucucuccuuagaauugaugugacuuuuuagucacguuugcccaaguguagagucguucucaauuuaaaacuugcaggaugcauuuaagauaugcaaaauaucuuacuggcucugaguccuggagaguguuuaugauggguaccaagaauguaaauuucacugucauguaucacccuccuagagaauggcaagaaguuaugugggcaguguuuucaagguugauuuaauuuugcaaaauggggucacauaaaacuuuaaaaauaaauacuauaauaaauuauaauaagacugagccuucuguggcaaacagaagugaguagcagagagugcuaaugcauugagauaauccccugggggcucuuccaggaaaacaacugacaucgugcuguuuugucauuguaguuggcugauauuuuuaauaugaaaucagauuguaagacuuuguuuuaggauuaagucucugauuacuuucuuuauaaauuuuaagaauguuauucauguuaguuauugagagugaaaacccugggacgauuuagcugagugauuuuuauuaugagaaagucucuuacaaauucuuucacauggauggagagacgaaaaaaaucucccuucuuugaagcaacauuuuauccugccuucagacauggagucacuuugauuucucauguuuaaauuguauuuggaagucaaacuaguauugugcuuggagguauguugaugcuuuuucauaaagccaaugugugaaaaauguuucccgcauguuagaugguaggaauaggggaauguggaaacaaaaggccaaaagauggacuuagaaaguugagauguggcuuuuaaaaugaaaaagucacuuacaugguguggaagaacccuagcauccugucuuuuugccucccuguuugugacagaucucuaucucaccauccucuaagcugggauugccgaacuuuuguguuuauuuguugcucuauccuuuguacauucaaaucagaauggcauagugcuucuaaacaguaauaagacuuaauccuuuccagaguuaauguacacuguugauuuuaggauuuucccuuuccuuccugccagaugucuccauccuuaugaagauaaauauauaggagaaaucacacucugucauccaagagagaguuaaaaauuuaaacucgaauucuagagaguuggugacauguaucagaggaaggccuaugugaagugaccagucaagggugauaaauggguagucagcugugcacagccagcccugugggccgugaguugccauggaagcaccgaauggcauucagcaaucccgcaugacuaaccuaguuuagcagcagggcccaugggcuccagccugggagaaggugcuuacagccagaugauaccagagccaacacacugccccacgucucaugcccaacuugggccuuucuguuacuaucuuuuccucauccacauaugcuauuuccuuuuuuagugugaaggaaagagaaaaaggaaucacucucacuaauccuuacagaguugugauuucuuacauuuuaccacaauauuuuaaacacauccaucccuacccccaagaagcauuugaaaagucaguaaaugugcccugacaggccccagcaugggguugacuaaaugacuguauugaggggcugaacaggcagcucugaauuccucaggauuuucaccaccuuucugaaagugagagcauucuggcacguuuuagcuuuccaaagcuucauucaagcucuugugcugaguuaguggauucggucagugaaacgucuguggcacagucccccuuucauggcuugaguguuuauguucugcaggugaguuuucacaugugacugaucucaccaggcacuggacacugaagccugugguucuccccauuucuaguucacuuaacuaaaauacaaauguggaggagguggcuugaugaauucuguagagaucuuuugauacaucagguugaaccucaaagaugguggacaguaguauaugaucugaaggcaagaacuuggcuacugaaaggagaauuauuucccuauuuaaauagauuuuugcagacuuccaguagaacucauggugucuguggaguggucagacuuugcauccuccuucccaggggcacaucagaggcucugaaacaagaauuguaacacaguuuuuauauuuauuuauuuauuuauuuuugagauggagucucgcucuguagcccagguugaagugcaguggcgcgaucucggcucacugcagccgagaucuagcgauucuccugccucagccucccaaguagcugggauuacaagcacgugccacuacgcccgguuaauuuuuguauuuuuaguagagacaggguuucgccaugugggccaggcuggucucaaaccccugacgaccucaggugauccucccaccucggccucccaaagugcugggauuacagaugugagccacugugaccggcccacaguuuuuauaacugaaagagcagcuucaugccauuggccauccuucucucaaagggguccucuguuaggucguuccucaaggacaggccuguguggaucaguuuaaccaaacaucaauuuuguggcucugagaugacccugcuggcggagaugauacuaaauuguugauguguaccuuuuugagacuaaagaaauaugagugguuauaaguuagcacacuuuagcacaccuucuuugucuucacugcuuuauuuaacgcagccugacagcuuugcuagcagaacuguggcugagaguauaagcuuucuugccaggcauuggugaauguucaggucuaccauuugugagcaagucaauccccucacccuuuuuuuuuuuuuuuaauugagacagacuuugacacuuguugcccaggcuggaguacaguggcgcaaucucggcucacagcaacaaccucugccuuccagguucaaacaguucuccugccucagccuccguaguagcugggauuacaggcgccugccaccacacccagcuaauuuuuuguauuuuuaguagagacauaggguuucacuauguuggccaggcuggucucaaacucccaaccucaggcgauccacccuccucagccccccaaagugcugggauuacaggcgugagccaccaugcccugcuuuuuuuuuuuuuuuuuuuuuugagauggagucuugcuuuguuaccuaggcuggagugcaguggcaugaucucggcucagugcaaccucuaccucccggguucaagugauucuccugccucagccuccugaguagcugggauuacaggugugcgccaccacgcccagcuaauauuuuguauuuuuaguagccacaggguuucaccacguuggccaagcuggucucgaacuccugaccucaagugauccgcccaccuuggccucccaaauugcugagauuacaggcgugagccaccccaccuggccgcaagucaaucucugagcuagcuuucguucaguuggaaaaugggguuaauaaucccacucucacaggguuguugugaaaauuaaauagaaaacugaugugauagugccaaaaucaguguugacuaacauguuaagugaugucauuccuuggccaggcugcugcugcuguuaucauugcuuuuguauuuugguaagccccaaaaaggaugugcugucuuuuaccccuggagaucccuuggaaacuuguucaacauacaagccuuggggcccaugucaggccuacugccuuagaaacucuguaggucucugugaucuguguuuugacaaacccuccagcuaacugacucagguuugagaaccucuuagcuaaugcaaaguaccaucuaaaaucagcuaaggagaacuuguaacucacuauauucuauucggaacagugggaaagaauggccaggcugauguugggauacauuuuuccuuaacacaggacuggaaaaaaaaaaagacaccuuuauuaaagugacaguuaacuuauaguuauugaaaggugauuauugacagcugggcgugguggcucacgccuauaaucucaacacuuuaggagacugagguggguggaucacuugaggucaggaguuugagacccguguggccaacuuggugaaacccugucucuacuaaaaauacaaaaauuagccaggcguggugucgggugcaucuaaugcuaucuacucgggaggcugagacaggagaaucacuugaacccaggaggcagagguugcagugagcugagaucacugcacuccagccugggcgacagagcgagacuccaucuggaaaaaaaaaaaaaaaaaaguugcuacagaguuugugaaucauguaggguauuugccgccuccuaaaauucccucauuaaaaaauuuucccaucugccccuuccuugcuuacaccuugguuuaaacagugauguguauaggcucaacaaagguuuacucaugguaugaauaguggguuuauuuuuaaaauuucauauuccuuuaucucaaaauggaaccaagaaaaagaaaauauucacaaaagauuugccugggagcuuuuaacagaucauucccuaagccauugcaaauuugcagcaagaaaccagaaagcuauuuaaugugacuggcaaaacaauuuaguugcaaggagaaaggaggcaacccagagcaggggcucaaagccuaccucuacucugugaacuuccugccucuucggucuuccucugcccugcccaggagcuuuugugaguuccacccaagagggaguuguuggacaguguggggagagcaagugucuuucacaaagccuggaccucauaaaacucauccuaccagugauauccaugaugucuuuuuucaccucacuacuuauagggcuuuuaguugaagggugauggugaaucauaaaaagaaaauuugucucgaaauagguguagaauuacaugucugccgauaaaaucuuaacguggguuuaaaaaaauuuuuuugacacuaaugaaguaaaaccuuaauuaacuagaauccuuaauuuaauaggauuuccucccugugggagaauucuugauuuuagaaucacauaguaauaaaccaguguuaggaauucugugaaagaauggcuuaauuguguucuucugguuauuucuguggcaauuuucaguauuuuggaaugaaaaucuggaaguaugggagaaacccaacugaugcugaaauaaggcuaauacaaggcugaguugauugauuuaaaaauauuuuaguaauguaacuucguuaaaggaaaauugaguguguggaauugaugagaaaauugaggacucugagcagccuguuaguugagguguaacuguucacacccucccuuuuggauccuggacugagaauugccauuuggaguucccuucucugagacaaagguagcauuuauuuagaaggggcggagcucugcccugugaagcggagccuaaggcugugaacacugacuggcuauaggggcucugcuguuuuaaguggcauaucagagaggggagaacucccuugguggugagaauagccaagcagacaagcacaugcccaugguaagcuuuccccacccgcucacccauaggccugucuugacugcugcaaggugcaugcacuggauaguuugggagaauagaagcuuagaugcucagaggaugguugccugcuuagcuccucccugcaaaaacuggcucaaaguggcuauaaaacaaguuugaaggaaaaagugauuuccuaaucagccugcuuacuuggcuucuaugguuauaugcuaauggcauaugaucuuuugaaccaacaagaggaauuaccaaaaugauaaaauaauugaaggaauugagugucaucaaguccagugugcuacugccaacuggaaguaaguuuaacugaaacaggugagacucagacuucauuacagaagauuacacgaccaguuucugguucagcagcuucuucuuuucaguauuuugacuggcauaaauuauuaacuuugugguuuuaagaguucuuuuaaaaucugauauugcaauauccaucaucuaggaaaaguuuuugauacacacaggucuaagaagauaauuuuuucuuucuuucuuucuuuuuuuuuuugagacggagucucgcgcuguugccccggcuggaguacaguggugcgaucucagcucacugcagccuccgccuccuggguucaagcaguucuccugccucagcccccagaguagcuggcacuacaggcgccugcgaccacagccagcuaauuuuuguauuuuuaguagagauaggguucaccauguuggccaggauggucucgaucucuugaccucgugauccaccugccuuggccucccaaagugcugggauuacaggugugagccacugcgccuggccuaaggagauaauuauuuaccacauuguagugaauucagucaggcagcuaauuucucuccauacauccuacucccauagauuaaaaggcuauagaaauacuagauuacuuuuuagaugauuuuuuaaaauaauuuuugcaugugucuuccagaguuaaaucuuuuuuaaauaguuguaaguuuguaaaaauacguaaguguaguggcuguuuuuuaaucuaaaaguauuuaaugauuagcuucuaugcagaguaccaugcuuuagcaccaagagaggugcuaaauuugcgagguucguuucugauggaguucacaugcuaggggagaagggaggaggagagagaacuaauugauguguuagguaagcacauacuugguggauuugaggaagccuuuagagugagugacauuugaaucauuccagagauuugccagaagcugaaaauuaaggaugggggugugugguggagagagaagcaguggaaauuuguggcuggaaugaaagcaucaaagucuaggauaucacugaggaauggggaguagucaggugugacuggaauguagagguaguuuguaagagagucauacuuccuagggaagcuggcucuggaagaauugguuaucuuucaguaaagagagccugguggaaauuagagcaagaggcugccuuacaggguaugcucaggggauggacgugacugacugacugucaaguagaaugcaugugacaggccugcaaggggacaguagauaauuucuagagaguagaucugcgucagauuaugggggaauuuuaaugccaaagcaagaauuuagaguuuauucugcaguaguaaagagccaucaaaugcuuguuauuuuaaaauauggauugugacaugagaaccagggccuuaaaucagguuucuuuucaugagaaggcugaauuaaagggauaagaugugggggaggcagggagaccaguaggcuuuugucaaaggaaauaagagaagucagaagagggcaaagaggccaggaaaggggguggggaagggcgucugacaucagggcuagaauuuccgaagguacugaccgacagccuuaacuagacaaucaaauauuuuccuguuuguucaaacggcauugggagaaaacauucaguagauucccuaggagcaagucugugaagacagaagucauuuuauaguucuuauuucacuuuuuaaucauacauugcgugugagggcugggaagugacccuuggugcugacaaugaggcagguccacuuuugguuuauguguugguuaaaacugcacuacuuuuggucuccaucucugauuuguuucucggugaaugccguuuaaccccuuuagugccagggcugaugauuuaggauacauuuuuauguguuuuaaguagggcagucagauuauaaagcguucuccgucgguagagcugacaucuauaauuggauuuucucauccuugacguuugaaaugagaaauaaaaaucauuuuuugugggguuuacaugccaagacacucccaguagaguaggcugagaaaguaaaugcuguuuugggugccugguaaucuuuuaauuaugaaauaagccuuuugauuuuaaucuuucaaaauguacgcuacugauccaggaaaacggccuuucuaaaguccacauccugcugacuccugcagaugaaaagcuuccaccucuaccccauauuuugcaagcugaaaauaaaaauaucauuaaucuugucucaguuccacugcugccuauaaaaggcuguucaguuuggaaccaguccugagccaugauggagaccauggcccagagugaaugcuuggguuuugggagccaggaccccaggcuggagggucacagccaagugacugaggccucacccuaaggcuggguuaaggaacuuaggcuuucuuuaaaucacagccgucaucacugcuucuucccagaccuguccucaccucccuucucacauguaaguaugccugacaaaacuuggagacugauaaauuuuauuguuuucauucuuuuguggcaucugaaacaguuuguacaaugacgacagaaaccugcuucgaauuagagagaaggaaagacgcaaccaggaagcccaccaagagaaagaggcauuuccugaaaagauuccccuuuuuggagagcccuacaagguauuuacugaacacuagacauugaaguccugauuuaucacaauguugaacccuaugaugaaacaauucaguauaauugaguucgaacaagggucacagcugugaaaauaagauaacuuauucuaacuuauucuagagauuuuugaaaacaaaguaugaaaauucucugaagguuguuagaauuaccaaaguuugugguuuucuuuuguaaugcuagucuucuacaguuaguaauauguauccaugguagucuucucaacaggggaauugaguuaaaauggcacauuaaauucuacaugucguacauuaaguucggaguuuuuuccuuaauaguauuauauaacgugguuuguuaaaugguaguuuuccuuaguuuuuuuucauucucaaauucuccuuuuuuuucagacagcaaaaggugaugagcugucuagucgaauacagaacauguugggaaacuacgaagaagugaaggaguuccuuaguacuaagucucacacucaucgccuggaugcuucugaaaauagguugggaaagccgaaauauccuuuaauuccugacaaagggagcagcauuccauccagcuccuuccacacuaguguccaccaccaguccauucacacuccugcgucuggaccacuuucuguuggcaacauuagccacaauccaaagauggcgcagccaagaacugaaccaaugccaagucuccaugccaaaagcugcggcccaccggacagccagcaccugacccaggaucgccuuggucaggagggguucggcucuagucaucacaagaaaggugaccgaagagcugacggagaccacugugcuucggugacagauucggcuccagagagggagcuuucucccuuaaucucuuugccuuccccaguucccccuuugucaccuauacauuccaaccagcaaacucuuccccggacgcaaggaagcagcaagguucauggcagcagcaauaacaguaaaggcuauugcccagccaaaucucccaaggaccuagcagugaaaguccaugauaaagagaccccucaagacaguuugguggccccugcccagccgccuucucagacauuuccaccucccucccuccccucaaaaaguguugcaaugcagcagaagcccacggcuuauguccggcccauggauggucaagaucaggccccuagugaauccccugaacugaaaccacugccggaggacuaucgacagcagaccuuugaaaaaacagacuugaaagugccugccaaagccaagcucaccaaacugaagaugccuucucagucaguugagguguguggaauuucuuaucuuggggaauuccaauucgaagacggauuugagaugaaaauguccggaggauguggggcaagguggggagguuaguccauggcuuuuggguagggggaauucuuuuuggcuuuaggaucuuguuaauaacccgcgaaaaacucagaucugagauggacgacugauuauagauauugaaaugcaguuugcagaaagguuuagagaaccuuuuuauggagccaaaauuuauauacaguaaaacauagagaucauaagaguacaguuuguguuucaaaaaauagauacaccuauaggauccaaaacccaaucaagagagagaagauuucgguuaccagaaaguuucaggaagguuuucaggugucuuauuuauuguuuugggagacacugggguaacaaugugaacacgaaaaaauuuuuuuugauuaauaccuccucagacccaguuaauuuuuccugggcucuaaaccguaaaaaaguaaaaacaagaugacagagucucuuaauuuuuauuauuuuagaaggacuuguucccuguaaauuguaaggaacuuuauaacuaaaguucuguucuaauauuuuauuauuuaucaccuaaaaaagaagaguggguauacggugacauuucacuugagagugagucacaaauauaauacagaauguuauucaauuauggguuuuaaaaguaacccaaaugcuguacuuuuuaaaaccaagaaaaaaaauauuucuuuuucuacugcauggauaaacagcagcauuguguuugaaugaggagaauuagagcauacauucugucacugaaauuuuaaagugguaccaauuucuccaaaauuaagauuaguagugugaagugaaauguuugaagggaauuuuaaaacuuaucuuuuaauguaaagucuaugguuuaguuacaucuauuguauaaacauucuaauuugcaucuccauugcucaaagacauuuaugccauccagauauguuuuacauaaugccagaaggugaaauuccucaggugggggcgugauuccuaccuggaaagauaaccuuuaucuuccaggaggacaacuuguaacuuucuggugucagcuucugguuuagaagagggagguuggggugccguccucacugagcucuugagcugaguacuuccagaugucuucugaauaccacuuguuuggggaccaaggaaaaauaagaaagaaggaguaaaaccaauggcagaaaugaccaagauggcagaacugcaucucugauccuaacuuaagaagauuuaaugcacugagccauuuauugaacauuuugugcugugauggagguagggguaggcagcugaaugaaggcaaaauaaagugagauccucccuccucaaaacagucacucccccugccuucuaauucaggcaauaaagaacucaaugagaguuucuuucuuucuuuaucaaauaggguuagcuguauguucccaguuuaaaaaaaaaaaaaaaaggggggggggggacaacuuaacauucuuucuaaaaauaacaaaccuaaaaaauugcuuuaaaacaauuuuuagacaaauuagcaaauauuugcauugucuaccaaaugcccaaccauaugcuuaagugcaagauucugugccagagaaaucgguccuugcugcaggacagauuagucuaguauagagaucagccuacacuuaugaaacaauuagagaacaauugaguuuucucucucuggaacgaggugcuuauaaaccuguguaauucagcccuagguuuccuaguagauguuucugggagaggauuccuguuaacuuacuguuuucuuggguggaaauaaguaggcugaguugagauucuucagugucuuaaaaccccuuauauuuaauauguauuuugaacauaggacuauguuaauuggcucuugcauguuuucugaggaacaaaauccuccauacauuuggucauugaagaaugggguuuuuuuuuuggcaccagugcaucugcugucaacaauggaguagaaguaaaccuuucaucugcagccucuguucacagucagcauuuccuuuaaugcggugguucccucuggucucggcccgaguucucaugccaggcagcggcagcugugguaccaacugccugggagccccguggcgcuguuggugagugggaggauggaacugagggggucagacagauggagggcucucggugaccccuuugagggcaaauuaggagccaagagcauggaaugaaggagucgucaauccgggaaguggggaucuuggugcucccuggucagguuuuggauuugauuuugcucuuuuaaugaagaucucauguugcacagacuuagcauuaauuuucuguuuauacacuuagcaaaauggguauuuuugaaaguuuuaaaaauauacuugaauuuuauauuucaaauuuuaauauuucuugugaauccaaggauuauuauucuggugaacccaaggaaaguguagagauguaggaccaaaaauguggaaauuagccccagagcagguaaacuuugaauauaggugagaauauuaccaauagccuggguuauuuuuggguuuggggcagaaggggaagcugucucuugguagagcugggagaagggggugugggaguagcugagugauuuuccuuuauuugcuuaauugguccuaaggcaagucagaggaaauuuucucuuuccuagugcucugagugugaggggauaguuggguuuugugguuuguuucauuucuccccuaccccuuuccacugcuucugugaaauagugauuuuacaaaugaacccaaauuggaaagucacucuuuuuauuuuuugguuuuuauguuccuucauucucuagccaccuaaguguggauucuuuacucccuguccuuuccuuucaccucaugggaaauacuugguuuuauguucuaguugguacuauaaaaacucauagucuucucugggauaagucuuucucagaauuaaaguuuaauucuuccaaagauccuaagggaaaaaauuaucaaaaggucgguuuccgacuagaggccuggaccacaaaaaucugcacuugguuuuucuccgggagugucuguuuuaguuuuacgucaacuggaagaugucuagcagugugaagugaccaaucugaggccaggcccagaacuccgcgaucucacguggaucccguccagcugcagaguugccacaucagagguggaccugcccaauuggaagauugagauuucuuuauaucguucuuuucugucuagagauaacaagugaaagagagagaagccguggcaucucugugagugcucaugcacauggaccccgaggcugggggcauugagauggaacguggagguggggaggugugccuagacacagguuucagauaaaggauuuaugugcuagauaggcuuuuuauugaaaaggagaaguggaauaagcagagauggguauaccaaaucauauacugaauuuagaauguuugaauuuuaaagcuaaagacagcucuuucauuuugcaaauaaggucuuaaaggguaaaguccuucauuuugcaaaaaguuguaguuaauaucagagccagagcuagaacacccaguucuuuugacuugcuguuugguggcagcauugguggcaguggugagauguuuguguuuuugaccagaagaguuguaauuugucacccagaccgaaccuacagcagagccauggaggauacagugaguuucauuuccuguguguuucuuggccucacuuuuaucuuucaucauuccucuuuuucuuuccuuuuucuuuuuuuuuuuuuuaacguacucauucaacaaacugguauuuuguuuguuuuguuuuguuuuuugagacagagucuugcucugucgccaggcuggagugcaauggcgcaaucuuggcucacugcaaccuccaccucccggguucaagcgauccuccugccucagccuuccauguaguuggaacuacaggcaugugccaccaugcccggcuaauuuuuuguguauauauuuuuuuauucgagacgagguuucaccauguuggccaggauggucucaaucucuugacuucaugauccgcccaccucagccucccaaagugcugggauuacaggugugagccacugugcccagcccaacaaacugauauuaacccuccacuguguuccaugcacuguaguagguucuugaugauacagcugagaucaagguagacagaucccuggucucauagaccaucuauucuaauggggggcauugauaauauaguuauaaugaaaucauaggcguugauaagagugccgcaagaaguaaagagggugaugaggaugagaugaaucagaggaggcugacuuaaaaaugguggucagcacaggacccucugaggaggcaccuuucacagagacaccucacauggaggaugaacaugcgucagucaugcagagcucagagacguauuucauuucaggcagaggaaacaaguguaaaggccugaauuuaggaaaaggcauggccuuguuaaucccagcacauugggaggccgaggugggaggaucacuccuggggagcccaggaguucaagaccagccugggcaacauagugagauguuuuaucaaaaaauuaaaaaguuuucccagcuauugggaaaaaauuaaaaguaguuccagcuacucaggaggcugagauaggaggaucacuugagccugagaggcugagguuguagggaguugagauacugccacugaacuccagccugagcgacagugagacccugucucaaccgcucccuccuccccccacaccaccacccaaaauaaacagaaaugaggggaguauggcuagaacacugagagugaggggaggaugugagauggaacuggcgacauaggcaggaguaagaccauggaggcuuuguuggccgugaaaggcauuuggguauuauuugugauugaaaccauuggauaauuuugagcaggggagggacauaucuacuuuuuuuuuuucuuuuuaaaaaacuguaacucuggcuucugggugggaaauggaugagaggggcaaagguggaagcagggagaccaguugggagauaggaaaugauaguggcuugggguaguagccauguauguggauaguagccauguacgugguaugaaguggacaaguucuggaucuguuuggcagggaacugauagggcucugugauugacaggagauaggaguggccugaggugaggggaggcgaggcaucaaacaaggcugguagacuuuuuauuugaaaggcaaggauggugggaugauacuagcuaccgagagggaaaugaccuggaaaacuaagaacucuaguugggucauguauuaagaucauguguucgguuugagaugcuguaauguauccagguagagaugacaaguggcagucauaaacaggagucuaacucugggaaaaugucagaacugaaaauaauuugggauuuguguuuauuuaguagguauuuaaaaccuugggaccgagcauguguaccuaagaauccuuauauggucuuaauuccuccuccagaucagucuggcuuugaguccugauugugacugauuucugcaaagcaauugcucuuuuccuuguggccucuugucacaucauguuaggaacguuuuguugccagaugcuugcauuuaauuuccaagacccaaguguacauucauuguuggaccacuuugauucauugcagcucuuaaauugagccuccuauuuucaauaaacuaccagccuaacaacugcaugaauuaacccacaguggaaaacugugugauagugauucacuuugcauucacauauacaaacauucuuuccuacuuccauauuuaauuuaaaccucaagaagagggacuucccuauuaugagaugaucuaaaccuucaggcgguuuacuucuggauaugccgauggugcacauccugcuccugcaccacucaaaacacauuuaagcagcuuacucucacaaacacaucauguauucagcaauuuuaaccaaaauaucuugaaccccuguugugugccaggccuggugcuggggaugagagguuaaaauggugggcaaaaccagaugguuccaguccucuuggaucuuaacuguccuauuagaaacugacauuagucaaguaaucacucagauccauguauaagaagcuuugacaagugcuauaagggaaacuacaagcuauucuaagagcuauaagaggggauugugacuuagaacuaaggagcugaggaaggcuucucugaggaaguacuauuugaaugagagcugaaggugaguaggaguggcccaagugagggguguuggggcuuaagcagugucaguauuccaggaagaaggaauagcaugugccacuggcuuaugccacaccaugugcagagaccauuagagaauucuucccaggauauaagcccaguaccauagaucaaagggaauuuuucauuuauucugaaacuuggcagcacaucagaaucaccugggaagccugauaaaaauacaaauuguuaaaaauaaaaauucccaggcccuccccuaggggggcugaguuuguucuguagccuggaaaugacaacuguuccggaaaagcuuaugggccacagggagcuacaggggccccucccaguggcucaagaagccccccgacaugugggucucgggcacaaggaucacacugaacugauggauggggcuuucauuccugaguaggacgucagaguagccuugggagaagcacaggagugggauccccaagacucuccuccucuuuuccuccguagcucauguuuuucauuguucugcccccaacauaagguagaagauuaugacacaaucuuaucuagcuuuucagguuccguuuucuaaaaauguuuuauuaugguaacucuagauuccguaagcucgaccucagugagccugggcagaccuacaugaccuaaauguguuaggaaauugauagcagaguaaaguuaucugugugcagaauucccugcugccauggguggugccuggagcagacgacuuccaaaccgcuuguaagaaagcaugaagaauaagucaccugcacuucagaggccaaauuuuaaaccugaaaagaucuaaauauagaaguuuuaaaauagugacaggcagguuuuuuagagcagaagcuguaaaccagcagccugagggcuagguugggccugcagacaaauuauuuuguuuggccuguagggcuuguuuucuuucuuucucccuaccgccccccacacuuuuagccaguauuuacaaacuggagaauuuaggaaaaaaaucauuauuggcugaguagaggcaauuucuggaaccuggcaaucuuuagaguuucucucucucacccgggcuggaaugcaguagcacgaucacagcucacuucagccuugaacuccuggguccaagcagugcccacuuuuccauccugaguagcuaggacugcaggcacauggcagcaugcuuggcugauuuauuuuuauuuuuuguagagacaaggucuugggguguugcccaggcugaaccuggcaaucuuaugaagaaacacuuuaaacucugaaggaaacuuuuuaaguaauauagacacaauauuuuugaaaagcucuuaaauugcuaaaaauuaaugcaaagaauagaauugcuuauaguagcccaagaggaaagcauaaaauugaaacuggaagaacuuuuugggugguauuaauuggaguuguuuuuacuuugugcauuucacuuucuauuccuucucggaaaugccagaaguacauuugguaccaggaugagaaauuccuguuccuccuuguuuucacacuugagauguuuguggaugguuauuggaucccccugagucucuccaguugugccuuugccaagauauagacauucaacucuuuugaaucuucccagacugcaugugcucucccaggcucucacauagccacccgggucauuuuagcucuucucuagauuaacuguguuuuauuuugagccaacugauaaucuucagggacagaaacccagauauuccaaggggaaucuuguugaugacugaguuagugguuugauuuuggcuguuuuggugggggugaccaacacucaugagauauuuaaacaguuccuccuaagagaggauccugguucauguuaacauaauaauuuauuuuuuggucuuguauuucuucucuccaguugccaacagcaauuugacauuauuuuccaagguuaacuuugcauguucacauuucccaagaacucuauaagcagcuauuuuuacauugauuuuguuccuuucuuuaauuguugaaauaacucuauugaugguuuuucccacagaggucuaggguccacacaaacuauuaguuuucucuugaacuucauuucauucccuauuuaaauuuggccuacuuucucucugcauuuuuuuuuuccuaaccccgugguaauuugucaagcccauucuaaucuucuuaaucccuuuggcugaaggguuuugagguuuaauguuuuaaucuagaggccucaguauuuaaguaauuagagguccuauuucuagcucuguccuuuagauaaaucaccuuagguuuuuuauuccaauuuacaaauaauagaacucugaaaacucauauuggacaggaauguggagcuuugaauugaagugcaugaauuaagaaaggaaggcauucuauguuauguauauuucuucgagguauucuuaacaaccccacacuauauuauagauucccuuuuuccuuagagcucaauuuuuaaaauaccccgaagcaaguauuugcuguugcauuuuagaaaaauuuaaaauagaauucuaugguauaauuagaauguauguuacuuccaacauuuuuucaugcucgagaacaugggaacuugugaaaaaauuuuuuccuauuaaauaaucugaacauucuuacaaaauguuuuuuaaaaauaacuuuguuucuuugucauagaaggauucauauuuuuacauucugucaacaaauauuugaacacccauuagauauaaagggagcuaauaggaaagaaagacacaggcacaguaaauuuauuaugacauagcauaaaaauccaaaguguaaucaguaugagcaagguaauacggaacucuucauaauacauugcuggcauaguccccuuguucacuuuaugaugaaaacuauucuaaaugcuuuauaggugcuaacucauuucauauucacgaugaucccaugugguaggguacuguuaccauccuguuuuacugagagauuuagagguacagagagauugguuguccaagcuucuggaggcuuuugccaguggaucugaaauccagacucaaguagucugguuccagaguccacagucuuaaccacaacaccuacauuauauugccuuucaaaauuagaagcuguacauuuuuuuuuuaagaguugacuuuugaagcacuuugcacucuggugaaagguacauccaggcuaaaggcuuaggaagagaaaagacauagaagcaagacacggagggaaaucuagugggaguggcagggccuguggcuccaggagguugggcaugggcagaggagagcaguggggagaugggccugguggcaagauagggccagcuuuugaaauucuuuaguuauuuauugaguaauuuagauaaaaacaagaaucauuaauaaaaggcggagaauuauuuuggcuucauggcaggugguacagcuugggcuuauaauucuguaagacuuugggcaaggaaccuaaccuuccuguguuaccaguuuauucgucuguaaguaaagugggucuaauauacugagguaaucuuugaauuacuuaagacagugccuugugcauaguaugaguuccauacuccuacuauggaacucuugguagugguagaagugaaauuugaacugggccuuaagaaaaagaauuuggacagaggguuaucaaaauggggaauuagugauguuggggaguuaggaagacugaucguauuguuuauugaaauguacuuuagaaaugaaguuggaauuagaucaaguggaccauuaauucccaguuaagaguucuaagugaauaaagccccuaagacuugauuuuaaaguauuaaaaauaaguaaacaaaugaaaagccuagugaaagaaaguauuuccuuagggguuaucaagcuuuuaagaauggguuugccaugguguuaaacccccaccgcugucuucaacauccccccgcccaccauccccaccccugccugauggcuuaguugcucugugagcucacuccugaacagcagcauucccguggcuuggcaaucucugguguaaacaguucacuuuauaaaaauguacgcacucuaaaaucuuguagugcccuuuccccuuuaauuuccaaagcacuuauuuguuucucucuugauuaucacaguaaccuugugaguuaaguauggcaguuggcaggagucaccauuuuacaugccguggaacugagucucuaaauuuaauuuaagcuaguaaauggcagagauggagacaugaaaccuggacccuggcuccuaguuccagcgcuccaucugccacaaaacaugguuucuguggaguaaugauggcuuauguacacuuuuauuuaaagugugcuguuuuuccacauggccuugcuuucauguuggcaucugaugagucaugcaaauauaggguggcacgggugauucaaaugacaggaugaguaaaacucaguuuuggucuucguggccauguggcuugcacugagaccuuuaacuuugcuuccuaccuuucagagaaggaagcaccagguaugaauucucucaguucuuucuaccuacagugccacccccgcccccaaaucauagcagccaccauuugucucuuucuguuuaaucucacagaaggagguguucucaacucccccacucucaaccuuugguuagcuuaaaccuuucccuuauuacucagcucuuucaugauagucuauaguuacauuuaggccuuucccaacugaaagagcaaaacaaacccuucuucacucuugugucuucucuaauuacuacuuucuuguucccuccacagcaaaagcucuggagacagaaguagguaaacacuguuccugcuuccucuccuccccuccccucuacuugcaacccauugcagccugcucugugccuucacgccacugccucugccggcaggagccacuaguggacuguauuggaugaauucgaggaaugcucuuuaaggccuuauccuacuugacaucucuguagcauuugacacuugaccaccaucaccuuaaacacucuccuccccuguugucuggguuuucuucuaccuuuuuguacgugccuuaaucuccuuuggaggcugcuguucccacuccuccuccagggcucuguccucaaccaucuuuucucauucugcagccuuucccuggugaccucauuugcacuuaagauucaacugccguugcucacgaacaccagagugauuuucuagccuaaaacucuuaaaacguauuuugagaucuagguucuguuauccaccugcccacuggacuuuucuaguagguguugcacaggcaucuuaauugaaccugucuaaaauggauuuuuuugugccccccucucccuguaucacuucacacacagaauguucuccuuccuccuggucaucaguucucaauuccuuucugucauauacuccauuguuuugaaagcagcuugauccuauggagauuacuuuauaaacauucauagcuucuccuuuucucugucccucauuuaguauggauuuuuaccgucuuucuugaacuguuacaacuucuuucuaaccucucaucuugcuguuuuccugcuucucaguaugccacauuauuucacaugagugauuugauuaagugaaaaucagaucaagucguacuuuuucaagauccuucaguaccucuccaucaccuucaggacagaaagccagauguguccauuugucuucuugccucuuaccugucucugcagccuugaguucuggcccugcugcugguacugccuuguuccacugcagcccccagacccuuauagaugacuuucugcugugcaccccgcugcccaggcccgaguuucagcacuucucccuugguaucauccugcugcuuuuucuccaggugguaaacauuuugagggcagaagucaauugugucucauaugcuuguuuguccuuuguguuuagcacaggugagaacuggagccaaaugggaacuuugcuacgcugugcucagcuugaggauuucuuacccagcucacucuggucuggagucugaaagauaaucucuuaaaugcuuggcuuaacagaggggugaaguacuggacugaauuuccuauucaggacacuugacugggaaaugggugcaguguucaauaauguuuuugagaaaucauuucaccauuuucuaccuaaguauuaaguaauuuuuggcauuccuacauuaaaaauaaacagccuaauccauucauuaggaauuuuuaguugaguuccagccucauaauuacuguacuuuucagaauugagccuggagauuaaucagauuguuuuaugugcuauaaaaguuggaaguuuuaugcaucugucucauauauaggugcuuucuuuuguauuaaauaagacacuggauuuccuuuagcauguguguguguauauauacuucuuaaaaguaaugcauauaauaaaacugcuguuaaucuagaaaaggauuugcaauuuuaaauauuuugcuauugaaggaaucacuuuuuugggaaugagucauccaaauggguagggcauacacucuucuagaccacaacgguaucauuaacugguauccuaguaacuuaagaauuauugggccaggcacgguggcugacgccuguaaucccagcauuuugggaggcugaggcggguggaucaccugaggucaggaguucgagaccagccuaaccaacaaggugaaaccccaucucuacuaaaaauacaaaaauuagccagguaugguggcaggcgccuguacucccggcuucuggggaggcugagacaggagaauugcuugaaccugggaggcggagguugcagugagccgagaucacgccacugcacuccagccuggcgagagugagacucugucucaaaaaaaaaaaaaaaaaaaaaaaaaaaaaaaacacaaaaaaacaacaacaaaaaaacggaauuauugacccugaaauugccugacuggcaaccugggcuuaauuuucuaguagauuaauggucuugcacuaaaggauaaaaccgguaccgaggucuuuuaucucccuuauauucgcucaggauucuagugaacuaguugcuaagacaagggaaaacacuggucuguuguucugaaccuaauugagucuuuuauuauguuaugacucaccuguaguucagauuuauuucauucaagucauguaaaauaacuacacugugguuuguuuugcuuacuugguucguguuucuagugaucugucaggcugaguaugcccauccgcuaaaguaugcccauggcuuuggcaggagcuugugcagcagagaggagaccacagcaguaaagggaagaggcugccucauuccauggccccuccaggcugaggaccuauucagaaucucuguauggaaacugaagauauccauaguaccuuaaacugggccauguuuagcacaacaggagauucuucucuuaaaaaugaaugcaucucucaaucucuuacucccuuguucucccacuugugagagaaggaagcauuaaaaccaacacuggggcguggcugcccacagagcgucagagacuguuauauuaauuuaguugccaacaucuaaaaauuaguaccuucacauugaaaucuggauuuuauuuuuuguguuaaaaaugggaagaauuggcaacauacagucuuacagcgcaauccuguuaggcagggugcaugugcugucuugucccagaccuaacuaggcccuugauaucaccugcuugaucccuguaacuguuaauguucucuccgucaauucaagcauuucuuuaucuguaugauuauuccucacuuugagcagacccaagacaugagaauccagacaugcaaaagaccuaucuuuucaguaagguaaugucaucaugaaauguccuuaaaaaaaugugauugauuucucaaacuuuugaaaggaauuagguaaaguagaauaaacuuugcuuuuuuugacccucuauccaaacauagagauguuuuccuacaagucuuuaaauguaugauucaggcauucauucauucauucauacggaaaacaaaauacuaacaagguuagucuaauuaacuuuuuucuuuuuagacggcuguucccaaaacuguggaacauggauucuuauccuccuuguuuuaguuuuccuguaugagugaugagaaaauggauaauuaucuuagucuagugaugcugccauaacaaaagaccuuagacuggguaauuuauaaacaauagacauuuauuucucgcaguuuuagagauugggacguccaagaucaaggugcuaacagauugagugucugauaaggacuugcuuucugccuccaagaugguguaucuugcuacguccucauguggcagaagagauggaagagacuugcucccucaaaccccuuuauacaggcacugaucccauccaugagggcagcgagcccucaugaccuaagcaccucccgguagcccugccucuuaauauuaucaccuugggauuuaaguccaacauaggaacuuuggagagacacauucagaccacagcaggaguuaucgaugcuuuuuucagcuguaaaauauauguuuuuuuuccaaaagaguuugaauuauagcacuuaaaugguggugcuguuuacaauaccaaguccaauagcauauccuuuaauaccuuuuauuuuaaauuacuuauuuuuauagccaguaauaggaagccuguuuuaaacauucaucagcauacaaaaguuuguuucuuucuuuugauuuuagcaauauuaaucacuuaguuagauagaaaacucauguguucuguaggguacagguggguacuuauuuauaacuaguggugaauaaguauauaauacagcauguuauucauuggaugguaaagacuggauguuguuggaaggaaggaagauauauuuuaagguuuuguuuuuggaaauaauuagaugaggcuuuuaggcauuauauauagguagugguuaaaagcauggauuugggauuaaggaagacuuggguuugaaucuuguuuuuaccuucucgaggccguuauaagacaagaaaacuacuuaaccuguucaagucucaauuucuuuucuguaaaauagcaaugguagacaguucuuuguaaggagauagguuuaaguaagaaaauguauguuaaaccuuuauaucgaugucuggcauauaguaaguauguaauagcugcuguaucuacaucauaauuauagcaguuauuuuaacguugucuaaauguauaagcauaguagauucaccucuuuuuuuuuuuuuuuuuuuuuuuuuuuugagacagaguuuugcucuuguugcccaggcuggagugcaauggcaugaucuuggcucacugcaaccuccaccucccagguucaagcgauucuccugccucagccuucccaaguagcugggauaauaagcaugcaccaccaauccuggcuaauuuuguauuuuuagcaggaugggguuucuccgugugggugaggcuguucucgaacucccagccucaggugauccgcccaccucggccucccaaagugcugggauugcaggcgugagccaccgcgcccggccagauccaccucuuuaccuuggcuuagaaucugaaauuguggaaguuuuaauaguuuugaauauuauggcuuuaagaaaauaugagugggaaauaauguuucuaauggacagagcuauggaguuagaaugcauggguucauucuacuucacauuuaaaugggacaguauuuccugagcuagagggcuguugugagaauuaaaugggauauguuugccugacauuuaguauauugugagauauaccaccuuuccuugacauauuguguuaguaaaagaaaauuuaugcuguaggaaaauuguauauuauccaucuucaaguagucuguauagauguuacagcugugccuagaagucagcagaaucccaagaaauaucuuuguguuuuagguugguuugcugguguuucacaguuguugugaugaaguaaugaaacucugugucauggauuuaauuuuagucaaguuuuuaaauguuacacuuuuucaauaagagacuugaauagauauuuuaugcccuaauaaaguacugaauacuugcuguaguuucaggauuccagaauugcauuaguugugagaaguauauggggcaagggcuaguguguaaagggcuuuuugagccccgucacauuugagcauugugacaaauagaaaaaauuauaguacugaacugaacacugauguauaaaguguuaauucugugaccugggucacaaauuuaguaaggaaagguguaagauuaaacauauuuucauggaaucucugaagguuccugaauccaauauagaagauaggcaacauuuguauugacugauagaguaagaugguuuuacaggguaggaagcuggaaugucccaagauauucauucaguuuuugguucacauaguauugaugaguauauaaacuucuuuaaaauaguauggaggccaggcacaguggcucacgccuguaaucccaacacuuugggaagccgaggcaggaggauuccucgagcccaggaguuugagaccaaccuggacaacauggugagacugucucuacaaaacauuuuaaaaauuagcggcugggcacgguggcucaugucuauaaucucagcacuuugggaggcugagguggguggaucaucugaggucaggaauucgagaccagccugggcaacagggugaaacccugucucuacuaaaaaugcaaaaauuagccaggcaugguggugggugccuguaauccucaggaggcugaggaaggagaauugcuugaacccaggaagcggagguugcaguaaagucgagaucgcgucauugcacuccagccugggcaacaagagugaaauuccgucucaaaagaaaaaaaaaaaaaagccggguguuguggcaugcaccugcggucccagcugcucaggaggcugagguaggaggaucacuugagcacaggaaguguaggcugcagugagcuguguucgugccacugcacuccagccuggcugacagacucugucacaagaaaaaauaauauaguguggggacaccaaccuuuauuuuaugugucuuaauguggugcauuagucugcuuucacacugcugauaaagacauaccugagacugggcaauuuacaaaggaaagagguuuaguggagaacucacaguuccacauggaagccucacagucaugcggaaggcaaggaggagcaggucacgucuacgugaguggcggcaaagagagagguugugcagggaaacuccuguuuuuaaaaccaucagaucucaugagacucacuguuacaagaacagcacgggaaagaccugcccccaugaucgaauuaccucccaccagcucccucccacaacacaugggaauucaagaugagauuuggguggggacacagccaaaucaugucaugugaauuaggaagaaauauaaaccagcauaucaaacaaaccuaggguuucacaaauauugcuuaggaugaggugagguuaaaaaaaaaaaaagugaguugaucauaaacugaucuaaaaaaauaguacaaguaguauuaugacgcagugccgcuaucaaaguaguauagaaaugaccgaaguuugggaaaaacuguuuuggacuguccucauaucauggaggaaagacugguuaaagauggggcagugucagaagaaaaauaaguuuuaggccggagguaauuuuaaacauuuucuugccuuaccagcggauggcuuccuugugcuuaaagaacuuaaacaguugagaauuaaauuuugcccauuauuuuuccccccccuuucucugugcaaccucucugccccuuaauaaauguuuuugguacugacuacugcugcuccugcuaauaccauccuguagaaauuuuucuugagugaggaauaguuuuuagaaggcuuuuaugaugauaacuuuuaaauuuauuuuuaacuaugccagcagguuauuagauauauagguucaaaggagauugaggcuggagucuguucaaacauuuucagaggugaagaugacacaggguucauggagauuuccuucaugguaccagaacagggcaggguuucacugcaugauaauacccauguuuccauugcuuguagaccuaaucauuuuuacuuauugauuggcacugugggccaagaucgugacauccauccuaauaagcaggucucaucaaaagccuuagaauggagaaaauuuuaauaaugcuuuauuaguugguuaaguaagcccugauguuuggcuuucuagugaccggucauugcccugcagacucuguaaugggacaguuuggcuggguguagggggucaugccaggcugaggugggaggauuacuguaggccaggaguuuugagacuagccuaggcaacauagaccgccccccaucccuauaaauauuuaacaauuagcugagcauaauggugugugugcuuguagucuuagcugcugaggaggcugaggugagaggaucacuucagcucaagagcuugagguuacagugagcuauaugauugcaccagugaacuccagccugggcaacacagugagacccugucucaaaacaaaaacaaaaacaaaaacagguagggagagacaaggagaaggguaguacugacauggccugucuuuacuuuccccucucagcccuggaacucuccacagggaaagguuuuuuguuccuucuucuugucuaauaaauggcuugacuugagggguaucuuggaggcauucucaacccaacccugaagguuuaucagcacuuuccugguggacagcaccucagccucugcccuggcuccuuucauccucauccccuagagccaggaucccagcauuuacaaauuaagauguuucucccacauuaauuaauucagaauuuauuagaaacauacugcagacacaaaggucaaguacacgacggcuucuucagagcugaagagucugcagcuguuuacgauuauaucagaggaggagauguaaucaaagauuguacuauacaauuauuaaaaguuacagaauuuguuacuguuuaucauucccuuuccccuuucagaggacauuuucacagagauucaugaaauaaaaguuugguuaaugacagaagugggaaaccuuaguaggauggaagaaaagaaagaaagacugaggcuuuugugccaugguaagaugguaaaacaauaaaaauaacaucugcauuuuauugagaacauacucuguguguacaggcacuguguuuaagccguuuccaugcaacaagcuuaauaguuggagaaucuugcucauaagcaccuacccugcacagccagaaccacuauggauaacuucuacaaacaucuccugagauuuuugagaauuccuguuugcaaagucugcugaaguuguucccauaaacugcaauaaaguguaacuucacgagaauuacuguauguaucccuugaguggugagugauggacuacagugagaaguggauucuaggguguuggauucacauuuguggcuaaccaagauuacaaauucaugcauguucuggaauuucaggggcauugcuaaaugcacagagucaggggccugcuggauguguuuuuaguggcaauaaguauuacccagucuuuucugcugcuguaagcuuucagauagagacuugagagcaaaaaggucagcuuacccuuuguaguuggaacucaguuccuguagaauuucuuuggaaacauguguuucuaauaugucagaauugguuuagcuuaagcuaaaaagaaaauuauagccugauuuguuuaaaggaacaaaaaugucuacaugccacaguuuggaugcacagagcaugguucaaugcucaguagacuuuuaugcuuuuuauuacucggauuuuuauuucucuaucagugugcuagauaaaaaguaaaguuuuauggguaguauucuaguucuacauagaaguuuuauuucucauauaguuuuuucuuauauguaaaauuacauguuaugagcuacuuuaauauuaacaaguaaccucaguaaaauacuaaagugacuguuaugggauaaauaacgaaacuuaggaaacuuaggaucauuuguuuugaaauacauaauacuggaauuacugaauuuuucccucuagaguuuuaaaauucccauugccaguggaguggggguggggaugugugcacguguguauuguuauuuuuguuccugagauugggcuauaauguaagcaugaaaauugccccccccccacuccaugaauaaauugccuuuauaucuuaucuuacuaaugauaugcauuuacacauaaugccuugugauagaauuaauucuaaaggaaauuguuaacuagaugagauuuuucagacacugccuauuaggcagguuuuaauaggaacucccacugguggcuuaacuauuuugcuugugugcuaucaucuacuuuaaaucccauagauuuuuccaucagccuugaaaacaaagguuaaacuauuuuugggucuucacauccugguuuugcagggagacgggagguauggaggcauugcccauuucauaaagcuguauguuuuugaacuacgcacauggugcuuugcacgaaucaaaacugccaaagggacagauguugccaauuucaaauguacagggggaaggcaaauauugcuaagcaacgguguacuugagagagcauuuuuaggagcagagccaggggaguuaugccugggagcacucacugcuucuuauggcucaguacaagggaagagauucaaaguucuuuccuguaagggccgccauugcagccgccagcacacgagacagugaccuaguggcaccgauuagggcuggcaaggggaugugugaaaacaggaaagcuuuuuugccaugugggaaggcaguaagacauguucacagaggugagugccccacaguguacagcugccccacaguaaguaugcagcagcuggagguucagguggggaggauggaggguagggaaauaagugagaggugaggccacaagagaaaguugaugugucuuguuucucuucccccuucucuucuuuucuuuugccccccuguguuaggggcuaacauggaagaagagaaggaucaaaaugaccucugugguuuagugcaugaccuuauaaacaagguaaauaagcuugccagccauagguauucgucccuucccauguccccucccucuguauaaacuugauagguaauagacagguggcgugguguguguggccucuuuuuuuuuuuuuuuuuuuuuuggcuaccacuagaggcuuggaauaccucuugagauuugcaugguuguuaguuuagauuauggauucauucucucccucccucuccuucuguccccaucuccucucuuuucugucucucccucccucccucuccccuucucccucucucucccuauccucuuccucccucccucucgucucucuuccuugcuuucucuuuccucucuccaucuuuucucuccucuccccuccucuuucucuccccuccucuuucucuccccuuucccucuccucucucuccucucucccucuccuaucaucucucccuccuuucccuucccuuuccccccacuuccucccuuccuuuuuucucuucuccuuccccuccuuucuuucauuuuacugaaauaauggugagagugacaguagagaaaauauaacuuggaguuuuguaucuggagaaaaucacagcauauucuuggcaauauauuugaaagaaauucaaaacauaaguauuaaauaagguauuccuuaucacucaggauuuuuuuuuuuuuuuuuuuugagacggagucucacucuguugcccaggcuggaguauagugugggaucucagcucacugcaaccuuuucccccaacccuguucaagcaauucuccugccucagccuccugaguagcugggauuacaggcgugugccacaacgccugacuaauuuuuuguuguugguuuuguuuuuauuuuuguuuugagauggagucucgcuuagucaccaggcuggagugcaguggcaggaucucagcucacugcaaccccugccucccggguucaagugauuguccugcgucagccuccugaguagcugggauuacaggccugcgccaccacaccacgcuaauuuuuguauuuuuaguagaaacgggguuucaccauguuggcgaggcuagucucaaucuccugaccuugugauccaccugucucggccucccgaagugcugggaguagaggcgugagccacugcacccagaccuaauuuuuguauuuuuaguagagacuggguuucaccauguugaccaggcuggucucgaacuccugaccuugugauccaccugccucggccucccaaaaugcugggauuacaggcgugagccaccaugcucagccuuuucuucaucuuucaaacucuggacuugaauuucuggaucacuuagcaaauguuuauggcuuuuaaaaaucuuccugaaguaaagcuaaaaacugaaaauauuggcagcuucucagccuaaauaugauguaugugugcguaugcauuuaugcaugugcaugcacacuccauccaagauguuauuuguuguuucucauaagaaacuuacaauuuaagucaaauuuaaaagauggugggugcuucuacccaaguuuuaacauauaaacaguauuaauuuucaccagucuaggaaaauuucaaaauaauuuuccuucaauacagacagguguacuagagaaauuucaguguacuucuagcuuuaugguucucauuaauuuauucagcauaguuugugaucugucuauauuuguaggggguguaaauuuaugugaugaaaagcuaauaggcgaggacgauaguguuuccacuuuuuacuccccaggagacaggaauuguuuaagguuagcuauagugaguccgcuuaagucaacgccaagacaacugagaaacuggcgaaaaagcagugagaaaggaagaagaacccccaauuuuuucuuugauugauuugaauguaggcuaguuauaccuuuuuggcuguuuuuaguaagaacuauguuauaaaaugaauuggaggaccuguuaccaccagacuuaggagguaguaguuuuccagugacuuuuaauuucccuaccagucuuuuuuuuuuuuuuuuuaaauacaggguucuagguuaguguaggaaaaaaaacugguguauuuuauuccacaagaagcuuuugguaaauuauuuauuaaggaaacaacuguuggacauugagauggcuuuuaaagauuuaccuagaagagauaauaaaacagauaaaacugaucugcucaggggccugucuucagucuuuucaggcucguuuacugugguguucaugccagcgcagccugguagacaguguugcuguggcuguagaaauaacacugcucauuuuuauggaggauauugcuguaugccaguuaaagaaauucaaguugaaagaccuuuaaauuuuuuuuaauaauacacuuccuuccccacccccaagcugucaccaugauuaugaugccaggaaagcagugcgguggcuccaggauuguucucccaugggcugugugccagguggaugaaguagucaggagggccacaguuggguuuauguacaaccuagauaucaucuacuugugcugguugacccuccauuuucuaaaggcaauuuccaaagggaguugcuuuuguuguuacuauuagaacgguugccuuuuuuccauaugaucucuucucugucacuuagguucuguauucuauauagaaaaguauggagggaaagggaagaaucaggaaagauagugaaugcaagaauauuggggguuaugaugugguuaaguuagauugugccucaaaacacugaaaagauuggaguuucgggucaggagcucuggauuaaaggccaacgggaaucuuuuaaacuucuugguugugugugugugucggugugugaagucagaggcagacgaugagagaaauaaauugagauggagagaaaauaauaugaaugcuuagaagauuuuaaauucagggcugggcgugguggcucacgccuguaaucccagcacuuugggaggccgaggugggcggaucacgaagucaggagaucuagaccauccuggcuaacacggugaagacccgucucuacuaaaaauacaaaaaauuagcugggccugguggcgggcgccuguagucccagcuacucaggagucugaggcaggagaauggcgugaacccgggaggcggagcuugcagugagccaagaucacaccacugcacuccagccugggcaacagagcgagacuccgucucaaaaaaaaaaaaaaaaaaaauuuaaauucagaaggcauuaagaggacauuuauuuuuuaaacgauuuucuccuuggcacuuauuaaauaccuauuuaaaauaaauucaagaauaacuuuuauauaucuagucugccccuuguauuuauuuauuauuuauuuuuauauuuauauuuuugagauggaguuuugcucugucucucaggcuggagugcaguggcacgaucucagcucacggcagccuccgccuccuagguucagcaauucuccugcuucagccuccccaguagcugggauuacacgcuugcaccacccaccaccacgccuggcugauuuuuuuuguauuuuuaguagagaugggauuucaccauguuggccaggcuggucacaaacuacugaccucaagugaucugccugcccucggucuuccaaggugcugggauuacaggcgugagccaguguacccagccucuuguguuuauuuaaaaagaaauacuggcguuugucgaaugauggagucuuauuuucaaacuuuuguauuaaauauauuuucgcuuucaccagaucaguaaaucaguguaucagaugagucuugcuggaagucugauguaguuuguguauaguuuuagaccaaauuuauaugcagagauaacgcaggaaaagauaauuaagucuaucuaagauucagugggauuaguaagccuuaaaaaaaaaaaaagaccaaaucuguuuauugauagguuauagaaaagcaaaauacuuccuuaaauuaggcacuuuuugauaggcuuaaauaaaugauguauaacuguucaugauguucugauauuaaaugaauuguacauucccaggaugaccuugagcccuuuuucuagacccuaguaauuaaccugauugcucauuacccagcauuaaagccaaaaaaaaaaaaaaaaaaaaaaaaaaaaaaaaaagcgggggcggaggauuuacuuguucagaauuaagaugucaaggacaaggucgucuuuauuugccuucucucuuuugcguuuguuauagugucaguaauccccaggguguuuggggcucagauugcuuccucagaguauauaugccucuagccuaccacuucaauaauuuucuguccuuuuuucccccguuuuuuuuguguuuuguuuuuaaauaacgaugccaggagacagaaaaccaacaccuacuccagaagaggcuguugagauuacugcuggaauaagcccaggauaaaaucuuuauguccuuucagacaaagcguggauuaaauaguuuaucugacucauaugacugcaguuucuuucggccucauccagaaacugauacaaaguuguuuuuuucuucuuccuuuuucuggugcuucuauaaucuuagcuuaugcucagcugugaaaaaaguaaauguccaggcaggcacucucugcaacauagaauuaaacaugcuuccugaacauuguuugcacuuucauuugacagagagcagaaauacagguuuauguauccauaaauccugucaugguugacaaaguaauuuaauaguguuuugacucagaaccauccguuaauacgauuugagagacagaguagagugcucgugugugugugcacgugcgugugugcauguguguguaggacuggauggggugggugcagggcaggaagcaugugacagaacaccaccacgcugcaguuucacacccucccugcagcaauagguuuuaacugaaaagcuacuacucaugcuuugcaaauugauagucccacugaaaaaaaaaaaauuaaauucuuccgaaaaacacucugagguuuucgugagcagaauugguuguagaaggggaaauagaucauauagcuuaggccauuugaaaggacuugucaguugacuauugcuggaauggaaccagugucuagacuuguucuuugugaugccuuuaaaaaaaaaaaaaucagugccuuuuaaccauucuuacuuaaucauucauggcugcugugcccacaaugggcuucauggggccucauguggucuuucaucaaaggcacaguguuuuaaagucuuagaccauuggggauucugauuccccuuauuacguggugaaugguaaugguucauagucaauaguuaggaaguuggugaauaacugagauuagacauuuacugucaaacagugguaaguuuuuuacauuuguuuuucauucagguacuuuguuguuaagugaguuuaaaccuaucccagcacacccuacuuauuuuaacuuuugcacuguuaguugacauauugucauaauauguacugaaaacauuucugcguauaaaacaucaacacugaauuguaccuuuuauauguacuguuucaugugacuauacaggaccuugcaaacaucaaaaauuauauuguaugugaucucaggauauauaaugguaacaaaaucagugaauccagcauuguuacugcuucucucauuauuugcauauucuuaucaagugaguguuuacaauuauacauguggacaacaaccacucauuguuuucauuuuuauuuaagccgggucuuaagaacuggaauccuugguuucauaauuaaaagaggcccucuuuguagagaucaaaacaaaauuuccagaauguuuuaaguagcucaguuaaugcagauugagccucuacaaauuuuauaugcuuuagaaaaauaucuuuaugaugccaauuaugcagauuaccucacugguauaaucaaaaugaccaacuggaaagaaacaauaaguuuucuaauuauucauauuaaucuuuaaagaacugcuauuuuaaaauacuucuucccauuggguuuuauaaguuucagugaugucuuaggauuuaguggguuuuuuuagcuuguuuuugcuuuaguugaugaaagauaagguaauaucauuugcuuaugaaagagcaauuuaccuaaagguaaauuuaaaaaaaucaaauauauaaauaugugugcauauauucacuuauauguacacauauauacacacguauucaauauguuauauauauaucuccuaucuacacgauauauuaggcucucauuuauuaaaugaacuggggugccagcacaucucuaacaugaucuuccaguguuuauccuggaguauuauuucuucaucuucuaucucaaggaagcguacguacauccuuucuuuacccaaacaugcugccugauauaccuacccuccccaaccugacguucugauguuacugucauaucugaaauuuugcauucugagaaauuuauguccccaaacugcauuuaggcaacuacucuuauaggugaaaacaucugauuaggugguagugguugauggauuauagucacaagauaauacuucuuuaaaauuugaagacuucugcaucuuaaaaauaucacuguucugugaaguugucuggaguuuuaccaauaugagcugacauauauugcuucccaggaaagagauuggaaauucaccauaaaacucuaauuacuuuuugguuaucuuauguaucugaauuuuguuugagaugucaugacaugacaaaaucgaguauucauuuuauaaauauuaaaugagucuagaauuaugcuaaggccuugugaggaaugcagagauuacuaaacccuaguuccugcuugugggaagccugucuggaggagaaagauuagaacacuaaggguuacaauccagaguugaaugugauuggagagucaagggagggaagacuuccagaaaagggcagccagugguugugaugcacuacccccuucuucuagguucccccaauaggaguagaauuccuuguucguuucauaauaaauuuuuguugggagauaacuguaggugaccuagagauuccucauuauuuuaaaauaaucuuuuuuauccaccuuauuucuccucucccugaaaaaucuguuuagagaacuauagagauucugcaguuagggagauucugcaguuagccucauuuguguuagucuucacauguggcaggcaguuugacguuaaaaagagucagggaacaugaaaguaauuuuuugcuacauauuagagcuuaucacuuuuaaggaauauccaaaaccuuuccauuauuuaaagauaucugggauuagaugaaguguagcuaauaauucuuaagggaggauuuaacaguuaaaguugguuuugcaacuuaauguaauaauacuuuauuuuuaggaaagcuguucagagcaccuuauuccuuguuuuguaauccaucaccccuccauccauauuaaucuuuagcauggcuguuuuuuguuguuguuuuccuuguuuuaauuuggacuauaacugugcucauauaucuguccagugauuuaaaaaaauguuuauccuaaaauucuggguauacagauagauggguaguugcccauagggcaugaugcuucugaaaguagaauuacugcuggucccuuugaacguuuuccagcugaaguaggcacacccaggcaguaugagcauguucuuggaacaggcuuagcuauuuauguaauuuacucugugucuauagaacacaauuuuaugacaaaccuuguucagccaggccuuuuagucuccuccucuaaucugucucuuagaaaugaugauuauggugucuucauauaaaugcauguauuuauuuguauggaauuaguuuuaacaugcauugucuuauuucuuccucaaaacaacccuguaagauuauguucauuucaaaugugucuucucacuauguaaguaugacuaacaaaaaggagagcgagaauaaaaaacuucucuuucaauaacuuucuagucuaguuuggaaaguucgugaaguuuagcaagugaacacugggccaggccuucagagcaaguccuguggcaacucgaguuccauuagggaaggcugacuggaaaucuguuuuguuuuguuuuuuuuacaaaaauucaguguggcguguauuacguagggugugcccagagcaccaagguguaagcuggggacaguuuaacauagguguguguucagaguaagguaaguuacauagaggaaggcuaauagaaaauuuagcuguacuucgagaacaggcuuuugaucccuauuuauuucaaucuaauauuuguguuuuuaguaaugaauagguaauaggucagaauuuaaaagguuaaaaaaaggauauacauugaaaaucuucccccuauuccuucccccagccuccauuccccagccuuccuuucuggaaguaauugauguuaggacuuucuuguguaucauucccagugguauuuuaugcauaguaagcaacuccauauauauguuuucuucucauugauacuuucuucauuuauagaaaugcuggcauauaaugcaucuuuuuuuaaaaauuuauucuucuaaacaauguaucuuggagauuaccccaaaucaaugcaaaaagagcauccuuauucuuuguuguaguugcguagcauuuauuucuuucuagguggcauguaccauaguuuucauagucaguuaccuguagauacacauuuagauuguuuccaguaucuugcuauuugcaaacuaggcugaagugaauaacuuuguacauauuuuuuuuguacauguaggaggcagugcuaaagguuagagaagugucuguguaauuagaauuugcugacuauugccaaauuaauguccuuaaagguuguagcacuuaauccuccuaccaaucaugggauuugagugccuauuuccccaugucuaucucauagauggaguauuguuaaucuuguggcuguuugccaaucuacgugugaaaaguaguuucucaguaguuguaauguuuccagggagaaaacaaugcaaaacaauuaucuuuuugucucuuuuauguuuauuuacauguaguuuaguuuguuaauuaagguguugcuuuauaauucaggcagccugcaucuucuuaagugucuaaagccauaagagaaacuuaguuucaaauucugaguuccgggacugaaaacaugccagccauuguuuaugggguugccucuguguggcuggcacccugugauucagugaggguucuggcccuaacuuccauggaacauauuaucuagagggaguagagaggaugcaauaacagagaauguacggauaguuacgggagcaucugcaagagaaccuggacaguuuugggaguaagggagcaucagggauguuuuccaaaagaugucuuucaucugcaaccugaagcuuuaguaggaauuaucccugacacagauggaagagagaagagggcuccagaucggggcaagaaaagugugacuuaucuaacuagcgaguuggggguagaugagcagcaaauagugaagacugaacaguaauccaaaagguggugacacauuugaagaaaaauagcuuggacauuuauuuuacucucuuaaaaauuaaacuuuggauagauaaccuauugggauuuuuuuuuuaagcugucaugcuguuaaagaaugccuugauaauguuggcaccgccuguuauuccauauaucagugccuuuugaugguuuugaaaguguguuuuauuagauauguuuuaauaugaaaacauauuugaccuucauaccaacccugagaagugguuagguuugguaauacuauaccuucucacaaugaggaaauagucccaaagaggaugaaucuuauccaagauucagcgccagucuucagcagagccagaucuagaauccaagaucuuuuggcuucccucgucagcacauugccuuugugcucucucuauuuccugguuagugauaaguaagccuuuuugagaauagcauuguuauaaaaaugccgcucuguugaaacuugagagacuuaaaacacaauauugcaagagccucccagucucaguggcauguuucuucagccagcucuuuuuagcuuauuaaaacaaacugucaugcuuagaagacauucacucacauauuuuauuuugguaucagugcguuuccuuacaguuacacaaugucauuccaggaggagugagaaaucaggccacggccagcauugcugccuuuucugguccgaagcacugguaguaggaagaggcaguuaaaugugaauaccaaaaugcuucuuuguagaagcaaaggaaaaacguagcucuugaaaaaauguuuuagguuaugcauaggacaacuggaaucacacacccuccuaaaaugcuaauauauuuguuucuugcagcaguguugagguuuuuagaaaacugguauaacaguauucugagccagcucagcugcuucagagcuuuuguguguccuugcauagacaacuuaauuucucuaggauucagucuccucguuuuauuuuuaaaauuauuuuauuuguaaauaccucaucguggacuccaaaagcaugucuccucguuuuaaaaacuggcauaauaccuaccacaaagguugaugugagaauuaaauagagcuuuauacagaauucccucaggcauuuuuaaguuuauguaauagggauguaucuuacaguugauggguacauuuaguguagucccccuaccucccaagcuaauaauggugcgucguacaauugaugguaccaaauugaggugauaauaacauagaaagaguuuaaugcaacgugaaguacaaaaugcauucaauaaguagcugcuaucauuuuuuuaaaaauuaaauauggcugcuuguuaaggccauaucccaggaggaaaguguggucucugcugggagguuggucuacauacaggaagccagaugugugagauggcucuagauaggcagaaggggagagcucgugcccucuaggaaccuauuaauagauaucaagggugggaaaaggcaguguuuuguggucauguuaaagucagugucuauaccauugaggaaagagcuagccagagaaggacuuacaaacuagauuuucuugauucaugcaacuaucauagaaauguuuauuguugcuuuuugucauuuuguguucuuuaaggacguuguacauugaaugucuucagccuuaucucaguuguggcuuagagagagcuggccaggaccaauuguuuauucuuugaccaugguguuaaagggagagucuggcuccuuuuaguaggaguagcaguauuuggcuggagacccuauugggagaguggauuuuaggaaagggguuaagagccaggugcagugucacacaccuguaguuccagcuacucucugaaggcugagguaggaggaugacuugagcccaggccagccugggcaccauagcaagaccccaucucuguaaaagaaggggauuaggggauuaggauguaacgguuuaacugcuccccuuuuggaaaaccuccuuccaguggcaugcuuggaggugccaaguugcacuuuaugagacgaggcagccuguccuuguagaucuuucccuguaaacaaauccaaaagaucugucuuguaguuuaagugucucuaauuaggguggcgagaagagugaagaugugagucucagguagauggaacauaaaaugaucucauacuaugcaaacuuuucaguagccucucuuuuaaauguagguuuacaauguguuuugguauacacaaaaguauuuagggauaaagggacauuaacucucuaacuuacucuuaaacaguucaaaauguaggugagcagaagagaaaaauauaaagcaaauguaaaaugcuaacauuugggaaaucuggguaaaagguaugugggaaauccuccuacuggcuuuuguaguuuuucucuaaugaaaugaauuuuuuuuuuuuuuuuuuuuuuuuuuugagacagagucucacucggucucccaggcuggacuacaguggcccaaucucugcucacugcaagcuccgccucccagguucacacgacucuccugccucagccucccuaguagcugggacuacaggcauccgccaccacgccuggcuaauuuuuuguauuuuuaguagagaugggguuucaccguguuagccaggauggucucuuaucucuugaccuccugauccaccugccucagccucccaaagugcugggauuacaggcgugagccacugcgcccggccguaugaaaugauuuuuaaagaaaaaaguauguauguugaacaucuuuccaugcaaacaccuauguuuauguuauuaaaucugcaugccauaccauuguacggaugcacuguaaaggcaguuagcuagaugcauguuguuugccauuugcucauuuccaauuauuugccaugggaaacagugcuuuguggagaucccuaaauaugauaugcccucauauauuuggaaugaaaucacuguuccccuuugaaacaccuucacucccauaauggacuugacaggaagauuaacaguaaauuaaccaacuaaugcuugaaucuaagaccuuauuuagaauuuuaaauggguuaaauggugacuauuaguaucuggauaaggucaauguugcuaaucuaaaauaagcucucaaaauuucuucaguccugguucauccaacauaacaaaacucuuggggaaaaaaaacauuucggcgacaugaaacaucuuggcaaagugucuacugcuugaguaauuauggagaucagaaagaagucuuucagucucuugaaggguguggcuuuuugaaaucacuguguuggaaacaacggacaaaucuuuucugccuucuuuuaaaaugugcuucacuauuuuuaaugguugccaaauauuuugauuggauuccuagucucauuccagcaacacguaggaugaggggaauauuuuuuccagacucagcacagucaugugcuuguucuauugauucaccuucgacuuuuaauuguuauuuuucuaaugauccauguaaauugaaaucguagaauaguauuacauuuacccucauguaaaaacagcauuucuguaucuuaaguuugugcuaaaauagagcacaaauguuugguccaguuuuuagguguuucuuaaugguuuuaaaaacaaaaaggccugguuguuugcauguguaaugcuagagaugauuccaguggauccugccagauguaagggacacccuugauucucuuugguuauaccugacuucaagacucuuuccaggaaauuuacauguuuuaaaaacagacugcaucugaauuuuuuuuuaauuuuuaaauuuuauuuuuaaauuuuugucuguuuugaaacuggguuacgagacuggcuaauuuuuguauuuuugguagagaugggguuuugccaugaugcccaggcugcucucagacuccugggcucaggcaaucugcccgccucggccucccaaagugcugggauuacaggugugagccagcacaccuggccuacaucugaauuuugacauuagauucaauuacaggacggugugaauguuuguaugcucuauuuccuuuuucuucauccauggagugaauuggaaugagggaaaugguagauuaauaaacccuagauugcaaauuagcaaccaguucuauauuaaauuacacauaaauuagaaccaagaacaggaaagaaccccuugccaucuguucucuagcugcgagguagguauuaaauggaccaaaaagagcagaguuuuaugcauagcaguggcaguaaugggaaagucauauguuguauaguacuugcuguacugugcccaugaugccuggcucaugaauugacacagagcaaguugcuauuccauugaaaaccauauguuccaugucucuaguucagaaaaaauaauugauuuuaauuuaacuuugccuacuuucuuugcucuuaaaaauauguagacuguaaaaugucauucccuaggcacugucugguggugauaccagcagcagcaauaaucauuauuuguuuagcuggguauuaggaagagguagaaauaguagaucuuuccucuaagacaauaauuaaucuccucuacccuuacagucuuucucugaaaaaaacuuugugugcgucuguguauguauauaugcauguauguauaaagugaaaugcugacuuuaagugagauauuuuuaacuuuaaaaugaauuuuggcaggcuagcauauaaaaauaaugaagaguuauccuugauuggacuuagcuccuuacuuucgacccacuaauguguucagaugaucaucaucuuugucuucauuuaauguggcuuauugguuagcuguugcuaugagguagcugacuguggcaccuauucuaaucuuauuuuguacaucucuuauucccuagguuuacuaauauacuaauuuucuuuaauaaagaaauuuuagaaacuuuuaaccugagggucaacaguuagucugccauugucuccaucauuacuguguuuccccacaagauucaguuagauuaaucucucuggucuuauuucauccaaauguaaaguuguuguuguuuuauauauauacagccagagugcaguggcaugaucuuggcucacugcagccuccaccucccuggcucaugugauccuccugccucuaccuccugaguagcugggaucacaggcaugcaccaccaugcauggcuaauuuuuauauugcuuuugguagaaaugggguuuugccauguugcccaggcuucaaauguaaaguucuuaauacuuagcuaguagaagguaagccuugagaugaguauugcugcauuaauacagucauccaccaguaccaucacucuugacucugguuugcuaaccuuuuauuuuuugcuuuucacuuucagcagaccuacuccaaugaaguccauuguguugaagagauucugaaggugaguucacuguuaaucuuucucauuugaagaaauauuuaaguagguaggcguacauccauuuacuuucacuuuaaagaacaguugccauuggcugggugcgguggcucaugccuguaauccuagcacuuugggaggccaaggugggcggauugcuugagcuccggaguucacgaccagccuggacaacauagcaaaaccccguaucuacuaagaaaaauacaaaaaauuagccaggagugguggcacaugccuguagucccagcuacucaggaggcugagucaggccuccugaacucgauugaacccgagagguggaggcugcugugagcugagaucacgccacugcacuccagccugggcaacagaguugaaacuaugucuccaauaaauaaauaaauaaauaaauaaauaaauaaauaaauaaauaaauaaauaaaaaauaaagaacaguuguuguucccaaaccccuuuuaaccauuucucccccacucaucuccaaaggcaaaaauaaaccagaauaguaacagaaguagucuuggaacguaauugaauucucuaccagauuuuauuaauuaaauugaagucuacaaacugcaagacauuuggaccagauuuuuauggcaucucucguuaaguuuuucugguuguccauaaaggcccaggagaguugcucacuucccagagaggaaacuuccuguauugaugugugggaggcaccagugguuaaacagugcuugauuuauaccucuuggcguucuguaggugauaccuaauaccuauggccucauacauacagccuuuucuucagugagacgaugaaauuuuaaaggaaugaaagaaaaauagugggaaguagauggucaucuuuagacuuaccuugaaggauuacuuuuugcuuuuguuuauugaaacuaugccaugaacauuugugcuuccacaaauaugucauugaauacauuacccacuuguucaauuuuucuuguacaaggaugacagauuccuucuagaacuuaauuccaggggaaaaauguuaacuuuccucaugaacuggcauucuuucuuuuuaucagagaagaauuauauauaauguuucccauuuugccuuuaauuuccaggaaacccagagcuuaauuuuaaugcucagguacaguaauuguaaaaacugaggguuuuguguauuuuuuaucccucuucuguggccuuuaauuugcuucuaggucaauuuuaaugauauucuugucuuuuacuguaggguuucugacuuuuuucuucuuuuuuuuuuuuaauuaguagagagauguauauaauaaaugugacuguuaauuugaaucacuauugcucauauuuucucaaaauacauuuacucaauuuuaguuuuuuaacuuuucauuuuaaaguauuaagugauggugguacuaaaaccaguaauuaaguauauugguuauuuccucacuugugaaauuuuugacaguaguaguaucuaaccaguuguuuggaaaacagcuuguuuuuguuucacagucuuuugucccauuuuguaguuaggguuuucugagaaagaaagaaccucuagagaaacauaccuuuuuuuuuuuuuuugagacagagucucucucugucgcucaggcugggcgugaccuuggccacugcaaucuccaccuccuggguucaagcgauucuugugccucagccacccaaguagccgggauuacaggugugcgccaguacgcccugcuaauuuuuguauuuuuaguagagacgguguuucaccaucuuggccaggcuggucucaaaugccugaccucaagugauccacccgccucagccccucaaaguguugggauuacaggcgugagccaccguaccuggcugagaaacauacuuugaacugcuaacagugaggaauuuuugucaaccagcauguaagauuaaauaaguuaccucgauuacauuuuuuaucauccuuuuccucuucuguuucugaaauuuguugguaugguaagucguaaacauacuaaggaauuuaauuauauacuguggccuuggcauuuccucugaaauugugcguuauuuguucuaucauuauuucagaaguaaaugcaacagugcagguuuguugucuucugcauaugucagaugcuccucuuagguuucgguguguguugaaauaagacaugucacauccuuuauuuaggaauggugguauuacagcaccagacaagcaucuuuaauugaaggaacccauccguccuccuucccuucccacccaggaucacguuagugaauccuugcuuaccucgaaaugcuugagagagagugguuaauguauaaaucaugcccauuuaugauuuggaaaucauaacuugggaaagcaaacagaaggacguccaggacugaacaggccauaggccuuuucauauuggagucugccccuucucuucugucugugaccucaguuaaguuauaggucgcugcugggcuuugguuuccucauugguaaaaugaaggcccugggcuagcggaugaucuccaggguccauuccagcucuuacucuugacgcugacccagaugcuacuuuccuuugccucccgguucccguucucaucuuguaccagcaauuuauuaagauugccaggaauccaaacacaaaucuuucugaugggugauagaggcaguaaguaguuuccuaacagagaaaaucaaucauagaagauaauguuugguucucuggggucaguauuuaagggggaaguguuguaaugaaggggaagugguggcccauaacuccagcaggcuaauggaguaagaagauagcagacauacacuguuaguuuucagggaauggucaugcacuagggucuagaaagggcaacaugcccuuggugggugcauggagacaccucagauuuucuacuuacaggcaagccuggccuccacaguaucuugggggauuaaugugguaccagcaagcauuaccucagugcagcauuuccaugaugcuaguacaaugagugguagcacuauuuauauguucauuuguuuauucaacaaauacuuguuaagccuccacagcacuaggauguuguagugaauaagacagagugcuugcuuucauggagaucagaguagggaagagaaauacauaguguuggguguugauggugcugugaauaaugcaacaggccaguaaacagaaggcuaggcagagggaagaacugguggaaaauccucgaggugguaucaaguugguguauuagaggaacaauuagaacuagacagugucuccagagcaggaugagcaaggagaaaaagacaguagcuguggggccuggagggccagggcugacguaggucccagugauuugucucuguucaugugacaagucauuguuaagguaggaagugaaaucauggccuugugagucuuucugagcagccucuucuccuuaauaauggccccaguucucuuaagucccucuaguaagcuaggcauguagggaaguauauaaauccuuucagacuaccagggaaccacuuaggguuugaaagaauuuauguacuuuccaacugccugauuuaauagcugggacagccuuaggcauuuggugacuaaaagucauagauaccauugagauuccaaauaaauuauugaaaaacauaagggugauguuuucagauaccuucucaauuaauuauuacauguuuuuguguuguaacauuauaaugguucugugccuuaaaguauuaccaaguaaauaaaacagcaggaagcucucuuuggugcaguauugaaauucuuuuaaaacuggacuuuuaauuaaaaguuguaaugcuuuuaauuuauuaagugccuucugugcaguauucauucaguacgguacauaaaguacucuuacaauacuuugaaaauaagugguucuaguuuaccucuuagugagcauugaggauuaggguucagaugacuuacuuaggcugacauggcugguaaggauuggaguuaggauucaaucugggucuuuggcuauagccauuauucuuuccaguauauuuuaggaaagaucuccuguuguguccugaacaaagcagauggccagucaguaaacaagggcacgaguucacuuuuaacaaaaauuaagaaagccggcaucacuuacauuacucgucacugugcgaggucgcugcugucucuccugaggcugugguaacccacagagcugcaauggggaagggcaacgggagaccugcacauagguuggaaguggaaguacuugcuacagugccaucuccagcuguugcaaggaucaaauggcauuuuuguggagauagguuagccaggacuuagaaaagaaugaggcguuagaauacaucauguguuauacagguggaguaauauagcaugcuguggggucgcagauugcugguagaguuguaugucaauuuuuuuuuuuguuguugagacggagucucgcccugucacccaggcuggagugcaauggugcgauccccgcucacugcaaccuccaccugccagguucaagccauucuccugccaaguagcugggauuacaggcauguaccaccaugcccggcucauuuuuguauuuuuguauuuauuuauuuauuuuugagacggaguuucauucuuguugcccaggcuggagugcaauggcacgaucucggcucacugcaaccucagccucccgaguagcugggauuacaggcaugcacacccaaacccagcuaauuuuguauuuuuaguagauaugggguuuuuccauguuggucaggcuggucuugaacucccgaucucaggugauccaccugccuuggccuccaaaagcugggauuacaggugugagcugcugcgcccggccgcaugucgaguauuaagccaguuugccgggcaggucugacacaugugggaaccaccuuugacuuccugggguaccuugacucaaucauuuuggaccucaguuuuuuucaaucuguagauguugggguuguaguuaauggucuccaaugccauuuuggccuuuuagaaaaguguguuuguguguguauguguauuugcaauuugacacaucuuuuuucugacauaccuguuuucaacaaguauuuuuagaaaaauuugugaauguguuuagaagaauucaugucaagauacauauaucaauuguaaguuuuagaaaucuuuccuucaacugagaaaauuguaaaaauuaagcuucucaauggaaaagaaagguaauuuuaagcuccucuccuucaaaaaaguucuuauuugcuaauaguguguaucagggaagggucaaauccauuaaaacucucccaaguggaacaagugaccugaauuacuuguuugcuuaagucaaacaggaaaguucuucuuccuuugaacugaaauaauuccaggaaaugcaguaaagaagcugagggagaaagaaugcaucgaggagagacugcuuuuccagcccaaccugucaccuacagucuucacagcuccacaagcucuggcaguaccuguuacguacaguuuaugugcuugauaauauucaggguguuaaauucauucacguucuauaccuugauugucuucuacaaacuggcguuuuuuaguuuuuuauguuggagagcuuuaacuuuucaacauagcccacugaaauaggaguuguuuuuuuuaaguacaugaaauaacuuuuaagauuguacuugccauuuaugaucaauccauucuacauuaaguucaaaauguuaaguagcaaugaauguucuauuuauaauuuacuuuuucuucccuuuccaaauaucuuuccaggaaaugacccauucauggccgccuccuuugacagcaauacauacgccuaguacagcugagccauccaaguuuccuuucccuacaaagguaauuccuuaaaaguauggcaggcauugcauccaccuuagugaaaagcguaaggcauugcugugaggcagauugauaaaguauuacuuguucaaaucuuuggaaaugagguuaaaauuaugauuaauuuagcuucuacagugcuucagaaugcuuucaaacauuuauucugcaacuuagaacauccuagauuuucauaaagcuuuauaauuuauaaaaagcauucaggauuuuccaauacguucucucauuugaggauccuuacuuuagagaugggagaacagaggggcagggaaauugagugugugauuucucguucagaauuagauauaugcacauacaucuuacauaucucacacucccuacauuuucuugaguuuaaugugaucaguuacacuagugcugguuuaauaacaagcaaauaaacugcugacuuguguguuucuguuacaguauuuaugaacaaugcguuaaaacacugccauucuccuuuuuuuuaauuuauacuuuuggauaaccuucaaaauguagaaauagcaccuucagaucuguguuuuguucaaucugauaugcauguucauuguuuuauauacauaauacauauauugagagagugagagagcuauuccuuuccaugauacuguugugaaaaguaguucuaggccagguaugguggcucaugccuguauucccaguacuuugggaggccgagguggguggaucacuugaguccaggaguuuaagaccagccugggcaauguggcaaaacuuugucucuccaaaaaaauacaaaaacuagccaggugugguggcaugcaccuguagucccagcuacuugggaggcugaggugggagaaucacuugagcccaggagguugaggcugcagugagcuguaauuaagccacuacacuccagccuagacaacggugagaccccgucucucuaccaccaaaaaaaaaaaaaaaaaaaaaaagguucuaucuacaaaaacucaaauuugcuacuuuauauauuuacuuauuuucuaauaauuuuuaaaauguaacucauggaccgggcaugguggcuuaugcuuguaaucccaggacuuugggaggcugaggcggguggaucacgaggucaggagaucaagaccauccuggccaacauggugaaacaccgucucuacuaaaaauacaaaaauuagcugggugugguggcgggcaccuguagucccagcuacuggagaggcugaggcagaagaaucgcuugaaccugggaggcagagguugcagugagccgagauugcaccacugcacuccagccugggguaacaaagcgagacuccgucucaaaaacaaaaaacaaaacaaaaaaaacagugacucauuauugcuuguuuuaaauuaaagcacuaagcucuguaaaaauaucuuugugcaacaacaaaggaaaaauaaacucuaggaaagaagagaagcaaugaaagcuaaaauuagguuaaucaauauuuucaacuuaugcaugaaaaaaguuugaauagauggauagcugcaagucauaaugaaauaauuauagaaucugugauggguaguauggguauucucuacacuguuuccauuuuucuagauauuugaaaguuucauaagacuauccuuuuaauacuaaaagcucaacgguuuucucuuuaacuuuauaagccuuaaucuuuuaauaauuagauauuuuuauuuucuuucuaggacucucagcaugucaguucuguaacccaaaaccaaaguaaguaaauuugaaacugcuuauuggauuggagaacaaagcauagcuuuuacuguuuaacguaaaaacauuaguaaaaaaugccccagcagagaugaggccuuccuauguugaaagaauaggaaaggagaacaaauauaaaacuauucuuuaugugggauuuaaaauuguugaccaggcgcaguggcucaugccuguaaucccagcacuuugggaguccaaggcaguuggaucgcuugagccuaggaguugaagaccagccugggcaacauggugaaacccugucucuacaaaauuagaaaaauuagcugggcuuggagucaugugccuguggucccagcuacuugggaggcugaggugggaggaucacuugagccuaggaaguagagguugcagugagccaagauuguggcacugcacuccagccugggagacagcacagauccugucucaaacaaacaaaaaccaaaauaagauuguugcaaagaguuaauaaagauguuuuagugaaauacuaaacaaaugcagugugguauuacugacacauaguagcuguaccaaaugugacucucacagcuaggaauuguauacaacaguagauuggagugugucauucuuguguuuuaaaaaacaaaacuaagaaauuuuuauaaggaauaugacauacaguuugucuagccccacuauauuuguuugccauguaauucuuuuucagccugaggguuaaaucugcccugcagcuaguuuuuguaaauaaaguuuuauugggacauagcugcacccauuuaucuaguauucuacaaaguauagcacaaaaaaccuaaaauauuuauugucuggccucuguagauaaaauuugcuguucccugcuguagagauacugaauaagaucuugcaaagaagucauaacuaaaauuuccccaaaaugcagauaaauaaacccgacuauauugcuacaguauuguaugaguagcuagguaaaauuaacugaaauggauggcugcuugggaagauugggaaaucuuuuuucuccacaucuuggcagcuagcccagaccaguggagugugcacaggucugaaggcagaacaccagcucagccgugggugggguugcuaugcaccacucugcccccaccuucggucugcuuggguugcuggucaugcagguggcaugucuuucacgggguugcucaugguuuguuuuauugcuaacucaugguuuagaaagaaccuuuaguccauuaaaccauuugauuuccccuuuuagcaaaauauaguugaagaugaacugauaagcacuuucuuggccagggauggaucauccucuugcccuaugcaguaaugugggucaauuccuuguuacucugaugagaaauuguccaacauuggugggucuccuggagguccuggcucaccagcugcuuacccccacaucuuuuaugcugcugucacuuuauucugcuauuccggcagccuuauuuaucuuugugagaaugugaccugaaaaagagggaucuaguuuguugcauguaggaugaagaggauggugggguauggauggauauagcuuucagugaagagaagacaaacauuucuuaaaguaugcccagcaagucaacucugauuucuucaacacuugaucuuaugguacugguacauagguuuuagagucucuggagaggggagguagggggauuuuacuuggaugcccuaguguuauauguccacaauugcaaaacccagacccuguggaauuuagaacccaggcaagaugaucguguggagucccugugaauggucugaagaggaggggccucugccccucucguuuggagucuugguccuagcuuucuagacagaggggaggccauuugaaaauaucauauaagagcugcugccaccaugagggcaaagugacuaauugcaaauaugcaagggucuccacaugacauuugugggaaaugucauucagcccugccuaaaagguacccauguuucuuuuucacuuccaauucuguuucaggucccuauuaccucaugucuagacaaaugcagcugccuccacacguaacauuuccugcucccuucuaaguuaugccagguagcacuaccagaguaauccuucugaggaaucacugugucauguuccuguuuagaucauugaugugucucauagcccagcaaauacagucauaacuucccauccuggccuucagagcccucugaaaucugcuuccgccuguuucagugcuguccagcacagauucugcaccucagcccugcccuuuccaaacucagacccucuucuucuuguuuguucccacuguccucucucucuugccagcaucacucugccagaaucuuggcuguccuuugugauacaauucauuuuguucuuucuuuaauuugcugccuuugguauuaccaagagagcaaccauucugugauuucccagggcaguuaauuuauguauugacuuguguacuuaaucucacagugccuuggauuauagauauuuauggacccguuucaugucccucagucaacagugagcucucugaggacagggccaaaugccuuaaacauguugguaucuaugagguagucuauaaauagcugcugaaugaaugaauugcagguggggaguugaauaaugaagggacaggugggauggagagcaccuaggacagagcugucuaaagagagugauaacaaaucacuaauaucuuuguaaagucacaugggacccagggcgcugggagcauagcccuggcagagugcuuccaugugggccuccaccccugucaaggacagggaggucuuccaacagguagguaaguuccuggcgucauagguaggguaugcugcaagcaaugauuuucaguguuuuuggccuauugagagguuuuugauucugaaccaagcauucucucuagaaguaacauaaaugucaucuuauaaugcuaagauuguaccaagugcaguguguuuagguaaaaacuggggaccgacauaaaagaacucacaacuaaggaucuuguaaauaugugucauugugcugcuuugauguuucucucccccacagaacaauaugauacaucuucaaaaacucacucaaauucucagcaaggaacgucaucguaagugaaaugcuuuuuguguauuaaaauuuuguaguaugaaauuguaaugucucaugucaaugcauugcuuagauuuuucugccuuuauguaaugacauuaauaagacugcugcauucuaaagggaagaaagggcccacauuaauuuuuuuugcuuguuuguuugagauggggucuuaacucuguugcccaggugggagugcaguggcaugaucucggcucacugcaaucucugccucccgggcucaagcgauucucaugcgucagccuccugaguaguugggacuacaggugcccaccaccaugccugacuaauuuuuguauuuuuaguguagagaggguuucaccauauuggccaggcuagucucgaacuccugaccucaagugauccgccugccucagccucccaaaguguugggauuacaggcguaagccacugcaccuggccuaauauuuggauuaagucccccuguugaaggucuauguaccauuggagaguuugguaaaaggucuucuugagggggaaaaaggguuuuugagccauuauuuacauuuuaacucugggaauagaaggccuuugcuuuuaagaugucauucuuuaauagcuuuagcuguuagaaacaaguuuugggggaugugcacaauugaagauuuuccgcccuuuuuuggccuaauuuacuaauaaagagcuaaucuuauugcccagcuauucuuuauuaaggccaguaaguccagaaauauuuuggguuaugggaacguuuuagacugcauauuaaagauuuuuaaauuggcauuuugacccaauuugucauuucuugaugguauugaacucuuacuacuuuacuuucauaugacaggagcuggucauagggacuaagugaggaggccuuccuccaguaucugaucugucacuaacucuguguugcuagucucaggauuucagguggcccaggaguuuaagcuccaacuuuccuuuaguuuuaggcacaauauuuguuccauguauuuuggaagguggggauugcuauggauuauuuaaaaaacuauauauugagcuggagagguuauuuuaucuccucgccaugacuaaaugugggucuggguuaaguguuuguuucccaagugccaauuccuuaauguacuuugugaaaugaagggaaaaggaacaagaagacgagguguuuuuguuuuuuuggucugaaagauggguuuugugcaugugguaagaauguauuuuauuugugauacugguagaugaugagguuuuuguuuuuguuguuuuuaaugccuuuugcugggaaaguaaaauguuaccuuuuguuauucccuuuuuuuuuuuuuuuuuuuuuuggagacagggucuugcucugucacccaggcuggaguacagaggacuacagacuacagggacacacccggcuuuuuuuuuuuuuuuuuuuuugguagagguggggucucccuuuguugcccaggcuggucuccaaguccugggcuaaagcaguucuccugccucagccucccaaagugcugagauuacagaugugagcuuccacacuuagccucuuuuuuucuuuuucuuuuucuuuuuggagacaagguugcuuuguugccuagguuggagugcaguggcucuucacaaacccaaauagcacacugcagccucaaacuucugggcucaaauaauucuuuaccucagccuccugaguagcuaggacuacaggcacaggcuacuaugaugcccggcuccccuucccuuuugccuuucaccuuuucuuuuuuuccuuuuuaauuuuuacauauuuauguuuuaacauauuuuuagagacagggucucacuauguugcccaggcuugucuuaaaacugcugggcucaagugauccuccugccgcagcuuccugaguaacuggauuaccagcacacaccaccacacuuccuuuauguuuuuggaaauuuuacuggcugcuaaauucuaagacuguagacucacugacauggauuacauuuaaggaaggaggagguuuguuaaaccaguugauggcugguaaggaguagaaucugcagaucaaggaccacaacuguaagaauucuguagaagcucuguaaucuccccaggguuuuacaccagguauuucuuugugaugguugguugucaagcccuguagaccauaaaaggcccugaccauugucuuuggggcagccaggaagggacguuaaagccuggguaucccaacugacuguaagcauagaggggaggagcucucccaggaguagaguggguggagcaauugcaccgaaguuggguagugacugugucucucgccuguggauagaggaagaaaggcagcugggucugaucuacgccugacagguagccucagacugagcaggcaaaagucacacccuaccacuccaauuuccaucagcuuucagacuuucagagacagaccauuccugugaugacacugcucagugaaaugagugguuuucuugauagcaguguuaaaccacucaaaucagaggugccugaaaguagcuaacaaguauaucuugugacacguaguguuugcuuuauaaaaacuauuaauuuaguacauauaaaauuaucuaggaaagaauauuugugaugauccuaauagauuuacagaagguagaaguaggaccuaguggaagggaggagagguaagaguaacacagaagagaagugauacugaggccgaguagauaaugaggguuguguggacuuggugauuaugugggggguagacguggugguauugauaagugccagaaugaaauguauccuugggaaaaaggaaugacuuuuaugaacucacuuuuaauggagauuagaagaaaguggugucccaaauuaauuggcaaauugcaguuguuucagauuuuguguggcaaaucucuuagugcucgcggguugauuugaucuauugucagcauuaggcuucuuugacaugcaguuaagcuauuugaguggcacauagagugcuggggagauauucuaaugcauuuugaauaucagaaaaaaauuauuaauugcagggucauuuacacuuugauuuaaaaaaccaaucuaggucuuaaugcuuuuucuuucagaguuaugaggacuugggaauccuuagacaaguggaauaggacauauaagaguauaaaagagaggcccaguaguaaaggauaagcuugcgaguggucuguauuaacucagauaugguuaggggguagcaacgugguagaaggauguaguugugaaauuaaauguaaugguucagcauguaguuugagauguaguuauuucucaaauaauuccuucuguaaaguucuguagguaacugauuagcuaggauguuagugcaauuugccccuaaguuuaagagagaguguauuuguuuaagggcucuugguuuuggaauccucuuccuuuccaaggcuuagaucugugaagugcugaggacaaaguauaaaguauuuccuuuuucuguacaguaacugugaccuucauauaauuguggacaauucuuuuucugugcagccagauuuaguuuacuggugucagugcauuugucagccucugaaagaggacaaaaauguuaauauuuuagaaacuaaaaaagcaauuuauuuguauauucuagcuaacuuguuucuuccccuaccccaaaauugccaaguccuuacaaaaaggugcccuccauuauuuuucuuguuuuuggccucugaaaucaacacuuacuuaaaauaagagacagaaauuagucauuauagcaauuugaaauauuuauuacuuauguggaagguuucuuuugaagugagggagauaucuggaugugaaggcugagauugggauugucccucgaguuggaugagaaagacuguugccaaguuaguaaagacuggggugagucugauaccuuuucaaaugagcccgaguuuucaacuuuuacucaaaacauuguuggcuuuuaaauauuuugguaaagagcaagggaagacucauucuguuuauuguaauauaaaauugucacaucaggauguaaguagugucagcugaaauguucuagaauuaaguccaaagacaugcuuuacuuguagcauauuuaaaucaugcuuagccuaaggaaauuaaauuuuuccuuguuuucaaauauuagcuuauaccguuugaaccuggauauuucaauggcaggucuaacugagaguacaauuugcugauaaauauuauggaagugguagaaaucugccccauguguaaagcuuagaacuugacauugaaguaauaucuacaucccuuauucacaguucuuccgcuucccaaaaacaaggaacaaacauuugugcugguuauuuguacauuuguagaucugcauuaagccuucaccaucauagaacauuuauuaaaauguuuuucacuaaguguugaucucacuuuuuauuuuccuuuuuugagacagggucucauucugucacccaggcuggagugcaguggggugaccucgguuacugcaaccuccaccuucuggguucaagcaauccucccaccuuagccucucgaguagcugggacuauaggcacacaccaccauaccuggcuaauuuuuguauuuuuaguagagacgggguuucgccguuuggcccaggcuugucuugaacuccuggacucaggcagucugcccaccuuggccucccaaagugcuuggauuacaggcgugagccacugugcccggcccccacaugcugugugcuuggugcugcuuuagguacuuggagaaacuguggucaauaagacaaaauauuuuguaacaaacuguagguggcauauaauacagagcaagggaugugacagugacaggguugagaggaauucuuuggauaguaguuacacuucagggaaaagagggguccagaaaggucucccagagagggugacauuugauaagagaaaggcagagacuauuugccaccuugaaaggggcuugacagauuaugcuguaggcuuugaaagcuuuugaaaaccugagggagucuuuuuuuaagugauuacuuugaaagagcucauuugcauauauaaaaccuggauuuggggagcccuuaagggucccuuuaagugucauuuuacaucauaacugcuaauuuacuacaauaagugacccuaggcuaauuuaaacguagauugaaagauugaauaaaauauauuuuaauuugcuaggaaucuuagccuuaaggguaguuaguguauuuuacccucucugugggaugcugggcuguuaaaccaacaaggugugguccacuuucacaagcauauuaacauuccugccuccuagcaagggccuccaagaaccuccauaaccuauccccuaccacggccugucccugacacacauguccauuuuccauucuggcaggcuuggccucccugcucuuuuugguguugugaugacucuccccacaagacuugcauugugcucucucccuccuuucagcugugaccugggguggccuuuaucaguaguuuucccuaacuacccuguauaaaagagugaccucuagccauccuuucucuuuuauccuuuucccuccacaagcuuguuacccauugagaaaugguguauuuuaguugucuuccuccucuagacuagcggggauauuuuucggcucagaguuguagccauagggucuagagcagugccuggcacauaguaagugcucagaauaaaugcagaaggaaagauucuacacgauaaacuugauugaauaccuauauacaguauuuaauagacaugguuuagaguaauauuuuagauuuuguuucuguuaaaaguauaucauucuuuuaccuugucauacuuacugauuuaaucuacugauuuaacuucagauuuucccucauuuacacucuugugauuuuucucauuuccuuauuugacaucagauaaucuucacuucguccauggaguuuaaauaaucuuuuauaacuccagcaccauuuuuaucauaucaaccauuaaccucuuucacuagaguuaaucauguagagucaguuuccccucuaucuuguuaccccauaauuccuguggaaaguuucccaugaacuugaauucugccuucuaacuauugucaccauuuggagauuuccuauuauauguugugucacaacugcuggagaucuaccuuuucacuuuuucaucucuucuucguuuagccugcuucguaauuuguaaccucccaccaucucuuagaaugcacgggcaguccuuauuucuggcauacaucaagaaaggaaucagagccugauugcuuugaaaaugccaggauucuacggccaggcucacaccuguaaucccaacacuuugggaggcugaaaugagaggacugcuugagccugggaguuugagaccagccugugcauauaguaagaccucgucucuacaaaagauuucuuuaaaaaauugccaagcaugguggcacaaaccuuuggucccagcuacucaggaggcuuaaguaggagggucacuugaaccuggacggcgaagaguuugcagugagccauaauggugccacugcacuccagcaugggcgacagagugagaccuugucugaaaaagaaaaaaaaaaauccugggauucuggaugugcucuggagcccagccucuuucuccugccuugugugccauugcccauccuauccccggaucaguuucagauuugugagauucuauaaguuuacacauucucacauacuuguuagugguucccgaaaaguguuacuuuucuuauuauuuuuagcacaccugauaccauggcugugacuuacuaauuuuaaguaacuacuaugagcacuuacucuuucucaaagugaucuuaagaaauguuaagccaagaaauaagguuauguaaauacuuuuugggucugaauugagauguuacaaaauauuggcagugaaagcuuugggcaagcccaguacuaagaaauggaaaauaaauggcgacuugucuuuaugucuucacacaguagcaaucggguugacucacugcagcgugucugccagaaccuguauguggcucuuuaagcuuugcuagaacagcugccugaaaaagcaguuguacaaaggguuuugagaauuguuuguuaccuguaagcaaaaaguuuaccuaaccaaauguaaaaugugauuaaaucuacauguaaagaguugcuuuaccugagcgauuuggcuucuuuugaacagugucaaaguagguaauacgguuguauauguuuugaaauaacugccuugacuuggcauuuggaaaugaaacuuguuauuugaccaguuaaaguauauaagguuuaaaaguuaauuugucuucauaagggaaacauaacauauugaguuccaauaggaaaguaguuuuauuuuaaaucaaagucucucucuugguggguucuggaauuuagauuuaauuccaucaguuggguuuucuaaccauuguguaauacauuggccagaacaaggggaucuugggcaugucagguggcuguuuuccucauccuuagaaugugaagggauggucaaaagccaccacacaggauuguaaugauaagcagugucuguucugaucacauagugggcacagcuacaugauacuguuauucaacaaagggguccuauucauucagccugcuguuuuaggauaccuaccaguuucuagacagaauauaaaaggugaaaaugauuugauccuaauuaaaaaaaaauuuauaggugagaaagaagaagcauauccauugagcuuucuguucucuugaccuaggcuuuauugccgugacugagacugggucuaagagauuuggauucucuugucauggggacagaggugcucacccaggugugcuguaguucaucuccucauuuuucacauucaacgacugauucuucacauauaguaugugcuuggcuucaaauacaguuugugggacaggcagaggaccuuagccucuuaaauuuaaaagaaauuuaaauuccuuuaaaauuuguccuuaggccuaaaaauccuucaccugucaucaaacugucuucagcuacauagauuuucuguuuaaaaaaaauucuaauggcauucaugauuaauuuucuauauuagcauaacuuaguuaugacuuguaacuuaaaaaaaguagauguuguacauguuuuuuaaucaaaaacuuuagaaaaaaauuuuuuucuugcugccauuuucuccuccaauaauagcaugcuaguuuacguugagauacccaccucuggugauacaguaaaucaggcuuucuggaauaguuugugguuacucuuggcugugccagcagacacuaguaauacacauaucugcugauucucaugugagauauguuuauucuuuaucaaauaaauuauacucacaaauuuuuauuaaguaaaauacuuuauguauaaaucccaauacaucccaaaugagggaggagagguuuuguuugaccauacugguuuaucauuucugaguguuucuuuggagacagcuuuugcaaucuuccuucagagaucacaguccguacucuuuagguuuggaauagguuuuguaucuguaggcuuauuuuguuacuaucuauguaauucucugcagggaaaauuuuuagaaucugggacagcauuuucauggugccuguuuauccugaagaggaaguggagccaaaagucagaacuuucucuaacuuucugacuuacuuuaggagaguauauucuuggaaguuagauguuugguagcuagaagagaaaguuacagaauuuuuaauccugugcucaaaacaggaaaugugguuggauuacaugaucauugauguuacaggaauuaaggcaaaucaguuuuauucaaaacaaaccuaguaacuaagaaagaggucaguuuuuuguuuuguugugguuggugacuaaugcugaauacacuuugccagauuuuuuucugguuguauuauacuuuacauuuauuucaaagauacaucuuuuaucuuuuguuuguguauaacucagcccagccaccauuuagcaauaaaccuguugagugacuuuuuuuguauaccauuacguugcuaacugacaaguccuaugacugaaggcuauauuuucuagccuugaaaaaauaugaauuuagcugugcaggguggcucacgccuguaaccccagcaguuuaggaggcugaggugggcagaccacuugaacccggagcucuagaccagccuaggcagcauaguaagaccucaucucuacaaaaacacaaaaauuagccgggcaugguggccugugccuguagucccaacuauucgggaggcugaggcaagaggauugccugagcccaggaggcagagguugcaguaagccaagaucacaccuggguaacagagugagacccugucucaaaaagaaauaaaaauaugaauuuagcuucuguuagauaaauauugagcaagaucuacauuuacaaguugcuaacaguuuucauuuuauuuagaaacuuaucccaguauguuuuuaguacauuuaugaaaguuguuucuuggcagaauuaccaccucauguaggcggucauuuacgaaacagccaaguuucguucauuuucauuagaaaacauagugauuuuuaccaggauuuccaaagacaccaugccugcuuucuucagugguagauauggcuuugcaguaaaaauuguugaucagauuuuugaauagguguuuuuggaaauacugaaggauuuuaaccucaaauaauuugccgguggaguuuuuaaaauuugacaacacauguacagauugacaaauguuugcuuuuuacuauuuagguucaccauaagccagaaugccuacagauacauuaauccaaguuugaggaaauuuuuuuuuuuuuccucacugaaacaauagcaauaagguuaaacauaauguguagacaaucgaguuuguauuacuguucuucccauugaucaguguucacauaggcaaaagagaauaauuuauugucaaaaauaaagcucacuauuaauaauguccuuuagacagaaauguaaaguaacugcacuguugggugauguuugccuugauagcaucauacaucuuacuguguauuuaauucuaauguugaacuuuuuaugugccuggcacuguucugagugcuuuacaaauauucauucauucaacuuuaauucauuuaauggcuaacuacuuuaguucaguuagagcuuauggaagaaaguaauugaguauauuauguaucccuccccauuuguuuuguuugcauggacccugacuucacugauuaggagugaaggacuuuagucucagggcucgcaacgaauccuugucuugugguaguucugcuucaguguuguagcaugugaaagagucuguuuugagaugguaagaggcuugcacuuaacugguuucuguguuauaauuguauaauuauaauuguauucguacauuguaauuguauaauuguaaaacuuaacauuuucaggaagucacagccuuuaauaaauaaagaaaacuuacacauauccucucucuuuguuuaauuaggcauauuuucuauuuacaugcuagaaaaguuguuagaaaucauuucacauucauucuucucugugucccugcccauuccagcaugcucgaagacgaccuucagcucagugacagugaggacagugacagugaacaaguaaguguugcacagccuguaauaccaggaguccuuuuaaauacaucuaacagaucugagcugcuuguucuaaccuguuuuuuguucuuuuccuggucuuucuuccccuuauugugaaugccuagaccccagagaagccucccuccucaucugcaccuccaagguaccguguggguuucuccccaucuguacagaauguuugcaauuuuuuaccaaaugggaaaaauaaagccuuauuuaguacuuucacauuuuuugucaugggaaggagcugaaggaucacaguaaaaggaaaguaccuguuuaauauuuuggaagcuuaaaucagccauagggagguuguuaacccuauagaagcgagagccccacacucaucuacaucaucaguauagauguuaaagauuuuuaagaguuuacaggcugggcgugcuagcucacgccuguaaucccagcacuuugggaggcugaggugggcagaucacuugaggucaggaguucgagaccagccuggccaacauggugaaacccugucucuacuaaaaauacaaaaauuagccaggcaugguggcgcaugccuguagucccagcuacucggcaggcugagccaggagaaucgcuugaacccaggagauggaggcugcagugagcugaaaucgugccacugcacuccagcuugggugacagagcgagacucugucucaaaaaaggaguuuacaaacaagcuuaaaauacaauuuaucaucaguauuagguaaucaauauuugaaaaguuaaacugacgagcccaguguuuuaauggagguaacagauuugcuguuuucaauaaagcucaguuauuuccagaacuucuuuuccauuaugccuguuuucuuaguuacaugaauuuucauauuguuucagcugcuuuucaaaaugaccagcaguacauuuuagugugaugggaaauggaauaagccagccauacuuuaggaaaugugaugauuuaauuuuugaaaauaugaacuauuugaacuucuuuuauaauacuuuccucugguaauaugccagguaccugccuuucauggacaaaguuauuuuacucacuugagaugugcucauccacucagagacgacauuagcaauaaaaucuuguccauuaugcaggggauguuacaguuaauguggaggaagcccaugugauuaugugcacucuuacagauucauaagguuugcuuguucaauuauaucuuauuuuguucaguaauuucugguggguuaugaugacucauaaaacaugacaagguagccuaacuucuaaaaguggaggaaaaggaaaaagaagagaccaagcggggguacaaauuugaggcaggaguaacauugagaguguauccccuuuugcucaucacuggcuuacgcucuucagcugccauggagacagggccaccaacugggugcagcauuucugugaggaaauuauauagugguaucguguguguuuuaaaguuaccucaacuagugauuuuguuauuguuuaauaauuuuuauucuaauauguguuauuuaugaaucuauuuugaaaauauuuuagguagauuugaaaucuguccagauuauaguuaaugacuuauugcuuuaauuaauaccaucuagggugaagcuuuaagauuauauaugcuuugaaauuauauaugugucuagcagugugaucaauguguuuucuuacuaacuuagauuuauugccccauucuuaaaauuuggaguagauaaucucuacuuugucugacauuuggggaugaucccuaagccacuuacgaagaaugguccguuuuguaguucuuccaggaagugugagugguugguuacuuuugaguucaccuugcaaaggaacaccauuuauauuuaguggucuuuggcuaccacccaguucuuguuuagagaauauagggagauuuuaacuuacuggcuuuucuuacagaaauuaauuugauuugguuauguguaacagagaccagcaaacuuaaaaggaucagauaguaaauauuuuaggcuuugugggccauauaugucucuauugcagcuguucaaaucugccauugcagcauaaaagcaaacauaguacauuaaaaaaauggguaugggugucuuccaauaagacuuuauuuagaaaagcaggcagccagccuaggcaaugguuuaccaacccuugauaugaagcacccagcaucuaacuuaaauuuuggaucacuugacauauucuucaggaguaaaauuucacaggcuucucuuuuaugcauuuaucuggcaaucaguuuucagagguuuuugcuuuucuauuaaacuacuuugggccucucucaguuggaugacaugauaguuuagcaguguaucuaauaccaaggcccgcccuuuugaguagcaggaaaaugggcaagggagaaagaagaaauccaccuuguaucgugccuucuaauuuuaucuuuugguugcuuugcagugcuccacagucccuuccagaaccaguggcaucagcacauuccagcagugcagagucagaaagcaccagugacucagacaguuccucagacucagagagcgagagcaguucaagugacagcgaagaaaaugagccccuagaaaccccagcuccggagguaccguguucccccucgagauggccaccuuagauggcagcauucuguccuuugaaguuagagucagugcugugggccaggacugaccaugagacugagucauucugucccauggggcaaugcuuuccugcuccuaugcugucuagagccaucuguuucuauuuauuugcuucuuaccaaauauuuaauaaaggagaguugggagagaggucuucucuccccuguugaaaaugauaggucuucucugucauugcuagugguguuuugaagaucaacucauuaagacuguuugcacaccauuuucuuuucccuucuuuuagaaagaaaacuugguuucaguaggcugcuauuuuaauauuaaugagaauucuucgugaaauuuuagaaaugcaugaauuaaagcaaaaggagacugccugauuuagcaaagggcaggaaugugaacuagaaauaagucaucaggaguucuauuuucgaaucacuaaaagccaugcauuaaauugauggcaaagugauuuugucaggguucuguuucuugcuccuuucugucccauguaaaacagggacgaugguguuugcuugucacccacccucaggagaauauuguaaagacaaacugauaagacugaaaaucuuaggcacuaaauaaaucuagaggauuuaugcuauuuacuggauuguugagcacaagaaauuguuaguaacaucuaacaggguugccaaauaaccucaaaauuuggguagcauuguaaaaguuaugguggggaaagaaauuaaugaaaagggaaggcaugcuuuucuuuuuggugaaugaaaccagcccacaucgagaaaauuauuccauguauuuaauaagggaaugccaggaaaugaagcuuucuaauuaggaaagcauuaaaaagccuucuguauuugucucuguuuagaaagcaaagcaguuccaauggggcauuaacugaauacaucuggagcuaauguagggagacuuaagggucuugucugagggugagggaggcugagaaaauaacuggcugucauuuucuguuagaugcgaaucuaugucuggcgcagaaaauaagagcuugauauguuuuggaguggacagacaugcaucaguauuaacugcacuugaagugccuuucagauuuuagaaacuacacuguguuucuggggcucuuuguuuccuuauaugauacuaauugcuauugaaauaauuuuucuaugccucagggaaaaggauacugaauaugcugugcagacaaauuguguuuauaagaucuuugcuuuauguuucaccuuauucuuaagaaaaaucuucaugcuaguuagauuacugacaucgaaaagauaauuaacauuuaauucaaauaaaauggaaauguuacagauuuggcugaauaauugaaacuugauagucuggcguuuguaguaaugagacauagauauauuuuauugcuugagaaguuacuggaauagagugaaaccucuguaaaauaaauggucccauccugccuuaucuuuuaaaaucacuuuaauaaaaaaggcuaguauuguuauguauugcagauccaggcuuggggacaguauguguuauauacugaggcuuauccuccugggaauauuuuaucuuuguuuagauuuuaaguuuugaauuuuuccuaaaguauuuaacuacaucucuuuccuuuuacaauaaauaccugcauuauuauaaauuucugguguuguuucagaguaacagaaauuccauaauaagcuguacauacagauauuaaugagaauucuuuuucauuaauauugcauaaucaguacuguaaauuauggaauuuucacucuuaacuuucucacuccuuuuuuuuauuuuuuuuuaacuuucucuuuucuuugucuuaauuuuuguggguauguaauaguuguauauaugagugcgugacauauuuugauacagccauauaaugcauaauaaucacaucagaguaagugggguacccaucaccucaagcauuuauucuuuguauuacaaacaauucaguuauacuuuuucaguuauuuuaaaauguaaauuaaaguauuauugacuacagucacccuguugugcuggcaaauacuagaucuuguucugguuuuuuuguuuuguuuuguuuuguuuuguuuuguuuuguuuuguuuuguugguaccgauuaaccauccccccacccccuacuacccuuccaauccucugguaaccauccuucuacucucuaucuccaugaguucaauuguuugaauuuuuuagcucccacaaauuaguguguaucuuccauuuuuuuaaugcucuuuuuaaaaaaaaauuuugcacucauauuccccauagcuauguaguguuacuaaaagaguaaaucuauauugugcauaauaauaagcucaaaacuucuuaauucaaaaucauaauucauucucaaauauacuaacuuuugccaauuuauuaaaacaccuaauaaaaaauaauuauauccuuuuuuuccuauuuccaauuugcaguauuuggauugcaccagcacugggagggcagauugggggugggaugaggagacgcagaggaagaaaugaaaguccaaacuuugauccucuaaacaaagauaaaauauucccaggauauuugaaagucuuaaaaccuuggcacuuuuaucuacuuaaacuuuauuuuuuuuuuuuuauuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuuuuuuuuuuuaguagagacgggguuucaccguguuagccaggauggucucgaucuccugaccucgugauccgcccgccucggccucccaaagugcugggauuacaggcgugagccaccgcgcccggccuuacuuaaacuuuauuuuuaaaaauauuuuauuuucauuuuuauuuauuuuuauugagauggagucucacucugucacccagacuggagugcaguggugugaucucggcucacugcaaccucugccucccggguucaagugauucuccugccucagccuccugaguagcugggacuacagguacgugccacuaagucuggcuaauuuuuguauuuuuaguagagacgggguuucaccauguuggccaggcuggucuugaacuccugaccucaagugauccacccaccucggccucccaaagugcugggauuacaggugugagccacugcgcccagccuaaaaaauauuuuuaaucaaucccuuaugaaaacauuuuuuccaucacaacacccaaauaauguaucaaauuauauccauuucacaacuuaauauuggguauacaggauugccccuaccuguuccccuugucuggcacaacuacucaauuuuacccucaaauugggacauaggccuuccuuuggaacauuuuuaggacuguaguggaagaauauauuuuauuucuguaaucaggacguuccuuuagggacuacuaaaugcaucucaguacuguccuguuuugaggguugggggggaaaccagauguuauuuauacugggaaugacuucccuuuuggguucacacauaaauagucuucuaaagagcaugucagggauuggggugcaguuguagauauagccaguggguaagauauguccauaccuuuccugaggaagggugugaaggcuuugugccugaugugauuggcaagugauguaucucacuaccuugucccaucaguuaaccacuuauguaaccacacccugaagucuccaggaaaucauguuugacaaguggguauugugugcuaaucuuuucucuacucuuaaccauucugcguucuuagaauauugaauacggauuuagauuacaugugacaaaaugccugccacauaauagugguuuccuucuucccucccucucugcccuuaaauucagaugacagcaugaguauacaguugacauaagcgaaggaagccguaaggaagauaauguuaucauaagcagcaguaugggguaaacagaaagaaaaaaggaauuauguagucaucuuacuguccaaagaauguucuugccugguuuuuuaaguuucuuaguucuguucuguuagucacacuaaacccaaacuaucuaccugauccuuuuauuaccuaaccuuuuccuggccaaaaagccuuuaugucauagccacauauuuugcaucauggauuuccauguuuuauggaguugaauuauuugggauguuccacucgggaaaauugucagcagucuuucuuccccuuaaaaccuuuccaucuaccggaguguucuccuuaucuauaaucuaagcaaauaaaucugaagugggaugucuuucaacuaauuuucugaugcauuauguguaugacuuauuucuacaaaccaccuccccgaguggaucuuuaaauaaauuaguauuuuucuuaagauaaggacauaaggacagcgauguauagucuuuaaaauaaauguaacuaucacucacucuguuagacacuaauauuuuucuauaugauaugaaauucauggguauaguaauccaccuagcagaauacucauauaucucaugcacccacuauaugcaagauagaguaguggaacuuggagacacaagagucuccgucauucuuuuaauaaggucuaacagccgagcuggagagacguggugggaugcaacagcaguuaauuuaucaacaaagguugaacuaauaguuaagguaacgagccaggaaccuauguuuuuaugccacgcaauuguacauucucauugccccugacgguaugccucccuuuguaucuuagaaacauaggugcuguuucagaccagguugcuuauaaugagagauuugauguaugaccuuuuuuuuuugagaccaaugugucacucugucaccuaagcuggagugcacauggcucaccgcagccucaaacuccugggcucaacaauccccaccuuagccuucugaguagcugggaccacaggcacgugccaccucuccuggcuaauuuuuuaguuuuuuguagcaaugagguauugcuauguugcccaggcuggucuugaacuccugggcuuaaacaauucuccugucuuggccucccaaagcugggauuauaggccugaaucaccguauuggucgaauguuugacuuuuaaagaguucacgugggauuaaugcuuggcuaaugugacccagcugacuuuaucaagguauaaaaauugcaaaucacuguauacuauaugugauaugauaacuuugucauguauaaauguuuacuacauaauguuuuuaaguaaaugagagaaaugggccuguuauucuagugcuuuggaagacugaggcaggaggaucacuugaggccaggaguuugaggcugcagugagcuauuaucaugccacugcacuccagccugggcgacagauugagacccugucacacacaaaaaagagaaaugaucucaucuugaauaaaagucaucuuuaguugaaaaauaugucaaaaaaaggauaaaaugugagcccacuaaaaauuuauucauuagcugccuucugcaaauacuugaugaaaugauuuuuuacucauuuccuccuauuauuccuuaauagaguaguucacaaaacaaaaugugucaauucuguuuaaauuauacuauaauuaccauuagaauauauuauaaagauuucucagcaguuggcaauugccuguugauuaauauuugcuauuaccaaauuucuaaaucccacaaaaaagugaagguugcuuuaagaguuaauuguuauagaacuuauaacuugaggaggaugaccggaaccuaaauucuggguuuggaaguauuugcuccucugcaggacaguguuguauaauugggugacuaacacaaaagaauaauuugucaucaauggucaguuaacacuuuucuuucuuuccuuauuuuuagccugagccuccaacaacaaacaaauggcagcuggacaacuggcugaccaaagucagccagccagcugcgccaccagagggccccaggagcacagagcccccacggcggcacccagagaguaagggcagcagcgacagugccacgagucaggagcauucugaauccaaagauccucccccuaaaagcuccagcaaagccccccgggccccacccgaagccccccaccccggaaagaggagcugucagaagucuccggcacagcaggagcccccacaaaggcaaaccguuggaaccaaacaacccaaaaaaccugucaaggccucugcccgggcagguucacggaccagccugcagggggaaagggagccagggcuucuucccuauggcucccgagaccagacuuccaaagacaagcccaaggugaagacgaaaggacggccccgggccgcagcaagcaacgaacccaagccagcagugccccccuccagugagaagaagaagcacaagagcucccucccugcccccucuaaggcucucucaggcccagaacccgcgaaggacaauguggaggacaggaccccugagcacuuugcucuuguuccccugacugagagccagggcccaccccacaguggcagcggcagcaggacuaguggcugccgccaagccguggugguccaggaggacagccgcaaagacagacucccauugccuuugagagacaccaagcugcucucaccgcucagggacacuccucccccacaaagcuugauggugaagaucacccuagaccugcucucucggauaccccagccucccgggaaggggagccgccagaggaaagcagaagauaaacagccgcccgcagggaagaagcacagcucugagaagaggagcucagacagcucaagcaaguuggccaaaaagagaaaggugaguguggggagacugcccugacuccagcguggaccauccuugcuguuggccuggcgguaucuuugaucggccuuugauuuaggcccaguugaguugucucacaagucuuugcuuugauucgcuguagccuuugcaucuucuuccagcauuaccugucuggacuuugcuucucauucugcagaugggcauuaacacguguuauguccuuccaucggucuugcuaguuugaaaaaaggugaggcagucauuaaaaacaauagcuucuuuuaggauaauguagcaucuagggccgcccccaacccaccucuuuuuuuuuuuuuuuuccaaagacaggcccuugcucuguugccaggcuggagugcaguggugcgaucuuggcucacugcagccccuaccucuggggugaaacgauccuccuaccucagccuccugaguagcugggaccacaggugugugccaccacacccggcuaauuuuuguauuuuuuuuguagaggugggguuuugccauguuggccaggcugcucuugaacaucugagcucaaguuauccacccgccucugccucugccucccaaagugaugggauuacaggccuaagacacgaugcccagccucauuuucauuuauucuuguaacuggcauuuaccaccugacccauuagguuuugccuuaguaguugagaucugaucugaauugaaauguuaauucauauucugaauuauuaaaagaacggcucuauacaaauuuuacucucauaguaggaucuuuuauaccaauaucacauccauauuuuaacgcaugaccauacaacaccucuuuacaguuacuaacaugugguuagugucucauugaguaauauaggcugauaauggcacguugcaaaguguugaccauaucauuuuauuuauuauaauuuuggaagauucuuuuggauacagaauggacagaguaacaaaauugcugcauuauuuaagauugucuguuacuugaacaugccacuguuuuagacaggcuccuuccuuuuauuuugaaucacuugaguuccuguucuguuuguugcuuuuucaugaugaugaaagauuagugaguuuuuccccaguagcauucccaagccaacuugcccaagaaucagagacaaagucacaagaagggccaacucucuccugcugagaaggaauaaaauuuuuaacacucuuguaaguaugugaaaaacuucuuacucagcuguggaaguugagcuaagaauaacaaaggaaaaaaagauuaugaagccugcugucaugucugagauuugacugauuaauccagugcguuaaaaauauaacacgacuuuaccgaauaguaaagggcgacugcuuucuucagaaccuccuugcagcagacuaaaggauguguauugccgccauguuugcagcaggcaaguugagugggaugggauccagugcuaguaagugcucugucucagcuagaagagggcauauuuucaugccagaaacuucuuuaaacuuuuuguaugggauggggugggguguguguguguguguaugugugugaaagguacaaaacuuuauggagaaaauugugauggaccugguuaggaaaaagauaccugcagcugauacaccugggaaaacuucaggaacacacucagguagcucccuguccugguaaaucucucaccugucucccagcugcuguggucuuguguggucuccagugcugaccgucugcauuagcuggaguggggacagguacucacuucugaaaggauuaccuaccagguggcaauguuagaacccggaggaucccccagagagcucaguccaguucauaccccagugcaaaucuagaagugcagcuuguggcucuagaaagggaaacuuucagcucucacuguugacugugggaacugugcccucuauaagccguucccagguuuuggcugagcaccucuugggcagcuuauuuaucuuucuguuuagagcaugcagaaauagugaucccuucaucuuaaucgagugcaugauuucuuuaaagcgcugucaagcugcugagagaucuggccuggggaacagucugccuccgugguacugucaggauugaugucugacccacugguuccaaaccccggcuacacauuacauucaccugguagccuuuagcacugaugacgggaauccccaacccccauugguauuuuaaaaauuccucugguaauccuagugccuaucagggcuggaaaccacugaagcagagccguacugcagggcccaagagcauacaaagcuaguuauuuggauccaaaguuggucaagugugcaguguuuagacaucaugaucuaggcaaacagaauuccuggccugaaauaugucacuaguuagaaacauuagaagcuuucagguaaauaaauauaaaaaaccagucaaccguauucuuauuucuucgucagagaaucaugugucguuugguuuaacuuccugcuggauucuggaugggaguuguugaacauauuaaucucauuauuuucuguagaggacagguuguccccccuuccucauuagcgcccugacugcuuguuagggcucucugccucuggcccugugaccagcacgguugcuccagcaggcagcagugugugggccugcucuccauggcagagacagggcugugaagcuuggguacugcucacauuuggauaaugaagauauuuuucauuguguucauuuuaaaugugaacauuagaaaaaacucugagcauauagucagaggaauagaagaacuugcuugauccuucacauuagugguauuuaguguuuuuauuuaaaggccucuuagagucugucccucucuuggcacaaaauuuagccaaauauuuucuuucagaagauuuacagauccuugaauccacuucagacuuaaaaguguaugaagaugaucauaaagaguuaaugauggcuaacagcugugaugaagccauuagacauggcaccuauagaaaugcacacguuuuuuuacuacucuacaacaguggguaaggaacaaugcaugaggaaaaguagagaaaacugugaggguaaauacgcaugaccucacgucguguucuuuacauaaacuacugaauuucaucagucugauuacaguuuagauuuucuaauaccaacuuauguuuucuuuuaaaauuuuuuuauuuuuagcuuagagacuauucuguuaauuacuuauuuuuuagagacagggucucgcucuguugcccaggcuggaaugcaguggcauagcucaccaaccucaaacuccugggcucaggugacccuccugccucagccuccaggcacaugccacuguacccagcuaauuuauuuuuuguagagaugggguuucacuuuguugcccaggcuggucuugagcucugggccuccagcaauccuaccucagccucccaaagcaguggcauuacugguugaggguaguugucuagcuccuugguguuuugaacaaagaauuggacaaaaugcacaaaaaaccaaggcagugaaagcagagauuuauuuuaaaugaaaguaugcuccacagggugggagccggcugaagcaagaggcucaggaacacugguucuucugggguuuauaugccuucuagagguuucccauugguuucccauugguucacucuagugguccacgacuagucugauugguuguaggggggaccaaucagaguuacuuucauuuuccacacagaaaaaggagggguuauaucuuauauccagucagggugggugggccuuagguucccugccuccagacccuauucuccugccucacugggguuacaggcaugagucaccaugccuggccuauguuuucuucuucagaauucuuaaaccaagcuuauuuuuuuccagauuuggaagaaaaguugaacucaagaaccacaauauauacaguaauacacaaccaggccagugcaauugggagcccucuaaaaauguaccuggcugggcacaguggcucacacuuguaaucccugcccuuugagaggcugaggcggguggauugcuugagcccaggaguucaagaccagccugggcaacucugugagacacugucucugaaaaaaaaaaauuaggcacaguagcgcaugccugaggucccagcuacucgggaagcuguggugggaggaucacuugagcccaggaguuaaagguugcagggagcugugauugagucacugcacuccagcaugggcaacagaguaagacccugucucuaaaaaaagaaaaauaaacacguaacgugcauagagcuacaugugugagccuugcauuguucuaggagcucauagagauaauuccucacuucauucagucaucuuacagauuccuuucaaaugaaggauagucugucuuaauugucauuuagaugaauaacugaauaaggaggugcauucauucaaaucuuuuuuacuuuuucuaaauaaucgcuuugcugaccaagacacuucaacuuuuuugggaaagacauuccagugcuaucauuuaugcguuuugaagagugaggaagggaaguuaugauguguaguaggaaaaugcaguuuuauugcagggagugauugguucaguccuucccuuccauccaagaucugacugucuuuucuuggguuauugcuccagaucagcaccccuaguuaucguucaaaaugaaagcucaucccuucugauugacuaaggccacuuacaucuaaauuucuucgugccuguuaguuacccugaggagagcaccacaaccauaugcaugugauagcuuaggcuguucugaaucaugcguucccucaccaaagagaaaaacaaguggaugaauuucccuuuucuguagcacucaccccagugaacauaaccugucugcacagcaagucccugggccugaucuugguacaaacuugaauuggugucccuugugucuuuuucauauugaaucuccuuccgaggcgaaucacagggaagucccugaauuuccccaaagacugcuucuccaguuuucuguguugcaugugcuaccaagcucauuugcuuccuuuuggaagaggauaauagagccuuagaauuuaggugcggaaagaaccuuaguggucccuugaucagcugccaccuuuuauagaugagauccaaaaaggcacuaacauggcuugacugcugaguaaaaauagaucugcagcucaggcaugcugccuccucccagucccgugagcuuuccucuuuuucacauguguuuucuccguacaagugucuguugggaggauucucaagaggcgcacaaggucggcguacuggcucuggcgcugccggugaauaaggugguuaccgcgucagccccggcuugguuccuccacggcccccaccacugccacucagugcccacacacauuccuacuccacuuuagcuacuccugcagaugcucccaucuuccuucacagccaaacuccugguucacuacaucuuuccaucugcuagaaucucuauggcaccaaauaagugucaguucuggaaaaagccaccuuuucccugcuuccuacaagugucugcuuggugagcuggcugcacggcagcgcagccugccgagaggcuuucccugacggaaacugacuuggccccuugcaagcccaugucuuccuuuuauggccuucacucuugcccugugcuccacuguggguggagcagcaucuggcagagaugaucagggcugccugacccaacagguuaagaaaagcaaacaagucugugaggaccaauucgucagccggcagccucccuuuguggaaggugaggcaccauccuugagacaacuaaccuaguagaaaaagaauuucugaaacccagaccuuaagccagauucccugaaguggggaugaccuggggauaaaccacagggcaaagggacuccuuuuuccuccugaagagagaguaucaccucaucugaauggcuucuugacccagaaaaaucuaaagaacagcaugccuccuguuuuacggcaggucuuguucuuggaauuuuggucugcauuucugcucacccaauauugcauggcucccauguuaaugacccuuuccuacauccauccacuuaaaguuguaaugcaguccugcauccagugcccucagcugugucccugagcuguuaagcugaauuucugugccaacugacaaauaccgagugccuacucuggggaagccucuguggcuguuccagacagaagaugacaaaguucuaagugcauaguguacaaaaaaccacuaacuucaugcccgcuggcuugaucucaacaguuaagcaaaaucagcagaaggggacuuuugcuuuauuuaguuugauggcuuccuuucuaccagcuuauagaauauuaucugcuucuagguugcuaaauaucaauauaaagcauauuauuccaguaagugccaaugcaguuguuagaugcuggcgcugaaguuagugcucacugcauucucucuuguuggcugucuacuugagucaccgauuggcacagccagagcuauaaccagucugugaggauugauuugcccugacuuguaucuucauguguggucuauaaggucugccagauuggcuuauagucacaaccagcauguccuaagcaaaaugaaacuauaugaacaaaaaucagcucucauuucacugcuagacuuugguguuuucuuuaagaaguagccuuguuaaugcuuaguuuugccuugggggccuuaaugugucauuaacugccuggaaauaccuuucauuuaaaaaaguauacuuuaguaccuaauguucaauuuaguaucgaucuggauauuuuagcaaauuuugacuuuucaaagacaaaguuucugucuuguaauguuucuugggccggcuauacugccuuucaucuaaaacucacuacaguucacugggccguuugguaacaggguaaccugggcauaauuaggugcuugauugacaagagaguuaccaguaccagaagucagguucuauuuuaaccccaucauuuccaauugauuguuuuucucuccaccauuauucacugucucucaaguguuagcacucugaguuguugaacggagguuuguaugcugcgcagagcccugucgcaaugccccagcaagcuucuuguuggcauguggccacucuaaauugugcuccaggaucugcuauggguccaugcuugcaggagaaacagcuguguagaauuuccuauugcauuucauuuguggguuuagaacucgguugcuuauuucauauugucucccuuuucaguccuucaagguacauuuuuccaacuucucuaaugaauuauuacauuucugaguagcugauauguuuuuaucuuaucuaagcaguauauuuauaauuccuucuuugcauuggcuaaucugauuaguaguucagaacccaauuuucagauugucuauagcaaacugugaagaacugugcugucaaguagaaauagaauauaagccacauauguaauuuaaacuuuucuaauaccacauuaaaaacuauaaaaggggaggaaauggaaaauuaguaaaaaaaaaaaaaaaaaaaaaaaaauucuuuuugagacagucucauucugaugcccaggcuggagugcaguggcgcaaucucagcucacugcacccuccaccuccuggguucuagugauucuuggccucagcuuccugaguagcugggacuacaggcacgcaccaccacacucgacuaauuuuuauguuuuuaguagagauggaguuucacaauguuggccagacuggucuugaacuccugaccucaagucauccauccaccuuggccucccaaagugcugggauuacaggcaugagccaccgcgcccagccuaacauuuuaauaauuauaucuaauccaguauaccuaaaagauuacuuuaaucaacucccaaaauauguaagucuguuauacaucaguaaaaaaaucaauauaaaaauauuacauucucuuuuuucuacuaagucauuucagacuaacaccauucaaguucaggugcucccuagauguggcuguggcugcagcugccagaugguagcaugcaggacagugagaacugauagccucccgaggguacgagccuucacuuggccuuaauuuauuucuuccuccuguauuuucccuucuuaacauucucacuugugcacaugccgcaagauuaaaaacagguaucuuuguaagccacucugaaggaagccguuuugaaacaagacacugcauaaaugaauaaaagugucuuuuccaaaggagccugugaagggcuggauggaugugcagaugcaggcacacugauuuguaggaugccaggagaagggaauuuuguuuuuuuucuguuuucuauuauuuuguguggagccaggcugcuuauuggugucugggcagauuuggagccuacacaucuuaaauuauucauuuuucuuaaacucgggaggagaggaagacacaggaaaacugggaccucccacaguuaauuugaaguuuuuuauuuuuuaagagaggauuucagguuuguuagggauuguccuaaauugacuggugucccagauuucuaacuuggugaccugacacuuaggaaguuucguucuaaaugcacaugagaauuaauugaagggucucacccaucacuuaccugccaccugcuagacaguaugugggcuuccuccugaacccagagccaugggaaggaggccgucagggagucugcaugucagacuccuuagaaagcugguguaugugcuaacaagugaggcacaagaaugcaagaaagacuuucaucguggaagaauucuguguuguuuuagugauuaaauguauuuagcacuuuaguugguauaaauggaugcuuugaagguacuuaaauucuuuuuucuuuuuuuuaacccuacuuucaagcuaccaaguuagagauacuuaaauucaauagugacagauucccuuuuccuuacucccacuaaaauauuuacagucuuuucaggguuuuuugaaaaauaaaaacauguuucuguauauggagagauauaaagacaguauuaaaaaaauugaaucaguggaggggaaaaaauguuagcuagaaucccagagcaauuguuucuauuguuguuauauaucuuuguaguccuuucuguaaaauacacgggauuuuguagacgguuuccuuucaacauuguacuuauuuuucaguagaaaauaaaguaagcuuuaaguaguccauuuugaauuuuauacaaacaauaaacuaguggguuuaaguggaugguucuuucgaaagaaguuggaggaaaccucauaaaaaaucaucucuguauuauuugauguaaauaugcauguuuuguggauucuuuucuauuuagaaaaacaucaguggucuauugaagucuacuuacuggcauugucuguuacuuuaggcaucuucguuuucuugcaugggaggaauuguuuuucuucgugcaaaaaaaucugucucaauagaaauuauaucaaaucuacauuguccccugcccacuccccaucacacucacacacagacacacaugguaaguacuaagaagguugcugugcguacagagaugucuccaaagguuccuuuacccucuuugccuuuucuauauuuucuuuucuguuuugucuguacaauuauguugguaauaauuugcuuugcugauuauacuguaauagggugaagcagaaagagacugugauaacaagaaaaucagacuggagaaggaaaucaaaucacagucaucuucaucuucauccucccacaaagaaucuucuaaaacaaagugaguauagagauuagcaaccaccuaaucuacggugaucaacacuucuugggucuugacauagcaaagaaauuuuucuucugcacuagaaucaguggauuaauaaacucaagcucauuuggacaauguaauaaguuuguuuuucuuucuugcauccaugaggaccuuacaggaauuaacaauucauguggcagcaaauuuagauuuaucagaaacauuuucacuauggacaauuucuuuagacaucuggauuuuuuuuuucccugagggaaaguaagaaagguacccuuauuucuacuuugcagaauuggaaacaaacacacagagaaaaugacuuguccaaagucagagaauucuuacuguguguuggagccagcauuuggacuccgggagccuguguucagugcuccuucuuuuagagaugacugagaaucugucagaccacucagugucuguuguugggaagagggguggcaggugagaagugguagugccaggaagacguaaauauaacaagcagcuauuauuuacugugauuuacucaagaaauugcuucaaaaaauguauuggcaaaaacaagugcauagugucaccgugugggaaccgacagagauggggaaggcucagauguggaggguguguguccacucgucuucuugucagggaaaggcaccgguugggaagcagcugaagcaggcguucggaaugguuggggaaagucaggaccacuggcagacucugcaagcuuagaaacuauacagcuucauuuaucacuaauggguagggcuagauuuuugaaaugccucaaaaagucccugaaauuuggccuguuuacacaguuucaugcuuugugauacccuacucuuuugugccagcagccaguuuguaacuaaacaacgaagccgcuugauguguacuuugccuccucuuaguuuuacgugauguuucacuccaggcccuccaggcccuccucacaguccucaaagaaggaaaugcuccccccgccacccguguccucguccucccagaagccagccaagccugcacuuaagaggucaaggcgggaagcagacaccuguggccaggacccucccaaaagugccagcaguaccaagagcaaccacaaagacucuuccauucccaagcagagaagaguagaggggaagggcuccagaagcuccucggagcacaaggugagcaggggcggcggucacucuguaagaugggaugcauugcuguaccuuuacguucccaaagaagacaaguugcuagugauggcacuucagaacuguccauugcuuuuaaugaggcaacuguuuguguuuaaaaugcuacuuuuuggagggagaguaaaagguauuaauaauacacaaagauuuaggugucgauuuauucuucuuacagugauuucagaggugaaaaaucaaaauagauuuuugugcuaguuuuuguuaggguguuuuacaguaagaaauaguuacccuguguaguccugcuuugaauguuugaucucagauacuuucauucuugguuauaguggggaaaaaaugauccacuuucucaaauaaaaguucuucucuuccuguuaaucuggguggaguggagugguguguuuggauugacuaagagaaaguguuauguguggcuuugugaguucucugaucucuuggacauucuagucuuuuugaguccccaguacaaucagaaccaccgcuucaguugaaucuguagcugaggaaguguuuagccaggguagauugugcauuguuugauuuacucuuuuuugaaacuacuauuucgggcuauuuaagagggaugguacuuuuaggacaguggucuuaaauguuagaguguaaucuguauauugauuuuuuuuuugaaggguucuuccggagauacugcaaauccuuuuccagugccuucuuugccaaaugguaacucuaaaccagggaagccucaagugaaguuugacaaguaagacuucagaugauuucuucuugcucuguuuuguuuuguuuugcuucccccccccaccaagauagagucucacucugucacccaggcuggaguguaguggcaugaucuuggcucacugcaaccuccaccucccggguucaagugauucuccugccucagccucccaaguaguugggacuacaggcaugagccaucaugccuggcuaacuuuuuuuguauuuuuaguagagacggguuucaucauguuggucaggcuggucucgaacuccugaccucaaaugauccgccugccucggccucccaaagugcugggauuacaggcgugagccacugcacccagccacuucuugcucuuucuuccuccauuuccuccuccccuccuuauuuccacuucuccuucuuuguuuacccucucuccuccccuugcuguccucccauccuuuuucacucuuggucuuaucuugcccuagucuaguaauuuuuggcucauaugaccugucccugguuuuuccucuuuuucagacaacaagcagaccuucacaugagggaggcaaaaaagaugaagcagaaagcagaguuaaugguuaguauuggcccuuuaucucuuugguagaauguuuucugauaguaaaaaaaauuuuugguagucuccauucugcuguauuccauaucacucagcguaugugcgguggaaggagggggugcagcaggcgcaggagaaaggaguguaugggcccuaccauuggccacaacauaugcacgcagcaaaaucaggaccuuaaugauuaagggguaggugguucuuaguggugguauuuucuuuggcuccauugauucagucugaucaugggcagauauacaaaggaccuagucacaaguuuuguaucuaaguaagucaaaguuaaucuaccugcuggugauuuaaugcauaggugccuuuuuauuccacugcaucaauucuuuggaugugaaaaaugagcccugcuguugaaacucagucaacguguguucacucuaaaacauuucacaaggcaggaagccuguuuacauuccaaaauuaucuuaaagccuucagaggcugaccugaaggaagaguugagcuaggcuauuagaugagauuuuaagaugaagguaaugauuauacuguugguaaacaugcuuuaaaaacaugaauucucuuuaccuauuggcuuuuggacuuucuaaaagguggugguuuuguaguuaauuguguacauaauuaugcuuuuacaucacuacugcaauaaugagauaauguuugcccuuugucauauuuagauauccaagacucuggggcuuuugcuuauguagugaguuccuaaaccuaaauccccacaaaugcaaaaaugcaaaaaccucccuggaaagccauauguugaacuuugguacacagaggaagggcaugaguugccuuuuuugguucacaugcaaaccuaacuacacauuucagacacccacaggggucugaaucagauugauucaugguggcccagcccgcaagauccuggccuggugcucuucaacccuaaucugcagaccuguaucucuucucagacucuuucaucagauacccuugcauuaggcaaaauguugauuccuuaccaugcucaauucuguaagauagucaaagacaagccucucuagcccuguuccuaaaacugcgcuguaccagggugaccuaagucaauuaagaaucugagauugugccaagcagugguuucagcagcuuccauuuuuccaagauuauuacuggaacuguaugaaucuuuggaguuuuggaaagaguaaauauuucgcacugucagccaguuaucuaaaacuuaucuugacauuggauacuuucaguacuaagauuucucguuauucaaaggaguaauauucauacucuagggaacuuuguuuuuaaucuauucauaugcauacauucuuucuccuuaccuaaggugacuguacaucccagugugccaggacaguccugguuuaugccuguuucaucccaguuugauaaauaauuauaucccauuucacucuuaaaauaugccagcuuggacaguaagccccuguggcccacccacuccauaauauucucccuuaauagcauaauguuucaaagaugugcaguugguguuccaaauaguuaccuauccaacugaguagaaagggauguauuucuucucuacguuaucuucaacugaugagugaugagggaaacuacuuuaacaauguuucaggagauacauggaaucacagaaauauggacguuauuggccuuaugauauacuuaucuaaaggaaauggauauugacaaauugcuacacaguauuguaguuuaguuuauuucuagccuaaagccaauauuaacuuuggaaaucccaugaaagagaugguguugaauaaguauauuuggagaauucaguuccaucagugaagcaaaccggucaugccaaauacugcugauuaauuggggaauacucauuugauuuuuguucugucacuaaucugagccucgguucucuagagaaaguauuuuuugauuaaguuaccuuuuaaaauaaaaaauguuagaauaauugaauauucugaaauauacauguauacuacauguguauauguauagcagccuaguucauucugcuacugguaaaacaugagaacaguaugcacuaaagucauucuguugucagcucacugggagaagcguuguuucugcccuguguagagugcagcagcaugccuaaguagcaugacagcccauaccgcucucauugcugacgugucuccagcuccuuguauuccacuuacaucuuuacuauuuucuuucuuucuuuuuuucuuuuucuuuuuuuuuuuugagccagagucuugcucugccacccaggcuggagugcaauggcaugaucucggcucaccguaaccucugccucccauauucaagcgacucuccugccucagccucccaaguagcugggauuacaggccugcuaccacaccuggcuaauuuuuauauuuucaguagagaugggauuuugccguguuggccaggcuggucucaaaauccugaccucaagugauccacucaccucagccucccaaagugcugggauuacaggcgugagccaccaugcccggccccuauuuucauucuuuccuuuugaacauaucaaauacaaagcagaaauuacaaaugcuaaucaguugcucucaaggucuucaugggcaguacauacgccacauguagagagaaagacaguugcaucacacugucaucagcugcacuugccauaugccacuuagaagcgugcugugugacaaaguguguauucaggguguagggugaccaccaauaucugauuuuguucauauuucuacauucccuuuaagggacucugaaauguuaccccuguuggccucggaggaugguuuugugcacuaaagcagaugucaaaggagguuaaucuauugggcuguaaaaugcauauaacaauuauuguuggcuauuaugucuaacaugcucauaaaccaugaugaguguuuucuuuuuaauaaacuucagcacgcacaaagaaauaugcgucugcauuacuccagacauguggaauaaucuguuucucaaggaaguuauagaaugaguaauuugacacuaauaacaaggagacuauguacuuacugccuuaguuugcguaugugcuuucauaaggcuuugagagcauggucuuaauacgggaucauuuucuuuuuccuaaugaauuuuugcuaaaauaguuuucagcaggucauagcugacaggcuuugguuaucauuuuuaguucauucauccucacacuucucccuggccauaauuaaacuaagacaguggaggaaagucacacuaaagaaugugggugagaaacuaaaucaagguuugucuucagccuaacaaugaccauguucuucuccugcagacggacaggguuggaaaggcuuuuaaguaccuggaagccgucuuguccuucauugagugcggaauugccacagagucugaaagccagucauccaagucagcuuacucugucuacucagaaacuguagaucucauuaaguaagugccgagucauugugcuuuccucuuaaguccuuuucuuuccucaccuuuauuguuuuaauccauuugaaccuuagugugaagauggcucaauaaaggggagccuuaaaaaaguuauuggucuaagaacuaguguuuguccugaaguugcguucuagaugaagugcuagcacagaauaacuggguccaacugcaucauuuugcuaagugcgccaagaagugccaaagcuuugagggagauugguuuuuccaguuuagcuuuuuuaugaaguguccucuccucucaguuuaagccuuuguuuacuuaccuacauuucaacaggggacucaguaaggacacaacuucacuugguuucaagagguagacaagccacacaagagacguguacucaccuaguuuucucaauggccuggauuguugcucuaaagccuuggguuuuuaaauuuuuuuccugugaugcucucaucucuucuucaggaaaagucaauauaaaauggaaacaagcauaguaaguuguauuugugucugccuuuguuuaaaaccugauguacuuuuauauuuuccuauagauucauaaugucauuaaaauccuucucagaugccacagcgccaacacaagagaaaauauuugcuguuuuauggugcguauuuuccuuugucuaaauaguacuaaauuuguuuuugcaucuguugauguuacaaaaagauucugaaauuuguuuucuuaaugugaaaauuaugaaaagcaagucaguacuuuggucaaaagguuaaucccucacugauaguaauucuuauaaaaugguaucugcugccauuuuucugauggcuugguaaaugcuuuggucuugugauauaaauuauauccuuguguuuucuaccagcauuuacuuuugggauaguaugaacagagcaguaagauacuuuacauacuaacucacacaggugaggcaaacccgguguguucauuaggcuauaaaagguuagauggcugcuuuucuguaguaugauagucacgugcaguuucacuucugucuuuguucauagcaugcguugccaguccauuuugaacauggcgauguuucguuguaaaaaagacauagcaauaaaguauucucguacucuuaauaaacacuucgagaguucuuccaaagucgcccaggcaccuucuccaugcauugcaagguaacucuaagucuaauauaaauaauuuccagaauugagucauuucuuuauuuacuucuugcuuuugcaaccauuuguaugcuuacauaugucacuuugccuuuucaaaaauuguuggcuucaucuguuugcugguugcuccuaaauuuaaauuauuagcauauuucuaccuuuuugagaaauaguuauaaaucaagguuuuugcugauuggaaaacauaaaaagguaauugcaaagaauauagaauugaaauuuuugagcuuugagguuuuuguuuguuucuuuguuuguuuguuuuuugagacagagucuugcucugucucccaggcuggaaugcagugcugcaaucuuggcuuacugcaaccuccaccucccagguucaagcgauucuccugccucagccucccgaguagcugggauuacaggccugugccaccaccaugcccagcuaauuuuuguauuuuuaguagagaugggguuucaccacauuggccagauugguaucgaacuugucaccucaaaugaucugccugccuuggccucccaaagugcggggaugccacaggcgugagccaccgcaccuggccgagcuuugaggaucuuuagauaagccuaagaacacaaaacaagaggcggagccaacagaaccagagccagaguccuuucucucucuguauguauggacauagcuucuuggcauuucaguaaacaagaaauuuccagagccauaugccacaccagcaauacuaagaaugaaaaugauuaucuuuagcaaaauuuuuuuccccauuuugugaacuaaaauuguucauguaugcuguaaguuauuagaaaaaaagaauccuuguacaaguguuuuuaaagugaagcuggaauuuucuucccuguaguccuugccuaguauuuuuuaauuuggucauacuccuugugaaguuccuaguucugauaagcuuugcuauuuuaagaauaucacuuacacgacugcccuauuucuagcacauucaaaagaagagacucccauauggccucucuuaaaaaagaaaguccugauuaagaagcaacuucguauuaccucugaagauuuucauggcugcugcauugagauauuauucuaagcuaauagauugucaaucacauuauuuacauaacuccuucaaucauuuguccauccaguauauacugagcaccuucuucauaccaagccuuguuuuagguacuggggauacagcagacaagaaccacugcccucauggagcuuucacucuacuccuugcaaauguacauucugcuagguccgugcagcccaaacggcagguguaacaucaugaggcuacugccgcugaaccaucaucuuuccauuuuauauucauuaacucuuuuuuauuuaguccacauugagucacauguuaacuugcagguccagauauucagccaagaguggaguaaagaggagauagagucuucugaugcaugauacuuaauauuaguucauucauuggcucagcaaguauuuaucaggagccuacuucuagcaccuauugugcuaagugcuaguaaugcaaaaauuagugagacauuauuucugcuguggcccaggaaaaggaauaaacaguagauaaauguaagaaaagagagauguucaagugguggcagaaaggaagcugugauauauccaggguauccacagugucuaaaagaaugcaugguacagagcaggugcucaguuaguguuuacugaguggaugaaaggaugaaauacaggugggugcacacacauaccuacauaugcauacauuacauacauagaguauugucuuacuaggagauuccaggcagaggaaguagacuaugcgaauggcaugggaaagcauauuuggaauacagauuagcccagcagggugucucguugaccuuguaggagugacuuuagcagugguuaucauuuuggcagguguauagugaaacuuugugucuuggacuguaguuccagacacguaaaucugugauccaggggucuacuggugacugacugaucaguuaucucuucucuuccaccucccagaagcacaggcacaccauccccucuuuccccaaugccuucuccugccagcuccguagggucccagucaagugcuggcaguguggggagcagugggguggcugccacuaucagcaccccagucaccauccagaauaugacaucuuccuaugucaccaucacaucccauguucuuaccgccuuugaccuuugggaacaggccgaggcccucacgaggaagaauaaagguaaauaaauggcuuuguggugguaauuacugggguguuuggauugggaggaauaaacauugguuuauauuuuauaaguucaguuucuuggagaaaagggaauguguagcuguuuuacuuuaauuauauuuucucuauucugccucaaaaccuaguugcgguuguuccuugagcacuguggcauggagcugaguuucuguggcuagaucuuagcaaaaccaaaauacaaguggcuuuagcgccuugccccuucugaagcucugcugucauuacuucagccugagcugaaaugcuagcugaaaggcagggcaaaugaagaagaggagccacuggcuguuccuaggcccagcacauuggagauacaaaguagcauaacccaaauaccgagauuauuuguuuuuaguauauguuaagaaagauaguagcuaugguacgagagauacagcguaguaaacauuauugagacuuguuuggggaagaagacccuuggagaaaugcaagguucaggagaguuggagccagcuggcuguaacuacuuacuuucgacauagagccucuuagggccuuaucugucuuaucaaacugauaaugcuuuuaacuuuuuuuuuucauuaaugcauccuuugaggcaaagguauaaauuugguguuuuccaagugccagccauugugcuaagcauuauggauucagcucuaaagcaaaccugguugguagucuaguggagaauuagcaagcaauuacaguagauugugauuuuuuugaugugauuaagugcagaauauuguggggaccuaccuucuggaaccuugaauuuuuguuuccauuuuaauuuuugugugugcuuguguauuuacuuguuuuuguuuuguuuuguuuuuuuugcagaauucuuugcucggcucagcacaaaugugugcaccuuggcccucaacagcaguuugguggaccuggugcacuauacacgacaggguuuucagcagcuacaagaauuaaccaaaacaccuuaauggagccccagguugauucaaugccuugggaacuauuuuugcacauuggaagccucaaaaacaguccagacauuuguuucaucaggacaccaaacucuaaaaaagaagcaccacgagauggccaggacauuuguccacuuaaacucucaacaacagugugaucauugguuggacacugugguuaugcagaagcagagaugaggaggcuggccccagagaugaucuugcccuuccuaacuaaaggacagaagugcaauuuagcuuaaauggguguaugaauggucuagaaacauuucuauuuuuuuuuuaaaccagcaggauacaaguugcaaaugaaaugaggagaaacaguuucaacucugaaagugaauuucacgucaucucaguagccacgcuaguccauucccagaaggaaauuuuuuuuuuuaacaaugacuuuugguaaaggguuuuguggaugauuuuuuuucuuuugaguuuugggagaaauauuuguuuaguaacuucuaauggccaucuguaaaccauaaguaaugaaggacuccacugugccccacuuucugccaaugaacaguggcuugauaauaccaaguauuguuguaauuuauaaaauugaaggcaacccccgcuccugccgcccccaaucuccccauugccuagagcgcugcacauugaccccagcucugacuucucauuacugugcugaaagucagcccacgucggagcggugaggaggagccacagcacauggggugccaccucgaggucugcacaggaggacuuggcgcugccauuuccuaccccugccauuucccaccccugcuucagcgaaagggacucucuaacagggcagucacuguugacucuauucugaauuuccucccuuggggaagaagggaaccaacauuuauaccugaccagauggcuaaagugcuuuuaaaguuuuguuuaaguagagcuggaauuugaggugcugaucuguggucuacaguuaugugguaacucauguuguccagccaacucagaguuucgucagugaacaagaaacaugaaaucugcuucuuagagaggcuauauuuuucugcuacaaauauuuuauauuuauagcaaaacuagacuuucagaguccuugauugucuaggggaaguuaacucccugagaggauguagagauuuggggugguugauuagacuuuugaaaaacucaucaccacaugccuucacuccagaguguucucagcuagauuugauuugguugaggaggaacuguggcccuccguaaguuauugccauaguguaugcauuaaaccaaguccauuuugaaugaccuaaaaugaaguaacacaaucagaaaucccaugugcccauaagcacagauuuuucuuuuucauugaaacuuuaaagguuauuauuggaaacauuacuuugagugcaguguuuuuaaaagccaauucuuuuuuaucccuuuuagaaguagaauuugcacacuuacuacaauugaggagugucaucucuauaacuuuuucuccgccuuugucccauucugccccuguacauguuuccuaccaagcauguuucacauuuuccuauuaguggaggagggagaaccauauuuauuuauaaugaagacaucuaagaucccuaugaugaaugcaggaacucucuugguaguuuguaaauacacaaagggaugugucgagggaugggagcgaugcuuaucucucacagugugaguggucugugugaggcuguuccuucaguuucuucuccagacuguucuuugguugucacuaagucagaggucuggucccucauguuuaggugaaagccagagaaugacagcuguagucauaucugagcauaagaccuugaugugugauuccugaugaccgguuucauuuauucauguuauaaagcaaagcccugguccuuuuuaaacuacuaguuuuaaaaaccuguguuaaaugaacaguaauugccugguagguuugguguguguguagcauuguguguccaucuguuauauguaaaggacaaggcaccagaaucaggcuuuauuucgauauugaagauguuauuuaacaucuuucuuuuuuccuuacucccuuagccauccccuccccuuuuguccuaucauucccuagaacaagccaccugucaauugugaaggguuguguucuuuauggcagguucuaugcagauugugccagagcaugugcguguucuguuggcaagccacagugcucccuugacugaagacauuuccagguagauuucucagccagcucuaaaacagauugcuuuuucaguggccuuacucuuuguggguuuuuuuuuuuuucucugaacuugauauaaagauuuuauuugucccuugaaaaaguaacaaaugugcauagaucaauuuguacuacuuuggucauuggauauuucugauccuuauugcauuguaccuaaaggagaguaacuaaugguaaccuuuuuaauagaguaugugaaagguaguggcugaugaauccuuaacguucauagggucuuuuugcuguuacgguuguauauagaggucugaaggauuuuuaaaaugauuugcacuuuuucacugcaugcuuacaauucccaaaggcaaaaucuguacugagguagaucauuugaaagggcuagauuauaaaauuaagccuuagaguauggaaaguucuuauaacaauaauaguacacacuucagaguaagacaaaugcaaagcaucuuaaggagugaaaauagaguguaaaucuugccuuuggcacuacaaggugugugugugugugugugugugugugugugucuuuaguaggaaauggaagaacacuguuuuauuuuuuaaaguguuuaauguuucuguccuuucugugaauuauugaauuuaagagcccugcuaaauaaugaaaaaacacuuuacuaaaauuuaucaaauuauacuggguucggauugugaaaacauuggccaccuaguagcaguggugaggagugggagggcccagcaagcauuuaucagaaauagaaucacaauaggaggagaauuugacugucugauauuaugauuugauuacaauacugaaugggaaaaguaucuaauauuuuguaacaaaaagaccuucauauuaucuguuuugaccaaaauauguagcuauuucccuuacacagauuggaccgcacuuaucucccuuguccuguauccuuuaauuucaggucucaggauguuuagaaagcuaaaacccccuaccccuuucuggcugaaaacuugccuuauuugguaucuuacacauuaauguuacuagcaucaggagcuuacuguuuuauuaugauucaucuucaguaauuuuuagaagcaagaagaaagccauuguguccucuacaauuaacaaaacuuaucucugauauacaaagggauauaaauauauacacuuaaauagagaaaaagagguugauugaauugugccuuugagugaacccaguuuuuaaauaccgcuguguuuguuucgccauggcuucagggaugcuacauggcucuugcaccuuuuacuccucugcuuuaugaaguuugaguuguauuugugcaucuuaaaguagguugaggcuugaggcugggcuuucggguuuuuuuguuuuuuguuuuguuuuguuuuguuuuguuuucuuguacuuaaaccugcuugcuuccuaccacagauucuuuauuuucccaaacacuacaaaaaaacuuuuaaaacuuugccauuucaucuguuuacacucuuugccacugauuagcaguauuuaaaucuugcaagaauauuuugugcuuucuuuagaaacacaagaguauagauuuuucucacugaaaagugagaguuacgcauugcagccaugaagggaugcuaggaucaauuauggcaguaccuuuuuuccccuccuguucuugagccaguugucucuuuuguuuugggucccacuuaggauuaauggauguaagguauuuuccugugccuuuauuuugugucauucuauuggaaggagguguaacggcagaauagcaucguguuggggguuuuccuucaaacacugcaagugauauugccaccaugugaaccucaaauaugcaauccaguuguguugguuucucggugacuuggaguguucaucucuucaugaauugugagcacugaccauguucuucaguucuuaauuauggugaguugacaaauaccaacuacugcuuuucuuuagguggcuauaaauuucuuacugucaggaggaaaugacauuauauucuguuccacugaacgucagagaucagcaggcacuguacuggguagagaagugccuauacuucucuaccuaagagggcaggagggaaacccuacagcuccuugugagccuauauauuaguauaucggccuggagaggacaagggaauaagaccacucauagugaggcuggccaagcugcacuggucggaccaggcaguggcugaccuaaggaagacaacuugcuuugcuuaaaaguagauuuuuuaagcaaugcuuaacacaggcagcauucaccuuuguucaggccaucgacauguauuguuaaaauuacugcauaucccccucagauaucaaguauacacuguucauguugggguuguguguguguauguguguauguacgcacgcaugugucccaaaucuuguuuuaauuuuuuuuuucugaaugugaucauguuuuggaugauaccugagcaggguugccuuuuuuuuauuuauuaccauuauauauuauauuauauuauauuauauauuuuuugcuuucuuauaacuuuggaggaaagucaaaucuugguauuauuaaaauuguuuuaaaaaggaguaaauuuuccaguugauaaaugaaaaucacuggccuauguuuaauaaguuuuucuuuaauuacuguggaauaacgugccagcuaucaucaacacaaugauuuuguacauaggguagggaagcagugaugcucucaaugggaagaugugcaacacaaauuaaggggaacuccauguauuuuaccuacuucagcaauggaacugcaacuuggggcuuugugaauaaaauuuagcugccuuguauagucguuugaaagaauaugugaucugugagagaauuauaguuuuuuuuuagaagaaaaaucugcaaaagaucuuuccaaagacaaugugccacagaucuuuuguucucuguaaugaggauuaauugcuguuuaaacaaaaauguaauuguucaucuuuaaauucuuuccuuuucauaagaggaucaagcuguaaaaaaacaaaaaaauuaauaaaaauuucgagaaaucauugggguugaaucca

SEQ ID NO: 191492 - RNA, 30948 nt, Homo sapiens
cacauuugcauaacuuuuauuacaauauauuguuguaauuguuccauuuuguuagcuauuguuaaucucuuaaugugccuaauuacaaauuaaacuugaucguaauuaugcaugcauaggaaaaaacaggccggacaugguggcucacgccuguaaucucagcacuugggaaguugaggcgggcacaucacuugagcuuaggaguucgagaccagccugggcaacauggcgaaauuaauuagucagaaauauguauauaccaacauacuaauauguuucagcuauaaauacuucuaacauuucacauguauauuuauguaaucaccacaaucaaacuacagaacuuuuccaccacaaggcucccuuuauagccacauucuccuucccuucagucccaagaccuggcaaccacgaaucuuguuucccaucucuauagcuuuauuauuuaagaauguuacaaaaacagaaucauacaguguguaaaacuuuaggauuguccccccaaaccacccaagcauaauucccuugagguccaugcaauuuguuacauguaucaguaguuuguuccuucauauuacuauuuaguauuccaugguguggacauacuaaaccauucacucuuuuugaaggacauccagguuguuuccggguuuuggcuauuauaaaugaaggugcuauguaacauuugugaauguuaaguuuuaacuucucagggauaacugucaaguaguacaaaugccaguuauauguuaaauguauguuuaguuuuauaagaaacugccaagaauauuuuccacaguggcucuacuauuucauaucucaccagcaacguaugagugguccacuuauccaauuucucuugcauccuagcaaaacaacucuaaaauuuaucauuuggaacugucuuuucuuucugcaaugguauuacguguccuuuuagaauugaaaucaaggguagaaagguuagauuuaguccagccucccauuucauauuagcuguaguaacaauccccuuuacaacauuugaucauuauugccacuuaacacuuccaggauuagggaguaguaucuuucuuucugagggaguuuauaucaguuuggguaacagauucucauuguucauuuuacugcuuuccuauuucuuccucaucuuccauaaaaggcacaauaauaaaucuaagcuuguuaaaacagaaacaaaaacaacacaaguacuaaaacgaggguuuuuguuuguaaaacugucaauuaggauuuuaauucauggucagugaagaccuucaggauuuucccugcccugcauuuucuugccuuuuucuuucagaugcagggauccagaguccaucuccauugugcccugucuuauguaacaucauccuagcucuagauucuuuaauugguguccuuuccccagacguacauuagguguauggcuccagguuaugacaacagccuuccagaagccuuagacaccugaaagugauagcagugcagaagcagaaaggugccuaaggauuucuaccagcuugugguagaagaguggcuugucuggaugguuugagggaaaugaccaaauaauaaccuaccuacaccaagcauuguacuuuuccuauaugcuaacaaguuuuaagauguuucugaacaaguuuuaaaauauuucugaaaaugaaauagucucaaaggaguuuugauuuugcaagaucacuuagcaaaugauccaaggauaacugacaggauucuauauuguguugguugaaaauuaagaauccugagccauauuccagaccugaauaaucaauuucuggggugagguggagcagguaaguucccugggugcuuauuuagcauaccaaacuuuaagaacugauuaucuuuccuuucauauauuuugagcaaaaacuguaccuuuuaggaacagugcauguuuaggcaacaggugaauaaguacauauagaaacagaacuccaaugcaaaguagagugauguacaauaagagguguagagagcuaugggguuucaaaacaggaggagagagcacauuauuaacuaaauagagaugaaggaaggcuuucaggaguagacagcauuuacaaaugacuggcaguuaauuuucuuugauaauuuuuauuauauacauaucaguacucacaauacguugcuuauuuaagauggcuguuuauaaguauaaagcaguuugagcaacacugauugugcauuauuguacuucagaugaaaaauccuuacauguggaaucaaugucuuuuaaaauuucagauaaagaauuuucauuugaggagacauacaauuguaagugcucauuuuuugucaauuuuaagacaccauuauguguaagaaggauuaauuuuaccauaaaauuacaaacacccuccaugucuugacauucacaugaaagaacagcauaacauuaaucauccaaaugcauaucagagcaaacucuaggccuuagugugaggugaacacgguaacugcuacauuauggaaaucgguugggccuuaguuaaauauuguaguauuuuuaaaauuuguauauugaaaaagacaaaaugagcuguuaagugauaaacagcuuacucaauuuagcauaacuuuaauuuagaaauggaauagugaaauuaaaaaaagcauaugaagcagauaaacaguaugucuuuagaaauauuaaagauuuuuacucuguuuacaaguuuugcuuuuuugguuaugccucuuaaauaucugucuuuuuacuuugucuauaaaaauaauuguccuuaguauuccuaaauucuuuuccaaauaaagcaauuaucguuuuuauaugguaagaaguuacugaaucauagguuuaagaucaguggcacaaaucauacauguagaagauuauguaacaaauucauuguuagguaaggagucagagaguacaguacaguaacagccauacaggagagguagaauucuuaaucacaguuuuauagaaaagaugcaguaguuuauaucuguacccugcuuuauuaguuaugguacuguaaauuugcuucucauugcaaauuuaacagcgcaaaagggagggguauucauaggcaaggaucuuauugaccuuuguucugcaaguguugcagaggauaccccuagacaccugaagcauuuucuuggccaauuaagguaauugaucauauacggcauuuaccucauuuuuaaaaaccuugccaguagggaaaucuaagcugcucuucucccaggggccuaagagggaaauguaucucuuuuuauacuacuaugaguguaaaugaaaucacucucugguuaucauuauugcucaucaagaauuccagcauuacuaaccuguugagggguucuauaccccaaauuuuaaguuuguuucuaacucacaauguagucauaaacaacguuauaaaugggcauaacuuaaaaauuauaguucauucaugaugaaguuaaauuacuaguacuugaguaagacccccauagacuucaaaaagcuagauggcagaaacuuuguuguauauauggguuauucacauuuagguguuuaaaacuugggagucuauguuucuaauccuuacuucaacaucaauaaauaaaguguucagaaaggccauuuuaauaaaaguuguuauaauaaaaauuuuuaauaaauauguacacccagugcuaaaccuuacaguagggcuuacauuuuauaaaauguaccugcuuacaaaaauaauucaaaccagaauucuuguagaaaauaaaaaccuacagccaaaguuucuuccagcuaacuggaaauuaaucaucuccuuugauuuauguuaugaguaggaugucaugaugagccagucagauucuagauauuuauuuauaguucuacuuaagugaauuuuauuuuggauuagguuuucucaaguuuuucuaaauucuuuccuguuucugauaauucuuagagcucagaaaaggagauauuuauuuaugguaggcccagaucauuuuagcaauauuuccuucauaacugcugguaauaaugaauuauccaagucagcaaucauguuaaaauuaacauaacaugauuauuaacuguugacagauauuaacuugacagauacuauuaaaaauaaacuuauuuuaccucacauuuaauuuuaaaauccuacacuuuaguuaaggguuagagaaaaugugucccuauggaggaggaagcuuuuaaacuauauucuucauuucaaagagaaaacauguccuaauuuuaguaaguguaacuuuguguuuuuaagaaucgugaaaaugucagcuuuugggaauguaagcaaaguacaaagacuaaugcuuucugcuaauauguuacacugaaauguauuugguuauaaaaaucucaaaaaccuaauuguauuucaaagcuauuauucuauuuacauuauaggagagaugcauauguaaauagagaaaaguugggcuuuuguagucuaaagauuuauucaauccaucauuagguaauucucaggugauuuauaacuuaaaacugaaaacuuccacaguuaauuuguaacugccgcauuuacaaaaaaguucuggguaauagaaccuguuaaaaacagacugguguugcaauuaggcccaauacucauuuauuuaaaucaccuaagacauuugcaaaauuuuucaaaguuaggaaaaugcaguuauuaauauggcuucauucaguuaaaccuauauucugcaaaauauuccuguuacacacuuaaguacaacuggaucagcaggauuacuugcacagaaagugaagacuuaauuuucacauuaaaauuauaccuguuuccuacuuuuauaucucaaaauauuuuggagaagaccauuaauggucuugacuguaacaguuuauugcauuuuuaugccucauuuuucaauguuacguacucuaguuuggaguuuuaaguucuacuuuuccucuuaucuucaaacagacucuucagcauauaaacuugaauggcugacaccaccaccaugaccacuaaauuaaccauagaccagaaauugacucuaucaaaguugcuuucuuguauguuucgaucacgagcuucaaaugcucuaagcagaguuuguaugugcccacuuuugcuuagucuggacuugaugcuguugauggauuccuggagauaaauaaaauaauuuuauuauuaaagaaugcucagaaauuuuaacuuaauuaaaaaaugaggcugggugcagugacucaugccuuguaauccuggaacuuugggagacuagggcaggaggaccccuugaacccaggaguucaagacugggcuggacaacacagacagacucugccucuacaaaaagauggguaugguagcaccaaguguggucccagcuacuugggaggcugagguggggggaucacuugaguccaggagguugagauugcaaugagccauaauggugccacugcacuccagccugggcaacagagugagugagacccugucucaaaaaaaguuuuuuucaaaauaugcuuuauguuuuuuauccaaacacaauuuuaaguuagauggcugcacaauucaauuaaagggcagguacuauuuauauuacauuagagauucucuguaagguuauauaauaguucuccugacauauuuauauuguuuauaaguaguuauuuaacaagggaacaaagcuacugugaauugaaaauagguaacaugaaauuauucugaguggcauagcaucaggaguuuuacguacauuaucucuuucuuaguccucacacaaccaaaggaaaugacuaagguuuuuuuuuuuuuuuuuuuugucgggggauggaguuugccuaggcacaaucucggcucauugcaaccugagacugugccuggucaaaugauuaaguuuuuagagauggggucuugcuauauuggaguguaguaucuauuuauaugugugaccaugguucacugcagccuugaacugggcucaaaugauccucccccuaaccuucugaguagcugggauuacagguaccugcuaccaugccuggcaaaugauuucauuuuuaaaaacccaauugauauaacuuuagguauuuaccuauuacauaaugcauguguuuauaauauuuccuucuuuguauguuuaucugaacaauuuaguauucaguaaaacacccaauguuuuaauaccacaaaauaguugugaaauuagaaaacauuuuacuuuucauaugccugcuguauaaucagaagcauaaucuauuuauaauuuaaaaauucuaacugcacauuuauaaaacaaacuuaccaagaugcagucuuauuugcacaucugaagcuauuuuuauaauaggguccuggaagauaaguuauuugaaaacuauaaaagggcuauauuaauauaaaauaaaauuaagcugauacuugaggucaaaguauuuauggcaaaaauaaaauauuagaaacagauuuuccuggauaaugcagauaaaaugcuuaguucaguaacuuauuaccauaguaaggccucuggcuguuaauaauuuuuauuuuauuagaagaccauacugaccaggaugucuuccaguuucauauccaauauaucugugccaguaauauauuucuuccaaucuucuuguucuugugccuguucucccauauuauccaggauuaauucaaagaaaaucaccuucucagaaauggugcugaauguauugucaaagcagaacauguaaucaccaacuucagucucuacacuguauaaaaaaaaguacauguuuuaaguuaccuguauuucuauuugugaugaaaagcaacuaaagguaaaaauaagaaguaacaggcugaguguguugccucacaccuguaaucccagcauuuugagagggcaaggcugguagaucacuuuagcucaggaguuugagaccagccuggguaacauggcaaaauccugucucuacaaaaaaauaacaaaaauuagcagagugugaggauugcuugagcccggaagguugaagaugcagugaggcaugaucaugccacugcacuccagccugggcaacagagcaagauccugucucaaaaaaaaaaaaaaaaaaaaagaaaccaacaaaacaaaaaacaaauaacauaguuuauaguaauuggacagcuuacccauaaauuuccuuaguauugaaagauaauuuauaauuucuugggaaagaagcaaccugaaaauauauauguucaaguacaacuuagacauguuuggcauuuacucaguaaauuaugguuagugaccucauuuuuggaaaaggauagaauuaaaaaccuguauacauaacucauaauaaacuuuaauauuuauacauuauuaaaaguauuuuaucaugaguucaauucauaugcagauaugacugccaaccuacccuacaacugagauuaaacugaguuuuguuuucaaaagcagugauggauuguccuaaaugucuucuuccaggccucuuacugauuuugccuauuaacugccacuggcucccuuauagauguuuauguuugauccuaaaugcuuuuuuugagaauuaaauaaaacuaguuuauauuuuauuauuuaauucuauaaagguaauucagcccaucauuaauuaugccaagugcugaagaaaaaaaugaauaauaucugaauuaccaguacccuaguuaaaauuaguuucccauauuagcgaaaguuaaaagcagggccaggugcgguggcucauaccuacaaucacagcgcuuugggagucugaggcaggauuacuguaggccagggguucgagauuagccugggcaaaagugagaccuugucucuacaaaaauuaaaaaauuagccgaguacacaccuguaguccaagcuacucgggaggcuugguugagcccaguacuuuaggcugcaguaagcuauggucacaccauugcacucuggccugggcaacauagugagaccuugucuuuaaaaaagaaauuacauuuaaaagaaaaagaaaaagccuacuuaagaaaaaccagugacauacucagauguuugcugcucuuacaaaauuaauauagcuaaagauaaaagcuuuguuuaauguuuaaaaaacagauuuguaggccgggcacaguggcucacgccuauaaucccagcacuuugggaggccgaggcaggcagaucacgaggucaggagauccagaccauccuggcuaacacggugaaaccccgucucuacuaaaaagacaaaaaauuagccgggcgugguggcgggcgccuguagucccagcuacucaggaggccgaggcaggagaauggcgugaacccaggaggcggagcuugcagugagccgagaucgcgccacugcacuccagcugggcaacagagugagacuccgucucaaaaaaaaaaaaaaaaaaaaaaauuuguaaaucugguauagugauuaauagugaguuggacugccugaauguauauccuggcuuugccguucacuagcuguguaaccuucagcaacuuaauuguucuaugccucaguuuccccauugguaaaauaauauuuacgucauaggacugugguuaagaauaaaaaaauuaguacaugaaaagugcugagaacacuggccuggcauaucaaaagaaugcaauaaaugugaacuauuauaaacucaauuauuuucucccaauuauuuaaugagagguaauucuacacaaggaagcaguaagauacuuauuuuucuaacagugaauuuuauuaucucaaaaagggagcaaauaauuggggagaaauaaagacugacauacauuuugaacauuuuuaaaauucugaaacuuaaaagaugaacuacauuuuuaguuuuguuuuuuuuuuugagauggagucucugucgccaggcuggaguacagcggcgccaucucagcucacugcaaccuccgccuccgggguucaagcaauucugccucagccucccaaguagcugggacuacaggcgugugccaccaugaccagcuaauuuuuguauuuuuaguagagacaagguuucaccauguuggccaggauggucucaauuucuugaccucgugauccacccaccuuggccucggaaagugcugggauuauaggcgugaaccgcagugccuggcccauuuuuacuucuuauacaccuaucaaagagaaaacaguuaauuccaaguauaucaauauaaacugacuuuuaaaauuacuauuucuaucuuauuuaguaauagcuuaugcaaauauuuuucugagcucugcauagguaaaaugccauuuaaaaugcauuuuaaaugaguaucuuaaaaaauuauuguugagacauuuuuuuccucucauccauucauacauguauucaguguuuacugaguaucgauuauguaucaggcauuuugguuaacaaagaccaauaauuuuaauaauagcuaguucuuacaauaguguuauguaccagggauguucuaagcauaugguagaaagcaaagaguuuugguccauccugucuccacccugcauguguaucccuggagacuuauuugacuucucugagccuccuugucuauaaaaugggaaucuugagucaaagacucuaucucauaguguaauggaaagauuaauuuagaagccuauaacaugccaacccuuguuuauagcaaauacuagauacuccauauuugcucuucuuccuacagacucacaguuuaaacauauaacaaaacugacuuaagaaaauguuauaguaagauaauagaauggaaccaggaaacauaccagugagauaugaaaagagggaagugaggugucagaagaagaauauauggucuuuugcugaacucugaacucaaagaguuauaacaaguauuuuauuuuuauauaguucccuaugaucagaucuuuuacuuucaggccuucuaauuaccuaaaacgaaugaggucugaauaaaaaaaaaaaauuuacguacacacaaagauauacuguccuguuuuaagaaagaaaacuauggacaaaaauggcauauagccagcagcucaagaaacuuuaagacauauaccuggaacaguagcuuuaaguuaaaauagaaagcuugugcuggccagaaggcagguuuaaaaugccacgauagauugaauggaauaccaggggaauacuaauuuacuaaccaaagcacagaaaaaauuuagccuggaucaaaagaaaacgcuuaaacaaaaauagaaagguuaauggaagauguuuuuguuuaucagauggcacacuaucaugaacuguuuuaaaucauauggaauuaucuaauauugauauguaguaucaaaugugcuaacuuuccaugcccugcagauaacccacugguauuauucagcaaugaaacucaacuaaaagagauuacuuacgugugaacuccaucugauuuucuuuguucaaaaacuaagguuuugccuucuggagaggcaagauggaaaucaauaucuaauccugcuccaucuaaaaccuguagaaaagcauacaugagaaaaacauauauuacaaauucuggaaauaaaaaauuauauacaguagaucauaugauguaaagauuaucuaagcuagagagguaagaaagucaucagugaugucugagcuagaaaagaaccaaaagaucaucuaguucaauuccauucauuuuuggaacuugucccuuccuuacccauuucucucaccaucaccuaaauuuaggccuuauggauauuacugaaauaaaucuuccuaaaauagugguuucauucagaaucccuguagaauggacggaaacacaaagagcaguucaaaugcugggcguuuuaguuaaaacuuaggcaauuggcagggcgcgguggcucacgccuguaaucccagcacuuugggaggccgaggcagguggaucaugaggucaggaguucgagaccagccugaccaacaugguguaacccugucucuacuaaaaauagaaaaaucccagcuacucaggaggcugaggcgggagaaucgcuugaacccaggagguggacguugcagugagccgagauugugccacugcacuccagccugggcgacagugagacucgguaccccgcccccccugccuccccugcccccccaaaaaaagacuuaggcaauuucagacauuguauauaacuuuuuuguuuccucuucaauaaaagaauaauaauuaacuguuucuuagccuggaauucaagaccaccaugguguggacuccaacugacuucaacacauucuucuacuacuucccaguaugaauuguguauucgaagcaggccgguucauuuacuagccaaugaauacaaucuauccauuuguaauuccaaaauguccuucuaugaagaugaugaugauaaucauggcaacuaacaauuauaguugaugccauaaauugucuuaaaugcuuuauguggauuaauuuauuccuuauaacaacucuaaaagguagguccuauuauucucauuuuaguaaaaaaacaacaaaaacugaggcacagagaaaucauuuuuccaaagugacacagcauuaauucaucuaggccacauuaaaaaaaauaaguaaaaaauaaaccaaagugauacagcaaauaagugacauggucaaaauuugaacucagcaaucugccucuagaauaauuuuuaauaaguaugcuguguugccucuauuucuguuccauucuccugaauagguacucauccaauuguauucauucuuuaagagccaguuuaacccauuuaugccuuguguuccauuaguggaacacuaagcauguaggaguuauuuauauccuacugcucaaggucauugccaaggucucauuuugcaauucaaaaaauugcaaccuccugcauaaaugggucaaguccuuugaaaucuccucugaauccuccuguccaguucucucacacucucucuuguauuacuacagauugcacaccuauccucuuuggcacuuaugagacguucucuggaaucuaagcaucuuuuuguaggauucacuuagcauaaacuuguagguaccuuuauggacaccuauguggcauauccaacauagaugauaagauggaugaaaauuuuguucacuauuuuuauaacuccaaggguacugguccuaacaauguuauuauccauauuuugauuuuuugucacagaugcaaauauuuaauaaaugcaucuuuuuaucauccuauacaaauuaaagugucucaguguuuucccuguagaucugucugcaaacuucucuuccugucuuccucuuucccugcguuuucucuucuguauuuauaguguuugcuaaaauuuuaaaaagaaucuauuuggaacacuauauaguacagccuuuuaacugaaaaaaaaaaaaaccuaacucaauggcuacucuuuuucuuaacacuccauuuuauuuuucaugguaguuuuaaugugaugauauaaaaaauuaccuacuccugugcuuuuauuguucaacagaacugguuucaaauggcuggcuaaauguacauaauuuucuucuuuaaaucccaaugaaaugaagaagacauguaacaauuaaaaucuauaggcugggugcgguggcucaugccuguaaucccagcacuuugggaggccgaggcgggugguucacuugaggucaggaguuugagaccagccuggccaacauggcaaaaccccaucucuacuaaaaauaaaaaaaugagccagccaugguggcacacaccuguaaucccagcuacuugggaagccgaggcaggagaacugcuugaacccaggaggcggagguugcagugagcagagaucaugccaccguacuucagccugggcaaaagaaugagugagacuccacgucaaacaaaaacaaaaaacccacaaagaagaaaaauuccuguuucaaaagaugaaaaucuucagacagaaaggaucuaauaaaugugaagcaggauaaaugaaaaaagaccauaaaauauggaguuuuccaaaggauuuaaaaaguacaaucuucuaucaaagagaaguagcagaaguaguagagaacugcaaaauacaagaauugggauuagcaucagaauucuuacauauaacauuagauggaaaaaaauaauggagccauguagucaauguucccaaguaaaaagauauuuacugacaugaaagcaaaaauaaagccauuugccaggugugguagcaugcacugguauucccagcuacuugggagacugaggugggaggaccacuugaggcuaggcguuaaagccuguaguguucuaugaaagugccugugaguagucacugcacuccagccugggcaauacagugaaaacccaucucuaaaauaaaauuuuaaaauaaauaaauaaaguuauuuucagauauccaaggacucaaaacauucucaaagaauuacucaaggauacccuccaaaaacaaaaaauauauauauuaaaucagaaaacaagcaauguaacaaagcuaagaaaagauuucaguaaaacaaaguuaaaaagcaguuauugguaguggcugucaggcuuaaugaaauugugaaaaaugauuuuuaagacuauggaagguuaauuaaaaaaucauaaaauauacuuuuuuuuuuuuuuuugagacacagucucgcuuuguugcccaggcuggaguguaguggcgcgaucucagcucacuguaaccucuggcucucagguucaaaugauucucccgccucaguguccugaguagcugagauuauaggcaugcgccaccaugcccggcuauuuuuguauuuuguagagaugggguuucaccauguuggccaagcuggucucggaacuccugaccucaagugauccgcccaucucagccuuccaaagugcugggauuacaggugugagccacugugccuggccauaaaauacacuuuaaaaauacaaaauaaauacuaaaaaugccacaaucugggccaggcaugguggcuuacucccguagucccagcacuuugggaggcugagguggguggaucacuugaggugagggguucaagaccagccugggcaagauggugaaacccugucucuaauaaaaaaaaaaaauacaaaaauuagcuggacauggugaugcacgccuguaaucucagguaccugggagguugaggcaggagaauugcuugagcccgggaggcagaguugcagugagcugggaucaugccacugcacuccagucugugccacagagugagacuccaucucaaaaaaaaaaaaaaaagccauaaucuggaacaaaaauuccaguugauuucaauggaacaugauggggauaauaguaaaacuguuaaaaguuagguuaaaaggaaacauagacauuaauuuugaugcugacaaauggguacuuaaacauuaaauagagggacaucuaauuuggcaauauacagauaaccgaaaagcccucccaguauaaaacucccuggaaaugcuggauuauauuuugaaaacaaucuuuccaacuacauagcaagggcaaagaaaaaaaagacaugaaaacuagagugguaaauggaaguuugugaaggggguuaacuugucacaguuaccugggagcuugagauuuaauauccccaugaggacaggucaugaagcuuuggggcugaauuauguaaggggcaggaacuaagaacuaugcauaaagcuaggaucuuugaagggucauaccaucaguaaaaggguuaauuuuuuuaaaaaguccaccaguacauagagaucacaagaaagcuuguccgucuuggccucaagucauaugugaaaaaaacaauauaaguucaccagguaauucaucuauaagcuuacacaucaagcaaauuuguaguucacaguuucacuacccacguguucagagacucaagcagagaacaauauaaaauguaguccuccaucguggaaugccugggaggaggaaaugcaaaaaccuuucuggagggucauauccucaaccuagggcacacacgauucacauaggauauagccccauuggguauggguuugauggguagcuucugacauggcucucaaugaucccugccuuucugauauucauacacuuguguaauaaauacaacauggcaaaugugaugggauguugcuuucauaaucagguuacuaaagauuguaacuuccgucuugcuagcuuguccucucuugcuggcacuuucucuugcccucuuacuugcucugaugaagcaaagcuuccauguuguaaaaugcguuacagagaggcucacauggcaagaaacaaggaaggccucuggccaacagcuuguagggaacagaagccuaaguccaacaacuaguaaggaauugaauccugucaacaaccaugagugaguuuggauccuucccaauugagccuaagaugacugcagcccugugagagauccagaguagaagacccaguuaagcagugaccagauuuuccugacuggcagaaacuaaagcuaguaaauauuuuaagccaguaaauuuugugguugauuaguuuuuuaucaauagauaacuaauggaucuacauaagaaaggagagcaucaggaaaggaauaaaugaagagaaaacaaucuuuuauuuuuuuaaucuaauaaauagaucauuguucaaaguaauaauagcaacaauguauucagugauuacaacauguggauaagugaaaugaaugacaacuauaaaggauggcagagaggaacugggaauacucaguuauaauguaccuguacuacccaugaaaguggacuuggauuaguuguaaguguauauugcaaaucuagggcaaauuuuuuuaaaauuuuaauuuguguggguaaauaguagguguacauauguaugggguacaugagauguuuugauauaggcaugcaaugcauauuaaccacauaguguaaaauuggguauccauccccucaagcauuuauccuuuguguuacaaauaauccaguuauacucuuuuaguuauuuuaaaauguacauuuaugcuacaacaaaagugccuuacaaagcaaaaauauuuuaaaaagaacaauuaaguuaugauugacuauagucaacuguuguguuaucaaauaguaggucuuauucauuuuuguucuuuuuguacccaauaaccaucuccacaccuuccccuccaccccccagccucccacuacucuucccagccuuuguuaaccauccuucuacucucuaucuccauaaguucaauugcuuucauuuuuagcucccacaaauaagugagaacgugauauuugucuuucugugccuggcuuauuucacuuagcauaaugaccuccaguuccauccauguugcagcaaaugacaagaucucauucuucuuuauggcugaauaguacuccauuguguauaagcaccacauuuucuuuauccauucaucuguugaugaacacuuuagguugcuuccaaauuuuggcuguugugaacagugcuucaacaaacaugggagugcagguaucucuuugacauacugauuuucuuucuuuuggguauauacccaguggugggauugcuggacuauaugguagcuguauuuuuaguuuuuugaggaaccuccaaacuguucuccauagugguuguacuaaucuacauucccaccaacaguguaugaggguucccuuuucuccacauucuugccagcauuuguuauuaccugucuuuuggauauaacccauuuuaacuggggugagaugaucucauuacagcuuugauucacauuucucugaugaucaaugauguugagcacauuuucauaugccuauaugcuauuuguaugucuucuuuugagaaaugucuauucaaaucuuuugccuauuuuuaaauuagauuagauuuuuuuuccuguauaguuguucgaguuccuuauauauucugguuauuuaucccuugucagauggguaguuugcaaauauuuucucucauucuuggguuggcucuucccguuguuaacuguuuccuuugcugagcagaagcuuuuuagcuugaugugaucucauugguccauuuuugcuuuuguugccugugcuugugagguauuacucaagaaaucuuugcccagaccaauguccuggagaguuauccuaauguuuucugguaguaguuucauaguuugaggucuuagauuuaagucuuuaauccauuuuaauuugauuuuuguauacagugagagguagagaucuaguuucauucuccugcauauggauauccaguuuucccgggaccauuuauugaagagacucuuuuccucaguguauguucuuggcaccuaugucaaaaaugaguucacuguaaguguauagguuuguuucuagguucucuauuauguuacauuggucuaugugucuguuuuuuugcaagcaccaugccauuuugguuacuauaucucuguaguauaauuugaaguuaggucaugugauuccuccaguuuuguuuuguuuugcuuaggauauuucugggcuauucugggucuuuugugguuccauauacauuuuuaaauuguuuuuucuauuucugggaagaaugccaaagguauucuaauaggaauugcacugaaucuguagauugcuuuggguaguauggacauuuuaacaauauugauuuuuccaauccaugaacauggaauaucuuuccauuuuugguguccuuuucaauuucuuucaucaauguuuuauaguuuucauuguagcgaucuuucauuuuuucggcuaauucuuuuuuaauuuuacuuguggcuacuguaaaugagauuacuuuuuaaaugucuuuuucagauuguucacuguuggcauacagaaaugcuauugauuuuuguauguugauuuuauauccugcaacuucacuauauuuguuuaucaguucuaauagcuuuuuuuauggagucuuuagacuuuuccaaauauaagauauaucauuugcaaagaaggauaauuugacuucuuccuuuccaaauuggaugcccuuuauuuguuucucuucucugacugcuguagcuaggacuuccaguacuauguugaaugaccguggugaaagugugcaucuuuguuguguuccagaucucagaggaaaggcuaucaguuuuuccccauucagaagauacuagcuguaggccugucaucuauggguuuuauuauguugagguauguuucuucuauacccaguguuuugaggguuuuuauuaugaagagauguugaauuuuaucaaauauuuuuucagcaucaauugaaaugauuauauggguuuuguccuucauucuguugauaugauguaucauaucauucuacugauugauuugagaaugcugaaccauccuugcaucccagggacaaauuccauuucaaccacaaaacuuuuaaaaaauaaguauaauugauauguugagaagagagaaaguagaauuauauaaaauguucaguaaaaaccagagaaggcagaaaaggggggaaagauguaaaaagaagaacaaguacaaugaauagaaaggaguuauaaacauggcaauauuaauccaacaauaucaguaaguacauugugaauggucuaaauaugccaauuaaaagaacugcuagaguggaugacaauacaagauuaaccauaugcuguccacaagaaaccaacuuuaaauauaaagacacagauagauuuaaaguaaauggaugcagaaagauauaccguguuaacacuaaucaaaagaaaucugaaguagcuauauuaaugucagagaaagacgacuucagaauaaggaaaaucuucagggauaaagaggggcauuacuggcugggcaugguggcucacgccuguaaucccagcacuuugggaggcugaggcaggcggaucacgaggucaggagauugagaccauccuggcuaacauggugaaacaccaucucugcuaaaaauacaaaaaaugagcugggcaugguggcacgugccuguagucccagcuacuugggaggcugaggcaggagaaucucuugaaucugggagguggagguugcagugagcugagauggcaccacugcacuagagccugggcgacagagcgagcaagacucugucucaaaaagaaaaggggcgggcgggcauuaccuauaauaaauggucaacuuuccaggaagacauaccaaugcuuauguguauacaccuaacaacaauguaucaaaauaugugaggcaaaaacugaaagagccacaagaagaaacagaaaaucauuacuauagcuggagacugcgacaucccucuaucaguaauugaccaagccaagaggcaaaaaaucaguaaggauauaguugaacugaacagcaccaucaaucaaaugugucuaauugaaucuugagaacuaaucaauccaaugauggcagaauaacauucuucucaagcucauauggaacauucaccaacacagaccacauucugggccauaaaacacaccuugauuugugcugucagaccacaguggaauuaagguagaaaucaguaacacaaaaauagcuguaaaauucccaacuauuuggagauuaaaccacacauuuauaaagaacucaugggacaaagaagucucaagauaaaauuuuuuuuaacuucaaugaaaugaaaauacaaccuaacaaaaauuugugggauacagagaaaucagugccuagagggaaauuuauaacauuggaugaacuuauuagaaaagaagaaagauguaaaaucaauaauguagacauccaccuuaggaagccagagaaagaacaguaauacaaaccuaaaacaaccagaagaaaaacauuagagcagaaaucaagaaaauugauaacaagaaaucaacgcagaaaaaaaaaaaucaaugaagcaaaaaacugguuuuuuaaaaagaucaauaaaacuaacaaaccucuagucaggcaaaccaagaaaaaaaagagaaaagacacagaacacuaauaucagaaauaaaagcugggucaucauuaauuaucuauggacauuaaaaagauaauaauggccaggcgugguggccaaugccuguaaucucagcacuuugggaggcugagaugggaggaucacuugaagccaggaguuugagacuagccuaggcagcaaagugagacccugucuguacacacacacacacacacacacacacacacacacacaaaauuaggcaggcaugguggugcaugccucccuagcuacuugggaggcugaggugagaggaucacuugagcccagaaguucaaggcugcugugagguaugaucgugccacugaacuccagccugggugauggcaagacuccaucuuaaaaaauauaaauaaaaggauaauaguggugagaggugacagcaugcuggcagcccuggcucgcucucagcgccuccuuggccuuggcgcccacucuggccacgccugaggagcccuucagcccgccgcugcacugugggagccccuuucugggcuggccaaggccgcagccggcucccucagcuugccgggagguguggagggagaggcgcgggugggaacuggggcugcgcgugaugcuugcgggccagcucgaguuccgggugggcgugggcuccgcggccccgcacugggagcggccggccggccugcaagcccugggcagugagaagcuuagcaccugggccagcagcugcugugcucgauuucucgcaggaccuuagcugccuccccgcggggcagggcuugggaccugcagcccgccaugccugagccuccccucagccccccacugugggcuccugcgcggcccaagccuccccgaagagcgccacucccugcuccacggcacccagucccaucaaccgcccaagggcugaggagugcaggcgcacggcaugggacuggcaggcagcuccaccugcggcccaggugcgggauccacugggugaagccagcugggguccugagucugguggggacuuggagaaucuuuaugucuagcuaagggauuuuaaauacaccaaucagcacucugugucuagcucaggguuuguaaauacaccaauccacacucucuguaucuagcuaaucuaguggaaaacuuuuguugucuagcucagggauuguaaacacaucaaucagcacccugucaaaacagaccaaucagcucucuguaaaacagaccaaucagcucucuguaaaauggaccaaucagcgaaauguggguggggccagauaagagaauuaaagcaggcugccucagccagcaguggcaaccugcugggguccccuuguacacuguggaagcuuuguucucuugcucuuugcaauaaaucuugcugcugcucacucuuuggguucacacugccuuuaugagcuguaacacucaccacgaaggucugcagcuucacuccugaagccagcgagaccacaaacccaccaggaggaacgaacaacuccagacacgccaccuuaagagcuguaacucucacugcaaaggucugcagcuucacuccugagccagcgagaccacaaacccaccagaaggaagaaacuccgaacacauccgaacaucagaaggaacaaacuccggacacgcugccuuuaagaacuguaacacucaccgcgaggguccgcggcuucauucuugaagucagugagaccaagaacccgccaauuccggacacaguggaacauuauuaauaaaucuauacccacaaauuugaaaacuuagaugaaacaggccaauuccuugaaagauauaaaguaccaaaacucauacaagaaauagauaaccugaauaggccuguaucuguuacagaaauuauacugauaauuaauaaccucccccaaaagaaaggaccaggaccagacaguuucaauggugaauccuaccaaacauuuauggacaaaaugaaaccaauucucuaaaaucucuuacagacaauaaaggcugagggaacaauucuuuacucauucugugaggccaacauuacccuaauucuaaaaccagaaaagacauuacaagaaauggaaacuacauaccaguaucucuuaggaacacagaugcaaaaaucuucaacaaaauauuagcaaagcugauucgacaauguaaacaaagaauuacaaccaugaccagauggauuuguuccaaguauauaagccuggcucaacauucaugaauuauuuuguguaauucaucacaucaacaggcuaaggaagaaaacucagaugaucacagcaauggguauggaaaacauauuugauaaaauccaauaucaauccaugauauuuaauauuaaaaaaaucuuagcaaacuaggaauagaggggaacuuccucaacuuaagaacauuuacaaaaauccuacagcuaagaucacacuuaauggcgagaaacuagaagcuuucucacuaaaaucagaaacaagacaaagaugcuacucccucauuacuccuacucagcacuauacuggaagcucgagcuaauguaauacaacaagaaagggaaagaaaagacauaccuauuggaaaagaagaaauaaaacuguccuugugauaguccauguagaaauccuaaagaacugccaaaaaaaaacccgucccggaacuaauaagugaugauagccaagucucaguauacaauauuaacauacaauagucaacugcuuuccuauacaccagcaacaagcaacuggaguugggaauaaaaaauacaauaccauuuacguuagcacuaaaagaaaaaaaaagaaaaaaagaauuagguacaaaucuaccaaaauauguacaagaucuauaaucccaguaaucccagcuacucaggaggcugagaugggaggauccugagcccaggaguuugagaccagcggaguuacacagcaagaccucaucucaaaaaagaaaaaacaaauuaguacauuguuggugggaauguaaauuaguacagcccuauggaaaacaauauggugguuccucaaaaaaccacaaauacaacuaccauaucaucuaguaaucucacuucugguauacauccaaaggaacugaaaucaguauguaaaagagauaucugcacucccauauucauugaagcauuauucacaauagucaagacauagaaacaaccuaaguguccauuaaugaaugaauaaagaaaaugugguauagauacacaauggaauacuggaggacauuacacuaagugaaauaagccagggacagaaagacaaauacugcauuaucucauauguggaauuccuagaauuccauacaguuccauuccuaaaaguggagaguagaacgaugguuaccagaagcugggggugggggacuuggggagagagggaauagggagcuguugaucacagaguacaaaguuucugauagacagaaggaauagguuuugagaucuauugcacaggaaggugacuauggucaauaauaauguauauuucaaaauaacugagacugaauuucaaauagcucaucauaaaaaauuauaggcaaggcaauguuaauuagccugauuuaaucauuacauguuguauauauguaucaaaacaucacgcuauaccgcauaaauguauacaauuauaauuugccaaucaaaaauaauacugauaauaaauuuuuaaagcuaaugauguagaagauagagcugaagaaauuauccauaaaauaggagagugagacaaagagagaaauuaugagagauuaagaagcuuggaugauccacuuaaacugcagugaaaaugcagaagcagaaaauuuaaaaagcuacaagagaaaauagagaugaacuacaaauauauaacaaacugacaggaagcuucaacagcuauaaucgaagucagaagacaauaaaauacuaguuuugaugcauuuaggaaaaauaucugucagugaagaauucuuuaaguaauucaauucuuuaagaaaagucaagagagcagagccguaagaaccagaggaaaacaaauuaagccugaaaucaguccuauucagacuuccaguuauaugaaccaauagacuuccuuauuaaaaacugauuugguuuguuuaccuauugguaaaaacuuuguaaggacuuaaagaccaugacauuuuaauuaaauaaucauauguguuucaccccaucaaacccuauauguuuuuaugaguaugggaaaagguguggaagaguucacaucuaggagaaugacaacaggcauucaauagaguuacaaagagguuuuuuuuuguuuuuuuuuugagauggagucucacucugucacccaggcuggagugcagcagcacgaucucggcucacugcaaucucugcuuuccggguucaagugauucuccugccucagccucccgaguagcugggacuacaggcgcgcaccacugcgcccagcuaauuuuuguuuuuuguuuuuucuuuuuuuuuaagagaugguguuucaccauguuggucaggcuggucuccaacuccugaccucgugauccacccacuuuggccucccaaaaugcugggauuacaggugugagccaccgcacccagcuuuuuuugcuuuuacaucuuuguauuguuugacuuacucuaaggagguuguauauuacuuuuauaauuggaaguaaaaaaauucauaaaggagacaggugugguggcaugugccuguagucccagcuacccaggaggcugguugaagugggaguaucacuugugcccaaauucaaauucagccuaggcaacauagugagaccccauaucucucuuuuuuuuaacuuuuauuuuaggcuuggggauacaugugaagguuacauagguaaacguguuaaaaaccacaauuauuuuugcaccaacuuaguauuucaucacccagauauaaagcccaguacccaauaguuaacuuuucugugccucucuguccuuccacccucccuccucaaguaaaucccagugucuguuguuuccgucuuuguguucauaaguucuuaccauuuagcucucacuucuaagugagaacacgugguauuuaguuuucuguuucuguguuaguuugcuaaggauaauagccuccagcucaacccauauucccacaaaagacaugaucucauucuuuuuuauggcugcauaguauuucaugguguauauguaccacauuuucuuuauccaaacugucauugcugggcauuuaguugauuccaugucuuugcuauugugaauaguguugcacugaacauucgcaugcaugugucuuuaugguagaaugauuuauauuccucuggguguguacccaguaaugggauugcuggagacccuaucucuuaaaaaaaaaaaaaaaguauauauacacacacacagacucacauaaaacccaaauauauauauuaaauuauuaaauauauuauucuccccaaaacccagccauuuauauauauauauuuauauaauacuuaaaagccauuuauauauauauauauauauauauauaaauggaccucaaagguaucuuucacucuucuuccuuaguaucuuggcacauguugugccuucuaauccauugucuuguuccacuuacucccuuaugccuauauauauauauauauacacacacacacacacacacacacauauauggcuuuugaguuuuuguuuuuuuauauacauauuuauauauacauauacauuuauauguauaugaauauauuauauauuuuguauauguauaaaauguguguauauauaauagauauguguguguauguauauaaaacaaaaaauaauaaauacucaaaagacauuuuuucccaaagaucaauaaaguaguccuaucuacuuuauacauguaauauuaggcauguauaccuguagauaaaauggaaauaggagauauuccaaauggcaucagguauauuauacaaguaaauuuuaaaaauuagaugaaauggccaguuuaccagaaaauauugaaauuuggcucuauacaaaaaugaaagacuaauaaaaauuuuuaaaaauugauauagcuauauucucccaaaaacucacccagauaguuuuacauguuugguaaacgucugguucacucauucaauagauacuuuuuagugccuauuaugcccuuaaaaaaguauuguuguucuaggcucaggguuuauuuucuagcuaacauuuuuugagugcuuauuuggugcuagauaccauuccuuuuacauguauuagcauauuuauucuucacaauaauauauaguggggagcaggugauuacuguuaaaguauagaaacugguacagagaggcucaauaccuuguggccaaaacgaucuuuuaaaaaacacagaucgaguuaaccugcuuauaacuauucaguggcguauuacuggucucugcaaaagacccauauccuuaacaaggaccuaaaagcccacaaugauuugguugcuguugcuacugacuucucuaaaguagacuuguaccacuuuucucucucuguauccuaucuuucaggaccucaaagguaucuuucucucuucuuccuuaguaucuuggcacguuguuguucuuuuuuacccauugucucguaccacucauuccauuaugccuagugaaagucugauaauucuguagaucuuaacucuacuucuggaugucuuucaauuuccagauaaaaugaaguccuccuacugagcccacucauagucuuaugaacuuaccuucauuaccccuaguaaauauuuugacauguauuuguguaauaauuugauuaauuaauacuugauuguaugagggcacagacuauacacacacacacacacacaaacauauauauauauauuuuuuugaggcagggucucgcucuugucaccgaggcuggaguacaguggugugaucacagcucaccauagccucaaccuccugggcucaagugauccucccaccucagccucccaaguagcuggaaccacaagugugugcuaccaugccuggcuaacuuuauuuuugguagagauggggucuugcuauguuguccaggcuggugugaaacgccugugcuugagugauccucccaccuuggccucccaaacuguugggauuacaggugugagccacugcaccuagcugauauuuucacucaccauuguaucccuagcaacuuggauagugcugacacauaucaagcacgcaagaaugacuuaaauuucuaaauggauuaucuauuuuagucauaagauacaugaauuggcauuaaaguuuucaagaaccucuaucaauauaaugugaggcuagucaauuauccaaaaaguauucuccuaaaaccuaaaaaguaagaaauuaguaaaauuuucaauaaguaaccaaggacaaaacuagauuguucuauaaaauuuuaaaaacuaacuuuaagacaaaaauuaguaggauguaguuacugggaaauuaaacaaguugggaaauacaaacaggguggaagaugauaguuacccuacacaucucaccaacacugucuaggauuacagacaaaugauuuuaccucuuuccuuaaucaaaacaaauuguuuagggagaauguuuuaaaggaauagucccagccgggcgcgguggcucacaccuauaaucccagcacuuuggaggcugaggcuggcagaucacuugagaucaggaguuugggaccagucuggccaacauagugaaaccccgucucuacuaaaaauacaaaaauuagcugggugugguggcacaugccuguaauccagcuacucgggaagcugaggcgggagaaucacuugaacucgggagaugaagguugcugugggccaaggucgcgccacugcacuccagccuggguaacagagugacagagggagacucugucucaaaaaaaaaaaaaaaaaaaaaaaaaaaggaacagucccuuuaagagugacuaaagauguaaagaauaaagcuaaaccaagccagcuacauaacuauagagguauaaauguaaaauuaacauucauugauuauuuacuaugugucagggaugaucuaugagcauuuuuuaauagacuacuuuacacugaauaugagcauuuauuaacucaugcuuuuucaaaucaacucuaugauguaguuacaauuauuaucucuauuuuacaagugagaagaucacauaaguuuuaaguaggcagagucaagauuugaacccaggcuaagguuaagagcuggugcucuuaacuauaagaggacaguaguuaaaauagauaucuucccuaauauguguguaaauacugaagauuuuuuuauuaauacaaauuguuuucuuaucuagacuauuucacuagcccucuaguuaguuuccuugacucuaauuuugcucuccuuaaauccauuuuccacacugcauccagugaucugcuuaaaucuuaaauggacuuguacaaaauuaaggaaaaccuacucagcacggcaaacaaggcuaugauucaugcuuaaugaccccagccuucuggccucuccgauguccuuuucugcuacucccacccuagacuuuauaugucuuaaagucuaauacaaacucaguacuuguaguguccacuacacacuaaccauccccacuuacacuauguauuuuaagaacuauggaucuuuuuguucgcuuuucugaaaugccccuuguuccuggcauuuucgucucaauuaagcaucuuucuggauuaaauuuuauuuucuccaggaauccucuucugaaacccuuagaagugacccuccucuacugguacuuagccauccuuuauugaaauuaccuguuuaugagccaguaaccuuuauuaagcucuuugagaagagggauucuuucuuucucuuuuaccuacaucccgcacaacccagcucccccuccgucucccccaccuccaugcacaauuccuggcacguguuaacuguucaguaaauguugaacuuuugaacuuuacuggaaaucaagaaacacugaguuuuagccucaguuuugcucacuaugugauuuuagauauuuuauucucugugcuuaucguguguaucuauauacaacuuaauccuaaaguuccaucguauaaaaaauucuacaacuuuuuauuuugcucuguaugugacaguaccugguauuuaaaaacaauucucuacaucaacuuaaaaaauuaacauuugaugauuauaauuaacuucuaaaaaacugaaagaugaaacacaucaaugccuuuucuuuccccccuguacugcuaccugaaaacaucggaauuugcuguggaacgaacaagauuucuucuaagaaauuacccccuaccaccaugacuacauaaaauaagguaauucccagcaagaauauuaugcagauacuaaaaagaaaacaugcuaggcaugguggcucacgccuguaaucccagcacuuugggaggccgaggcggguggaucgccugaggucgggaguucgagaccagccuggccaacauggugaaaccccgucucuacuaaaaauacaaaaauuagcugggcaugguggcgcacgucuguaaucucagcuacucggaaggcugaggcaggagaaucgcuugaacccgggaggcggagguugcaaugagccgagauagcgccacugcacuccaacucuagcuugagcaacaaagcgagacuccgucucaaaaaaaaaaaaaaaaaacaaugacacgagggaaaugcuuacaaugcucaaugaaaaaaugaaaagaaagguuauaaaguuuuaauauacgauuugaucuuuugaaaauaauggauauauaacuuaaacggaaauguaucauuaaauauagcaacagcgucuuccaaaaaauuucaaaaucgggcuuaaugccaauuacacgaucauaauccaaaaacccuuaacugaagcaaagacagugauuuguaacaucugaacugugugaaaggggugggggugauucaaacaagugucaucaccuuguccaaugaugaaggagaacguguaucaguucugcauugugaaauucucaguaugagagcguguaguggcuaagaaaagcagugggcgaauuaggaaacaaagagaaaagccagcgacaucaccaguucuggccuccuucccaccggaggaaaggggagaaggcggguagucaucaauuccagguccagccuaaguucuggguccccggccccagcgagagccucgccucgccucgcgcgccugcgcggagcgggcuggcuuccugaacggcccucgccucuucaccaccagggccguccaccagaaguuucuaaacgggugagaggcgacaacgcagugcagcuggguuaaaggaaggaggcugguuuauccuccgcacuuacuugguacucgaucuccagcgaggccuucaggggcaugggcugguagaagcacuccuucuggccggcgggaaggguaaaggugaagucgcuaucgagggaaggugugaagccggccgccccaggcagcagcaccggaggcagagcggccagaaggagcacggggaagggcagccagaucuugucgcccaucccugcuggggcgaucccgggcugaaagaggcgucagguacuguugucuccgcuccgcguuuccucucuggacuccucgugguugacagggaaaucuggagucugaagaaacuccagguggcggccgcggcggcggcgaacacucccuccgaaagagaagcgcaguucuccaaaggguagggacucugggcggggcuagcaguccuauuccgcaaccgccucagucucggcccccucaggccaggcgugagcgccgcccgccucucccccugacggccuccgguucccauggcuucccccaccaaugggcaucauggcgguaauugugggaaauguagucccgggcgggcuccgcuagugggcucgggcgcgcucgccgaccacgauccccggcaagccccgcgccuucggcggcgccucacgcagucugcgccggggcggggcagu

SEQ ID NO: 191493 - RNA, 98007 nt, Homo sapiens
gguucgaauucugugcugccgggguucgcugguucuccgaguuguguccgaggcuuccacgcgcaggggcccgggaaagggucagaggcuuccuaacgcagacucgagugcgaagcgcgcagucgccgggugggucucuccccagcgacgauuuggguggugagcgacugcgccuuggcguggggaaaccggcuuaccugggggaguucuguuccuuucccucccggcaccuuggaugcgcugggacugguccucgugguugcugagcaugcugcucugaacgguuguauuuuauuugaugaaaaauaggaggccgggcgcaguggcuuacgccuguuaccucagcacuuugggaugucgaggcggaaggauugcuugagcccaggaguucgaggccagccuuggcaauauggcgagccacugucucuauaaaauuaaaaaaaaaaaaaaaaagaggaaacugucacuuccgucccccacccccgcccccgcuucuuucagacggauguaagauuagcugugucaagcgaucuugagacaggagacuacuacauaaaguuaugacuucuuuccaaaaugaggaaucuuuuucgacuacagcccauuguaucacauacauaggguauaaaagaacacuuguccuucguuugaugggugugcgugugcaaaccuacaaacacauuguuaauuagggccgaaagaugauguuguuaaggucggugaguaggaugaugugcuuuucuagguaugcauagucagugaagauagccuuuuuuggguaacuacuguaaauugaaguuaaggacauucauuugacaguaaaugucccacuaggaaaaugaaaacauuuuaguaucaaauauauucauugcuacugcagaagaguuagggaguucuuucuuuuuuuuuugagaccgagucucacucugucgcccaggcuggagugcaguggcgcgaucucggcucacugcaaccuccgccucccagguucaagcaauucucugccucagccucccgaguagcugagauuacaggcgcucgccaccacccccggcuaauuuuuuuguauuuuuaguagauacgggguuucaccaucuuggccagguuggucuuuaacuuuugaccucgugauccacccgccuugaccucccaaagugcugggauuaccggcgugagccaccgcgcccggacugggaguuauuucuugcauggcaauacacagauguugaacuaaaaccugauuuaagaugaaauauauaguaccaaaugguauuauagaauuugcccaauuuucucuacccuuuucuccuucaccauccuacagagagcuagagauguugaauagguaaagcaggauggggaccugauuuauugacuugucugcgagagucuugucacuuaagcagaagcaaauuuguggaaacaaaaaagggaaagaggauagaaccaguuugucuauuaagauuacauaguaucucauuuaauuuccugccacuuucuuuccauaaggugggaguuuucuuuuuaaucuuccucccuacaucugagaauuuuugaguggggaauaaauguaacauaccauucuaacuggaugagggaaggaaggacaguuuaguauucguuaauucauucaaaauauugagcuucucuaaguacauugcgguccugaacguaaugcacaggacuuuuaaccuuuuggaacuugggaugggaucagaaugcuaagaagggcguugaaggagaugcuacagugaaaaagguaaaugggaucugaaagaggaauguaauuuuaagauugcgcagaaagcucuguaguaguggagauuauaaagcuuuaguuuuuuauuguauuaauuacaauaauaaaaugugaugcuuuauugugauuuuuauaugcaaagaaauuuaguaguuucacaacccuagagauacucauccacugaagaaacaaaagcuuuucuucauuucuaugaguugaccugccaaauguuauuuugaucccugugguugugacuuguaaaugugucuuuuuaaaauuuuauaacuauugggcguaggaggaggagacagcuuuuaucugguaauaaauucccuucuaacaaaauaugaauguaaugauaccauuuaaucagauguccaguacuuguaauguaauuaugaaaguucaaacaccucauauugaaauugauauguaauauguaauaaagcuacaaugcgacauaauuuaauggucuuugcauccuaaugacuuggauucaaaucuugauuucaccauuuacaguuugugugacuuugagcaaguuauuuaaugucugauucuuaguuuccuuaacauguaaugaaaauaauuaacaauuguuaggaagaucagguaugcuuacaaaagagaacuauaauaacuagacccuggcuaaaaugaaaaauucauucauugaaauuguauugaauuccuuuauggcuuuacacuacagauaaauucauuauuauugauuuuuuguuuuguuuuaaaccaccaugaaagauuucacaacauuuaaaauagaaaacuaaugaguuaaauucuauucaugugaguauuuugacugaaacuacagaaucuuucagacaagguacaagaaauucauuuuuuuuuuaagaaauggaaucuaguucaucagacuacuauaauaaagacaaugaagaggaaaguuugcuugcaaauguugcuuccuuaagacaugaacugaagauaacagaauggaguuugcagaguuuaggggaagaguuauccagguaaguaaguaaaaucacauauagaauucacugugccuuaaauacaucaauguaaaauguguggauuucauuaugauguauuguuucuaaccugccucuggaauaagaaauaauuuucuuauacuuuuuaauguaacuuucaguuuagggaaaaauaaggaauauuagagaagccucuuugcauauuaaaaacacuuucaguguauuagaacucaguauaaaauauauauuuugggcuuuacuaauuuuuuaugauuuuuuugaaucuuaaguaaucuuagcguagaggcuuuagaaauacaguuugcuaguuuaaaaguaauuaugauuuauuuaaaauuuaguggaaacauugccuuauguucauaacugugaaucugcuuagcagcauuucagguuuucuauuuucuuauuuaauguauagcaauuuguagugaauaaacuauccaagaacugaaauauguuuuuucuuuuuucucuaguguuaguccaagugaaaauucugauuaugccccuaauccuucaaggucugaaaagcuaauuuuggauguucagccuagccacccuggacuuuugaauuauucaccuuaugaaaacgucuguaaaauaucugguagcagcacugauuuucaaaaaaagccaagagauaagguuauuguuuuuagaccuaucuaguuaaaagaaguuuugguuuuaggccugucuacuuaaaaaaaauuuuuuuuaauuuuaaaauuaaauuaaagaaaaaaauuuuuucuuuaaauaccuuauucaugguuuccauaaucuuuuacuaugguacucaagaauuuaaauauaauuguucuuuuuauguucuaacaagaaaguaguuaucuugguguauuacucuacuuuuaaacuuacauauuuauuaccuuuuugcaguuaaaugucuucuuaaguaaauuauaauccccuugauuuuaacacuacaucuuauacauaauagguaaucaauuguuuauuaaguaguuaagguauacccaccauuuaaagccuggaucaaguacuuuggauaguauggcacuguucucuuuucauuaucuauuuugucaaugauguuagagaucuuugcuuggucugaaacucucuuccuuuuucuuauucuaucacauauuuaucucccugcauuuaucccucuuccucacucaacucuuuuaucuccuuuuacacucucuuccuauucuuuguucccccgacucccuacauguauauacacagauaugguugcacauaaucuuuuuggauauguauuugcucuuuccacuucggaaagccaaccauuaagagcuuuccuuuuuguaacgaaucugcuuaaugaagcugucugaaucuacuuuuuagaaacaaauucaaauuccauguuuacaugguauguaauucuaagaaauuugaucucuauccucauucaaauugcugaucauucuuauuguauaugugccuuaauugggaaaacaauaaugauaaugccgaucaaagacaaaaggcuaaucuaguguguaaagaucuccuagaaauugagaacaaaaauaucaguaacccaaugggcaaaagacaugaacggaaaaagaaauaaaagugauauccaaacuaaugaaaagguguccaauuucacucauaauaagauaaauucaaagugaaacuauaccuaaguaccuuaccuaguucuuaccuauagaauuauuaaacauucaaauguuugagguguuauuuuauuggugauauuggguacggguacauugccuagugggaaugcacagugauauaaccccaacugagaugcauuuggcaauauuuaccaaaauuacaaauacauuuaccuugacuuggaacucccacuucuggaaaaacgauacuguagacacccugcaggauaugaaauuaggcauuguuuaucauaucaaaagauuagaaauaguucaaguauccaguaauaggggguuaguugaauaaacuaaugguuuauucauacaauggaaacuaugcaguugagaagaaaaaaggaguuugucaauguauuuauuauggagagauugccaguguauauuguucaaguaaaaaaaaaaugcaaggugcagaauguuauauuuaaugugcuaguuuuugcauaaggagaggagggaaguggguaauuuauauugcuuauguaugcauguggaauuaccagaagacuaaacaagaaacuuauaaaagugguuacccaccuauuaaagaugggaagagacuucuguguauacuuuuucuuuuauauaguuucaaguuuugaauugcauaaauaaaucacucaaaauaaaguuaauuaaaagaaauguuuugaaaaucacaauccucaugaaaauuaaauguauuguaaaauauauauaaaaagaauauaauaaaaauauuuauacagaugaaauaauauuuuaccuauuauccauuuuguuggugguggacauuuggguucuuccuauuuacuaucucuggacaauguagcuaugaauaguuuuauaucugcacgugaaaaaguacaaaaguuuuuaucagguuuaugucuagggaugauauuauugguucuuagcauauucaacuuugcuggauaauaccagccaguuucccaaagugcaccacuguuuuccagguuauacuuguauguacuuccaccagcaguggaagagagaguauugauuguuccacauauccuugucaauacucacuaaguauuuuaacucauuuucugagcugcuucgucauuuuguuaauaauugcucauaauuuuccauuaauuacauguaacccuuaauugaaauaauugaaaauauauuuguucuuuuucauucuuucagauguuuucaucuucugccccuguggaucaggagauuaaaagccuucgagagaaacuaaauaaacuuaggcaacagaaugcuuguuuggucacacagaaucauuccuuaaugacuaaauuugaaucuauucacuuugaauuaacacagucaagagcaaaaguauguaucuugaaauaaguuugccaacagaaaauaguuguuauuuuaagauuuauaauuggaaaaauauuccuuguauugccacauugccuuaauguguuaugggaaguaauuuucauuauaauacuauaguaucaacauguuguaaaaucaauauuguaugaauuauaucugaaaaugauugaagggaacuuuacaguuuuugcauuuagauaagucagcuucuuaagguguuaagauuaccaauuugugugguuuuauuuuuuauacaaaggaaguauaacuuacuuaucuucccuuuuaaaauaacacauugucauuguugaaaauuuuaaaaguagcaaaaagaggaagaaagaucacccagaguuuccaccuagaaaccacuuuaccaguuuaauacguaguugaauccagacuguuuuaaauaguuuugguguuuucuguuuuuuacuuuauauauagucugugcauuuucugaugcauuuacauagcuuuuccauugaacauuuuuuaugguagcauuauauuucaugugauuauaucauaauuuaguuaauaauuccuguauuucagugguuuccuauuuuuuuacuaaaugauugguauuacacaaaaaauuagaagaaaccaaaauguccaguaauggagacauaguaaauuaugguauacccauaagauagauugcaacaaaaccuuuuuuuaaaaaaaugaggcaaauauacuaguacuaagaugcaaaguuguuugacuuguauggagcauuauaagguuuaaaugauauaauauauguagucacuuaaaacagugucuauguguagucagcacucaaaaacaauuaccuaauauauuuaguggcagaaaaacauuacagagcaguacacacauguauaauacucuuaguuuuccucuuuauaagaagugugcaugugucuguguguguguguuuguauguaaauauauauacaugugauauauuaagguuagaaacuaugcuucacacuguugauaauuucgagagagacuggaagguuggagugaggcuuucacuauuuacuuuuauaaacauuguauacauacauuauauguaguuuuaaauagaggaguuaugggaagacuuuauuuuucuuuucuguuuuuucaaacaaaacaaaaugcuauuagggauuauuucagcacaggaaaaacaaaaugcagcaaugaacauaaaacuucuuugguguuugagauuauuucuaggguagacuuacagaggcagaaugaccaaauuuuagggaaauaauguuuuucaagcauuuacauuugguuccucaucuuuucuuggucacuuugagggaaaaaugcuguuuuucuugauuucuuacaaaauguaccuuuucaguauuucuuugccauuuagauuucuuugugauuugucuguucauuuuuucugcuuauuuuuaaaauuuuucuucaacuguagauaaucucucuuuuuaaagucaugauugcuuagugauuuaaaguaagaaaagagacauaaagauaauuuaauaacuacgaacuaauagcauuuugaaccuuucuuuuuaggauauaaacauaccagugguuaugugagaaaguaagauacuaguauuguauuucucagcucagcauuuucaaaguuguugaaauauuuuuuagggaagccaccuauuucaggccauguaugagcuuuugauguuacauauaugcccacuauugagacuguuuugcagaaaucaaucaauauauucauaacuuacgucuggcaaugguuguacuuacucuucuggagccuggcauccugcucuuucugagcuuuuugcccucuacaccugcuguccaacugcuacccugggacuucucuuugguguuguucuagguuggagcuacuguuuccugaauucuauuuuuuguuauuuccuaguuuauucuuucuguauuuggagcauaucuuccaguuacuuccuugccugccugaaaaugucuuaauuucuucuucacucgugauuaaauuccaguuugaaaauuauuuaaugucagaauuuuuagggcauuacucccuucuaucuuccagugccacuuugaaaagucuguugccauugugaauuacuuuuuagcauguaaucucuuuuuuccccccauuuguuuguuuuucacuuuaugguagaugguaguucuuaggaccuucccauucugguguuuuaaaacugcacaacaaguugucuuugaauaggccuuuauuacucauauuggguauuugagagcccuuucaggcuggaaacuuguaucuuuugguucuggaaauuuuucuguuucuuaauuuuuauuuuuaauuuuuguggguacauaguaggcguauauauuucuggaguacauuagguuuuuugauacaaucaugcagcauaauaaucgcaucauggagaauggauauccauccccucaggcauuuaucguuuguguuauaaacaauccaguuaaacucuuaguuauuuuuaaauguacaauuaaguuauuauugacuauagucacccuguugugcuauaaaauaguaguucuuauucauucuuucuauuucuuguacccauuaaccauccccaccucuccccaccccaacaacugcccuucccggccucugguaaccauccuuuuacucucuguguccaugaguucaauuguuuugauuuuuagaucccacaaauaaguaagaacaugugauauuugucuuucugugccugacuuauuuuacuuaacauaaugaucuuuaguuccauccauguuguugcaaaugacugauucuuauucuucuuuauggaugaauaguacuccauuguguaaguacuacauuuucuuuauccauucaucugugaugaacacuuagguugcuucuaaaucuuggcuauugaacagugcugcaacaaacauggaagugcagauaccuuuucaauauacugauuuccuuucuuuuggguauaugcccagcaguggaauuucuggaucauaugguagcuguauuuuuaguuuuuugaggagccuccaaacuguucuccauacugguuguacuaauuuccauucccaccaacagcguaugaagauucccuuuuuuccacauucaugcaaacauuuguuauuaccugucuuuugaauguaagccuuguuuuuuuguuuuuuuuugagacaaggucuugcucugcugcccaggcugaagugcaauggugcaaucacagcucagugcaaccuugaccuccugggcacaagugauccucccaccuuaaccucccaaguagcugggacuacaggcacgugccaccaugccuggcuaguuuuuguauugucuuuuuguagagauggaguuuugccauguugcccaggcugauuuugaacuccuggacucaagcgauccacccaccucccaaagugcugggaugacaggauugagcuaccgcgccuggcccugugauuuuuauuuaggagguauucucaacauuauuuuuugcacuucuauuaaaucuuuuauuuuggcugucauacuuuuuucgguuucugaaguuuuuuuuuguuccgauuguuuuguauuucauaacauacuaauguaguauucucucuuagcacucugaagauuuaaugauuuuuuuuucauguuugcuuuacuuuccuuuuucuuuuguuuaggccucugacuuuuauguuagaagcuuuugggccgggcacggcggcucacgccuguaauuccagaacuuugggaaucugaggugggcagaucacgagguuaagagaucgagaccauccuggccaacauggugaaaccccgucucuacuaaaaauacaaaaauuagcugggcguggugaugugugccuguagucccaacuacucgggaggcugaggcaggagaauugcuugaacccagaggcggagguugcagugagccgagaucgcgccacugcacuccagccuggugacagagugagacuccaucucaaaaaaaagaagauuuuuucagguguuaguauuuuagcuauucauauuuaagagaaaggcauuuaaaugcagauuggugguuuguuguccaguggacuuuauuucugggugaugguuagggaggugguucuuuuguagggaaacaccugccagcccccaaacaguaucaguaugagauguuuuucuuucccuuuuuuuuuuuuuaacauaaacucaagauuuuauugucuucauaauaaaacaaaagauaacacuuagaacugggucacuuggcucuuucugcucuuaccuccucccaguugagaaagcuugcaucuuuuaauacucagcauucucuuagaucugcaguugggcucagugcacucaagccuuagcacaaucuucuuuguaguuucagccuuuuucuggaaaaucuacuuagucugcccaccauaaccacucugcuuccugucauaucgacacuuucccugggcauacagagaauccuugcccuucuuguacugugucacuuucuaggguuggugcuugccacacuucuuacagaaaguccugcagguuuuaggaauguucaccauguuugcgggagugcuaucagcaaggagauuuuuuuuuuuuuuuuggagcaauugaguuucuccagcaaagaauccuuuaguuucucaccugugggauaacccaaaaugaaauugaguaguaagguggggcuaaccguuuuauauuaauucccuuguuacagcuguacuucauuccugcucauuacucuuagugucucacagucucaagcuucuucuguucaguuucuucugauaauaaacuuucugccucuuuccuaguaugccaacaccuugcuauugguguucugggagugggaaaaagaggaugacuguuacuugcagauacuuugaacuguaucccugguuuuucauuggguccucacuucugcccucuacaguaccuugugccuucauguucuaaacuucuuuuucagugauaguuaucuuauugauacucucuucuauaccauuuagauuguggguucccacccugcuauaguaguuguacucucuuuauuauacagauuguaggguuauuaugcuuuucuguauuuagauucuuccuaguaagcauguauucuauaauuagguuuuuaaaucauaaaaauucaauaaauauuuucuuuuauaauuguuuauaguuugauauuuuauguuuaauuuucuaauuuauguaaaauaaaucuugcuagaugcuuaucaauagagauucuauuuucuccccuaaauaacucuucaguuauaaguugaagguaaugccaggagcuuacaugccaaggcuggcuuauaaugaugauaugcccauguaaauguugaucaaaggaauagaugggaagcuuuauaucugaccaaugauuugggagcccuauugaacacccucaucugacaggaaaaaaacuaaggaccaaguagguuaauuuauuuucugaaaguacuauaaaaguuguuuuuauguuuuagguuucuaugcuugagucugcucaacagcaggcagccagugucccaaucuuagaagaacagauuauaaauuuggaagcagagguuucagcucaagauaaaguuuugagguaaauauacuuuuuauagcucucaaaguuuuauuuucuacuuauacauuuuauuauaucuuguuaaaucuuguuccccacacccaauaaauuuacaguaaccuaaugguguucagcugucuuagaacuuguugaaucuauuuuuagucaaucauaacuccucuuggcuguagguugcauguaguauauaggggcuaaaaagacuaaggugagaugccuauuuacaugcuuuuaucaaacaugaauuaguucauuucuucaccuacauagaaguauauacucaguguuucaaagggaguucaagaaauaaaauguaaaggagucagacacuuuuauuauuuuuacagaaagggucucacugcgucaccuaggcuggagugcagugguacaguauggcucacugcagccucagccuccuggguucaagugaucauucugccucagccucccaaggaggugggacuacaggcacgcacccacugugcccagcuaagcuuuuuauuuuuuauuuuguagagacagggucucacuauguuggucaggcuggucucaaacuccuggccucaagcagucguccugccucggccucccaaaguguugggauugcaggcaugagcugccaugccuugccaucaggcacuuuauaauuuauucucuucugcuuugaauaaaaugggaaauauaugcauauuaaauaacauauuacucugagugauuccgaaaguauaguuaaaggaccagcaguaguagcaucaccugggaacuuguuagaaaugcaaauucucaggucuuaucucuggcauacugaaccaaguugggagggguuucacaaguucugcaaaugaugcugcugcacacugaaguugucuuuuauguccaucagaguuuuguaauuuucuuuguaauacauauauuauuuuaaauuuguagguauuuuauauuuuuggcaauugugaauuguuccuacuuuguucauugcuaguguaugggaagguuaccgacuuuuguauaauauaauuauuuuguaauugguagcuaaugguauuaucagcaaauaaaaaaaauuuuguuucugagucaaagaguaggaaaaagaaagaaagaaaaaaaauuuugucuuuccuuuucagcauuuauacuacuuauuaccuuuucauauuugcuuuuugcaguggguagaacugucagaaaaguuguuggaugugggggugauaacagucaucuuuauuuaguuucugaacuauacaggaaugcuucugguaucugacuauaaaauacgaugugaguuauuacuucagauauauuuaucaucugguggaaguauucuuuuauucuuuaaaaaacucuuaauuaacaagugaugaauaugccuuuuucucuaucucuuuuuguauauuguuucucuuaacucauugauuuaaacaaauauaauuccuaauauuaaauuauucuugcauaccugggauaaucucuuuaguagucuuaaacaaaguauccuuuauuuuauagagaggcagaaaauaagcuggaacagagccagaaaaugguaauugaaaaggaacagaguuugcaggaguccaaagaggaauguauaaaauuaaagguggacuuacuugaacaaaccaaacaaggaaaaagguauguguuuuuaaagcaaauacauguuuuugaaagggaauaaaaggaaauauuaccuauuuaaaauucuaguuaauuuuugaagugaaaaaauuucagagauuuggcaauaaauuaacuuaauguucuuuuuuaucuauuaauuuuuuuaaauuuuccauuaaaauguuuauauguggaauuuauguuauuagcauccuggauugggcuuaauuucuacaaaacugauaacgauuaucaguuuaaugauacuuauuucugaaauuaaguucuauggccuauuugaaaccaguacacugaguuuaaaauacuaacagggaaaaagccuguaaauuaauauuaccucuaauaaaacuaaauaaaauguugaaugaacucuuuaaaagaaaauuuugccucauagagaaagaaacucaaugccugugaaugugugcuuggaucuuccuuuagaaauauauaaauaguacaaaaauaucuauuuuguauaaauuauaucuugagaucaagucuuuuaaguagcucuguccaaggaaccauuaacucugaaugccaguucacuuuuaaacugauaaagauuuaaauuuuuugaguuuaaacuaauaagauuuuauaauaaaauaggauuauagcaguuguuauacaguauaaagucauaaucuguacuaagcaauuuugcaauuuugcaauuuugcaauuugcaauauugcuuaguagaaaaugcguagguuuuggaguuagaaaauuuuuagauuuuaccucucauuggcuuuguuaccuuggccaaaugauauaaccuuuugaaaucucagguuuuuuucaucuguuaaauaaagaugauauuaucuugauauggauagaaaugaagaguaaaugaaaaaaagaaauguaccucuuaaaaaauacuaacaauuuaacuauuuuauaaacuuugugguuaaauacucuagaauucacacuucacuuacucagauaagcuuugcacgugguuaguuaaaauagugagauaauaauacaugaagaccacauucacaauauagcugccaagaaaaaauaaagaggaagagcuacuaguuuccucuaugcaacuuagauaagagaugacuuuuaggauagaguauugacuuuguuguuguuguuguuguuugagauggagucuuacucugucucgcaggcuggagugcaguggugugaucuuggcucacugcauccuccgcccccuggguucaagcaguucuucuuucucagcuuccugaguagcugagauuacaggcaugcacuaccacacccagcuaauuauuguauuuuuaguagagacuggguuucaccaugauggucaggcuggucucaaacuccugaccucaagugauccacccuccuuggccucccaaagugcuggaauuacaggcgugagccacugcgccuggcuaaauauugacuuuggcuucacaaagugaguaagugggggacagacacauucugggcagcaugugcaaagguauagaaguauaaaaggguauuauugcugaagaacucuuaaguaauuuuauguucuuauaaguaaauagguguagugggagaugagacaagaaagacaggcuggauccagacuguaaauggcuuuguguguuauaccaaaggauuuguauuuuaaccuggaaagcauaaauagccaauugagauuuuuagguagagguaugacaugaagacucuuggagcuuuuugaagaacuaaaaugaauauugacuuucugcuaugguuugaauguguccccccaauuuuuuguauuggaaacuuaaucccaacgcaacacuguugggagguggggcauuuuagagguacuuaggucacaagggcucugcuuucgugaauggauuaaugccauuauaagagggcuugacagagggaguuuguuccuuuuuuccuuucugucaugucagaauaaaguguuccuccuccuuggaggauguagcauuuaaggcaccaucuuggaagcagagagauuaggcccuaccaaacugccaguaccuugaucuuggacuucccagccuccggaacugugagaaauacauuucuguuuuuuauaaacuacccagacuaugauauuuauucuagcagcacaaauagacuaagacacauucugagauugaaagaucagaaccuuuucaaggacuauuggguggagaagauuaaucauaauggauuaaaaagccaguguaaagaaagggagagauuguuuagcuuuaugcuguuuguaagagauuaccuaaaacauaaggacacagaaaaauugaaagcagacuggaugcggaggcuaacaccuguaauccuagcacuuuguggggccgagauagguggaucacuugagcucaugaguucaggaccagcccgggcaacauggugaaaccccaucucuacaaaaaauauaaaaauuagccuggugugguggcacacgccuggagucccagcuacucaggagguuaaggugaaagggauugcuugagccuaggaggcagagauuacagugagccaagauugugccauugcacuccagccugagugacagaggaagauugugucucaaaaaagagaaaaaaagaauggaaagaaauguuucagauaaauacucaccaaagcaaaguugauauuacuauauuaggaucacacagaauagacuucagugcaacaagcauuaccaacauuaaaaugacucauauaauguuuaacacuuaaccaagaagauauaaagacucuaaaccagcaagauauaaagacucuaaacuuauauguaucuaauaauuuagucccaaaauacauaagaaaaauaacacaauuucaaggagaaaagaacaaaucuguagucauauggggaaaauucuuuauacauuuaucaggaauuguuaaguaacaaaaaauuaaggcuugaaguguugaauaagacaauuaauauucuugaucuaauggauguguauauggaaccauguagucaacaguuugaaauugacauucuuucaagcagauguaaucuguuaccucacuaugcuagaaagcaugaauuugaacaaauuccaaaagauugaugucguauguauuaucuucugcaaccacaguucaguuaaguuagaauauaacuccuugaaauccuguauguuuggaaauguaaaaccaggcuuacugguguucauugaccuacugguguucauugaccauugaauaaauuagaaaaccuuuagaacugagugauauaaaaaaugcacaucacugcauguaggcuguaccuaaagacacucuuagaggaaaaaauuuaaccuuauauacauguauuauaucaugacugaaaauuaaugaacugaaauagacuauuguguggucaggaaaaggaggacaucagaagaaagaaugaacaucaaaagaaaauagaaguaaggaaauaauaaagauaaggaugaaauggaugaauagaaaacagugaaacaauauaaaggauuaccaaaaccuaaaugugguuauuuucacaaugaacaagaaaaugggcaucagacaagauuaauaaaggagaaaaggcacaaguguugggauuggcaagggacucccaaauuacagauuuagcuauaaaucgguaagcaauaagaaauauauaagaaauaaggccaauaacugaaucauuuuaaagaugauacauuugaaaacuuagacuaaauaaaauucucagcaaaauaaaauuuaacaaaacuaacuuuaaaauaaaugaaaaaccugaauaaauauauguguguguguguguacauauauauguguguguguauauauauagcuauuaggguuaucaaaucaguaauuaaaaaucugcccacaaauaacuaaacuagucaaaacaauggugacaaaaggaaaggaaacaucaggcccacuacagcccaugaugacuaaaauggaaaagacucucaaaaacaaguuauggcaaggauguggaauugaaacucuccugcauuucuuuucuuuucuuuuuuuuuuuuuuuuuuuuuuuugagacagagucucgcucugucgcccaggcuggagugcaguggcgcgaucucggcucacugcaagcuccaccuccuggguucaugccauucucuugcuucagccucucuaguagcugggacuacaggcgcccaccaccaugccuggcuaauuuuuuguauuuuuaguagagacgggguuucuccauguuagccaggaugaucucaaucuccugaccucgugauccgcccgccuuggccucccaaagugcugggauuacaggugugagccaccgcgcccggcccacucuccugcauuucuaauggaaguguaaauugguagaaccacuuuggaaaacuguuugucaguagcugcuaaagguaaacauaagccugccuuaugauccagcauucauuucaacaaaacuuagucccuguauuaaaagacauguacaagaauguuagaguaauuuuauucauuguuaaauguucaucaacaguguaaucuauaaacugugguauguucacauaauuauacacaucaguaaaaaagagcaacuacaacuauguaacaacauggauuauuaucacacauauaaugcucagcagaagaagccagacacaguagaauacuguauaauuccauagcaaaucaaggauaggcaaaauuaacauauguuguuaaaaguccaaauggugcuuaccuuuuugggguaaagaauauucacugggaagguacacaggggugcuggaaguguucucuauuugauuggguuaguaguuaaguaaguauacacauuauuauaaacuucucucauuuaggauuucuguacuuuacucaauaaaaaauuaaaaucaaauaagaaaaacuauaagaaaaaaucuacagaagauauguauagucuuaauuuuuuuuuaaagaaauaugguauugcuuuguuacccaggcuggagugcaaugcuguggucauggcucacaguagcucccaacuacugggcucaagugauccucccacuucaggcucgcagauaguuaggacuacaggcuugccccaccacacccgacuaauuuuuaaauuuuuuuuacacaugggucucacuguguugcccaggcuggucuugaacuccuggguucaagugguccucuugcuuuggccuccuaaagugcaaguauuauaggcaugagccacugugccuggcuuuaaugcauguuuuaaaauguauuugggguuuguuuuaaucagguaugguaagauacagacacaggacugacauggagaaagaaauuuuuauacuuacagauuucuagaaguaggaggggcacaauaugcuguuuugggauccuugggguguugcuucacgagccagaaaccucuguggccaguggcaccuuugcccgaguuuuacucuggcccagugggcucauucugcccacucagccuggcaggcugcgcuuggcucgugcuaccacccuggaucccacaccugccaagggugagcuaggugcagaauggcaaggggugugugaacgaccauaggguccagccacuauacauagccaggcaugccggcugugguggugugagcagcuccaggcgccagcacgggcgccagcucccugugaggcuguggcuggaccagguauagcauaagcagcuucuguggcugacaccagggaacggggugguacuggaagcuuggagacaccaggaaccacagagcccuaaagagggugucacagcccuggcucgggaagcucauaggucugggcuccccugaagggcuguagcucuucucuccuucucuugucuuuucuucuuguugccugcaacguagugagcagggggcguguuucagccauuuguguuacagcauuuuaagccccaccauucaguggguccugaguucuuguccugcauccaggaagaaugagguaagcaaacaaguggagggugagcaagagaagcucuguugagcgacagaacagcucagaggagacccacaguggguagcuccucugaauggcuacccccaccucauuugcguucugguacauguggacacagucaaugcagcaguacccgaugucaauugccaccuucacagcuucaguuaccuggcccaagggggacuugcaggugcccagccccaguaugagcaucuaggugcuguuguugagcaugagguagcuggccguggcugcugcacuuuacagacccccaccuggaacugucuuauuuuauuuuauuuuuuuuuagagauagggucuugcucugucacccaggcuagaaugcaguguugcgaucauggcucacugcagccucaaaccccugcguucaagggauccuccugccucagccucuagaguagcugggacuacaggugugcaccaccaugcccaguuaacuuuuuguagagacgaucucacuacguuucccaggcuggucucuaacaucuggcuucaagcaauccuccuggcucagccuucuaaacuguuuggaauacaggcgugaaccaccacacccagcacauaacaauuuuagagauguuaaaaaugugaaaacaugguaagacuauaggagauuauuuaaaaaaaaaaaaaaagcgagaacaggcuggacacagugacucacuccaguaauccaagcacuuggggaggccaaagugcgaguauuacuugaggccaggaauucaagaccagcccgggcaaaauagcaagaccccacacacacaacaaaaagugaaaacaaugugucucuuagaauagaugaacugugauauauacuauuuguggguguagguuaacaugaauguacaaaauaaaaaacaccaaaaucaggauaggguuaccucuguuggaagaagucaggggaaugggauuuggaagggacacauaaggaccucaacuuuauuuguaauauuuuguuugucuucuguagccuuuucagacaaagagugaagauucauuaaaacgugauugggaguacaugguaauauuuauccagacuuuuugauguggcugaaauaugucauuacuuuuuacaaauuggaagugaggaagaguagauaaguguaaagcggauaagucuggcuugaaaagaaggauaauagaggaaagcacaauacgugggaagguuuuuguuuguuuaagugagaaauacagguauccuuugaucugaacaguaccugugcacacucaggaauugauuauauuccuacagauuuucagagaaguccuuuguuguccuuacuuuccuuuaucugaaacuuuggagucaaauagacguacuuaaccacauagacucagaaaguuaggaguacuuuuacuugaacuuguuuauacuuguggcaaaauaaccaacagagagaaugaaaauacagaagcuagaguguauuucugaaggguuaagaguuaagaucuagacuauaaauagaguaauucacccuggauaagaggagggucacuaaccucacuuacauuagaaagaauaugaugggaauagguuuaaauauuaaaauauuuuuaggugugagagugauauugaccaaauauucucaauguauugugccccaaauuuucauuucauugcaagaagcauaaggaacuaagagaugaggcaacaagguucggcuuaaagagugguugguggugguuguguuuuuuguugucuagauuuuuauaucugguaucaauagaaguuaccauuuuuugaaauaacuauuugaaauuuauuugaccuuugcaaaggucacagaauuuacugaguauauuuaauauucuagacaauagacugauucuguaauaccuaaccuuugaaaauguaucauccagccucaggcuauuucccuaaucugucuuuuccagauagggaaaaaaaaaauugccaacacauaagaauuuauauauauuucgacauuuauguuuauuauuguuuuguguuuuauuuuucauauugauagagugagaaaauuuuuguaguaugaucuacauucuucauuuuauacuuuaagccuaauacuccuuuuuagugcagagaaauuuguuucucuccaauuauuccuuauaauuaaagauuacuuuggaacuuaacucuucaaaugcagagcauucuucacuuuuauucauuaucucuuuuuaaauuuuagagcugaacgacaaaggaaugaagcacuauauaaugccgaagagcugaguaaagcuuuccaacaauauaaaaaaaaaguggcugaaaaacuggaaaagguaaaaggcaguugugcaaauucaguguuuuguauuacugucuauauuccaacaguaaagguaggaauaauuaaaauauguuuaugguugagacagagaguaauuuuuaugaucuuacaaaaucauuuaaauaaacaauuuguaaauguuaguuaaggaugauguucaccaacccuuuuauuaucaggagaaacuuuuuuauccaaagagggaaaagaguagagagaggagaaggaacaaaauacagagaaggauggaauguguuaacagagacuggagcuaaagaaguagaaaaaagaaauucauuuuuaucacuucaaugaaaaugaagauagauuauguagcuuucaacuggucucccucagucugcuacucugagaggggcuugcuucugccucucggaagguuccuugaacugauuugauauagaaauaauagugaguuuauuacauucauuuauuauauucauuuauuaucuuuaaguaauaucacaugguaaugaaauguguauggaggaacaccacaguuggauauucagauauugagcucaaaagagaggucugguaaagagauacuaauaugggagacuuccaucuugagauagcaaugaaagcagaggaaguuuaugauucugauccaagaaagguagaaaggcagaggaaggaauguucagguagaaggguagaguaagaagauggguguucauuuauuaaacaaucaugaaauuccuuuuacaugccagguacugugcuagucucugggagauucggugauacauaacacaugauaccuauccuaaagagcucacugucuaguaagauugacaaguauguaaacaaauaauuucaguauuuuggaauaaguauaauauagaaauaagagguaggugugguagggugggugaagguggcagugguuaauaaacucuggugggcccaaagaaggcuucacagaguaggcaaugcuugagcugcuaggcuaucucaaagauugugauauaucuuugaacaguguuaaccagggaaaaugaucaaaaucuauguucuaggaagcucacccugaugucaugugaagaugcauuugagaggugagagacaagucaaggagacuuuaaaagacaaggcaagagauauugaagaugaaggagcugaguagguagcuaugagggauguuaaaguuggggaaucagugggaucuagugaccacuugaaugcauuagaagcgggcaguaugagaaagaagaauauaggauauuuuuagguugcugguuugagugacugcuggaugauugcaucaugaaucaaaauagacaguuuaagaaaaaaaguuaaugaguucuauuuuggaaaugucuguagaauauccaguuauagguaggcuuuuguaucuauaggucuggauuuagacauacaaaucuguacuagggcuguaguuuugagaauuaacaguacugaauuaaagugguagaagccuuggacauugacagaguucauauagaaugagaacaagaugaaagauacccugggagauaaagaacagguagauuagcuuuugaaagauaucgagaagugauuuaaaaaaauuagagaaucaggaaaguauaauaagaaaagccaaggugauagaacauuuuaaaaagaagguggugaucuucagugccagauguugcaaauuggucaagaagaaugaggacugaaccaggugugguggcuuaugccuguaauuccagcuacucagcaggcugagguagaaggauugcuugaacucaggaguuagaggcugcauuaagccaugauaaugccacugcacucaggccugagugaaagagcaagacccugucuguaaaaaaucagaaaaaaaaaauuuagaaagaugaggaacaagacagggcuauugguuuuuauaaucagggagucauuggauacuuuguagagagcaacuuauuaaaguagaaggcacaaccucugaaaugggagaaauggaaagggaggggguagagguagcuaacagacaauucuuuacauacgguaggugaagaggaaauaagugugugugguggguugggagaggcagcgaauggaaggguagaaagaagcuaaguuaaggugaagaagcugugguaaagcaccuaaggguauccugaacauauuaguagggggagauugaagaugcuagaauuauaaggaauaaaagauggcacaagggucugaaugauaugcaagaugauaguccaagagcagaagugagauucuuuuuuuuaaugaaauaggacauuucuuuaugggaaaaaaguggauaaaaacagaaaaaaguuuuagguggaaggaaauugaacgauuuugaauuaaaugucuuuggucucauaaauuaagauguugcuuaagugauuuucauagcguaaggaggauaggagggauuuuggaaacuuggggugaguauuucucauaauauauuugcaauaaggaaagccaagaaauuugcuaaacuuuugagagaauauauggaaagaaaagagcagucaggaaugaugaguuaauaaaaggaagcaaggaaaacaagaguggccagagucaaguguaauauuaucaugacagcuacaugauaaaauauuuuagaggagaaguuaccaacaauauuaaauacugagaucaaggagaaagucugcaguugauuacaaaguggucauuccuuugcaguaaaacugugaguaucacuuggcaguguaaaauauuaaggucucacuagguacugaaaucuuuuuuuuuuaaauuuuauuauuauuauacuuuaaguuuuaggguacugaaaucuuaagugugaauuaguuaaucagaacgcuguuuugagagcuaaagaggguccuugugggaaugaaauaucuuagaagggauuuuuaauaaggugaucaguaaggggagguagaagaccuaguaggaggaauaugcuuggggagaagaaggacuuuauggagaaggagagaagaauguaagagacagguuuuguuuuuuuacacuuaggauuaucaauugcaaacaaugcucagcaaagcccuauaguuagguggauguaacaggguaacaaaggaauuggggcagaucuacccaaucuucuccucucaacaguguaucuugggugcuuuuuucuguucuacauuuugggcugugguuucguugguaaauuuugugguucaaauuucaaaaguaacuucucuggaauauuugcacugaaauuaaccuuuaguaacucggacgcagcagcuguagaugaauuuuugacuucaguugaugcaauugccuaucuguuacagguuuucuggacagguaguagugucuuuuucucuguccuuugcuacugcccaggaacuucacuuugcuucuuuucacuacaaggcuggggacuuaaauguaugaaauucuuagucuacucuccugcuuauuucugaaaucacuacugacauuuuuagcuugaaacaccuaaaacuuacaaccacauuaguauguccacuuaaauuauuguuuuagguucaagcugaagaagaaauauuagagagaaaucuaacuaacugugaaaaagaaaauaaaaggcuacaagaaagguguggucuauauaaaagugaacuugaaauucugaaagagaaauuaagguacaguauucuguuguagaaaaaggauuuuuguguggacauggaaaaaacugaaacacuuuaaaacacaauauuuuauuguuguaauuauaggcuuacauuauauagaaggauaggcuucaugacugaaacuguuuucuagcuauagaguuagaauuagaagugaaguaaaauguguuaaugcuaauaauauuuguaaauacggagacauacugaucaacauauuugcuuugcauauauuuagagaaaauuaauagauauaauguccuugauguauaaccacauuaacucacuaguaaaauguguauaauauccgauguucuaaaaaaaaguguuuuucaaaucauaaaaaauuaccuaguccagacuucucauuuuauaaguaaacagaagccccgagaguagccagaauuuacugaaggucugaaagaucgaagucuucugacuccaaugcucucuuuuaguacaucauguuguccucucaaaacuaacacccaucaacuuucagagguuaauauuaaccagucuuuaucacuucaaacuguuaauuuaaaaaaaagggggagcaggaagcaaucaaugacugauuugucuaauuuugccauacuuuccuuaagguagucuguuuaguauuuuugccaaggaggaggaaguaaagauacuuuuuacuagaguauuuuuuagaaucgguuaucgauugcaagauauacuuuuaagaaagaaagaugcugccaauuacacuaugaugcaauccuuuaucacuuaaaauuuuuauacuucaugaaagaauucuuguauuuguaauuagauaugauuucuuaagucguuauuuucauauuuuucaaaaaaguuauucucauauuucaaauauaagugaaauaaauugguuaagauauuuuuaaaacuucacauuuggagucuaacccucuaaaaugucuaaguuuuuccucacaguaucucccagugugccauuaagacuuguugaugcaguauuucuuaaaagaauccuuguaagaacagaaagucauugaugcugggcucuuaagcugguuguacaauuauguagagccaguuuacuuuuucuccuguuuuaggaauccaaaacuuuguugauaaugugaaaugcuaugucagggauuuugaaguuagauuuccugucuuauauaauuaaacagggagcagaaaugcuuuuaagacaguagggcuguccuucccuaccauuuacugugagacacuaggaaaguuauauaaccuuuuugugccucaguuaccucaucuguaaauaagaaguaauaauagugccaaccauauaaaguugugagugccuggcaugcagaaaguagguauuuaguaaaugugagcagguauuauuuuagaauuaagcuucaaaaaauuuuaaaagugagauuaaauaaauaugauuaaaaugaaugcauauauauuuuauuuucauuuuuauucucuuuucuucauaggcaguuaaaagaagaaaauaacaacggaaaagaaaaauuaaggaucauggcagugaaaaauucagaagucauggcacaacuaacugaaucuagacaaaguauuuugaagcuagagagugaguuagagaacaaagacgaaauacuuagagacaaauuuucuuuaaugaaugaaaaccgagaauuaaagguccguguugcagcacagaaugagcgacuagauuuaugucaacaagaaauugaaaguucaaggguagaacuaagaaguuuggaaaagauuauaucccaguugccaguaaguaugugugauuacguaauggaaaagaagaauuuuacuaaaguguuuuagaaaagacuaucauuuugugguugcuuuauuagcuucuaauuucuuuuucucuauacuuuuagucaugaauuucucuucugucuaaaucucuauuuuuuuuccugcacuuaccauucuacacuuuuccccaguuucucagaugccauauauaagaauggcacagaauuuuuuuuaaacagcuuuguugaaguaucauuuauauaccauaaaauuugccuguuuuaaguguacuaaucuaugauuuuuaguaaauuuauaaguuuuguaacaaucaccaugauccagcuuugaaacaugucugucauccccaaaagguauuuuggacccauuuauaauuagucccuguacucacuucuaccccuaggaagacacuaauaguuuuugcaucuguagauuugucuuuucuggacauuucacauaaaugaacucguauaauaugugcucuuuugcaccuggucuuuugcauucuuagagucguucauguugugauaucaguauuucauuucuuuuuauugcuaaauaguauuucauuauauagauauguuauauuuuguuuauccauucacuggcugauggacauuuggauuguuuccacuuugggauauuaugaauaaugcugcuaugaacguuugcauacaagucuuuggacauguuuucauuucucuuggguagauaccuaggaguagaauucuugggucauauggugaauuuauuccaaacuguuuuccaaaaugucuacacuauuuuacauucucaccagcaauguaugaggguuccuguuucuccacuuccuugccaacacuuguucuugucugucucuuuuauuauaaccaucuuagugggugugaagugguaucacauugugguuuuucuuuuuuuuuguuuguuuguuuuuuugacggagucucucacucuguugcccaggcuggagugcagcagcaugaucucagcucacugcaaccuccaccucccagguucaagcaauucuccugccucagccucccuaguagcugggacuacaggcacaagggacgggguuucaccacauuggucaaacgggucucgaacuccugaccucaugaucaacccaccuuggccucccaaagugcugggauuacaggcgugagccaccaugccuggcccuaauuuacauuuuuuuuaauggcucaugaugagcaacuuuucauguacuuauuagaauggcauagaacuuaaaauuuuuuuucuuuuuuugagauggagucucgcuuugucgccaggcuggagugcaguggugccaucuuggcucaucgcaaccucugccucccggauucaagcgauuuuccugccuuauccucccaagcagcucaaacuauagcacgcaccaccaugcccaucuaauuuuuguauuuuuaguagagacgggguuacaccauguuggccaggauggucuugaucuuuugaauucgugaucccccugccuuggccucccaaacugcugggauuaugggcgugagccaccaugcccggccuuuuauuuuuuugaaacgaaguuucacucuuguugcccaggcuggagugcaauggcgagaucuuggcgcacugcaaccucagccuccuggguucaagcgauucuccugccucagccuccugaguagcugggauuacaggcaugugccaccaugcccagcuaauuuuguauuuuuaguagagacaggguuucuccauguuggucaggcuggucucgaacucccaaccucaggugaucugccugccuuagccucccgaaaugcugggauuacaggcaugagccaccacgccuggccuaaaauguuuuuauaauaauggucuaccaccuuuucucuuuuaguaauauuugugaccauauauauaaaugagauuaagaagaagguaaguaaaccuauucaggaauuuguaaucaauagguguaaaaugaaggaaagaucaggggaaacuauagguaaauauauuaugguugguuucagauaugaauguaugguagacuagaugguagacuuaccaauguuaaacuguuaugaacuguggaauuaugaaccaaaaaaaucucagaaaucaucugauucaauacuauuuuauuggugaagaaaccuagacccaagaaaguaaauaacuugcccaacugguaaguaguagaauuuaaacuagaacauaagaucuuagcuccucugauaucugcuuucccaggaugcuguuuauuugcuuggauuuuuaauguacuguuugcuuuugaaauuagaaaguaaucauauacagauaacaauuuuaauuuggcauucucauuuguguaucaagaauuauuucauauauggucaggcacaguggcuccugcuuguaaucccagcauuuuggcaggccaaggugagaggaacucuugaagcaagaguucaagaccagcuuggguaauacagugagacccugucucuacaaaaaugcaaaaauuagcugggcaugguggcgcaugccugugguccuagcuacucgagaagcugagguaggaggauugcuugaguccaagaguucgaggcugcagugagcucuaugaucauaagcuccagucugggugacagagugagacccugucucucaaaaaagaaucauuugagauaugauuccgaaugugguaauguaugcuugaucguuuguuucuuguagugcuaagaaugacacgauuagaaaaugugauuuuuuucuacuucuaggaggugugauucgguuauaguuugaagguagaagucauuaaaugcuaaccuugcuccuuuuuauaacugucuuuuaaaauucuguauuauccaaacauacagaaaggugcauaugcuaguguagcaccuuauuuguaaaauuugggacacauauugucuuaucaacucuauguuuuuuuagaauaaaauuuuacagguaaaucuucuuuguguaccuugucagaucccaauuaucuuccucucuccucagaaauggcaauuauucugaaauucauguguauccuucucguccauguuuuaaauauugucacauaucgaugcaucuagaaauauauauauguugcuuaguguuuuuaugaaaauacuguuugccacuauaauuuguuuuucacucaauauuguuaugagauguauccauacugauuuaugugacucagguuuauuucuuuuaacuauuguaguuuuccaauuaucuuaauauuucuuaauguauuuauauauucuccuauugauggacauuaaguuguuuccauuaaauucauacaguuuuuaaaauuugaaguucugaauaaaaaagcaaaugcaucucauuuacauaaguuuacauauguuuguuuuuaaacuugcaguuaaaaagagaauuauuuggcuuuaaaucauaucuuucuaaauaccagaugaguagcuucucaaacaaggaagaccguugcauuggcugcugugaggcaaauaaauuggugauuucggaauugagguacaauuuucagauucugcaguuauagcaaauagaauguuuuuuauugguaauuaagacccuuaauuggccgggcaugguggcucaugccuguaaucccaacacuuugggaggcugaggcaggcggaucacgaggucaggaguucgagaccagccugaccaacauggugaaaccucgucucuacuaaaaauacaaaaauuagccaggcauggugguggcacgcgccuguaauccccacuacuugggaggcugaggcaggagaaucacuugaacccgggaggcggugguugcagugagcugagauagugccacugcacuccagccugagcaacagagugagacuccauuaaaaaaaaaaaaaaaagacccuuaauugaggaauuuaaaaaauauacagaaaagcucagagaauauuauaacagguaucugugauuccacaacuaagaauugaaucuucuuaaccaggauugauucuccuuaaaauuugugguauuuguuuuaaaucuguuucuccaaauaaaaaauaaaacauuacaggaugaauaaugcccuuugauccuuaugacuagucccauuuuuccccuaaguauccaccaucaugaauuggauauauauuucucuauucauuuuuguauguuuacacacauguacacaaauauguaccguauacugugugcaauuuugcuuuuucacucagcaguauuuaaaaaauucauucauauugagauagaguagauuaacaaauggauuuguguaauuacuuuuaauagcuguauaggauucuguccuauaacagugucauaauuuauuuguuccuuuauagguaucuuguuucuguuuucuguuacaaacagugcugcaaaggacauccuuguacauguuuucuuauacauauauaugagaguuucuguaguauauauuccuaacagugaaauugcugggucauacaguguguacauuuucaauuuuacuaaauaccaucaaguuuguaaaguggcugaaccaauuuauaauucuacagugguauaugggaguuuucauauccugccuaaagaguugacuaauauuagaauucuaauuuuuuaaaucaacuugaaaggugaaaaauaguacaguaugaguuuuuuuauagaaucuuucuaauaauuuuucccuucuuuucuuuugugccagaauuaagcuugcaauaaaagaggcagaaauucaaaagcuucaugcaaaccugacugcaaaucaguuaucucagagucuuauuacuuguaaugacagccaagaaaguagcaaauuaaguaguuuagaaacagaaccuguaaagcuagguggucaucaaguagguaaguauauugaguuauuuuaauaaauuauauucagaguuuuggaugauaguuuuuuuuuaaaaaaacuuuuauuuaaauuuuuuuuuuaauuuaaguucagggauacaugugcagauuuguuacauagguaagcuugugucauggagguuuguuuuacagauuauuucaucacccagguauuaagccuaguaccccuuaauuauuuuuccugaucuacucccuccuuccacccuccacccucugauagaccccaguauguguuguuccccucuauguuuccauguguucucagaugauaguuuuuaaagaacaaauuuaucaacuguuugguuucuauuaucaaacauacuugauaaucuguuacuaguuguggucugauaagacagcaaaaguuauuucagaauuauuagacuuuguaucauucguuaaugaaguaaaauugauauccaauagaacagugguccccaaccuuuuuggcaccagggacugguuuuguggaagacauuuuuuccauggaccagggacagggucaggguugguuucaggaugauucaaacgcaugacauuuauugugcaauuuauuuauauuauuaucauauugauguugaaauaauuauacaacucaucguaauguagaaucagugguagcccugaccuuguuuuccugcaacuagaagguuccaucugggggucauggcagacagugacagaucaucaggcauuagauucucauaaggagugagcagucuagauccugcgcaugugcaguucauaauaggguuuguguuccugugggaaucuaaugcugccgcuaaucugacaggagguagagcuccagcaguaaugcgagcgauugggaguggguguaacuacagaugaagcuuugcucauucgccugccacucaccuccuacuauguggcccaguuccuaaugggccauggacugguaccaguccguggcccagggguuggggaccccugcaguuaagaugcacccauuuuaauauacaguuugauacguuuugucagguguuuguguuuuaauguuuaacucuuguuaccaucaccacagucaagacauaagacaucuccaccaggauccuuuguacuuuuucccaguuaacuuuuaggcuuaauuuucucucuuuuuuuuuuuuuccaaaaaaaccacaaaacuuuucuuaaaguuuagauuauugauuuuagaccucuuuucuuuucucaucuaaguauuuaaggauagaaacuucccuuuaagcggugcuuuggguguauuccacuacuuuuuuuaauguguuguauuuucauuuucauucaguucaaaauaguuaucucuugugauuuccucuuugacucauaggcuguguguguuuuauuuccaaauauuuggagguuuuuccagauauuuuugugucauucaugaugaucagagaacauacuguauaggacuucauuuuuaagaauguuuugagauuugguuuauuguccagcguaugaucuaucuuggugaauguuccaaguugagaauacuaguaauuagaggugguaauaaauauaauauguuauagauucuuuuacaucaagaacagagccaauaaaaaguaaauagccuagaaagugaaauauuauagauguagagaauuuaugagaaauggcuacugaugcaaaucuugaaggcaaaguguaucuuguuuccacaucuguguguucucauguaaucaucuacauuaugcuuuuuaaaagcacuucugaaggcuuacuuaccuuggagugggagauguguauguuuauaguggagaaggggcauggucaaguaacuaccucugauaacccucaguaauuuuuuugagacaggaucuugccauguugcccaggauggucuugaauugggcucaagugauccucacaccucagccuguugaauagcucagauaacaggugccacugugccuggcuacccucaguaauuuuuuuuaaagcaucacugaauucucauuagcuaguuuggagagaaagacgauggggucgggaaggauucacucuuuggagcuuuugaaccugcuucugugugcaguacauaaaaauguucuuaaugaucucaaacuguccaaauaaauuuuaugauuaccuucaguuuaaggaaacagggcaacuuaaaaaaaauuuuuacaaugauuucuauuaaaaaauggaauuuaaaagguggagaaggauucuuacauuucugguacaaaggaauagucuuagcuaccuagaaaaaugagugauucagaacuuuucuccucuuuguuacguauuuaauuuagagagcacauuacuuauucuuugauuuccuuaaugaaugucucauucucugucccuuuuaguacucuuuagaucagaaacuaaacuuuguuuaugacuaaaucuuucaacuauuuaaguagguuuuuauucuugaaguccuauucagaacaauuuuccuuuuauguuuauuagcagaaagcguaaaagaucaaaaucaacauacuaugaacaagcaauaugaaaaagagaggcaaagacuuguuacuggaauagaagaacuacguacuaagcugauacaaauagaagcugaaaauucugauuugaagguuaacauggcucacagaacuagucaguuucagcugauucaagaggagcugcuagagaaagcuucaaacuccagcaaacuggaaagugaaguaagcuuggaauuagcuugguauauauguuaauuuuugaacuagaacaaaagguauuauuuuaggguuuuauaaaaauuauauguuuacauccagauuuaaaguuuuuaaaaaaugguaccacauaaguuauaaauuguuuuaaaauuauauuuggaaaccuuuguauuuuaacuuauuaaaaguuaaaguuauuaaaaguaggaaaaacuguaguggguaaaagucucaaauuugguggaaauaauauugcauugcagccuauuauuucuuccauaguauaaguuaauaugguuaauauacauuuauaaauaaagacuuuggauuaugcuguuggaagaaaaggagugauaauaaaggauuucaaauuuuagcaaaccccaaaccaccuaggaagccuguuuaauaugcauauuucuggguccuguuccagcaauuucugauucaguauauaugggcacaagagucugcuuuuuucuuuucuuuuucuuuuuuuuuuuuuuucuuagagacagggucuugcucuguugcccagucuggagugugguggugugaucauagcucacuguagcuuugaacuucuaggcucaagccauucuccugccucagucuuccaaguauuugagacugcaggcaugugucacuauguccagcuaaguuuuuuuauuuuuuauuuguagagacagucgcuguguugcccaggcuugccucgaacuccugguuucaggugauccccaccucaguaucccaaaaugcugggauuacuggugugagccaccacaccuagccggaaucuguauuuuuauuuuuuguguauuucugcuguuuaaagagucuguauuuuuaaacaacugcauguaaaccugaaacaacuacgcaaggaauuacauucugaaaaggggauaaugaguguuuugugaauaucuugucuucauuuucacugaggacaggauaagggugccucauuagguaauuguggaccaggaccacauguguauaucuuauacucgaucuucaaaccagaggcugcagucaucuauagguacacuuuuuaaauaccugcuuucucagcuuaaagucuauagccaaggcugaggaaaaagaacuauaagauaggaacuuauguuaauaaugaagauggagauuuagacaguuuauaacuauggcuaccaguuuacuuaggaaauugccaaauacugggauuaauaaguuuuuuaaauuacaaaaauagcacagucuuguuaauauaaaaggggaaaaagaagaaaaugaaccauugauaauucuaccaccagaaauaacugcugauaacauuuuauuguacuuauuucagucuuuaacagcuacguaaaaauagauuaggguauuguccuuuuuggauauaggggucugaauuaaaugacuuauguuuuacauagauagaagaagugauccuuuguuuucaguauuuguuuuucuucuuaauugucacuuauuuuguaaaauacuuauaauuauguggguuaaaaaguuauucacuuugcauccuaaauguuuauaacuguaaguuugcccaauuuaccuagacacaauguauuugaacuuugaaagaggagcagguguuugaucuuagaaugcaaaaucauuaccuuuaaaaaauaauuuuacauuuauuucaauguguuuucagaugacaaagaaauguucucaacuuuuaacucuugagaaacagcuggaagaaaagauaguugcuuauuccucuauugcugcaaaaaaugcagaacuagaacaggagcuuaugguaaaacuuaucuuuguuccuacaaauuuacugugauuuuuaggcacuuaauuugugacagcacauuuguuuuagcaucauuauuauaaaauauauaggaaaguauaaauucuacuaaacucuucugaucauuucuuguuuauauuuuuaaguuaauaggcuuauauggcaaguuauccaaguuuucucuuuuuuuuuuuuuuuuugagacagagucucacuccgucgcccaggcuggagugcaguggugugaucucggcucacugcaagcucugccuccuggguucacgccauucuccugccucagccucccgaguagcugggacuacaggcgcccgccaccacgccuggcuaauuuuuuuuguauuuucaguagagacagguuucaccguguuagccaggauggucucaucuccugaccucgugauccacccgccucagccuuccaaaguguugggauuacaggcgugagccaccgcacccggccguuuucucauuuuuauccuaauaggauugaagauaaugguaguucuuugauaugcuucuugauauuuaaaauaguuuaaaucuucucgucuugauaaaguauuuuuagccauuuuguuaaaguuugaaguauaaacuacugugguucuuuaaagaauggaguaugacauauuuaaugguugacuaauguacuuuuauguaaaacugcuuuucaauuauacuuuuuuuuugagacaaagucucacucugugguucaggcugcagugcaguggcacaaucauggcucacuacagccguguccucccaggcuucccccugagcguccccagaagcuaugaccacaggcgcaugccaccacaucuacuuagcuaauuuuuuguauuuuucauagagacggggucuugccguguuucccaggcuagucuugaacuccuggauucaagcgaucugccugccuuggccucccaaaucaauuauacuccuuuaaaguguuuuguguuucuaggaaaagaaugaaaagauaaggagucuagaaaccaauauuaauacagagcaugagaaaauuuguuuagccuuugaaaaagcaaagaaaauucacuuggaacagcauaaagaaauggaaaagcagauugaaagaguaaguaauacauauuuagaauaugagugcugaaaagaaacuuaaacauuacuagccccagcauuuuuuauuuuguagacgaggacacaaagauacacaaaaguuaguggcaagagcuguaauuagaaucccaaucuuucugaauaauuuuucagugcuuuaacagaauauaguaugccuucuguuucagcuguaaucauuauuuuugacauuauuaaaguaagaguaauucuguagacuccauuucccuaaaaauaucaguugcuugaagauugauugagaggaaaaagcagaauaagagaagcacucuugaccuuggguuaaaaguagaaaagaaaauuugagaccaaaaaugcaagacacaguaaaaaaaaauagauacaguagucccugcuuauccaugggagagacauuccaagaccuucagugaaugccugaaaccacagauaguacugaaccuuauauauuuuuuccuauacauacauaccuauuauaaagcuuaauuuauaaauuagacacaguaagagauuagcaagaauucuaauaaaaucgaccaauuguaacaaaauacugucauaaaaguuaugugaaaacuuguucucauaaaaguguguucucucucuuaugcccuagugccuccuuugcacuuuuuuuuuuugagauagagucucgcucugucggccaggcuggagugcaauggugugaucucagcucacugcagucuccgccuucuggguucaagugauucuccugccucagccuccugaguagcugggauuacaggugcgcgccaccaagccuggcuaauuuuuguauuuuuaguagagaugggguuucaccauguuggucaggcugaugucaaacuccugaccucgugaucugccuggcucagccucccaaugugccuggcucacgcagaggugugagccacugcgcccagccuccuuugcacuuuuaugaauguagguucugugagucaucuuugagaacagccuaguuucgcugcaauugaagucuugcuuuggaugguaucuuuucuccuuagcuucuucaucucugcuggaaaugugacagcagcugcuucaucagcagacacagcuucuccaauaauuuuaauauuuuucagucuaacccuauuauugaaucuguguaaucaucccuuauuugcaguaaaugacuuggugucacuuguuucaggggaucuuugcugaagucuuaauauauacucaauauuuucuggugcaacacauugcagucaguuggaacauguuuucuguuaaugccuuccaccuacaaauuuaaugccuuuucuauuuuaacuaagcacuuacgcauugugguuguaacuuuuguaguuugagguacaacugccauacuugcaugaauuuauuuuucuucacaauuucauggauagauuuauucuuuauuguagaucuuagcaaccucagcaugcaguuuuuuuucuuuccucauuaagucaagaaccuucaccuuuucacuuaaaggaagcaugcuaugucuucucuuugacauauccaaauuggaucugcauccagauagcaucacuacucuuuugcuuuggggccauuauuaaguaaaauaagaguuccuugaacacaagcacugugauaccauggcaguugaucugauaaccaagauggcuacuaagugacuaacgagcagguagcuuauacagcauggaaaauggaucauucuuguccagagcuggacauagugggacgucaugagauuucaucacgcugcucagaacugcaauucaaaacguaugaauuguuuauucguggaauuuuccauuuaguauuuucagaccaggguugacugcagguaacugaacuguggaaagugaaaccacgaauaccacagggcugcuguaauuuagaugagcuuaacagaagaauggagcagacaagaggaaaaagacagugaacuugaauguagauuaauagauauuauucagucugagcaacagagaaaaaauuuuuuuuccaagaaaagaaagauuuauaaaaauauugaacaaagccucagagauauauggggaaggaccuggaagaucugauauucuugucuucagagucaaaggagagaaugagauuagugcaggaaaauauuugaaggaauaaugucugaaaacuucacaaauuugaugaaggaaauaaauuuacaaauuuaaaaaaaucaaagagaacuacuucuagacacaucaaaauccuugccaaaaacuaaaacaaaaaacuuugaaagcacccagagauaaaugacacugcauauaagggaacaaauguuaaaauuacugcagauuucucaucaaaaacuauggacauaagaagauggaacaacauuuuuuaaaugcugaaagagaaaaaaacugucauucuauuuuauauccaacaaaaauacucucuaggaaugaagguaaaauaaagacauucuuagaugaaggaccgcauagagaauuugucaccagcagacuuguucuaaaagagaaugcuaaagaaaguuccucauggaaaaaaaauaccugagagaaacuugggaccucaggaauaaaggaagaacaacaaaaacaguaaauauuugguaaauauaggauuuuuauaauaucuauggcaguugaaagaagaaauuauaacauuuacugaugagguauauugauauaauacaugugacaacgacaguguaaagggggagggguaaaggggucuauauucuuaguuucuacauuuugccuuuuuuucuucagccguuaaguucagggguacacguacaggaggugcagauuugucacauagguaaaugugugccauggugguuugcugcacagaucaucccaucacuuagguauugagcccagcauccauuagcuauucuuccugaugcucccucucucccaucccacuccccuauaggccucaguauguguuguuccuccccaugucuucguguguucucaucauucagcucccacuuauaagugaguacgugcaguauuugguuuucuguuccuguguuaguuugcugaggauaauggcuuccaacuccauccgugucccuguaaaggaaacgaucucguuccuuuuuauggcugcauaguauuccauaguauguauguaccacauuuucuuuauccagucuaucacugaugggcauuuagguugauuccaugucuuuucuauugugaauagugcugcaaugaacauacacaugcauguauuuuuauaauagaaugacuuacauuccuuuggguauauacccaguaaugggauugcugggucaaauuguguuucugccucuaggucuuugaggaaaugccacacugccuuccacaaugguugaacuaauuuacacucccaucagcaauguaaaaguguuccuuuucucugcaaccucuccagcaucuguuuuuugacuuuuuaauaauugccauucugacuggcaugagaugguaucucauugugguuucgauuugcauuucuugagcgaucagcaauguugagcuuuuuuuuuguauguuuguuguccacauauaugucuucuuuugagaagugucuguucaugcaagugauuucauuucuuccuuaaaaagagagaagcugaagacaauuuggcaaaauacaaaaaucuauguaauuucaauuauagugucacauguauuuaauauuuaaaauguuucaaaauuuuaaaauauuuaauaugaaaauucuguuuucauguuuagcuugaagcucaacuagagaaaaaggaccaacaauuuaaagaacaagaaaagacuauguccauguugcaacaagauauaauaugcaaacaacaucaucuugaaucacuagauagacucuugacggaaagcaaagggguaaaaucauccuuauaaaagugcuauuuagaaguugacuaauauuuuaugucucuauaacuugccuuuaaaucuaaucaaaucugcauacuuauacuuuucuuacuguuuuuaggaaaugaaaaaggaaaauaugaagaaagaugaagcuuuaaaagcauuacagaaccaaguaucugaagaaacaaucaaggcuaguaugcuaauacuuuauuuuucuuucuuuccuuuuuuuuuuuuuuaacagacagaaucucucucauuugccuaggcuggagugcaguggcaugaugauaacucacugcaaccuugaacuccugagcucaaguaauccucccacaugagccuccugagcagcuaggacaagcgugcuucaacaugccuggcuaauuauuuuuuucuauuuggagacauucuuguggcuuuuuuacuuuucucuguaaauuguaaacauuguacagauaaaaggcaauucagagcugacgauuugaucugacucaaugaacuuaguuccuuuaaauguauuuucuuuagagcgaauuaugaucuuaauuauuugauaguuaaucaucuaguuugcagguuaucuagccucuuuuugucuuaaaacaguuuuuauaacccuaaaaauuguuuuaaauuuuagcuauaauugcuacuuauuaacauuaccaaaaaaaaagaaaauuaccagaggaaguggaggaagagaaaacuaaaagugauucaauuuugcuuguuuuuaucaguuggcuuguaagauuaauugagauaaagccagaauuucuagcuaaaauacggcuuucuggcuaguauaucuucaugguuaaaaacaugggcuuuguuguuaaauuggguuucaguguggcuucaagugcuuacccacucacuguaaccuuagccagguuauuuaacucuuugaacuuuaauuucuucauccacaaaauaggaaugacaauacccuagaagagcauuagugugagaauuaaaugaaacaggguauauaaagugcuuagcacauacugaguugcccgaaguuuuguaacuaacugcuauauauuuaguauuuucucuugcauuuuuaguguuaaacguagguccaaauaugcuaugacguuuauucugucauauguagcuugaauauaaaagauuugcuuuaaagauacgauguuauuuuuucccuauucuguuuuuaauucauuuugugacuguguaugcccauguagacauguguuuauucauaaauauuccuguaguauucaccaaaacucuuaacauuuaaugcaaugucaguucauuucccuguguaagaauagccccaaauuucauuaauauuaaaaaaugauuacuguacagagauuguaggcaugaaauacuuuuauuagauaaaacucaugcagccacuuaacuccugguuuucauuaaacuaccuaacguaacugggcagucaucuggugagguauuuccguguguuaauagccagauaugagauggaaaagaaaucagcaaaagaaugaaguaugauguuggauuuuauuccuuuaacaucuuuagcagguuugcuguuuggggaaaaaucaaaaugaguaagaaauauagaagccaaauuccuaugauuuaagcuauauugacugauucuacacauaaguuauuuauagcagcaaaauagaagccugaagucuacuucucuccugauuaugucauuacuaccuuccuuucaugacuuuuguucaugucucucaacaugccucaacuuguucucugcaaaagaaauaugaauuuuuuuaucuauaggaaaguuauaagggucaguuuaaaguuguaucacuaagcuaaaagguugaugauaaaauucugaacugguaacaagaaaucaguaaauuaaaccaguuguuaccugcuguuaaauggaaaauugaaaaggugcuuauuagacuuacagauuuuauuucuuuuguuuuguuuuccucuuauuuucuacuuuagauuccccaaaacccccacaaaaaagucuuaaacauaaaagaagaguuuaccuucuuuuuuugaagaugcauagccuagggcccuaucugguugucuccagauugugcaccugaggagcuucuuugguucagcagagugguguuuguuuuuguuuugauuucauuuauuuauacacacacacacacacacacacacacacacacacacacacauuugcaagugguuuguauacaaugcaagauguuuaucuguaugagauucagacuuucaaacucuguucaaauaagaaauucaauagaguagcggauguuuuggguuuuuaauuaguuuuuuauuagcuauaauugauuuauuucuaauuuauuuuuuaaaauuucaagcccacaaaaaauugaaaaaauagucuacuccucaccuagauucacucucuguuaaacucuauuaaacucuagguacacucacuuuaucucucucuacacauacacaugcaugcaugcuugugugugucccuaccaacccaccucccuuuugccaaaccgccugagagaagguacggaugucauaauacuuuaccccuuuaauacuuaacaugcaucuccugugaacagagaauuucuucuguauggccacaccaccacuacacuacagagaaagucaacauuaaguuaguaauaucauucaacauuguccguacuaaaauuuccccaauuacuuaaaauuguccuuuauagccuugcuacucaaagcauggucugugaacuagcagcaucagcaucaccuggaagcuuugaagaguaucuagccaugccccagaccugauucaccccagugaaucaagugugaugacacaaaauuuaaggagacacucucaggauuauauaccuuauuuaauuugaugacugccagaucucauuauuuuaagggcauacauuuucauugauaauuagcaaacuaacuuuggggugagucuuugaggccaugugaauauccuguuccucaauaaccuuauaaucaauggcuuucauaucuaaugaugaaucuugcccaaaugaguuauuacacuguuaacuauuagguagugauauucugacagaaucauagguuuuauuuauuuucucugugugaaggaugauacaagucccaaugcccauucucuuucauaaaaaagaaaauuucuaaguauuuauaauuuucauaaaacaaauguuaauuagucauucagaauuacagauuuuuuagcuguuaaugauuucauauacagacuauaagggugguguucaaaaacuguguaucuuauaagauucccuuuuuagaaauaagaguggcaaagauaauuucaugauguagaauagaaucugcaagagagaauguuuuucucguuuuuucaucugcuaagaaaucuaagauuucuuucacuuuuucaagacugcuuacuagaacauuauuagcauuaagaggaagaacaccauugagaagcucaaauuuacaauaaagaaaacaaggagcaagacaagaaucuuaauagaugagauguggagcauguaugcaauaugugcgccuugaacgaaaaguaccaaauuugaguugcucuuugguauuaagguaguaaagcaguggcaacuauaugaacacuuggaccaaguuaaauugcugccuuucugaaaauauuuucacuguuucaaagcaaagaagguuucacuucuuuuuuucuagcugacaaauuauuuucuuaguaacuucagcauuucaaaauauucucacuuaaggccaggcaagguggcucacaccuguaaucccagcacuuugggaggccaaggcggguggaucaccugaggucaggaguuuaagaccagucuggccaacauggcaaaacccacucucuacuaaaaauacaaaaaucagcaagacaugguggugcauaccuguaaucccagcuacucaggaggcggaggcaggagaauugcuugaaccugggagguagagguugcagugacccgagaucgcaccacugcacuacagccugggcuacacagcaagacuuugucucaaaaaaaaaaaaaaaaucucacuuaagcaucauuaacaguaugcuaguuuguacucacuuuccuauuuuucuuauucaaggaggcuuaagaaguagguuuaaauaccacuuaccuuuuaaagaaaaguuuuuagaguguuuggccuacagguucuugacaguuggcccuaguuuaucuugucaauuguggcucccaaauaaccauuuccuacaaauucaucuucuuacuacccuaggcuuuugccaacuucucaccacucccuuucgcagggccuugcuucugagcauacucccuuuuccuggaaugcccuucuaaacuuguccaacucuuguuuauucuucaggauuccauaccuugguuuucucuuugguuuccucauuugcaaugaagaauuaguuuacucaauaaauaucuucuauaauggcauuuuauauccuaaguaggacuguauauucacuauuugaagcagucagguaacauuaggagauaaaucuguaaaauauugaguauaucguuuuguguuuuuuuuuuuuuuuugcuuuuuuuccugcuuagguuaggcaacuagauucagcauuggaaauuuguaaggaagaacuugucuugcauuugaaucaauuggaaggaaauaaggaaaaguuugaaaaacaguuaaagaagaaaucugaagagguaaauuaacauuuacuuuauauauagcauauauuucaagugauuuuuuuuaagaagcaugagauguaggacaaaauauauauauauauauauauuucuuuugagacagcgucuccccauguugcccaggcuggaguacagugucgcaaucuuggcucacuugaaccucugccuccuggguucaagcaauucuugugccucagccuccuguguagcuaggauuacagguaugcacuaccaugccuggcuaauuuuuguauuuuuaguaaagaugggauuucaccauguuggccaggcuggccuugaacuccuggccucaagugauccacccaccucggccucccaaagugcugggauuacaggugugagccacugugccuggccaaaauaauaucuuuuauguaucugauauaaaaaaguauuuccaauaaaauguaaauuccaauuuuauuuucuuuaaagagcaaacauuucaaugcaaaauagaauauaccuuaaaauucuaauucuuuuauuuuuagggaaucagaagaauaaauuauuaauauuacagucauucuaauauaauauuacaugacaccuugaacauuguuuuagauuuagagguuuaaaauucuucaagaauuuuucauuuuguuuuuguucuuguugucuguaggauugagaauuaacuuuagaauuucaacuuuuuuaagauaaguuucucagauacugcauuggaaaccuuuuuuuuuuuuuuuuuuuuuugagauggagucuugcucugucgcccaggcucggcucacugcaaccuccaccuccuggguucaagcaauuuucuugccucagcccccugaguagcugggacuauaggcgcaugcugccacgcccggcuaauuuuuuguauuuuuuuuuuuuuaguagagacgggguuucaccauguugcccaggcuggucacaaacuccugaacucaggcaauccugccaccuuggccucccaaaguguugggauuacaggcaugagccacugcacccagacuuggaaacuuuucuugaacaucuuacucaucucuguaugcucaauuuguagcacuuuacuuugguuaggcacucacuaaacauuugcucaaauggauaaucguaaugaagaauguauuuguuagaauuuauaauguauauauuuuaagguuaaaauuuauuuuuagaaaucguucccaaugaaucuucaucaagguugacuuuuggccacucauuguugcucacgccuauaagcccagcacuuggggaggccaaaguggguggaucacuugaggccgggaguucaagaccagccugggcaacauggggcaaaaccccaucucuacaaaaaaauuaaaaacauuagccagguaugguggugcauacccguggucccagcuacucaggaagcugagaugggaggaucacuugagccuaggaggucgaggcugcagugagcugugaucacgccacugcacuccagccugggcagcacagcgagacccuaucucaaaaaaaaaaaaaaauauauauauauauauauuuauuuauauuuacauauuagucaagaucgauuugacuauaucagaaagguccaaugagaaaaacagaagccuuuauaucuuuuaaauagagcaaauuuauacagagaauuagauacacaggugaugaaaggguagagaagccaaacaguauaccacagugacucagagauuauuauaagcagggacccgcuaccauuguuaagguuagaggaacaucaggaaaagauggugugaucauagucuagaagcagggcugccuaucuggagcuggggccaaagaaaaaaggucuguccaauaggaacuggggcaauagaggaggagcacugcagcuacuggccauucccauuggccaaaccuauuuguaaucuagagggcaaaggaggccaagaaaugcaguuuccugcaauacacagagcagaacaggggaaagccauagguaaaucuaagaguaaauaauguaguugaccagcacuccagacuuaggugcaucaaguaauuauauagccuuagaaguuuaaaaaaaaaaaaaaaaacuucagauuuaauacggucaugucuucuucugucuaccuucccuuaugaagguuuuuauagcaucuuugacaggcauauauuuuucuacuccaauacauagaaacuaaaucaucuaaacuguauguacuuggauuuuuaaaaauaggaauguccuuuuuuuuuuuuacuaugaucaucuuuaaaguaguauacaaaauacauuauuuuggcauuuauucuacugcccauacccacacuccgcuucauaauaaauagacuuggcagagauggaaucuaccuggagguaggcagcauuuguaacaggagaaucuguugagcuuuagacuuugcauucauagaaacaacaucagagacuaggguggauaacagauauuuacacacaaaauaaauagaacgauuuuuuuuuucuuuuuuugagacagggucuugcuuugucacccaggcuggagugcaguggugcaaucucggcucacuacaaccucugccucccagguucaagcaauucuccugccucagccuucccagcagcugggauuacaggcaugugccaccacaccuggcucauuuagaaugauuuuuacaacuggaaauacauaccuaggcucaaacugaauuagaaaccagaagugguaaucagguauauuugaccagacuagggaguaaguaaauuagaaagauuugcaagcucauuuauugccgcucaauccuuagcucaacugcacaugcauuggcuugcuuacuuaaaaggucaucugucacauguucauguguauugauaaaaaacguggagaagaauccaaguacuaacuguugacuuauuugccuuuacagcaaauuaugucuuacagagaaaauucuuucuaauguugguuaauauaauuaacaccuuguaacagcagaguugugaaguuuucaucauauauagcuacauuuuagaaaaucugauuugaguaauagugcauccauuccguuaauaauaggugauauuauaaagauguucuuaucuuuuaaaucagggaauaugccccaaucauauaacucacugaauaauuaaguggcccuagggcauauagguagaaauuuagccaguuguaaaaacuacauguugauuacccguugcaaaaagcuaauauauguuccucugagcuuuugccucagccacauauucuuuuccggauguugaaauaaauauauuuaugaugaaaauaauacuuugggguucugaauuuuuggaagauauuuaauuucauauuaaaauguuuuuaacaaugcuuuuaaaauaauaaaguuauguguucaugcaaaauuacauugucaacaugauaaaagaaacucaauacaaaguagaugcgacuaagccuaaauguuuucugcauaaagauuuuauucaauaaaaucagucguuucauugauaaauaucuucauuuaaauggauggacuuagauuuugagaagcuggcaucauauuucugcauuauauuuuauuuuuaagcaacaauuaugagacuuucugcuuuggguacauagugauacuagauaaaguuaaguguaagguagauuuuaucaucuaaauucuacuuucuuauuuacuucaauuauaaaauauuaaguacucugggaauauaauaauacauuaguagaaaauaugauguaaaaacaauuuguucuguauuuacuuuuaaacuaaagccaacuggccaggcacgguggcucaugccuguaaucccaacacuuugggaggcugaggcaggcagaucacaaggucaggagaucuaacacggugaaaccccaucucuauuaaaauuaaaaaaaaaaaaauuagccgggcgugguggugggcgccuguagucccagcuacuugggaggcugaggcaggagaauggcgugaaccugggaggcggagcuugcagugagccgagaucgcaucacugcacuccagccuggguggcaaaggaagacuccaucucaaaaaaaaaaacaaaaaacuaaagccgacuggaguuaaaggucaguacaaugaaaugucaguguaaguuugauagauauauguucuauuuuguaaauauuugugauaacuaauuuuagcuauuucaauauauguaauugaaaugucagugacuagauuacugaaauaaaauuuuguuguuauuaugugguaaggcuuuguguuuugguuagaucuuauuuuuuucuucuguuuugucuuauuuuaauauuuuguccauuuuuuucucugaauagguaaguaugaaacaggauguuccaauaaagaaaaaaagaguauuuaaaccugucuugcaggcaagucaguucuaucuaaaauaaaccagugcagaagugugaucugcagguuuggucaggagcuaagagagaaaacaaaacaggugauacugacacauauuuacacuaaauuauuuucaugcagacagaauuaaacaaaacauauuugcaugaaaagggauuauaauucaggauuagagaucaguuaguugccugugauauccaggguuacuucgaguauacaacaucaucauauaauuaagaaaucugaaaucucagagcuucucauaaugagcaaagaauauuuggcccugaaggccuuaauguucaccugcuggauaguuagaaaaaagaagcaagucgugauucucuuccgcuauuuacuauaaggaguuuaaauuuccuuuuggaaugauauuuacuggaaagauucuuugcuuuaaaggaauggcuuuauuuuccuucacuuaaaaaauuuauuauauaagcaacaacaagaaaacuucuaaagaacauuuaccuacagcccauucucuaauacuucaguuuucauuuuucuguuugcauguauauuuuucaaaauuauauuaaugaaaugugauuuuuuaacuuuauaaauuuuuauguuagcugucuuuuuaauuauuuuaaaugguugcacauuuuaaaucacauugacaaucaucacuuauuaaaucuuccauucacuuugguaggagaugaagaauauuauaaaauauauuuuaaauuauguuucauuguugauaguauuuuaaaaauaauuucugcuggcauauuuuuagaauuuggauuacuaggacaaagggaauuuauuuuucuucuuaauaggugcucuuggauaaaaguaucuuaaagcaauuuuggagaccaucauauucaaguccuaaauauauagaguaauuagugaaauuucuuaguuguuauugucauuccuuuauguguuuuuuuguagcauaaauauucagcagugcuuugcugggauauuauuauauaaacaacagcaauaauagcaacaauaacaauaaauagcaccaaacaucauauagugcuuuuauggcucuaguuuauuauuagaaagggugaaagaaucaggugaagugcagauaaaaccauggcugccuaugcuguucccuccuucugggagaggucagacagaacaugcuccuuuuuauagcaguaaaauguggcaauaucuguuucugccuagggaagccuauuuaugacucaaaguucaggguuuuuauugggggcuugucacacaggaacaaugaccagccuacaaguaucaaaaauuccagaauucuaaaggaaggcauguuucagugccccagccaggcaaaacaaccucaucacuuaggaacauuuuuaaagccacauuuccagacaccaaccaagagcaauccuauaagcaagcccuuccaguacaucuccccauuagaaaaaugaauacuguccuuccaaugacaaacuauagacaugaaugcaauugucccacaugacaaguggaugguuaucuaauaaggaggacagcuuugacauuuuauugccauuuauuugaaacauugcauuguauugagagauauauauauauauuugccagguauauuguuuacagaaagagcuaaagauaaaaaaucacagucuucaagagacuucugagcaaaacguuauucuacagcauacucuucagcaacagcagcaaauguuacaacaagagacaauuagaaauggagagcuagaagauacucaaacuaaacuugaaaaacagguauauauuauuagcccaagauuguuuuauuuguaugaaauagaaauuuuuaaaaucaugaauagauuuuucguuaguuuuuuaaauugcuguuuggccagaugccguggcucgugcccauaauuccagcacuuugggaggcugaggcaggcggaucaccugaggucaggaguucgagacgagccuggccaacauggccaaaccucgucucuacuaaaaauacaaaacuuagccaggcauuguggcacaugccuguaaccccagcuacugaggaggcugagacacaagaauugcuugaacccaagagguggagguugcagugagcugcaaucgugcccuugcacuccagccugggcgacagagugagacuccgccuaaaaaaaaaaaaauugcuguuaaaccucaaggauuuugcauuauaagaaauacucuauacugauauuguaaaauaaaguucuauuccuauguaaucugaccuccaucucuuauaccaugauuauauguuugcuguuccauacaauuuauaauucauguuucuuuauucaaucucucuucuuguaccuaaucugaauaccuauaauuuuuccuuuuuggaucaggacaugguaugugauauuccuuaaagaaauggcaaagcagugcacuaaaagaaaaaucccaagggaaaauaccccugaaaguucuaaaauuaaaaauuauuacuuacuugaauguaagaauucuagagaauuuuauacuagaaucuaaucuuuuuccuuuaauucauuacugaauuuaucugaauucuuuagauauuuuacauucuuauuuuguuuuuucuuugaaaagaaaucaaauuuacaguaauguguaaauuagaaaaugaucguccccuguaaucuuacuguauuuuccuuuuuugucauuuuuucggucuuuuaucuacuuguucugaaguccuccucagccuguccaguggaacuaaaguaucuuccucucacuacauuuaaacacaucaggcagguauucuguauuuuuuuuuugagacggaguuucacucuugucacccaggcuggagugcaauggcgcgaucucagcucacugcaaccuccgccucccggguucaagcgauucucccaccucagcgaccugaguagcugggauuacaggcaugugccaccacacccagcuaauuuuguauuuuuaguagagacaggguuucuccauguuggucaggcucgucucaaacucccuucucuggugauccacccacuugggccucccaaagugcugggauuacaggcgugagccacugcuccuggccucuauuuuuuuucaagagacaucuuccugugacucuccaucccuuuuguuaaaauuuagaccuacugcuugcuaugccuacuauacagcuucauccugaagcauuucuucuucucaucuauguuugauucccacugccuacauccuuugucauugacucugguucuugcaggauugauuaugauucuuguuccuaacucacuucuauaaugguuguaugguuuuuucuguuuuguuuuguuuuuuuuuaacaaguucacuuuuuuuucuuuuuuuucucuuuuugagacguagucucacugugucgccaggcuggagugcaguggugcgaucuuggcucacugcaaccucugucucccagguucaagugauucuccugccucagccucccgaguagcugggacuacaggugcgcaccaccacauccagcuaauuuuuguuuuuuuaguagaggcgggguuucaccauguuggccaggauggucuugaucucuugaucuugugauucgcccaccucagccucccaaagugcugggauuacaggcgugagccacugcgccuggccucauuuguauuuuuuauuuggugauuuucuuugugaucuuguuuuaaaagauuuuguguucucauuagcuucacugaggucuacagaaguuuauaucuaaaaauuucuucaguauuuggaguaaauuuuugacuugguauuccuuuucugccuuucauucauauuacacugugcauagguuccauuuugcaucuucagauuucucuauuuaauuaagaauugaguagguggauuuuccuugguuccuuucccuuuuuaccuggguacuguuuuaauuuucuucuugaaacuugagguggagggguggauauuaaugggguuuucuuguuuuguuuuguuuugagaccgggucuuacuuugucacccaggcuggagugcagugacaugaucauggcucagugcagccucaacuucccugggcucaggugauuuucccacuucugccuuccaagugcauaccaccaugcccagcuaagaguguguguguguguguguguguguguguguguguguggcuuuucuuuuuuuuucuuuuuuuuuuuuuugguagagacagaguuucaccauguugcccaggcuggucucgaacucuugggcuuaagaaauccacccuccuuggccucccaaagugcugggauuauaggugugaaccaccgcaccuggcaagauauuaaugguuuaugaucuauauuuaguucuucagugagggauuuuagaagaacgggggauaugcaggucagaguugagagguuaacuuugagaccacagucauauaaauauucaugaagacauggagugacugaaauuaccuagggagagaauauagaaugagaagcaagaagauugacuuggacagaucccugagggaugugauacauggaagccaaaguaaguauuucauuaaggaaggaaugaauguugcugucaugggcuacuggaaucagugucaaguaaaaugaagguugggaaauguccauuggaauuagcaacuuggaagucacugguguuguaaucccuguuucuguggaauggccucuggcuauggguugaagaaugagaagugagacagugauacaacaugcauagaaaacuuugagaaguugggcuauauaugggaggaaauaaaggguaguagguagagggaggucaaggucugaagaaaagcuuuuuacagugggaaagucuuuuaacauguuuaaaugcuaauauuaaaaaaacaguagagagacugaagauauuggaaagaggagauaguaguaugaaguuccugaaaaaaugaauaggaauugaauccacaacaccuaugaagcaguuugauuuauauaaaggaggaagaauaccuccuuuauuguaguagaauagaggaagaaugaauaggaacagauucaaguuaagaugggagcaaaugcaaauuagcauuugaggucauguggaaaucuaggaaucuauugagugagccaauucgugaagaaaagaaaggagcaguaugguaagagaagaaagggcauuucaaauggggacaaugaaaaggggaauauuuacuaucauuuuguucaauuauuuuaacacuuuaguguuaugauguggccacuucccuaaauaguaauauguaugugaaguaucuuuauuauuagaaaguaagccuugcuuuuuauauuuuccaaacauuacuucuuggucuauauguugauuuuuaugauacaucuugaaacugauaagcuagguuacauauuuauaaaaguauuuuucuucugaauuuaaaauguuuacugaaaacugcuuuacaaggugucaaaacuggaacaagaacuucaaaaacaaagggaaaguucagcugaaaaguugagaaaaauggaggagaaaugugaaucagcugcacaugaagcagauuugaaaaggcaaaaagugauugagcuuacuggcacugccagguaaaaugugaauauguuuuauuuaccuucccacuucaauaucagugguaucugaguuuugaaaucagauaauguucaguggagcauuugcuugaggaauuaaugucuccauagucuguguuccuauugcauuuuguuuguauuuccuucauaucucucauuaugcuuuuuacuguauuacaguuuaaugcuuuuaaccuuccuacuauaaguuucuuaaggcaaggaucauaccugguuuauuuuagggucuuacacaacaacuggcacaguuccuuauaccucauaggcacucagcaacuguuaauugugaauaacauuaaaaguuguaggcaaaaauguaaauguacucacauagaggaaacuuucaggcaauccaauuauauaggggaagaaugacaauauaaaagugguucucagccuugagugaauauuaaaaucaccucaagagcuuguaaaaaaacauacugaugacugggucccacuuuuagauuaaauaaaaccuaaagauucugauuuaauuuggcuaggcuggucccaggcaucgauacuuaauuggucaagaaaggaacccaugagcugaaagcaguacccagccucuucagaucucuucuacuuuguugggaagaauugacauaauuuauaacauaaucagcccacccuucuaccaacaggagucaagagugaacuuaggcacuggcacuaaaaccacauguccccagguucccucuccuccauugacagggguccuuugugcucagaggagcaacuugcuuccucagaugucugucacccucucagcaggguugagggcuucccaaguuuaagacuaagaccaaaguauuucacaccuucuuucuuccauugacagauguucuacucacuaacauggccucaccacugguguccaccuugagucugugaagacugacugcauuaucacuuuauccuuguuuaugccagauaccacaagaaacccuagauuuccaggucagcucucauaucucacacuaauucccaaaaaacucuccacacauucuguuucuuucuccaaccccaucccaacuucugaaagacuucuacugugccuuuugaacuucauaauccauucucuguauucacuacuuuuucuuuucucuugcuguaauagaaaccuggcccuccccuaaggacauugcuucuuccccuguagccuucuaaaguaaaaaacuuuuccccauagcucuuguaccacaggguccaggcaaggugugaaguauauacuauacuuggugaaccucaugccaucagaacccuuacuggugcugauuucuuuagacggccugacuuacuguugcccucuccagcaucacuucugucauucuucuuggggauuucaguacaccucugaagcugauccuucugacaccuuggcuucucauuuuuaacaauuucuguacucuagugauccugaucuuuaacauaccucagccacuuacucccauggaauuuaucuugugcugaaaauuuaaaucaaaaccaaauaacauuuuuugguagaaauuuucuaaaauguauauuuucuugggguuuuuacuuucucuggguaucucaggguuaucauuauauacaucaugcuaaaauguagugauacccuaaugaaacuuugaggcauauacaguucuguuuuuuauaaaaugucuguaggcugcuaaugcuuuuugaguccuuguauauuuucuauaauuuuccccuaacuccuuugcugacaagccaucugcucauggcucuaugccaaucucuuuugauuauucuuuucuaauuaucuguuuuauaucuacuuuaauauuagagcuaauuggucaagcuaaaaauuauuuacuugggauuuuagaaauguaaaagugucauuagcacucaucuaaucuaguacuuaauuggucuauggacauauuugaggaucugguaaaaagcuuuagcuugucuucuauacauagauguauacauguacauuauacauguauaauuuugcauacuguuucagggguuuuauaguuuuccuuaaguuuacucauggacuuccaauuaaaaaacucuugaacaaauccaaauuuguugaaguuuuaucuagaaaagaaaugcuccuacuugcaaacucaauuuagaaauuucaaagaucaaacaacagaaaguguugacacaaaggaacaugaacucuuccuaccauugaggguaacauuaacaauuguuuaauuaguaaauaucacuuuagaauuaccaacaaagggacuuaaaacuggcucuuaguauguugauuugucuguaggggagcugccguauuagaauaaguucaggacugacaaaguuaguaaaccuggcccuaucacuauuaacagcuaguuguauuaucucagacaacucaccuagucuucaguuuccuccucuguaaagcagggaaguugcacuagucuaggaaucucuaguuccuuuuaaagcuaaaaaaaggauagaaccaauaauaaaacugaguaaaagcaauugacuuggcucuccagugaguaauaugguuuuuauggugaauaauuugauuguuuggcuuauuuauuuucuuuguugcuaauaacaaaaauuccuagaugaaugagguccuuggauauuuucaauacaugcaaagcuaaaguuaaaugugguuagagugaaaagaaugcuaggcuuguuaaauauuaccagguaguaguaguaaaguuguauuuagugguauguaauguguaaaggaauaguuuuuaguuggagaauuuuuaaaaauaggugauuuaaaauuccaacuagauauuuugcugauauuuguccuuauauaacuugcaggcuuuuuuuuuagucagagacaaguuaguugguuaaguuucuaaauuaccuguuuuauuauuuguuuuuaauuaggcaaguaaagauugagauggaucaguacaaagaagagcugucuaaaauggaaaaggaaauaaugcaccuaaaacgagauggagaaaauaaagcaaugcaccucucucaauuagauaugaucuuagaucagacaaagacagagcuagaaaagaaaacaaaugcugguaagcaagugguuagaugaguauagcugccuauguauuuguacuuaacgaagugaaauaaugugagaauuugagaugguggggcuggaagggaaaauaagugguauuuugccucucguagaugaauauaauugaauauucuuaauauauacaaaguuuguaauaaaugguuuacauauaguuauaaaauuauucucuccucuuaauaguaaaggaguuagaaaaguuacagcacaguacugaaacugaacuaacagaagccuugcaaaaacgggaaguacuugagacugaacuacaaaaugcucauggagaauuaaaaaguacuuuaagacaacuccaggaauugagagauguacuacagaaggcucaauuaucauuagaggaaaaauacacuacuauaaaggaucucacagcugaacuuaggugaguuaaauaauaagaaauuauaucacaguuauaaguccuuggauaauacaauaaaauauguuguugcauucuagacgucuaaauuucucaacugucuuuggcucacuuuggcucaucccagccagccuaucccaugccuuaucuaacuaauucagcugucuuuguuggccgccaaaacuuucauccucagucuuuagaccauuuuauacuagcccuagugguaaaaaaucauugggcaugcauacagcaguggcuaacagcaggaggauauuaauaaugauaauauuguucuuuguauuaaguccuuauuuuaugcuaggacuacgccagggacuucacauaugaucucacucauuuccuuacaacacaccuauuagaaacauauaucaccuuuuuaauaguugagaaaccugaggccuugagaaaaauaaaaugccccaagucauacagguaguagagucuagagaagggaguuaaacacaagucuguccaacucuaaagucugggaucuuagauuagcaguauaacauaaacuguuaugcugacacacauguauagugaguggagguguacagccagauuagagccaaaguaugagaaauagguucagaaaaggaaaauagaauuacaaauuaggauguaaaaugugaaauaaaagaacaggauaaagagcagcaagauaacccagaaacuuagauacuguaccacagaauucaguguagggccuccuucucuucuguauccacaaacucauccuuaguaaauuucauguagcuuuaaauacuaugugucagacacuuccaaacccauuucuccaguauugaccuuuuccuguaacuccagauucaauauccaacuaguuguuaccuccauucggauauuuuuaagaggcaucucagacuuagccaaaauaggacucauauuuucucauaacccuacccuucuccuaacucaguaucaugcaguugcucaaaccacaaauauauaagauuuuucuuguucucucuuuccaucccuuuuuucauccaguguauuagcaagccaugucaacuuuauuuccaaaacauauauauauauuuuuuuucagacagauucuugcccagguuggagugcaguggcaugaucucagcucacugcagccuccaccuccuguucaagcaauucuccugccucagccaccaaguaacugggauuacaggcaccugccaccacgccuggcuaauuuuuguauuguuaauagaggcgggguuucaccacguuggccagacuggucuugaacuccugaccucaggugauccauccaccugggccucccaaggugcugagauuacagacaugagccacugcacccagccccaaaacacauucuuaaauccauugauuucguggccucuuuucuguuauccuuagcacaaagcaucaucucuuaccuggucuguugcuguggcuuccuagcugggcucucugcuuacaaucuugacccccucccaacaauccauuuuccaaaaauagauuuaaguuuauuauuuaaaacauaaauuagaccaggcgcgguggcucacgccuguaaucccaacacuuugggaggccgagacaagcagaucacaaggucaggaguuugaaaccagccuggccaauauggugaaaccccaucucuacuaaaaaugcaaaaaucagccaggugugguggcagguguguguagucuuagcuacucaggaggcugaggcaggagaauuguuugaaccugggagguggagguugcaaugagccaagaaugagccaugauccauuccagccugagugacagagugagacuccaucucaaaaaaaaaaaaaaaaaaaaaaauagaucauauugcuuaccuacuuaaaccuucuaauggcuuucuaaaaccuucagaauaaaauccaaacuccuucacaaaugaaaauaaaaacuacauugauauaucacuucauaccaaggauggucauuuuuaaaaaccaaaaaauggaaaagaacaaguguuagcaaguguagaaaaaaaaugaaacccucauucauugcuggaggggaucuaaaauggugcagccacuguagaaaacacuuuagccuuccucaguaaguugaacguagaauuaccauaugacucaguaauuccacuccuaguuuuguacucaaaaggguugaaaacagauaucuaagcaaaaauuguauacaaauguuuacaaaguaagccaaaaagugaaaacaccccaaauguucaucaucagaugaauggauaaacaaaauauagugucuuaguccguuuucaugcugcugauaaagacauaccugagacugggcaauucaccaaagaaagaaguuuaauggacucacaguuccacguggcuggggaggccucacaaucaugguggaaggugaaagacacaucucauaugguggcagacaagagagcuugcgcagggaaacuccgcuuuauaaaaccaucagaucucuugagacugauucacucucaugagaacagcaugggaaagaccugcccccaugauucaguuaccucccacugggucucucucacaacacaugggaauucaagaugagauuuggauggggucacagccaaacuguaucauucugccccggccccucccaaaucucauguccucacauuucaaaacaaauuaugccuucccaacagucucucaaagucuuaauucauuugagcaguaacucaaaaguccacaguccaaagucucaucugagacaaggcaaaucccuucugccuaucagccuguaaaaucaaaagcaaguuaguuacuuccuagauacaguggggguacagacauuggguaaauacacccauuccaaaugguagaaauuggccaaaacaaaggggcuacaggccccaugcaagucugaaauucagcagggcaguuaaaucuuaaagcuccaaaaugaucuauuuugacuccaugucucacauccaggucacacugaugcaagagguggguuuccuuggucuuggcagcuccaccccugugacuuuguaggcuauagccuuucuccuggcugcuuccaccggcuggcauugaguaucuguggcuuuuccaggcucauggugcaagcugucagugcaucuguuauucugggguucuggaggaugguggcccucccucuucucacagcucuaccaggcagcgccccaguggggacucuguaugggggugcccaccccacauuucccuuccacacuuuccuagcagagguucuccaugaagcccugccucagcagcaaacuucugccuggagaaccaggccuuuccauauauccucugaaaucuagguggagguucccaaaccucaauucuugacuucuguguacucacagauucaacauuggguagaagcugccaaggcauggggcuugcacccucugaagccacggccugugcucuauguuguccuuuuuccgccacagcuacagugacugggaugcagggcaccaagucccuaggcugcacacagcguggugacccuggaucccacccaugaaaccauuuuuuccuccuaggccuccaggccugugaugggagaggcugcuccagagaccucugacaugcccuggagacauuuuccccauugucuuggggauuaacauuuggcuucucauuacuuaugcaaauuucugcagccagcuugaauuucuccucagaaaaugggauuuucuuuucuaucacacucaagucaccucuggagugcuuuguugcuuagaaauuucuuccaccagauacgcuaaaucaucucuccgaaguucaaaauuccacaaaucucuagggcaggggcaaaaugccaccagucucuuugcuaaaacuuaagagucaccuuugcuccaguucccaacaaguuccucauuucucuccaagaccaccucauucuggacuuuauuguccauauugcuaucagaauuuuggucaaagccauugaacaagucucuaggaaguuccaaauuuucccacauuuuccuguauucuucugagcccuccaaacuguuccaacccuaccuguuacccaguuccaaagucgcuuccacauuuuuggguaucuacaguagugccccacuuuacugguaccaauuuacuguauuagugaguuuucacgcuguugauaaagacauaccugagacugcacaauuuacaaaagaaagagguuuaauggacucacaguuccacguggcuggggaggccucacaaucaugguggaaggugaaaggcacaucucacugguagcagacaagagaacuugugcagggaaccucccauuuuuaaaaccaucagaucucaugagacuuauucacugucacaagaauagccaaggagagaccugcccccaugauucaauuaccucccacuggguuucuccuaaacauguagaauucaagaucagauuugggugggaacacagccaaaccauaucauauaguguauccauacaaagaauauuauucagucauaaaaacgaaugaacuacugauacaugguacaaagugcaugaacuuugaaaacauuaugcuaagugaaagccagacacauguugcauaauuccauuuauaugaaauauucagaauuggcaaauucauagagaaagaaagauuagugguugccagggacuaggggaagggaaaauggaaaauaagugcuaaugaguaggaaguucuuugugggggacugauggaaaaauacuggacauagauaguggugaugguuacauaacauuaugaauauacuuaaugcuucugaacugugcacuuuaaaaugguuaaaaugguaaauuuuauauuauaugaauuuuaccacaguuaaaaaaauccaaguuccuuaucuugaauacaaagccuuauguggucugguuccuguccuuguuccugacauuuuucuuauacuuuacacuuaccaaguuuucuucuaccauggaaccuuggccauagcuguuucuuuuuacuggaauaacaguuacauggucagcuucuucuuguccuucacauuacuucagagagaagccuucucugacuacccacucuaaaguagccacccagucacuaccucaucaugcaguuaaugcucuaacauagcauuuaauauuauauuuuucuuacuuaggugucugucuuuucuucuggaccuauuacaauguaaacucagaucagagacauuuaucuuuuuuacuauuaaauccacagcacuuagaacccuggcauauaggaaacauccaguaaauauuugcaaaauaaauaagugaaugaaaacaugaaagauguaaacagugaaaucuuaaguucuagcuaacagaugaauuguggaagcuccgcuauuugcauagauagaaguuagaguuuucuuuaauuucauacuauuuuuagaauauuaguuuuagccuuguguuauauaccucuugagacuuuuagaagaauauuaaaaacaacucauuaaagaaguucaaaaucuucuuuuaaaaauuaguacccuuaucaguacuauuucauauuucagacuggaaaaucauaugaagauuuucaagaucaacauuuucaaccuuugucuuaucagaacuuagaguuucaaauuauucucugaucacaggcuucacuuugguaaaagccuuaaaauugugucaguauuaagcauuuuauaauauaagguuauacauaaauuaggguuuaagagggcuuagaauuuguaauauuuuuauauuagauuuaagugcuuuuuuauauguaaggcaucguuuugaguaacauccucaugagaaauacuaugguuaaaugccucauucaauuguaaugaagucacaauuguuacauguaaaagacuuugaaacacuccuuugaucuguguaugaaaaaauguggauauguauuuuuaaaaauucuuauaaucauucaaucuuggaguccugggaguguuuuagcaauuagcuuaaauuaucuguaauaccacagugugaguuaacuuuuacccuuuuagaauacccuuuauuaaauuaauuguauugaugucaaucuuuuucuuuaucuauuauuccuuaaauuugacccuuucaaucugacuugauugcauauauuauuuugcuuuuaauuuauagaagagguaaccugguugaccuaacuuuuuaaaauuauacucuucuacuaucugcuuugaucuuuuuccuuugauaaauuguagagaaugcaagauggagauugaagacaaaaagcaggagcuccuugaaauggaucaggcacuuaaagagagaaauugggaacuaaagcaaagagcagcucagguugauuuuucuugauuauauuuuaauggaguuuucuguuaugacacagucacacaggauuugagaggucaccaauuuuuuguaaaaugggcauuuuuauagcauaucuuuucucugcacauaggguuuacuaaauuagagauaugucaucucucuuuaucuugauauuuuucuagcaaguagauuuugaaaaugaggauuagcuuaguaucugagccuuuugaucucuuauauuaccccguaucagaagaagcuaaguguuggaggaacaaaaauauuuggaaggcguuauuuagcacuuuuuguccagcauaaaaugaagucugaauuauuugucauuuaugaacacaacuauauuuuauuguuucuauaauguauaugggauugaaugucacuauguauuguuaaaaaaaaugcauauggggcucaugagccaguauuaguaaacaaugauuauuuuucccauuuaaaaaauaauuugaguuuauacuaaagcaaagagcauuaguauauuagcuauacuaaugaguuuauacuuguuauacuugcuauaaacaauuacaaagccuauucuaagcauacaaguuuuuauaucagaauaaaauugaacaacaguuuaagguuauuuuuuagguuacacauuuggauaugacuauucgugagcacagaggagaaauggaacaaaaaauaauuaaauuagaagguacucuggagaaaucagaauuggaacuuaaagaauguaacaaacagguaaauuauuuuaaaauuacguauuuuaaauuauuuuuuaaaaaauucaaacuguaacuaaaaacaccccuucaaauaguggguguuuuuuguuauuguuguuuuguuuuuuguuuuuuuuggagacagagucguucucugucacccaggcuggagagcagugacacgugaucauaccucacugcagccucgaguuccugggcucaagcaauccuccugccucggucuccccaaagcuuugggauuacaggcgugagcgaccacacucuguggaucuuucacuucuuugauuaaauuucuuccuagauacuuuauuuuuuuguagcugcuuuaaauaggauugccuucuugauuucuuuuucacauugauugcuuuuaguguauagaaaugcuacugauuuuuguauguuaauuuuguaucuugcaacuugacugaauuuaucaguucuuuuuuaguuuuuguuuuuguuuguguuuugagacaagaucucacccugucaucugggcuggagugcagugucaugaucauagcucacugccgccucaacaucccaagcucaggugaucccuccaccucaagucucugaaguagcugggacuacaggcgugcaccaccaugauuggcuaauuuuuuaauuuuuuguagagaugggguuuugccauguugccuagguaggucucaaacuccugggcucaagcgaucuuccccccucagcuucccaaagugcugggauuacaggcaugagacaccacgccagcccuguuuaucaguucuaauaguuuuuugguggaguuuucagguuuuuccaaauacaagauuauauccucugcaaacaaggauaauuuaacuucucucuuuccaauuuggaugcccuuucuuucucuugucuaguugcucuagucaggacucccaguauuauacugaauaauaguggugaaagugggcauacuugucuuguucuauaucuuaguggaaagacuuugaguuuuucccuauuccuaugauauuaacuauggguuuguuguaaaugaucuuuacuguguuauuuuccuucuuuuuuuuuuuuuuuuuuuuuuuugagauggagucuugcucugucacccgggcuagagugcaguggcuugaucucagcucacugcaaccuccgccucccggguucaagcaauucucugccucagccuccccaguagcugggauuacaggugcccaccaccacgcucagcuaauuuuuguauuuuuaguagagacggcguuucaccaucuuggccaggcuggucuugaacuccugaccucaugacuucacacaccucagccucccaaagugcugggauuacaggcgugagccacugcgcccagccuguuauuuuccuucuauacccaauuuguugagagcuuuuauaaugugaagauguugaauuuuaucugaugcuuuucaauaaugcuuuuaauuuuaauaugaaauuauuauaugguuuuuguccuugauucuguugauguaauguaucauguuuaaugauuuguguauguugaaccaucuuggcaucccugggaugaauuccacuugguuauggugaaugaucuuuuaaaaaugucuuugaauucaguugauaguauuuuguuguggauucugccucuguguucaucagggauauuggccuguuguuuucuguuucuguuauguccuuguccgguuuugguaucaggguaaugcuggccuuguagaaugaguuuagaagugggccaggcacgguggugcgugccuguaaucccagcacuuugggaggucgaggugggcagauugccugagcucaguucaagaccagccuagacaaccuggagaaaccccaucucuauagaaaguagaaaaauuagccagguguaguggcaugugccuguagucccagcuauuaaggaggcugagguggaaggauugcuugagccugggaaguagaggcugcauugagccaugagugcacaacugcaccccagccugggcgacagagugaaacccugucucaaaaaaaaaaaaaaaaaaaaaauguucccuccucuucaauuuuuugaaauaguuugaguagaauugguauuaguuuuucuuuaaauguuugguagaauucagcagugaauguaucagguccugggcuuuucuuugaugggcgacuuuuuauuacugcuuuuaucucauuacuuguuauuguucuauucaaguuuucuguuucuucaugguucaaucucaguagguuguguggguccaggaauuuauccauuucuucuaguuuuuccaauuuguugguauguaguuguucauaacagucuguagugauccuuuguauuucugugguaugaguuguaauguuuccuuuuucaucucauuuuauuuauuuggauucucucucuucuuagucaucuaaagguauuuguuaauuuuguucaucuuuucaagaaauuaacucuuuguuucauuuauccucuguauuguuuuauagucucaauuucauuuauuuuugcucugaucuuuauuacugcuuuccuucuaauaauauuggguuuggcuguugcuauuccagugugggaaaggcaguucaagaccaacuugaacuuaccuuuuguagagacagggucccacuauguugcucaggcucacauucuuaucagcacauggaauuauccagaauacauaaauguauuauguauuauccagaauauguaauauguuaggccacaaaauaagucucaucaaauuuuuaaagguagaaauccuaucaaauauauucucaaugcaauucuaaaagcaucauuuucaguaauauguccaauaauauuuucaauaaugcuuuuaacaugcaccuuuaggugcauuguuuguuugaaauuuuuguauuuuuuugauguaagcaauuauugcuauaaacuuuccucuugguacugcauucacaguagcccguagguuuuguuauguuguauauccauuuuuauuuguuucaagacauuaaaauuuuuuuuaaaauuucuucacucacccuuuguucauucaggugcauuuguuuacauuuuauguauuuauauaauuucuaaaguuccucuuauuauugauuucuauuuuuauuccauagugguuagauaauauauuugauaggauuucuaccuuuaaaauuugaugagacuuauuuuguggccuaacauauuuauguauucuggauaauauuccaugugcagauaagaaugugagccugggcaacauagugggacccugucucuacaaaaagugaaaaaaaauuagccaggugugaugaugagcacuuguacucccagcuacuugggaggcugaggcgggaggaucacuugaacccaggaggucgaggcugcagugagcuaugauugugccacugcacuccagccugggcaucagagugagacccugucaaaaaaaaaaaaaaaaaaagaaaagagagaaaaaaaagaauauguauucaguaacagugggugaaauguucuguaaaugucagucacaaaaugccuccuuggccuaguuuguaguugaacucugauguuucuuuguugauuuuuuuaaucuggacaaucuguucauuacugagagugggguauugaagucccugucguuuuauugcaaccaccuauuugucccuugagaucuauuaauguuugcuuuauauacucgggagcuuuauaugccugggugcauagauauuuauaauuuuuauauccucuugcuagcgugacacauuuaucauuaaauacuggccuucuuugucucuuucuacugucuuugaucuguagucuguuuugucuaaguauagcuauuucugcuauacuuuugauuuccauuugaauggaacaucuuuuuacauuauuuuacuuucagucuaugugugucuuuaugaagugaauuucuuuuaggaagcauauaguuggauuuguuuuuuaauccauucacccacucuauguguuuuaaauggaaaauuuaguccaguuacauucaauguuauuauuaauagguaaggaucugugccuuucuguuacuuguuucuuaguuguuuuguaacuccucccuuucuuucccacuuacugucuuucauugugguuaaaugauuuuuucugguaguaugauuaauugguugcuguuuauuuuuaguguaucucucacagguuuuugcuuuguggugagacuuauagaaaacauccuauuguuauaacaagcuaucaaaaacugauaucaacugugauagcaaaaacaaaaaaaaguaaaaacuuguauacuuuaaucuccuucuccuuccacauuuugaauuuuugguguuccaauuaaauuguuauauugccuaucucugaauaaauuguuguaauuauuauuuuuaauaauuuugccuuuuagucuuacuaaagauauaagugguuuacacaccaugauuucaguguugguguaacagucacauuaguggcgguuuuucuuuuaaguuugaaguauucccuuuagcauuucuuguaggacaggucuaguagcgacaaauuuccucagcuuuucuuugggaaagugucucuucuucauuucugaaggauaacucugcuuggcacgguauucaugauugacagguuuuuuuuguucaacacugaguaugucaucuuacucccuccuggucuguaaauuucugcugaggugucugcuaccaggcauacuggaucuuccuuauauauuauuugcuucuuuucucucacugcuuucaggauccuguguuugucuuugaucuuugagaguuucauuauaauaugucuuaggguguuauuauuuggguuuaaucugguuagcgaucuuugaccucuuuauaccugcauacuuauaucuuuccucagguuuggaaauuuuucuuuuguuucuuuaaaaaagcuuucuaccccuuugucuuucucaguucccuuuuuaacuccaauaauucaaagauuugcucuuuugauguugucccaaagaucccauaagcuuuguuuauuccuuuuuauuccuuuuuuccuccucucacuguguagucuauuuaucuaucuaucugucugucuaucuaucuaucuaucuaucaaacuaauuaacuaacuaacauggggucuuuguuacccagagguggagugcaguggcacaaucauagcucaauguagccuugaccaccugggcucaaagaauccucccacuuccgcauugugaguagcugggauuacaggugcaugcugccacaccuggcuaauuaaaaaaaaauuuauuuuaagugauggaguuucacuaugugacucagucuggucucaaacuccugggcucaagugauccucucagccuacugaguaucugggauuacaggugugagccaccauccucaguucugauuauauauuuucaaauaguccaucuucaagcucacugauucuauuugacccauucugcuguugaugcucuuuauuucauuuuucacuucauuuauuguauuuuucagcuccaaaauuuuuguuugauuuuuuaaaaauuauuuuauucucuguuaaguuuuuuugauaaauuucucaauugauucccugcgucgucuuagaguuuguugaacuuccuuaaaauaccuauuuucaguucuuugagagaucacacaucuccaucacuucaggguuacucucuggugccuaauauuguucauuugguaagguuguauuucuuucaauguucuugauacuuguagauaugcaacgacaucugcauauucagggacuggguauuuauuuuagucuuugcagucuggcuuaguuugugcuuguccuuuuugggaggcccuuccaggaauuuaagcaaacuggcuuuuguguucccugaggcugugaucacugcagcuguugaacacuagagaauaaucuacauccaggcuugcugcaggucuuacaagggcuucaagguugacauggcuuucuggcccacauggaccugggaaggggucaaguugcguacuaaggcugugggaaugcuugccagggacccagguccagaaggcuguccugguggcccagaugggcauguuucccagcaaaucuuuugacaggugagaugagucucuaguugcaaugagaggggcuggaguugagacuggcccucuugggauauauuguggaauggaggcugaagagcccagucucagcuuagaggggcacacauagcccagcaagcuccuucacaggauauuuccccaacgacagugugaggagcuagaguugagacugggcccccuuggcaucugcugugggauggaggcuggagaaccuaucuuguuggcccagacagggccagcaggucucagcucagauggaauaguucccugucugcagugggaggugcuggagcugagauuuaaccccuuuagcaucugcugugggacagaggcuggagagccuaucucauuauuucagaggugcaugugucucccagcaagucccugcacagacaggauaguucccugauugcagcaagagagucggggcugagacuggguccccuugggaucugcucugggacagagguuggcaagccuuucaaggaggcuuagacuccuaggcagcaggauaaggacaggucucccuuugggucugugugugaguagcucugagcugggaccuuugcugaggggaguuggagcagagucaccaggcaauuuuccgguccacugcugagacugaugucagcagggagagagccuuuccacuaaggcacuaguaugcaugauuccuuauggaccccuuuucagaugguugugcuuguaggcucaaggccaaauggggcuguagccaagucccuuggggacgugggcuguuuccaggcuugaacccagaagcaagcuuggcauaucagccaccuggguuucugucugugcucucaaaauaacacucccacaucuucgucucuaccaggauuucacaaacuccuaccugaauccugaggcuccugcaaagaggcuuuugacuauagaaaggugcaggauucuuuuuuuauuuuauuuuauuuuaaauuaacaguguuuauuuaccucuaaguauuguugagagacuggggugaagacacaauuuucauuuuguaauuuacagacuucuauaagcuaaaacaaaaacaaaaaagucuucucuauuuaauauaaugguagaauacaacuucuacuuuuauuuauuuuaauuuuuuaaauuucaaucgcuuuugggguacaaguaguuuugguuacauagauacauuuuauaguggugaagucugagagggugcaggauuccuguuguugugggggaauaugaguggguuacccucuauucugccuuucugguaauguccaagaacaagaauuuuugugcuuauuuccaggauacgauugccuuaaccuauuuauauuuugcuuuuagauaugaguguuuaaagcuugacuuacuuggaacacagcauugauuaaauuacauuucauuaauuuuacugauacugcuuaucuguuuaaaauucagauagaaagucugaaugacaaauuacaaaaugcuaaagaacagcuucgagaaaaagaguuuauaaugcuacaaaaugaacaggagauaagucaacugaaaaaagaaauugaaagaacacaacaaaggaugaaagaaauggagaguguaagcaaauuauuuccaccuaaggaacaagugguagucucuguugagugaaaugaaucuuuauguuuuaaacugguugguuuuaauauacagaaacugugccauaacuguuuuuaggcuaguuuuuugugccagaaaccuguuaguuucuuugaccuuuuaaaauauuuuucugauggucuagguauaggcaaagacagugucuuauuuaucucuguauacaggccuuugcaugguaucuuucauauaguaaaucuacaauauaugcuuauuugguugacaaauauuuauugagaagcugcuauguaauagaauugaggagucagcuuuuuuuuuuuuuuuuuuuuuuuuuuuuugagacugagucucucucuguugcccaggcuggagugcaguggcucaaucuuggcucacugcaaccucugcuuuccggguuccagugauucuccugccucagccucccaaguagcugggauuacaggcaccugccaccacgccuggcuaauuuuuguauuuuuaguagagaugguguuucaccauauuggccaggcugguuuugaacuccugaccuugugauccaccugccuuggccucccaaagugcugggauuacaggcgugagcuaccgugcccggccgaagagucagcuauuaauaagauacaguguuuugucuguuaggaacuccaucaaaagaauggauaaauaaauaauuguacauugagaccaagugcacugaguugccagaugaaguuugaugacuucauaucaucaguaugcauguguguugacuggugaauucauuccuccacuugcucuuuuaaaaagugaauuuagggucaggcacgaugacucacacuuauaaucccagcauuuugggaggccaaguuggcagaaucauuugagcccagaaauucaagaccagccugggcaucguagcagugggaccccugucucuacaaaaacauuaaaaaacuagcuagguguggugaugcaugccuguggucccagcuacuugggaggcugagaugggaggauugcuugagccugggaggucaaggcugcagugauuugugaucacgccacugcccuccaaucugggcaacagagcaggagccuguaccaaacgaagaagaggaagaagaggaagaagaggaggaagaggaagaagaggaagaagaaggaggggggagggauaguggggaggagggggaggaauacuuuauuagaaauuuaauugaguaauauaaaaccauuucagugggaguagcagccccagugacaaguuuuacuuucacagagaguaagaccuuaacccagcuguguggauuaaaugguggauuuuaauuaucuauaccaauauauucucugucuuugacauagauaaucaaauguuaacuucucuuuucucuuuauguuuucugucauaaauguuacauuuaaaaugauaaaagauuauauggcuuguguauguuacagugauguaauauauaucaauaagagucccaauuaugguauuuuugucauuuucucauuagauuuuuuucuugaauaucaguuucacagugggugauacucauuguauguuaaauuuuaacauacucauuguauguuaaaggauuuaguuggaagguggaaauuuacguauuaagcaaaaucagaauaagaaauagguuaucuauauauuucauucugaaaccuacaaauaccuuaugcuuuucagguuaugaaagagcaagaacaguacauugccacucaguacaaggaggccauagauuuggggcaagaauugaggcugacccgggagcaggugcagaacucucauacagaauuggcagaggcucgucaucagcaaguccaagcacagagagaaauagaaaggcucucuagugaacuggaggauaugaagcaacucucuaaagagaaaguaaucccuauuuuaaauaaucuuauguaucugaaaucuuacaaauauuagcauuuuuuuugaacuguagaauauaguucuuucaaaaaugaacuguauugcacaacagugugaauguacuuaaucccaccgaauuauacacuuaaaaaugguuaaaauggucaauuuuguguguauuuuaccacaauuuuagaaaauaaugaacuguguuauauauagauaacuuuguaauauaaccaggaaguccuucagaacugaguuuuggcuaaacuaguucucaaauugaguuauaaagcacuuuuagacuuuuaagugaguucgagcucuuacuugaagaaaaaauaaagcuaaucuuuuuugaguaaaaauuuuuacauuuguagugacucuuaaaaaugaaaacuauuggcuuggcacgguggcucauaccuguaaucccaguacuuugggaggccgaggcaggcggauaaguaagucaggaguuugagaccagccuggccaauauggugaaacaccaucucuacuaaaaauacaaaaaacaaaauuagccaggcaugauggugggcaccuauagucccagcuacucgggaggcuaaggcuggggaaucgcuugaaucccgaaggcagaaguugcagugagcugaagucgugccacugcaccccagccugggcgacagagcaagacuccaucucaaaaaaaaaaaaaaaaaaaaaaaaaaaacaugaaaacuauccaaauuuguaacuauuaaauuuguaacuuuuaggaaaccuguaguucaaaacccuugguugauaaaguaacuuggagguaaagugcuuuuaaaaagcaaaaauacuaauauaaauuuuauuuuuccaguauuugguaggaaguuaacuacuuggcuuaaaaauauuuacauugguauacuuggguuaauuauuuagacuuuaagaaaaauguguuuauugauguugcaaaaaaaaaaaauucagcuuuccauugugguuuccaugguuuaauucaauuccauaggaacugaauuaaaauauuuuuaccuuuaauuuugguuaagccuaccuauguuguuauucacauuucuggaugguuagaccaguaaagcauacauagagaauguuuauuagagauauauuauacauuugggguucuaggaaaaggaaagcuaucuacuuuuaucucauuucugccuuuaucaauagugucaaaguauaguacaauugguuuuuauuugauaagcuaagcucacuuuaaaaagugaauuaaaguuaggaauuuuuuaauugacaguguuuuaaauacuuauuuuaacccaaaacuaaauauauauugauauguuuuuccuuugauguagggccaaaccuugguucuuuuuguaugagucauuugauuagaauucuaccuagucuuucucacauaacuagacuccuaccuggucuuucaccacacuauauuccaucaucuauaguuuccaauucugcuuucuuuaaaguggaggaagaauuaauuaaaagacauuaauuaaaauuaaaauaauuaaauuaauuaaaauuaaauuaauaaaaauuaauuaauaauaauuaauuaaaagacauuuguaagugaaccauguuauauuuuuaugggaccuccuaccauauuuuauaacaauuuugaguguuucuaauuggauagcaaaauguucaugacuuacuuauuaagcugguucaaaacauauaacuuaguuuuuggauaaaaacuuugcauuugcuuauuucaucauguucauaaucuauaauaaaauuacacaauuaaaauuacaagcacaguuagcuaaauuagcauaaauaaguuugaauaaaaacacaacugacucuugauaaacagacaauauauauagugagcaaaaauauacaggcauaccuagcaguagacuguuaucugccagaguucaguguccugagguuauuauuaauaguucauuuuauagaaagcauugguuagugaacaucuauuuuaugaugacagcaaacaauuauauuaauacucucccauuaauagucucugaaaugucuagauuuuaaagcauacuauuuaguaaguuaacuuugugucuguguuuauauaauauaaaaaauuaaacuacuuccaauaaugcacuggauuaguuuagcuauaauaaccaaauaaacaaguuuuauagcuuuuacucaauaugucauuuuuaaggaugcucauggaaaccauuuagcugaagaacugggggcuucuaaaguacgugaagcucauuuagaagcaagaaugcaagcagaaaucaagaaauugucagcagaaguagaaucucucaaagaagcuuaucauauggagguaaagaaaaauuuaauuuguuuuguuagugcccacuaaaguagguugaccuaucuggacaaaaguaugaguccagcucuuaaguguucauuauugaauaauacauuguggucuucauuucugguagccuaaacauacagcuuucacuuuaauauacugugggguuaagagcuugaauuccugagccaggcaaccugguucuaaacccuagcucaccacggagccaccuguaucaccuuggguaaguuacuuaaccugugucuaaaauggauauaauaauaguaucuaccucauagaacuguggugaauauuaaaugaauuaauauauaauauaaaauagcauuuguaaaagauuaacuggaaauauuuaauaacugauauaaaccguuucaugugauguaaaucuauaaugcuuugcaauuuucagcauuucuucuuauaauaacuuagcuagagagauaauacuagagccuuuuuaucugucagcaugucuugagccuucacagaaaugggcaguauuauugacuagaauagcauuuuucaucuuuuuaaaaacuacauuuaaagauauuacccaaaaucucuguauaugauuuaaauaaauuacuuacguuuagugcuaauaaagcguuuuuucuaauacggcaaggguugcaaauauuuauguuaaacuccauucaagggaguuuggugacauuuuugugagugauugguagggcuuguggggaccaugucuugcuuaaauacauuuagaaucauaucucuuugaaagcauugugccugccaaacaaaacauauuuacaagcugaaucuaauccuaaggcuaagaauuugcaaccuuugaucuuuagcgacaaaccugaaugaaugcuguuggacucagcauaauuauauaauuguuauuaacagcucagcuuaguaacuaucaguaauaauuaggcgcuuucaaguguuugcccuuaacuacucauuacacuuucauuauauggccucuguucuguuuuuaaguauaauuauccaauuguuucuuuuaguuuuauaagccaccugaaauuauaaauagauuguacauaaaauaaauuguaaaauuaguucaguauugcuaucuuuuuaaaaaagugauggggucuguguugcucagacuggccucaaauuccagagcucagauaacccuccccacucagccucuaaguagcugggaguaaaagcacacgccagccgggcgcaguggcucacaccuguaaucccagugcuuugggaggccaaggcagguggaucucuugaggucaggaguucgagaccagccugaccaacauggcaaaaccccgucucuacuaaaaauacaaaaauuagcugggugugguggcgcaugccuauaaucccagcuacucaggaggcuaaggcagcagaauugcuugaaccugggaggcagagguugcaguaagccaagaucgcgccauugcagucaagucugcgugacaagagugaaacuccgucucaaaaaaaauaaguacaugcugcugcauuuuaauauuuaauauuacuauuuaauauuugauacuaauauuuugucuauaauauugaaguauauauuuuuaccuguuuggaaguugauaaaaauuuacuuuuaaaauauauauguuguuugaauauaaaaaugagaggauaugguauuaaaguaauagagagcuagaaaagaggaucaauaauuuuuaacaguuuuuuuuauuauacuuucuuuuuuuuuuaauacauuaaguucugggguacgugugcagaacaugcaguuuuguuacauagguauacacaugccauggugguuugcuguacccaucaaccugucaccuacauuagguauuucuccuaauguuaucccuccucuaaucccccaccacccaacaggccccgaugugugauguuccccucccuaggucuauguguucucauuguuuaacucccacuuaugagugagaacaugcgguguuugguuuucuguucuugugauaauuugcugagaaugaugguuuccagcuucauccaugucccugcaaaggacgugaacucauccuuuuuuauggcugcauaguauuccaugguguauaugugccacauuuucuuuauccagucuauuauugauggacauuuggguugguuccaagucuuuguuauugugaauagugcugcaauaaacauacaugugcaugugucuuuauaguagaaugauuuauaauccuuuggguauauacccaguaaugggauggcugggucaaaugguauuuccaguucgagaucaacaguauuuuuuaauauauagguuuccaaauugucagaaaaucacuuaauaauaaauguaaaacuccugacuuauuggaggagaaugagauuguuuuaaccuuuaauugugaaaaauuuaaauauauuuaaaaauagaauaguauaaauaguauauacauccucauauuuauuuuugaacguuaauaauuuucaaugcauagccaauuuauuucauccauaaauacauugaccauuuucuuuaucuaaaagagaauacuuuugagaaugaaaaggaaugcuauaguaauuacaugaggguaccaggcauaaaaccuagacaguccuaagcauucucggaagugugucaacauaccuuuaaccuuugaaagcacagugcuuucaaagagauaugauucuaaauguauuuaagcaagacaugguccccacaagccccaccaaucuaagcaagacauggucccccaagccacaucaaucacccacaaaaauguuaccaaacucccuugaauggaguuuaacauaaauguuaaacccauucccaacccaucccccauauucacauauuauuugaagcaaauuuuagacauaauuauuucaucuguaaauaauuauguagacauaauuauucuauauucaauaaguaucuuguauuaguccauuuuccauuaguccauuaguccauuuucacacugcuauaaagaaauaccugagauuggguaauuuauaaagaaaagagcuuuaauuaacucacaguuucacauggcuggggacaccucgggaaacuuacaaucauggcagaagguuaagggaaagcaaggcaugucuuacauggcagcaggagagaaagaguguguaaaugccacacuuuuaaaccaucagaucucaugagaaugaacuuacuaucaugagaacagcuugggggaaccacccccaugauccaaucagcucccaccagguaccuuccuccacaugugaggauuacaauuugagaugagauucggguggggacacagagccaagccauaucauuccaacccuggccccucccagaucucuuguccuucucacauuucaaaacacaaucaugccuucccaacagaaccccaaagucuuaacucauuccagcauuaacccaaaaguccaaguccaaagucuuaucugagacaagccuuccaucuaugagccuauaaaauaaaaaacaaguuaguuacuuccaagauacaauggggguacaggcauuggguaaaugcuccccuuccaaaugggaaaaauuugccaaaacaaagaggcugcaaggcccaugcaaaucugaaacccaguggagcagucauuaaauguuaaagcuccaaaauaaucuccuuugacuccaugucucacauccaagcuacacugaugcaagggguggacucccaaaguucugggcagcuccaccccugugguucugcaggguacagccccuguggcuguuuucaugggcuggcguugagugccuggggcuuuuccaagugcacggugcaagcuguugguggaucuaccauucuggggucuagagaaugguggcccucuucuuacagcuccacuacccagugccccgguggggacucugugugggggcuccaaccucacauuucuccucuguacugccuuaguagagguucuccaugagggcuccaccuccacagcagacuucugcuuggacuuccaggcauuuccacacauccucugaaaucuaggcagagccucccaaagcucaacucuugucuucugugcaccugcagacuuaacaccacauggaagcugccaagguguggggcuugcacccucugaagcaauggucugagcuguaccuugaccccuuuuagccauggguggagcugaagcaacagcaauacaggucaccccgucuugaggcugcacagagcaguggggcucugagccuggcccacaaaaccauuuuuuccuccuagauauccaggcuugugaugggagaggcuuccuugaagaucucugaaauggccuggagucauuuuccccauugucuuggcaauauuuagcuccucauuacuuaagaagauuucugcagcgagcuugaauuucuccccauaaaauggguuuuucuuuucuaccacauggccaagcugcaauuuuuuuuuaacuuuuaugcucugcuucccuuuuaaacauaaguuccaauuucagaucaucucuuugugaaugcauaugacuguacacuuucacaaaagccagaucaccucuugaauccuuaaaaauuucuucucucagagacccuaaaucaucucucucaacuucaaaguuccacagaucucuggggugggggcaaaaugccacuggucucuuugcuaaaacauacaagauacucuaguuuccaauaaguuucucaucuccaucugagaccaccugagcuugcacuucauuguccauaucacuaucagcauuuuagucaaaaccauuugacaagucuguaggaaguuccaaacuuucucacaucuuccugucuucugauuccuccaaacuguucuaaccucugcccauuacccaguuccaaagucacuuccacauuuucagguuaucuuuauaguaguaccccacuauucugauaccaguuuucuguuauuaguccauuuucacagugcuauaaaaacugugagucaauuaaaccucuuuuccuuauaaauuacacagucuuagggcuggugugagugccugaggcuuuuccaggugaaggugcaagggcugucgcuggaucuaccauucuggggucuggagaauggugacaguugcaggguaauuuauaaagaaaagagguuuaauugacucacaguuccacauggcuugggaggccucaggaaaauuacaauucuuaugauuauggcagaaggggaagcaagucaugucuuacaugguggugggagacaagagagcaagaggggaagugucacacuuuuaaacgaucagaucucaugagaacucacuaucaugagaacagcaugggugaaaccauccccaugacccaaucaccucccaccagguugcuccuuugacauacaggaauuacaauucaagaugaagccuggauggggauacggagccaaacuguaacauagcucuaaaagauaagggcuauuuuuuggaacagaaccacaauaccaugaucacaccuaaaaauugacagugacuccuuaauaucaucaaauacccaaucauuguucacauuuccccaauugucucaaaaaugucuuuauaguuuauuuguucaaaucaguacccaaauagaguccauugcauuugguuaauuaaguucuuaaguaaauugaagauuauggauuccuuuguucccuuuuuccucuaguauucauugagaaaucagauguuuguaacuauaaacagaauuuacuuuuuuuaaagaaaaaguaaauaaaaguagaaagcauuagacuguugucgaauccaguuuccuuccauuuuuuuauuuuuuuucuuuuccaauucuggggcuauauagaugauuucacaucaagagaaccaugcaaaguggaagauuucugcugacucucaaaagucuucuguucagcaacuaaacgaacaguuagagaaggcaaaauuggaauuagaagaagcucaggauacuguaagcaauuugcaucaacaaguccaagauaggaaugaaguaauugaagcugcaaaugaagcauuacuuacuaaaguaaguaaacauauaaaaguaauaaagcauaucuaugaaaacauaaaugucugacuuauuuaccugucuuaguaguuuauagaggacuauaugaccaaauauuggccuguuugaauaaaaaccauuugauuuagaagauguugaauuuaggaaauuauuaagaugauguacaucuuauuaccguagaagauauaauuuauaaauguucaaauauaaacucaucuaaucauaauguuuagaggguuuuauacuugauguaccuaaaaaaagguagaaacauuuuucaaaaucagcaaaguucuuuuaaaaucauaaaguaggccgggcgugguggcucacuccuguauucccagcacuucaggaggccgaggugggcagaucacuugaggucaacaagggcaaagacaauuuuuugagagccaugaaggcaucauuauauuauggcucacuacaauuacguucacaacagugaccuucuuugagucuuaagaaaaaguugaauuaauuuaauguauucaguguacuauauuuaauuguaaaaguuauguguuaaacuguaacuuaaauaaaauccuacuuauaugagauaccacauaucaauuauggcuagauaaugcagaauaggaaaaagaaaaagacugcagcuguguacaguccuauucugugccaacucuacaacuguuuuguuaauugugauuuuaagaaugugaauguaggauuuacaacaaaaaauuggcacucuagccacuuuaaaccaacaggcuuuaaaccaacaaagaucaaaagagaccaagaaggccauuacauaaugguaaagggaucaauucaacaagaagagcuaacuguccuaaauauauaugcacccaauacaggagcacccagauucauaagucaaguccuuagagaccuacaaagagacuuagacucccacacaauaauaaugggagacuuuaacaccccacugucaacauuagacagaucaacgagacagaaaaucaacaaggauauccaggacuugaacucagcucugcaccaagcagaccuaauagacaucgacagaacucuccacugcaaaucaacagaauauacauucuucucagcaccaaaucacacuucugccaaaauugaccacauaguuggaaauaaagcauucuucagcaaauguaaaagaauagaaaucaccacaaacugucucugagacaacagugaaaucaaauuagaacucaggauuaagaaacucacucagaaccacacaacucaugaaaacugaacaaccuccuucugaaugacuacuggguacauaacgaaaugaaggcagaaaugaagauguucuuugaaaccaaugagaacaaagacacaacauaccagaaucucugggacacauuuaaagcaguguggagagggaaauuuauagcacuaaaugcccacaagagaaagcaggaaagaucuaaaauugacauccugacaucacaauuaaaagagcuagagaagcaagagcaaacacauucaaaagcuagcagaaggcaagaaauaaguaagaucagagcagaacugaaggagauagagacacaaaaaacccuucaaaaaaucaaugaauccaggagcugguuuuuagaaaagaucaacaaaauugauagaccgcuagcaagacuaauaaagaagaaaagagagaagaaucaaauagaggcaauaaaaaaugauaaagaggauaucaccacugaucccauagaaauacaaacuaccaucagagaauacuauaaacaccucuacacaaauaaacuagaaaaccuagaagaaauggauaaaguccucgacacauacacccucccaagacuaaaccaggaagaaguugaaucccugaguagaccaacaacagguucugaaauugaggcaguaauuaauagccuaccaaccaaaaaaaguccaggaccagacagauucauagcugaauucuaccagagguacaaagaggagcugguaccauuccuucugaaacuauucuaaucaauagaaaaagagagaauccucccuaacucauuuucugaggccagcaucauccugauaccaaggccuggcagagacgcaacaaaaaaagagaauuuuagaccaauaucccugaugaacaucgaugcaaaaauccucaauaaaauacuggcaaaccgaauccagcagcacaucaaaaagcuuauccaccacaauuaaguuggcuucaucccugggaugcauggcugguucaacauacgcaaaucaauaaauguaauccaucacaugaaccaaaccaaagacaaaaaccacaugauuaucucaauagaugcagaaaaggcuuucaacaaaauucaacagcccuucaugcuaaaaacucucaaacuagguauugaugggacauaucucaaaauaauaagagcuauuuauuacaaacccacagccaauaucauacugaaugggcaaaaacuggaagcauucccuuugaaaacuggcacaagacaggggugcccucucucaccacuccuauucaacauaguguuggaaguucuggccagggcaaucaggcaggagaaagaaagaaaggguauucaauuaggaaaagaggaagucaaacugucccuguuugcagaugacaugauuguauauuuagaaaacccuaucaucucagccccaaaucuccuuaagcugauaacuucagcaaagucucaggauacaaaaucaaugugcaaaaauaacaagcauucuuauacaccaauaaccgaccaacagagagccaaauuaugagugaacucccauucacaauugcuucaaagagaauaaaauaccuaggaauccaacuuacaagggaugugaaggaucuccaaggagaacuacaaaccacugcucaaugaaauaaaagaggacacaaacaaaugggagaacauuccaugcucauggauaggaagaaucaauauaaugaaaauggccauacugcccaagguaauuuauagauucaaugccaucuccaucaagcugccaauuacuuucuucacaaaacuggaaaacaacuaccuuaaaguucauauggaaccaaaaaagagcccacacagccaagacaauccuaagccaaaagaaaaaagcuggaggcaucacgcuuccugacuacagggcuacaguaaccaaaacagcaugguacugguaccaaaacagagauauagaccaauggaacacaacagaucccucagaaauaacaccacacaucuacaaccaucugaucuuugacaaaccugacaaaaacaagaaauggggaaaggauucccuauuuaauaaauggugcuggaaaaacuggcuagccauauguagaaaggugaaacuggaucccuuccuuacaccuuauacaaaaauuaauucaagauggauuaaagacuuaaauguuagaccuaaaacuauaaaaacccuagaagaaaaccuaggcaauaccauugccuaggcaugggcauaggcaugggcaaggacuucaugacugaaacaccaaaagaaauggcaacaaaaaccaaaauagacaaaugggaucuaauuaaagagcuucugcacagcaaaagaaacuaccaucagagugaacaggcaaccuacagaaugggagaaaauuuuugcaaucuacucaucugacaaagggcuaauauccagaaucuacaaagaacuuaaacaaauuuacaagaaaaaaacaaccccaucaaaaagugggagaaggauaugaacagacacuucucaaaagaagacauuuaugcagccaacagacacaugaaaaaauguucaucaucacuggucaucagagaaaugcaaaucaaaaccacaaugagauaccaucucacaccaguuagaauggugaucauuaaaaagucaggaaacaacaggugcuggagaggauguggagaacuaggaacacuuuuacacuguuggugggacuguaaacuaguucaaccauuguggaagacaguguggcgauuccucaaggaucuagaacuagaaauaccauuugacccagccaucccauuacuggguauauacccaaaguacuauaaaucaugcugcuauaaagacacaugcacauguauguuuauugcggcacuauucacaauaggaaagacuuggaaccaacccaaauguccaucagugauagacuagauucagaaaauguggcacauauacaccauggaauacuaugcagccauaaaaaaggaugaguucauguccuuuguagggacauggauaaagcuggaaaccaucauccugagcaaacuauugcaaggacaaaaaaccaaacaccgcauguucucacucauagguggaaaucgaacaaugagaacacuuggacacaggguggggaacaucacacacuggggccuguugugggguggggggaggggggagggauagcauuaagagaaaucccuaauguaaaugacgaguuaaugggugcagcacaccaacauggcacauguauacauauguaacaaaccugcacguugaguacauguacccuagaacuuaaaguauuuuuaaaaaaucauauaaaucaauuuuagaugaaguaguaaaaaaaaaaaaaaaggaaaauaccaaaauaugcguguuaaacuuuuauuuuguaaugcauucugugguuaugacaguuuuaguuaugaacacaguauuuuugaaagcuacuuuaagaauagaaacuaucagaguaaaacugacaggauuuagaaauauauaucuuauggauaccuuuaagaaaaggcaaauguauuugaagaggagacuacuauacuuacauuauuaagcuuuugaaauuaaaauaucaucucuuuuuuuaggcuuuuugguuuuuuaguguauguagucucauuccuaggaucccaaaguucagucagaggacccaaaugaaagacaugaaaaaaauugaaaugaaaaguuuauuuaacaaggauugauuuauuaaaaauuuaucacuuuaaguuuuugaaaaauuucuaaugcacuaaagcuuucuuguaaugagaacacaaaaagcagaauagcuuaucuauuuauucccuacuggaaauucugaaaggggucuuuuugugucuauauguguuagauuaacaaaagauagcguaccucuacaucuuugcagagaaauuuuuagguguaagauuucaaucuugaauagaaauugauauugucauuaacaccaaaaauauauauauaaggagaaucuaguuuuaauggaauuucuuagaauaagcauauuucaaaggaauauguguaauuuucccaaagugaaccuaucuuaaguaaagguuuuaaacagagcuuggaaaacucucaagaauuauaaacagaauuccuauagugggacaaagguugacuuucuaaaagucuaugauuuucuaaggaguucauucauuuaacaaaaauguauugagcaccuacuauguaccaauuuaucugcaggaaucagaauuaaccagauuacaggccaaaauuucuggacaugaaaaggcagaagacaucaaguuucugccagccccauuuacaucuccaacagaaauuaugccugauguucaagauccaaaauuugcuaaauguuuucacacaucuuuuuccaaguguacaaaauuacgucgcucuauuagugccagugaucuuacuuucaaaauucauggugaugaagaucuuucugaagaauuacuacaggacuuaaagaaaaugcaauuagaacagccuucaacauuagaagaaagccauaagaaucugacuuacacccagccagacucauuuaaaccucucacauauaaccuagaagcugauaguucugagaauaaugacuuuaacacgcuuagugggaugcuaagauacauaaacaaagaaguaagacuauuaaaaaagucuucuaugcaaacaggugcugguuuaaaucagguauguauuuuauacacuguaaacuguaauaauuuguuuccaaagaauaucauuuuauuacuuggaagaaaauucauauauuuaaaugaaaaacuacuaauauuugaagaaggaagauuuuacauuuuauacauuaaguaaaaucaauaccaaaagacauuuucucuauugcauggugugagacaauacggggaaagagagaggcagagggagacagaacaggaaguagaacgaaaaauaggaagauagacaugaaagugcuuaaaaauaaaaaaauuaaaaaacugaaaaaaagaaaaaugguaagaaauaugcagugagaggaauccagagaaaguagguucugaggugaauguucucauaacuucgucauaauuuacuguucauuugggcucuguaugucaaaauaaguuauugcuggcuaucacugauccuuggaaaguugauuuacugaauuagccauuauuuaaaagcaugaauaaggccaacuguccucauccuuauaauuuuucacccuaaaauauuuauauucaucuuuccuucuuuugucccuuuucucuuuaaaagaaagauauaucccucuucuuuuuuagagagaaauucuugaacauguacuuucaagccuuuaauaugcuugccuguuuugcuucucugcuuccugauuuaaucuguaucuucaggcuucuuuauuucccucuuccuuucauuuccagacaucuuaaauucauacccacucuaagcugggugcaguggcacaugccugcaaucccagcuauccaggaggcugaggcaggaggauuauuugagcccaggaguuugagacaaguaugggcaacauggagaccccaucucaaaaaaaauuuuuauucauucuauuucuccauuguugcuaccuccuuacuacccuucccacuuuguaacuuacuguauuugucucuugaauauuaaauuuacuguuuucuugaaagucacaaaaaacucuuuguauaauaaacaaauuuaguauccucuuuuucuucagcuuuuguagauuuaacuguccauucccccuuuugauauuuucucuucucuugacuuuuaugauuuaauauuuuucugguccucuucuuauuuugaacuaauuacuuucucacuuuucugcuccucguauuccuuauguuccacaauauaggauuuaaucuguaguuugagaauggaaauaaucuccuuuagauaaugucagcuuuuuaaaaaaugccuaacaucauuuucaaacacaucaagauagcuuugguggccugaacaguuaaaaacuauuuuuuuggaauagauccaagacaaagaaaaauuguugagugaguuuuucuucauaauacuuauuuuugcuggcuuaaguauaugucuaucuacuuguuuauugauugucucccccacugaaaauguaagcucuguguggagaggguauggucauuucgcuuauuucuauauuucuagugccugguauauaguagaugcugaaugaauauuuaugaauguaucaaguggcuaaauaaauuauauacaguaaacacaacuguaguuuuaaaugcuagauuucaucaggcugugcuggccaaaauuucacuuuuagcauauuacuuuuagcacccaagaaguuaaagauucaguaaagguaacugagaaguaaucagugaaauagaagagaaauuaggagaguauaauauuucacaauguauuucaaggagggugagaucaauuguguccaguguugcuaaguaaagugaagguugauuauugacuaucauauuugguaaugucgaggcuuuuaugacccucauaagacuggcuuuagccuaacaaugggaaugaaagccuguuguagaguggguuuagcauagaauggaaagagaggaaauagaaacaucaagaauagacaacucuuuggauaaagaguaaagcagagaaaugagggagaugugaugucaagggagaguuuuuuguuuugcuuuuuaacauaagagagaaaacagcuguuggauauugauaggaaugauccaguagacagggaaacagccauucaagacagagcagaaggaguaaaauccuuaagguaggcuuaagaaaugggauacaggagagcaguagaggaguuggucuuggauaaaaaggggcaguucauccacuguggugggaaggcaggcagaauaugggagcacagaaacacauggaauggaagguuugauagugggagagaaauuucuuuaucaauugcuuuucuuuucuuuuuuuuuuugagacggagucuggcuguguugcccaggcuggagugcaguggcgcaaucuuggcucacugcaagcuccgccucccagguucacgccauucuccugccucagccucccgaguagcugggacuacaggcgcccgccaccacgcccggcuaauuuuuuguauuuuuaguagagacgggguuucacuguguuagccaggauggucucgaucuccugaccucgugaucugccugccucugccucccaaagugcugggauuacaggcgugagccaucgugcccggccaauugcuuuuauuuucuuagugagauaagaagcaggguuuuuaguuaaggcacaguaagauauuggauauuuaagaacagggaagguaugugaaaugguuacuuacuuuggagaguaggaaagcauaaacagacuagcaaagucuaguagaauugccagccagauaguucugucauguggaacaaccgugcaagauacaggacaucuggcaucauuuguuucugccuguuguauaucagcagcagcaugucccuuucuccccuaucacaaugacaaacaaaaaguaccaucacaaauuucuagaauguucuguagaggaugguacugcacccuuuaagaaccucugcucuacuccagugacccuugcagucauagauaugcaagacucucuuuuugguaaaaaucgcaccuaauuuaugcaggauaaauuugauaaguacagugacagacugugaucauaacaauacauagccuuuacuguaugucaagcaaauccuuuacauaaauuaacucauuuaauccuuauaacaacccccugauagguacuauuaucugaauaguaccaaauaauaguaccuaauaguucuacuguaguggguacuauuauuauccuuaugauaugaggaaacugagucccugcucuuaaccacuauauauaaucuuuacauaauuguauugguauuuucuucaguaugucuaauuacauaguuuggucuugcaguugcuuagccaauuaaggauuaagaguaggaguuagccaggcgcgguggcucacgccuguaaucccagcacuuugggaggcugaggcagguggaucacgaggucaggaguucaagaccagccuggccaagagggcaaaaccccaucucuacuaaaaacacaaaaauuagcugggcaugguggugcgcaccuguaaucccagcugcucaggaggcugagguggagaauugcuugaacccgggaggcagagguugcagugagccgagacugcgccacagcacuccagccugggugacagagcgagacuccaucucuaaauaaauaaauaaauaguaggaguuaaaaguuacuacauaacagauagaauaauuucuuacucuguagguuuuugcaauauauauuugaauuuuucaagucauuucaccuauucaauuaucauugaagaucaaugccaaauuaaaauauucaaaauacuggccgggcaaggugccucacaccuuuaaucccaacacuuugggaggccaagcaggaggauuacuugagacuaggauuucaaggacagccugggcaacauagcaagacccgaucucuacagaaaaauaaaaugaaaaacuagcugggcaugguggcgcacaucuguaguccuagcuacuuggaagcugaggugggaggauugcuugagcccaguucgaggcugcagugagcuauuaucaugcaaugcagcaagaacccaucucuaaacaaaacaaacaaacguagccuauuguuaaacuuaaagauuggauucuuaaaauccuaucaaaguuauauucuguauaaacauaguuuucuugauugucaaugauacucuacugaguuuuaaaugcauugaccacugucaauacucauaacuuuaagcucacauggaacuccuacagcgcaugagccucaguugcauuaccugugguagugaccaccucauagucauuuauauguauguugcauuaauaaauauauacuacucuguaaaauuuaaugaaagagauguauuuuuauuuuuuugaggcagagucuugugcugucacccaggcuggaguguaguggcacgagagcucacugcaaccuccgcuucccagguucaagcaauucucauaccucagcccccuaaguagcugggauuacaggcgugugucaccaugccuggcuaauuuuugcauuuuuuaguagagaugggguuucaccauguuggccaagcuggucucaaacuccuggccccaagugaucuacccaccuuggccucccaaagugcugagaugacaggcgugagccaccgcaccuggccugaaagagacauuuuaaauugggauguagagccaugaucuguagccuaguucagguccucggcuuauuucaccugccacuuaaguaugacauugcauuggucuccuauuuaaaagcaggauuuuaaaacucuuuuaaaccaaauaaauuauuauuuaaauaaagaaauccaguaugucaaauagauucaaagguaguuuaucugauuggggguaggauaugucugaccuuuacccaguuacuuaaaucuacucauggcugcucaugcaaaagcuccagagcagcccuggauuaaucauuaaggaaaauaagcaggagcauaggggacuaaggggaaugccacagaguuguuugcccuagcuaucauccucuuaauucguucacugccacacuugacuuuaguagaauuuuuaguaacugucuuuaucugccaguucaaauuuaaucugcacuauuaaaaaaucauuuucuuugguaugaugagugacaaaaguuuaaaaguuugauuugaaagugucaucagguauuacauuuguuucuuuacacauggugugaguuucaaaaccagcuaccugggucuggauagcauuugacucaucagcugauucgucuaaaggacucuuaagcaauuuuuuaaagcagugguagggccaggaggcgccauuguugggcugugcagaggguaucagcuggccuaaauccagcucugcuucagaaaagugcaguuuuaaaguccacugguacaaugaaaagaauguggaaaccgauacaugagaaguguuuaauaaguguuagcucccuuguguugcagcccaaauacuauuuuccuaaugguuaaguacguuggcacuuccauugagaguaaagccucuuaacacugaaguauucugcuuucagacuaacaaaagcuucagaacucaaaaaauuacaccuguacacaauuuagaacacaauaucagcaaguucagagacuucauauuaacuccuauucuaauccuguuuuggauuagagcaguggaaguguugugaauacugauuaauuagcuaauucaccauuuauuaggaauuuauaaaaaguuauuacuucuauuucucuuauuuguaaguaguuuucaagauaugguacauauaucaugcaguaagaugaaaaauaagaaauuaggaaauuagcuauagggaaaacaaagaugaaaaaaaaauguuaaaccaggaguacagguaauaccuagagacaugauaauauuuucaaauucacacccucaguaaagaugaagguaugacaagaaaauuuggcccauauuuuuuuaaauccccugggccuuuuuccucuauuuuucuacuuuauguuaaacugcuuuuauaugcaaauaauuguguagggguggguugccccuacacaccuguggguguuucucguaaggugggacaagagauuuggaaaagaaaaagacacagagacaaaguauagagaaagaaauaaggggacccggggaaccaggguucagcauauggaggaucccgccagccucugaguucccuuaguauuuauugaucaucuguggguguuucucaaagagggggaugugucagggucacaagacaauuguggggagagggucagcagacaaacacgugaacaaaggucuuugcaucauagacaauguaaaggauuaagugcugugcuuuuagauaugcauacacauaaacaucucaaugcuuuacaaagcaguauugcugcccgcaggucccaccuccagcccuaaggcgguuuuucccuaucucaguagauggagcauacaaucggguuuuauaccgagacauuccauugcccagggacaggcaggagacagaugccuuccucuugucucaacugcaagaggcauuccuuccucuuuuacuaauccuccucagcacagacccuuuacgggugucgggcugggggacggucaggucuuucccuucccacgaggccauauuucagacuaucacauggggagaaaccuuggacaauaccuggcuuuccuaggcagaggucccugcggccuuccgcaguuuuugugucccuggguacuugagauuagggaguggugaugacucuuaaggagcaugcugcccucaagcaucuguuuaacaaagcacaucuugcaccucccucaauccauuuaacucugaguugacacagcacacguuucagagagcacgggguuggggguaagguuauagauuaacagaaucucaaggcagaagaauuuuucuuaguacauaacaaaauggagucuccuaugucuacuucuuucuacacagacacaguaacaaucugaucucucuugcuuuuccccacauaauugucuuuugucucugucugcucuuuuuuucuucuuuuaaucuuccuuuuucauugauuuuuucauguagcuauucaucauccuuguuuauugugcucucaaacuauaacaugacacugaugccaaaauguuauauuuauguuccuuuuuucgaguuuuaaaauuaguuuaaccccauauucacacccaccucaucaagccagaauuauuugcuuuuauuuuuuauuuuauuuauuuuauuuuauuuuuuugagauggaguuacccucuugucucccaggcuggagugcaguggugcgaucucggcucccugcaaccucccccuccaagguucaagugauucuccugccuuagccuccugacuagcugggauuacagacgcucgccaccacacccagcuaauuuuuguauguuuuaguagagacaggguuucaccauguuggccaggcuggucucaaacuccugaccucaggugauccaugcaccucggccucccaaaaugcugggauuacaggcagugagccacugcacccggccugcauuuuauauucaugugguucauuauugacuuuuuaugauucauauuuuucaguagacuaaauauuucucacucucgcuuuaaauuauacuccuguuauuaugguagacuuuuaaugcuaaaucaguuuaggaauauuucaaauauuaaucuauuauuuugcauuauucuagggagaaaauguguaauucaaagaagauacugauguguugaaaaaauggaauuuuugguacugugcuguuuacuuauuauauguagcucauacuucauagaagcuguuauuuugcuuuugaauaaauuuuauauuucaauauuuuaaaagaaagcccuucuaaaacuuaauuauauuuuuaaagaaaauuuauuauuuuauuuauuguuuuuuggcuuaaacuugcugcuuucuuuugcuuuuuauauaaaaaucauuguuaaaaugca

SEQ ID NO: 191494 - RNA, 64855 nt, Homo sapiens
augcuccgagcgcggcgcccccgacgcggcgcucggcucggcucgggcauuuccgccucuuuguuuuaaacuccggacgggcuuuuuucuccuccucuugggggggacccagagggagcggcgcccccuccccccuccggcgcggaccccgcgugcgccuugcucgcccgcagccccgagaccgcaggucagugaguccgccccgccuggccugggcccucggcgcccgcuccucaggcugcggccucggcccguguccggcccggaaggcuccgaaccccgggcccgcgcuccgucguccccgucggccuggcccgggaagcccuuggcaggcccgggagggccggcaccccagcccagucaggacuccgggaggucgaagaccccagcccaggcaggacuccgggagggccaagagcccagcccaggcaggaccccgggagggcugggacuccagccuaggcaggacgcagggagggcaagaccccagcccaggcaggacuccgggaggucgaagaccccagcccaggcaggacccagggagggcugggacagcagcccaggcaggacgcagggagggcaagaccccaguccaggcaggacgcagggagggcaagaccccagcccaggcaggacuccgggaggucgaagaccccagcccaggcaggacccagggagggcaaagaccccagaacagggagggccaagaccccagaccaggcaggaccccgggagggccaagaccccagaccaggcaggacccagggagggcgaagaccccagcccaggcaggaccgcgggagggcagggaccccagaccaggcaggaccccgggagggccaagaccccagaccaggcaggacccagggagggcgaagaccccagcccaggcaggaccgcgggagggcagggaccccagaccaggcaggacccugggaaggucgcgaccccagcccaggcaggacccagggagggcgaagaccccagaccaggcaggacccaggugagggcgaagaccccagcccaggcaggaccgcgggagggcagggaccccagaccaggcaggacccugggaaggucgcgaccccagcccaggcaggacccagggagggcgaagaccccagaccaggcaggacccaggugagggcaaagaccccagcccaggcaggaccgcgggaggguagggaccccagcccaggcaggacccugggaaggucgcgaccccagcccaggcaggaccccgggagggcugggucuucagaccaggcaggaccugaagagaguugggcucugggauugcacaggacccccagagugcuaggacacaaugacacaucauccaggagggucugacccugggacaggucaccgagaagggcugggaccccaagaugggucaccaaggagggucggaccuggccaccuggcagggcccgggggggcuaggacccugggaagaaucacggaggagggccagacguagggaccaggcagaauccaaagaaugccaggaccccagaauagaucccccaggaagguccugccuuaaagugggucacagacgagggccaggaccccaugaccauaauucaggaggaccugacccuggagcagucuugugaguccugugagcacugcugggacccugagacugccccgucucccccgggacccugagacagcccuguuuuccccugggggccgggacccugggacagccuguuuucacccgggggccgggacccugggacagcccuguuuuccccugggggucgggacccugggacagcucuguuuuccccugggggucgggacucugggacagcucuguuuuccccugggggucgggacccugggacagcccuguuuuccccugggggucgggacccugggacagcucuguuuuccccugggggccgggacccugagacagcucuguuuucaccugggggccgggacccugagacagcucuguuuucaccugggggccgggacccugggacagcucuguuuuccccugggggccgggacccugggacagcccuguuuuccccugggggucgggacccugggacagcccuguuuucaccugggggucgggacccugagacagcccuguuuuccccugggggucgggacccugggacagcccuguuuuccccugggggccgggacccugggacagcccuguuuuccccugggggucgggacccugggacagcccuguuuuccccugggggccgggacccugggacagcccuguuuucaccugggggccgggacccugggacagcccuguuuucaccugggggccgggacccugagacagcccuguuuucucccagggcccggcacccugagacuggacagugagaagggcucaugacauggacaggcuucuagaugaccaggaccucaaacggggucacuuagggucgggacacugguguggacugggaagaaggcuaggcucucaaagaggaccugaugagagcuggaacuuccagacagguccucagagggcugggacuccugaacaagucacugaggagcauguaggccccaagacuggacuguaaggaguacugggacccucgggggggaauccagcaguguccugaaucugcccaguccacucagcuggaugcaccugcugugaaggccaggcaucuggcauccugguacccgaggcccuuuccaugagacccugggccagccccacagccccugcacaugaaccgccuaggugauaccugggguagguaugaggcaggggccucaggguuccaggagcucccagcccacaggcuccacaccucaggcuggcacugcacccucccacucagccccucguccggggcugcuguccuguccuugccuuggcugugguccguguccagcaccuucaaccccuccugccccucuccccaucuucaaggucaugugagugccccacuuccucaguguagaggcguuuccaguguccgggagacuuggaggagggguggggucugagcugggauguggacuccugggcauauuuuggggacaguugguccaagucaggaaaguuggagcaggcaaggcuauuucccacucccucucuaguaagggaaggaauuaaaggauccugguggugaucgggcuggggacggggguugguuuauuucucugaaaccuuugaaucagccuuuuaucaaaaacuuguggguguuuuccuuuaauuuggaagugguaaugaaaaaguggggugcaugagguauucagaagcgagcggucuaugcuguccuuugacuagggaaggguugucuagugacaucuugucagggguguuuccagaggguggucaucccaggaacccugcucccagagggugccguguggcugcuuggugugccguacauuccccaaaagagugaaugaugcaugaacgaaugaaaggcaagagugaaugaugcaugaacaaaugaaugaaaggcaagagugaaugaugcaugaacaaaugaaugaaaggcaagagugaaugaugcaugaacaaaugaaugaaaggcaagagugaaugaugcaugaacaaaugaaugaaaggcaagagugaaugaugcaugaacacaugaaugaaaggcaagagugaaugaugcaugaacaaaugaaugaaaggcaagagugaaugauccaugagcaaaugaaugaaaggcaagcgugaaugauccaugaacaaaugaaugaaaggcaagagugaaugauguaugaacaaaugaaugaaaggcaagagugagugaugcaugaacaaaugaaugaaaggcagggccgcucuucagagacauccccucggauuaggcgugcgggcuugccuggaaguugggcaguacaaugagguguaacccuaaaacucugagcuaucuagacucccaagagagacacugaauuggaugguucgggauuucaucuuugccacagcuucacuucuugguuacuuaggagaaaaccguguuagguuuucagcuuaacauuucaggguacucagugucagccacgucgugucccugcguggucagccuggaccuagaagcucuuacucgcccaguguaaccgccagggaccuuuuuacucaacacuuccuucugauuugcucuuuugacauauccuuuacuguuuuuuaaacuucauuugcuuugugaaauuguggaagaggcuugugaagcugaguguucagguuuguuuggcucuguacugucugguucccaggcuuuuagagguguguuuuagagguguuuuuaggccgugcugagugguuguauuauuuauauauugcuguguggcagauuaccccagaaccccugccuuaaaccaacaguccgaugauaacuuacuguuucuguggguugggagaccaggugggcucuggcucagggaccucccaucugggguugugucuccucugaaggcuggacuggggaggguccgcagccaggcugugucacgugacugugggcuggagaccucaguuccuuucucuauagggcagcuccgagggagcccaugccuagccagagagggacaggaaggacgucccaguguuuguggagugacauucuaccacuuuugccaagagucauucggccccuacacacuugaggggaggggacuccaaaacggugagcauacgaugggcagguggggucacuggaacacuuaaagccugcccagcacagcggugcugugagccuggcaccucucagggcacuggagagacaucccguaaguaaaucagcgauugcguguggagugacguguuaagaugaggaugugacuguucagcugucucuuuaauugguguggguuucuccgaugucaccgucaugauugagauauuugugauacguaaaagaagauaaauuacagauagaaaagauucuuaggaauuaacuugcaauuuggcauaccaguagcaagccaaaagacccccccacaaauuaaauuacaaggugugugucacugaugucaaauccuucccaacagcuucaagugcaaggauuuuugcuguucccagaguccccucauuuucuuccugccagugauuuugcuccagaaauuaucaaccgacuucuguuaaguuuuccuaaaccauuuuaaauauaugggggaaauguuuuuaccaguuacaguagaccuugcgcuugcaguuauuugugacuucauaaaaaugccguaggagacgugagaccuugaccacacuggacauuugaccggugugaggacuuagcuccaggguccaggcacuacugugagccagagccucugcuccuagcccacacccuccacugcacagggagccggaccccaugccuccuuccgguucugggcuggagcuagggccgggaagggggccuguucuggacucuggagaccucagccgccccucccaccaugccgcacucucuagacuacagcggcucuguggcaaaaucgaggagcugcagggugcggcaggggcccuuugccgugggcuagaauucuuuacuuggguuuuuuuauuuggauuauaaagugagucuuguuuugguguaugcuguuacucuuuauuaaauggcaggauuuauuuuguuugcagccuuauuuuugguuaaugguuagaauugaaguugaaaauguaauuuuucuuuuuuuuuucuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcacccggccgaaaauguaauuuuucuacagaauuaggcaggcguguguaauuuuucaacaaaaauuagccaggcaugguggugggcaccuguaaucccagcuacuugggaggcugaggcaggagaauugcuugaacccgggaagcggaguuugcagugaucugagauugcacuccagacugggcgaagagugagacucugucugaaaaaaaaauaaaaaguaaaaaaaaaaagaaaagaaaauguaauuuuucuuuuaccauugaaauauagugagguuuagggacaguuuccuauuguuuaucuauuuuuuauuaugauacuugcuguuaauauagcaaaaauaugguacaauucauugugcuucaaaaauugaaauuauuuuuaauuucauacauugauaguuuaucacugaauuuuaaaaaugugaggccuuaagaaaaacaaaacaaaacuaucuuuccagaucugccacguuucucccgacagaacugaauuaugcaaaugccaaaaugacaaagaacaauagugaauguugccuaggugcauuuuuguagaauuauccacugaguuaagcaaaacucccauugacaggaacucacacucuagaaaauauaguccuucaaccuauuguuauauugacuugcuuuuuuuuaagauaaacucuaauauucguguuuguuuguuuguuuuuguuuuuuguuuguuuguuuguuuugagauggaguuuugcucuuguagcccaggcuggagugcaguggcgcgaucucggcucacugcaaccuccgccuccugguucaagugauucuccugccucagcucccuaaguagcugggauuacaggcgccugccaccaugcccggcuaaguuuuuguauuuuuaguagagaugggguuuugccauguuggccaggcuggucucaaacuccugaccucaugacccgcccgccuuggccucccaaagugcugggauuacaggcgugagccaccgcgcccggccaauaaacucuaauauuuaggugcauuuagagaguggauuuguuggcuugguuucuuuuuucuuuuuuucaaauucauugauauuugcugggcuuugcuacauuaacagcaaauuccagauguuuaaugagaaauagaugcaaagaggggaaaucugucugcagacuuccuugaaacucccucuaaucagugggucccguuggccuugugggucuuaugggggcugugagccucgugggagcugugggccucaugggggcuguauggccuuguugggggccuguggggccugugggcccuguggggggcuguguaccuccugggggcuguggccaaguggguccuauguucuucguggguccuguguggucuggugggggcuguggccucgugggagcuguggcuuugugaguccuguguggcgucaugggggcuguggccuuguggguccuguguggccuggugggggcuguggccuuguggguccuguguggccuggugggggcuguggcuucauggguccuguguggucuggugggggcuguggccucaugggggcuguagccuuguggguccuguguggccuggugggggcuguggcuuuguggguccugugugucucaugggagccguggccuuguggguccuguguggccuugugggggcuguggccucgugggggcuguggccucaugggucuugugugccuugugggggcuauggccucauggguccuguguggccuggugggggcuguggccuuguggguccuguguggccucauggguccuguguggccucgucagggcuguggccucauggauccuguguggccucguggggggcuaugacuuugugccugugucuccugucugggucuugugagcugucacauuuccagguucuugaucagggcguggcccguauuagaugcucaauaaacaguaaccggaagcugauccucauggaugcuguguggagcuguucugaggcggcaugaguaugaacuuguuggauuccugaugccgcccaggaaucagaccguaaaagcugugcuuauuucgcagugugagccuggcacagcagagggcgcacagggcaggcaucauuggaaugugggggccacgagggcucaccuuaaaauuuuuuaaauguuaagugauuuuaauuuacuuuuuuacccaaguuuuuguuaagaaaaaaaaucgcaauacagaaaaauggagaaaauuauacagugagcacuugcugugguccgaacgucugugucccccagaauccaugggggacccuaacccccaaggugucagugucaggcguggggcccucggaaggcucugcccugaugacaggaccagcgcccuuucugucauuugaggacacgagagaaggcacugccugugaggacucugaccccaccagcccccaaaucugcgagcgccuugauucuggacucccagccugcagaacugagaggugcguucugugguuugucagcugcucggccuaaggugcuucggucgcagccgccugaacagaccaggacggcacccucuacugcccagacccacucguggccguucggccgcauuugcuuccucuccuucucucaguacauccuggacucaccugugagcggcuccggacaggagccuugcugggaaggugagucccaccugagagcaagaacuaggggaggcccccacaccgcuacaaccccacugugacccuaggacgguggcaccuacuucacggcguuaccugauuuucaggccgccuuaccucuucccagcugucuugagaaugucuccauguuuuccugaaccagagucagccagggccuguccuugcccuggagguccuggcccuucugaccaugccaggugagacccccuggcguuggaggucuugucucccuguccguggaccgggcucgcauccuucccaccccacugccuucugccaggccagcggagacauaggcccugacguccucuucagucucagcuggagaaagcugcccuggagggacucuucucacuaggucacgcaaaccugggcacucccgauuuugagguagcuuauuugggaccuuaauuacagcuucaaaagucccuuuacagcaguccaugggucaguaugucaguaacagaacugggcgucgguucugggacccuguagacacugagggugagaacugggugucggugcugggacgcuguagacgcugugagugugagaacugggugucggugcugggacccuguagacacugagugugagaacugggcgucggugcugggacccuguagacacugagugugagaacugggcgucggugcugggacccuguagacucugugagugugagaacugggugucggugcugggacccuguagacacugagugugagaacugggcgucggugcugggacccuguagacacugcgagugugagaacuggguguuggugcugggacccuguagacacugagugugagaacugggugucggugcugggacccuguagacacucaaugugagaacugggagucggugcugggacccuguagacacugagugugagaacugggcgucggugcugggaccuuguagacacugugagugugagaaccgggcaucggugcugggacccuguagacacugagugugagcacugggcgucggugcugggacccuguagacacugugagugugagaacugggcgucugugcugggacccuauagacacugagugggagaacugggcgucggugcugggacccuguagacacugagugugagaacugggugucggugcugggacccuguggacacugugagugugagaacugggugucggugcugggacccuguagacacuuagugugagaacugggcgugggugcugggacccucuagacacugugagugugagaacugggcgucggugcugggacccuguagacacugagugugagaacugggugucggugcugggacccuguggacacugugagugugagaacugggugucggugcugggacccuguagacacuuagugugagaacugggcgugggugcugggacccucuagacacugugagugugagaacugggugucggugcugggacccuguggacacugagggugagaacugggcgucggugcugggacccuguagacacugagggugagaacugggcgucggugcugggacccugaagacacugagugugagaacugggcgucggugcugggacccuguagacacugagugugagaacugggcgucggugcuggaacccuguagacacugugagugugagaaccgggcaucggugcugggacccuguagacacugagggugagaacugggugucagugcugggacccuguagacacugagugugagaacugggcgucggugcuggaacccuguagacacuuagugugagaacugggcgugggugcugggacccucuagacacugugagugugagaacugggcgucggugcugggacccuguagacacugagugugagaacugggcgucggugcugggacccuguggacacugcgagugugagaacugggcgucggugcugggacccuguggacacugugagugugagaacugggcgucggugcugggacccuguagacacugagugugagaacugggcgucggugcugggacccuguggacacugcgagugugagaacugggugucggugcugggacccuguggacacugcgagugugagaacugggugucggugcugggacccuguggacacugcgagugugagaacugggcgucggugcugggacccuguagacacugagugugagaacugggugucggugcugggacccuguagacacugagugugagaacugggugucggugcugggacccuguagacacugugugagaacugggcgucggugcugggacccugaagacacugagugugagaacugggcgucggugcugggacccuguagauacugugagugugagaacugggcgucggugcugggacccuguagauacugugagugugagaacugggcgucggugcugggacccucuagacacugugagugugagaacugggcgucggugcugggccccuguggacacugcgagugugagaacugggcgugggugcugggacccuguagacacugugagugugagaacugggcgucggugcugggacccuguagacacugagggugagaacugggcgucugugcugggacccuguagacacugagggugagaacugggcgucggugcugggacccuguagacacugagugugagaacugagcgucggugcugggacccuguagacacugaaugugagaacugagcgucggugcugggacccuguagacacugaaugugagaacugggcgucggugcugggacccuguagacacugagugugagaacugagcgucggugcugggacccuguagacacugaaugugagaacugagcgucggugcugggacccuguagacacugaaugugagaacugggcgucggugcugggacccuguagacacugagugugagaacugggugucagugcugggacccuguggacacugugagugugugcuuacuuuuuuuuucagucuugcuuugucacucagacuggagugcaguggcagggucucggcucacuguaaccuccacuuccugaguucaagggauucucccgucucagccuccugaguagcugggacugcaggugcuucccaccacacccagcuaauuuuuguauuuauauuagcgacgggguuucacuguauuggccaagcugcucucaagccccugaccucgugaucugcccaccuuggccuugcaaagugcugggauuacaagugugagccaccgcgcccggcugugugugcuuacuuucaaacaagguagucucugcagcauacugagaugacauugagaagaggcuugauaaggugcaggagggcguguucugggcacagggcgcccugagcgagagggccgagaauguccugcggugauugaggaguccacgcggcaggggcagagggagaggcaaaggcagagggaggugugggcuguuggcagggccagggccugaccucgauggcccugaggagccucugcguccacucaggcuuguguguucgggaaucccgugggugcugcguugaggucaguggggccugguguggcagaggcgagggugcugugugggugccgcguguccuucaaggcacagcagauugguuucuaggggggcccagugugagggaggcgcagguggcucagaggugucuggggcucccuggggugcaaggcugucagaggaggucagggcagggaaguccugauggacgugccggccgcccacugacgugcagccgucagacgucuggaugggaguucaaagcaggguugggccagaggugccuggagaggaaacguggagucggggggucugugggguagccccgggggcggcgcugggggccggacugcugaagcgcccccgagcucccuggguauaaccugccugggccuccuggacagcugcaggccugcggggccuggguugagggggaugucacugagcuacacucugaggcugguagugacucucaucuggggucccaccuuagugaauguaccuuaggucuuuguaugaacgcaaauauuuguauaaacacuuaauuuaaaaaaugagagcugaugugcgccuguaaucccagcuacugagaaaugucagcccagcagugaggccuguccagucucagcccuguccgugugagugcugugcucuguguguggcccccacagugccacgguccacggagguggggucggcuggcucuggcugggaguugggggcccaguugcucuaaugcaggcaacacccugaguggggcugggagucaaggaccaggcugggggcucgaugucacaggugugggcaggagcccauggcccucugagagcuuuguggccacgguaggggcugggccaugggggaggcaacuuuacugccuggggucaguuccugccuggccagagauggagcagggaugcuuacugucuuucgagucauggacccuuuugagaauuaaauucaaagcgcugucauguuguagcauuguuuuucauuuucuuuuuuuucuuuuuucuuuuuuuaauuuuuugaguuagagucuugugcugucacccagacuggaguguaauggcacuaucuuggcucauugcaaccucugcuauacagguucaagcauuucuccugccucaggcuccugaguagcugggacuacaggcacgugccaccaugcccggcuauuuuuuguauuuuuaguagagacgguguuucaccauguuggucaggcuggugucgaacuccugaccuugugaucugccugccugggccucccagagugcugggauuacaggugugagccaccucacccggcuguuuuucauuuucuuaaaaaaacuuuuagggugacauagcugugcagagaaccauguaaaguuccguuuuccuccuaaccuggucgucuccagcgggaaggaacagagagugcuuggugugguucuguguguccgcacgagguugaugagaacccucggugccuggacugucuucucaccaggcgcagcucaggaacaugguggugccggagagugguuugugucuguuccucccuggcugcugugagccgcccccccagguccuguguccuccgcgcggguuggcgagggagcugugugugucuguggugcagcugcaaugcggggucccgucagggaacaggagcgaggcguuuacgccauaaggagguggagaagggauggugugugaguuuggcaggugcugagggcuacaguggagcuggaggggcaggacggugcagggcggugcaggcaggguguuuggggucaggccagcuguggaaaggccacaggugaaccaggugcggagacaaagagcuggaggcauccgguggucuggcugggccucauccguguccugccgcugcugcagugaugccaggggcauggaagggacccuagcccagcuccucccuuggcagucggagcgucggggccgcauuauagagggagggacucuccggacgaugggaacgagaguccauugggaucguagcuguggugcgguucacagcguugugaacagcuaauguugggcugggggcaucuguggggccaguugcagcaguuuggucauuuuugugugaaaauaaaugaaaacagguuuugcagagcccguuggugaaggcaggggugccucuggcaucgacuggauggccuuucccuccugagugacagcccuggacgugcugucgccucaugaggacgccgauguggcccugcugccggaguaugccaagcacgaggggccagguggcacacagcaccugugugccgcuggggagggugaccgcgggaggagcgcccgugcaucgcugcagagggugacugcgggaggagugcccgcccaugcaucgcuggggagggugacugcgggaggagcgccugugcaucgcuguggagggugacugugcaggaggacagagugccacaagggagagcagcagagugguuucagcuccgggagguggggcugcccguccagagaggugcagggucucuugucagguggacaggggcuggcccacccgugaguggguagggccuccugccagggagccuugugcauggcugggaggacggcaaggcugauguggacgcagccccgacgugaacaggaccccacguggacgggcagugacgugcguguggacccgggguggacgggcggugacgugcguguggacccgggguggacgggcggugacgugcguguggacccgggguggacgggcggugacgugcguguggacccggcguggacgggcggugacgugcguguggacccggcguggacgcagccccgacgugaauggaugugguuccgacgugacugcgcuggcaugggaagcagagggugaggcucggcucugcugucaggaggacaugucagacuucugucucuaagauacugcucagacuuguguggagggugaauuagugcgagggcggcuuggagaagccuguccugggcggguuucaccacuuggacgggagcucuggcaugguccagggaguggccgaggacagcaaggaggagaugaccccaugggcaagcaggagcucagaugggaggcauggagcagacgggacuccacguggcaccaccccucccaccugggcugggcacccaugaggcugaggacccuggggagggaacgcugcuugucgggcgguggugacgauuucauggauguuugugaaaccaaccucacugccccauuacaacagugcgggcccugauucucaugguuccccagugaggcuguuccacgguggcacaggacacgccugcagcuuugugccugugaaucucaggagcuguuuucuggaaaguuccauaacucagcaaaacugacucacaaacaacagaaacuucaaggcuguccuaagauauggguggcagaagaaaaugugccccaggcaugggcuugugaugccggcucuuccuccuggcagagcuccccagaggaaggcugggcugggcagucagccagacgggaaagggggcugaggcguccaggcugcagagggugccgggguggagagcggaagagagagggagucggugccuuaggaggcugcgggcgaggcgagggcagagugcacucgcugggggucacccugccccccaggacuccuuucacaggacagagaagcuccuggugagcggggcugcugaacgcaggccccagggccuguaggacccuuagggagacggguggcucugcguguggguguggagagaggccugugggagacggauggaugggugucucuguguaugggcauggggaggggccugugggagguggauggguuggguggcucuguguaugggcauggggaggggccugugggagguggguggaugggugucucugcauguggguguggaaagaggccugugggagacugguggauggguggcucugcgugugggcguggagagaggccugugggagguggguggacaugugucgcugcauguggguguggggagaggccugugggagguggauggguuggguggcucugugugugggcguggagaggcccguggcagcuccuucguugcagaaaccgcaucggagcacaucgcguagugcaggacacacggggcgugggacggugucugugugagagcagcaucuguguguaugcaguguuaucuaaggacacacccacagacacggacacguccuuacgcagagaacagccgcugccucuuaguguucaggaugauacguuuuuccuuaauaucauccuucgcuuugcacaucauacugaauacguguguaugugacuuuuacugcaaaacaaaacaaaaagcagaagcuacuguguuauccagacggcugugugcugcaggcgcgacucagaacagcagcuccucccagcaucccgcagcuaaaugacaggagcuggaggcugccccaggcagcggcguggcuggcgugcggaguguuuugggggugucugagcuggguggagaggaaggcauaugucacacugaggcaucagagacacauccauucacgucggggcuguguccgcgccggguccacacucagucaucgcccguccgcgccggguccacacucagucaucgcccguccgcgccggguccacacucgcgucaucgcccguccgcgccggguccacacucagucaucgccguccgcgccggguccacacucgcgucaucaccugucugcgcuggguccacacucgcgucaucaccugucugcgcuggguccacacucgcgucaucgcccacccacgccggguccacacucgcgacaucgccauccacgccggguccacacucgcgucaucgccauccacgccggguccacacucgcgacaucgccauccacgccggguccacacucgcgacaucgccauccacgccggguccacacucgcgucaucgccauccacgccggguccacacucgcgucaucgccauccacgccggguccacacucgcgacaucgcccgcccgcgccggguccacacucagucaucgcccguccgugccggguccacauucgcgucaucgccauccacgccggguccacacucacgucaucgccauccacgccggguccacacucgcgucaucgcccacccgcgccggguccacacucgcgucaucgccguccgugccggguccacacucagucaucgccguccgcgccggguccacacucggucaucgccauccgcgcggggaugugucugaaaaguguggugagagcuguguucccugcgcauuucugaaggcuccuagccgcugcaguugccgggagccauggagccacgugaccuugagguccaccggggagaggagggugcauuucggaggcuagaaguggcaccuggaggggcuggcccugggugugaucauugagaggagggagguggaaaaagaucuggaagaugcccuugggaagcagaagaaggugggugaccagaguggggugcccagaggguagggcagggcagaccagaggagggggugggcuuggcacccccgggaaggagggauggggcucugugaaagugagagcuguguggacguggagcuugugagucugaccaggaaagacagaggguuccagacggugcgggggccccuucagucugguuguguggggcaggguccucacccccaggugagggggccuuguagggcagauuccuggaagacccucaagacgcaggagcggaggcugcuggcuggauggggauggagccgagagcugagcgggcagcccaggccugaaggacagcacaggggccucugugaggccaggaggggcuggagugcaacacccccugugacccaggucuggugugugacgcgucaggccccacggcaccgcaggcuggcuggcuccccagaaggccuguggucuccauggccgcagcgcauuccggggacagggcagaguggagucagcagagggaggaggcguguggggcguccagggaucaaggggucucugggccuugcucccuuccccagcagcugugaggauggugggggcugcugucugcccaggacugcaagcgucaggcacagcagcugcuguuaacagucaaggaauguucgggucaguuugagaacuucagggcccaauggcagagccccggcagaaagacucagggcagauggugguugucagccgggagggggcacggagcccuggggguggucaggcccacguggccuugggacgagagcgaagaggugggaucggcugcgggagacagggaagugggugacaaggaggcucaggggcuacagcaaaggccccggaggcuuuuccacacccgaguccguccucggccaugccagccaggucaggggcucaguccugugggccaccacagccggccgcacaggcagggaaggugaagcuccacggagcacccugguggacagcggugcugugggggccauggaccagaaggcggagcccaugcugugggcugggugggguggcagcugccaguucaaagucugucuuuuguuuauuuacuucauaaaauacuccagguguuuuguuagaaauuauucuuggccgggcacgguggcucacaucuguaaucccagcacuuugggaggccuaggugggcagauccugaggucaggagucgagaccagccuggccaacguggugaaacccccgucucuacuaaaaauacaaaaaauuagcuggguacucaggaggcugaggcaggagaauggugugaacccgggaggcggagcuugcagugagccgagaucacgccacugcacuccagccugggcgacagagcgagauuccgucucacacacacacacaaaaaauuaguugggugugguggugcacgccuguagucccagcuacaugggaggcugagacagaauugcuugaauccaggaggcagaaguugcagugagcugagaucacaccacugcacuccagccuggugacagagcaagacuuuuucucaaaaaaaaaaaagcaaagaaaagaaauuacugucuuaguguugauaaaucugccuuuauacauaccaauaguugugcacacugagagaaguaggcaguuuuggaucugaaacuggccuggugacaccgcgggugcagcaggcgggcagaugcgggcacaggagggagcuucccacacuguucaggucaccagagccugcgcuucugugguugguuuugaugaggacucguauuucagcuccugucucuccuugucagaggccgugugaggugcguauugcggaccgccggccgcgcugugagggguguacauguggagccgugacaaucgugggaaguucuguuuccagcuuuaagcuuucguuuauauuucugcauauuaagaaaugauaaauuaagaccuaaugagaaguuguggacuagacgugggguguguaggcugcugggaggaggggcagcggcccugagggguuguggggcccaugggaccaucugacccagugcauggcggagccguguccacgugaggagggaguaggaacgggcucugcgcuguggcuccgugggcugccgagggcugcugugggcucugcgcuguggcuccgugggcugccgaaggcugcugugggcucugcgcuguggcugugugggcugccgagggcugcugugggcucugcgcuguggcugugugggcugccgagggcugcugugggcucugcgcuguggcugugugggcugccgagggcugcugugggcucugugcuguggcugugugggcugcagagggcugcuguggguucugcucuuauuugcccaggggaaacccgagucgcugccccuccuguccagccucagcgcucguccccgggucccccagcaggugaccacagaugaugacggagccuccuggaaccgccucaguuuccccagcuggccccucacuggccuccccauuucaggagccccagggccacucuccgccaggcucucugugucuccgauuaacccucaggucgucccagccucuuccgagccaugguuaggaucggccccguccaccguguguccauggaagugaaacaggccaccagcagugggcagccgcgggcgggaugggcuguggggcagaggcuggcgggcaggaauggucucgugggugcgcaccuggccuguguggcgcugcggccguggcuucugcaugccagggucagcagccaucuugucggguuuuuaaugugcauuucccaguucacugauacaguugagcauuuaaaacaugcuuguuugaaauuucucuuuugugaagcucucuguuggcuagaguggggcuggcaaacccugugagggagcagauggugaauaucgugcggccccaggccucccuccaacgagcagcgcugugugcugggagcaggcccugcgggggccagcaaacccgcucacacagcccacggggcacagccgggccacgauggccaggcccuggucuagguuguggcccuggaggcacugccgaaauuucccucaggccuuggcuuuuuuucuccauggugcuuuugaauaacucagggugcuuaucuuugacuuugucauuuccuucauggucaguuuuguuuucugucucguaaaucuucuccucauccacgaucaugacgauacccuccuuagcaaccuccaaagguucacggucgccuuuuccauuguccucacccacccggcccugguuauuuuuggggugggauggugcaauacaagcugacaguuuggcuuuuuuuuuucuaauuucaccacaggaaugauguuuaugguguauguuuuuaauucuaagauacacacuaaaauucaccaguuuuauugugcaguuuggggacuuuucacccccuguccaguuucauggacuugccggcagugcuggcccagagcucgguccccgcaggccucccucaggucccucuguggccagucccugccuugccuggacugugugugccuguguccucccaccagacuugccguuguucuggaauugaguggcgugugggaacgugugugcgcuccugcgucugccccucuccccugugggaucgugggcaccugcguugcucacucucacugccgagccgcaucugcguggggagggguuacgcuguguuuaucauccgccuucugauggacuaacuaggugguuguuuccaguuuggggcuguuaggaaaagggcugcuuugaacauuguuguauaagacuuugagaggauguguguguuagcgagcgucuuuuuuuuuuuuuuuuuuuuuuuuugagauggaguuucagucuuauuccccaggcuggagugcaaggcgcgaucucggcucacugcaaccuccgccucccggguucaggcgauucuccugccucagccucucgaacagcugggaguacaggcaccugccauuacaccuggcuaauuuuuuguauuuuuaguagagacagagcuucaccauguuagccaggauggucuccaucuccugaccucaugaucugccagccucggccucucaaagugcugggauuacaagcaugagccacuaugcuuggcugaguuuuguuuuuuuuaaaucaugaauggacaauuauuuugucaaaugauuuuuaugcaccugcugggaagaucaugugauuuuucuccuuguaucuuuugucauaaauuguaucuuuuucccauaggcauuaagcccacguuguuuucuaggacucugaguuugucaagaaugauuaucuuuuuguauauugcuuaaaaaggaugacuaaccguuuucuuuggauuuucaccucuguguuuccuggugagguuaacguugaguucuuuccgucugccauggucagugccugguuuugucaggcucauagugugaguuggaaaaaggcuccuuuuaguucucugagaagaguaugagacugaauuauuugugcccugagcgucuggugaaaccaccugcaucccuccggggccugaugcugucuuggaagggacuuucugaccauugaccuggcucccuguagguucuggaacuuccuggguuuucucugcuagucucaaugcuggugaauuacuguucuaggaacuuagcaguuucacguaaacuuuccauuuuauuagggucaaguucaucauaucuuguccgugcucggacgucaccugcuuuaggugcacccgguuuaauagugcacggccagcucccccgaauccauggguccagucaacacagauugaaaauguuugggaaccaaaacaauaacaaauaacaguacaacaauaacaauaaugcacaucuuaaaaauacaguagaacaaccauugacauaguguuuacagcauguuaagugucguaaguaaucuggggauggcguagagugcgugggggguggcgugcacagcguguuaagugucguaaguaaucuggggauggcguagagugcgugggggguggcgugcacagcguguuaagugucguaaguaaucuggggauggcguagagcgcguuggggggcagcgugcauagcuucugugcagacucgacaccacuucauguccgggacuugagcaccuguggauuuugguaucagcggcguccuggaacuagucccccacggauaccaagggauggcugugugucaccuucuaacauaguaaauaauugaccuguuuguuaguuauugucugucuuccuucauuagaaugcuggcuccaaggucugugucuguguuuucacugaagucugagaacuccugucaggagccgccagcuguaccagccaacacaggagccacuggccacaguuuaacuaaaauuaaauacaauuaaaaauucguucgguuggccgggugugguggcucacgccuguauucccagcacucugggaggccgaggugggugaaucacuggaggccaggaguucgagaccagccugggcaacauggugaaaccccaucucuacuaaaaauauaaaaguuaacugggcgugguggcggacgucuauaaucccagcuacucgugaggcugaggcacaagaauugcuugaaucuggaaaguggagguuacagugagccgagauugcaccacugcacuccggccugggugacagagcgagacuccaucucaaaaaaaaaaaaaaaaaaaaaaaaaaaaaacugggcugggcacgguggcucacaccuguaaucucagcacuuugggaggcugaggcgggaggaucacuugaccccaguaguucacggccagccuggauaacagacugagacccugucucuacuaaaaauacaaaaauuagccaggugugguggugcaugcuuguaauccaagcuacucaggaggcugaagugggaggauugcucaagcccaggaggucaaggcuguagugagccaagaucgugccacugcacugcagccuggguggcagagcaagauccugucucaaaaaaaaaaaaagaaauaauaauaauuauaaugagauccuucagucccacaagccacaguucaggugcuccacgccauguguggucagcagcugugcuguuggguaguggagauguggaagcccccaguguugcagaauauuccggaagccuggcuuugagccuggcuucauucucuucaucuuguuucucuucucccuaacucaagugccucagacaugccugcugaucuccccuuauauuugccugggaagacuaacucuacucuuucccuucuuccucccuuuuuauguaaaaguuaacugagcuucaaagauuaguuaauaaaaagugcaguuaugggaaaccggaagaguagaaaugauacaaacgggguagaaaaugaagagcaugaaaguauuuaaucucugucacuaagccacagacacuguacgucaucccaggcccccacuuuccccagucugacuccagccaccuguuuccccaacucacacaggaacgugugggaggccaccgagguucccggggaagcacucccagcauggcagccacccugaugccccaucccagacgcagggucccuacgugguccccuggucccggguggggacugugucccuccccugccccucccucccugucugaggccccaggugcccucccuguccucauccccacugagcccaacaccaggcucagugcccacgccggggcccuuggugcacgucugguaggcgcaggcaggucugugacugggagagaacauggugcccugugcacagcagcagaauugcgggcaucucuuggcugcgucguggagccagccgucacugccuugccucugaggucuugcauuugcccagaucaccccugaaauucaccccuccucuggggggcuccacagacucacauccugccuucuugggcccaaaacagcaugauggggcccccagcugcccccccacccccgugggccacgugcccacuccugcugucuccgaugccuugggccugggcucagagacgcccgacaggcaccgagaccagcccgugucucccggguagagccuguucuucacggucccugugaagaacuuuugguuauuuuaagcaaggaacagagcaguguaaccgagccaggcuuggcaccgcggguggggugggggucguccgccuccggcccacggguaacccuguugugcuuuuucuccgcaggcgucacaauguagcagggaccccaggcgucgugcucagguaagugcgcguaggccgacugcccucuucuuuccgcaccugugaacugccggacuccgccgggaccacgcuuugugcauguggucggcguuccuugcagugccucugaaacgcaggcucugaggacaggcuggagccaugcguggguccuuagcuuuucucccggucaguacuucugauugaccccauuccgcccuuugcucgguagggcuugguugcaaguuccaguaggaauggcggaguuguggcagucacacauccaugacgcgaagugaacuaacaggugccguuucugugcuagaaaauggaaaaagagccagggccggaaggagggugcagaagcgaguccgcgugcggagccaggaggcagcgucgcgugggagugcuggccugaagccuccaugccccggcagagggacggacacgcggacgucuagcggaggugaggcccacgccccccgaccccggggguccugcugacuccuugcccugcccuguugcugguuguggcgagggccggcgaucauuaggagccagcuggucaggacacgaugcaguguucacgguucacugccgaguuuuccuggccccuccugugagaguccaagguccagccagcugugggggucccaggccucgauggcagugcggggugcagagggcuggucuccuuccgucacugguucacuuggguucccggcgugucgcugaggagcagugcugcuugggggccgagccuggggccucagcccagugaguugugaggcggucggcuagcauccugcagggagguccucaggggcgcagggcagggcuaucucuccccucccgggugcucuguccccucgugggugggcguggcccucagggguguagggcggggcucccccucccgucgugggugggcgugguccucgggcauagggcggggcuccccuccccucgugggugggcgugguccucaggggcguagggcggggcucccccgccccucgugggugggcgugguccucaggggcguagggcggggcucccccuccccucgugggugggcgugguccucaggggcguagggcggggcuccccuccccucgugggugggcgugguccucaggggcguagggcggggcuccccuccccucgugggugggcgugguccucaggggcguagggcggggcuccccuccccucgugggugggcgugguccucaggggcguagggcggggcucccccuccccucgugggugggcgugguccucaggggcguagggcggggcucccccuccccucgugggugggcgugguccucaggggcguagggcggggcuccccuccccucgugggugggcgugguccucaggggcguagggcggggcucuccuccccucgugggugggcgugguccucaggggcguagggcggggcuccccuccccucgugggugggcgugguccucaggggcguagggcggggcuccccuccccucgugagugggcgugguccucagguugguaaggcggggcuccccuccccucgugggugggcgugguccuuaggggcguaggguggggcucccccuccccucccgagugggcguggucgucagggcgcgggguggggcucccccucaccucccuucccucccuacccuccccuccccuucccuccuccccucccuucccuuccccuccccucccuucuccuuccccucccucucccuuccugggcaggcucccguguccucaguaugcaucaggucucccgaaccucacagccccgcagggaggaggagaaggggaggauuugacuuuggaagucucugugaccaggugaggaccgcaagcguaaaggugguggcagaguggucggggacaggccucacccacaaacauguggccccuggaugagcccagcucucagcugcuucgugggacugcagcuggacgcccaggcccgcgccugcagcaggcgauguggggcucagcagagagcuccaggcugggccucuugguggcggugaugacggaaguggugucacgcaugcagcaguuugggucgcggcuuuccguccccacugagggaaacucgugccugcugcuccccuggugaaagguguggggagcgaagucccaguaguggggugcaccuggccacccugaguccccaccagccuccgcacgcggagcggcccugcucucuugccucaagcacagaagcaaaucaccaggcucugccugccgucgugcggugacaucgggggucaccuccccgaaggcgcaggucuggugggcgagcagagcggcugcggcagcugucaaggcagggccucugccagccacuguggccuggcauugugcccacccugugaggguaggguggggccccugccgcgugcugccuccgccccugccccgugcugccuccgccccugccccgugcugccucaggcucugggagacacagccucaggagacaccguggaagccgcgccggccccacaagugaauggggaggaaggggugugagcauacagcccagacucuaaacugggcccaagggucgcgcugugagccgcagaggguccaggugcccagagccugcccauccucaucccacccggcagcucugccuucgcgggcuccuccugcuccuuccgcuuucacagaagacagacagcucggggauccugccucucugcagcuuuauggacccuccucaguccucacugcaggaggagaggaggggguguugggcacagagagaagccagugcgggggagccgggggcuuuugaaaaggugggcuugucccagugcacgcagacacuggauugcugaccgugcccugcacaugggagccugggaccccgugagcccaagaggcuccugccacccaggccucagggccugcacuguccucccugggggcggcugucagagcucagccaaggaugaaaggcauggaagaguuucagguguuaauuaaucgcguuuucucuuguagaagccaaagauguugaccaggaagaucaagcugugggacaucaacgcccacaucaccugccgccugugcagcggguaccucaucgacgccaccacggugaccgagugucugcacaccuguacgugcccugcccgcgccacccagggagggcgcgcccuucccagcucugugcucuucagaaccuuggcuuuuguguuaccacacgcuuuuagcucaagcccgacaaaagcaggaaccaggaccaggggcagagacgaucuugaagauaagucagaaaagucauuucacgcuaaagguccuguggguggugucagagcagaugaggccucgcuuaggagagcgaaacacaggagagaccccacauuccucccacggagcagcaaggccaguagccgcugugacagugcucacugcuggcaguuuccaaaucuccagaggaguuccuuagauccuucaaaggggaaccuuccaguguguucuucacaccugaugugcguccucacaccugaugagucugugcuuugguguuagaggacucacaccuggggcuggaccugaguguuuuucuaaguguggcuaccgcugacgggcaggugccauccaucaggcugaggcucggcucuuaugcuaaccugaggccccauggcuggcggcccugcugguguggacgaccgcugugugcgucucuugauggcuggggagcauuuuguuuaaacaggaucuuuaaaaugaaguguacgcuuauaauacaagugaugcuuguguauuucucacuuuaggaaauaaaauauuugccaauuugauagaauuuugacuuuaacguuaaucguauuuuuagauauugguuagcauauuuuauguuagguuauuuucauuugauuuuaucuaguuguacguagaagauacugucaucuuuuaggacaaaguauuguaaaauuaucuguuuuagcccauguucugaugacccacagcucugucaccuuugagcaucaucuccccauucuaaguuuuuuucccacuuaauuccuaacccugccucuuugaggaagcccauugacggggcaauuaaaaccuucucauugcuccugagaccagaacggcaagauguuuccuuucagaagcugagagccacaaggaggacagcagugagcaucugcacagaaacgagcucagagacgcccguguucaguggagcacgccgauggggugggcgcccuggcucuagacgcucuccuaacacaccugugcuuugaugacagucugcaggagcugccuggugaaguaccuggaggagaacaacaccugccccaccugcaggauugugauccaccagagccacccccugcaguacaucgggugagugugggccuucccaggccacaguacguggggugagugccccugggcgucucugugugugggccuucccaggccauuagcgcuguacucccauccugccuuggcagcagccucuccugaccaagggcaccccaggagcugcacacgaagaaccuggguccagcgcucaccaggccauccugccaggccugcccaggcugugccugcacauacauuuccaucaauacuuagguaggccgggcgcaggggcucaugccuauaaucccagcacuuugggaggccgacacaggcagaucaccugaggucaggaguuugagaccagccugaccaacguggagaaaccccaucucuacuaaaaguacaaaauuagcuggguaugguggugcaugccuauaaucccaucuacucaggaggcugaggcaggagaaucacuugaacccaggaggccgagguugcaguaagcggagauugcgccguugcacuccagccuggcgacagagcgagacucugucucaaagagaaagaaaaaauacuuagucaaguuaaauuguuggagagcccucaagaccaaguugaaucucaugaguuuuacgcagaauuugcugaaguuaaauuugaugugagccggcccuuggauaccccuuucaccuuucugccauggagcagaugguccuggggcccuggcccugcugccccugacacauggccaaggucuuucucccugcgcugugcucuucugcccagggucacagcgagccuggacucaccccugggccagccaccauuucuggagaaggcaacucuugccuggacgucagcaggaggccaaggggccagccagguggagcgugugguucucacacagauuugggaggucguucagauuugggggguugcuccaaaggaagggaaaugcuccccguaccaugaggguaguagagauaauucugaagacacauuuugaaggaggaaaggcagauguguuuguuuuucccuuuuauuauuauuauuuuucuuaauuuuauuuauuuuucuugagauggagucuugcucugucgccaggcuggagugcaauggcgccaucucagcucaccgcaaccuccaccucccggguucaagugauucuccugccucagccucccgaguagcuggaauuacaggcgcaugucaccacgcccagcuaauuuuuguauuuuuaguagagauaggguuucaccauguuggccaggcugguuucaaacuccugaucucaggucaucugcccgccucagucuccccaaaugcuaggauuacaggugugagccaccacacccggcccucacagacuuuucuuuacauuauuuggaaacauucuagaaaagccucuguucauuggaaaucccacaaagaccaggagaccccaggaagcacuuggugggaggggcagggacaguguccccugagcgcauaggaugcagggaacccgggguguccgcagggacgguguccccugagcgcauaggaugcagggaaccugggguguccgcagggacgguguccccugagcgcacaggaugcagggaaccugggguguccgcagggacgguguccccugagcacacaggaugcagggaacccgugguguccacagggacggugucuccugagcgcacaggaugcagggaacccgggguguccgcagggacgguguccccugagcgcacgggacgcggggaacccgggguguccgcagggacgguguccccugagcgcacgggacgcgggaaaccuggggugucugcagggacagugucgcggggaaccuggggugucugcaggggcgguguccccugagcgcacgggacgcggggaaccuggggugucugcagggacgguguccccugagcgcacgggacgcggggaaccuggggugucugcagggacgguguccccugagcgcacgggacgcggggaaccuggggugucugcagggacgguguccccugagcgcacgggacgcggggaaccuggggugucugcagggacgguguccccugagcgcacgggacgcggggaaccuggggugucugcagggacgguguccccugagcgcacgggacgcggggaaccuggggugucugcagggacgguguccccugagcgcacgggacguggggaaucugggguguccggcagacagaagcacggguucccagaagagccuucucugucauuauuugaaauguuugaagcagccagagcccaaguuaaaugacgcguuaauucagcucauacauggcuuuuggugacacauuuuuucauguguaaacuagaaguaaaauuccaacaaagcuccagacuggugauucugaacuuugauauuguuaaauggaaaguguacaagaauuauagaauuaacauuuccagcuaacuccaccuuucuguucuuuugccagucaugacagaaccaugcaagauauuguuuacaaauugguaccaggccuccaagaaggugagugucugacugucuugcugaucccugaggucccagccuggccucugcagccccugcucuccuggaaguuugguucucggaugggaggccccuuuccuuuuggccgaaucaccgucuucucaucccugcucucagcccaacuucaucuccuuggcuggucucuucuuucgucuaagaugcguagacaucuuuuuaccccuuauguguauucauucagcaaguauggaucgcauguuuagcacaugggacccccagggcucaacgcagcuccugccccucccaggacccugccuucuuccugggccccaccuccugucccaggccugccuccccucaucccacagcgccagcuuccccacaacagaggagcagcacguuggcauagcggguagcugguguuucuagaaaaacuucaccauaaagucaaauuucauuuagaauuaaaagaaauaccaaguaguacaaauacccugaaaguggaaaucgguugcuuggggaucgcucagcugaaagcuccccagcucccgacacucucacggugguggcccuccgcuggcgaccggcaaggaggccaaggaggggccaggucagcgccaggugggcuguccugguauucugcucaucagaccuuucaaaggcagauagagaagcugagaauucacuugggcugguucucacuguaucucagaagaggguuggaauucaaaacacagcugaauaugccagauccguagaaaccguaucucgcuuuaaugcgugacccagagaaucauacuguuagaggcuucuucccuacucacagaguucauucaugcaggaagaauuuagauuuccugaguaaacguagauagaaacaauuagucuuuuaauaucugaaaguuuuuuaguccugagaaaaggcaaaggauacauucgaguuaaaugcugacaccuuaagaaacguuugcaccgaguguuucagacgcguagcagugggcgggaucggggcgggaccccaaguuuugugacccccgccagugcugacacuuuaagaaacguuuguggccgggugcaguggcucacgccuguaaucccagcacuuugggaggccgaggcggguggaucaucaggucaagaguuugagaccagccagaccaacauagugaaacccugucucuaccaaaaauacaaaaaaaaaaaaaaaauuagucgggcguggugucaggugccuguaaucccagcuacucagcaggcugaggcaggagaaucgcuugaacccgggaggcagagguugcagugagcugagaucgcgccacugcacuccaggcugggcgacagagcaagacuccgucucaaaaaaauaaauaaauaaauaaagugugcacuggagcguuucaaacgcuuagcagugggcgggaucggggcaggaaccucgaguuuugugaccaccaccccccgccagcaguuucuaggcguggccguccuugcugcaccugcugcucccucagccucaccccguggccuuugaucuguaaaggcugcaguacguauccccaaaagauaaggguucuucuuaaagcucauaaccacaauaccuugauaauguuuaggaaaauaguagagauuccuuaauaccaaauagccacucagugcugacauuucuaguugucucauaaaugcggugcuuuuugguuguuguuuauuucuuuauuuauuuugagaccuggucucugcugcccaggcuggaguucaguggugcuaucacagcucacuguagccucaaccucccgggcuccagugauucucccaccucagccugccagguagcuggaacuacaggcaagcaccuccauccuggcuaauuuuuuguagggauaggguuuugcuguguugcccaggcuggucuugaacuccugggcucaagcaguccuccugccuuggccucccaaagugcugggauuacaggugugagcccccacacccagccuguuuuuguuuauuccaaucaggauccagagaauaccacugacucacgggccuccuucugguuccugccucugccuucccauuguccuggguuguccugcggcaguggaccugggugcguuccacccguguuuuugggaagcccgcuucugggcauccaucagggcaggugucguccaugugcugagccggguggcacugagaucugcaugccaccuccguuccaucgcucgucuccacguguuaguuggagugugcguccagccuggagcagguuguauguucucguccaccucagcacgcucuuguccgguguggacgcugccaacuccacucuacguugaagaagucgagaggcaagagguuccggagugcuccagauugacacccccagggcacgguggccccgagccgccucccugaccagcuccugucucuggccaccauauuuuccguugagucaauauucuuuuucuuguuguuucucaagcuuucagucauuuguggcucuuuagcaggaggauucuaacuuuaaaacuauuagcagugcaccuauuuucuugauggaggcuacuugcaauuuguuuaguuuuaucuguggugcagacaauugcaaaccucauuucuccgaccagaggccucuuccugaaacgcgcguuagcugcgaggaugcaguggugaggcgaggugucagcccuugaggguccaggugucuguuuuggaggagacgccaacacgguccugccccucccaccuggacuccgggcaggcccucaacgcuguccccgcacccccacauggugggggcuugcuggaagagaguucccugcuagaucagaggugggguuagguuuuuagugguuuguuguuucuuuuuguuuuuauaaauuauuuuagaaaccugucuucguagaggcaacauguuuaaaacauuuaucaaaguguccauucucagucucagcccacucugggcucuuucacucggugggcgugucauggucuuuggugugccaggcuccuguccguuccuggugagggcuguggggcucacgcacucaccaguccucuuuccauggauccugaacaugccugucaccucuugcuuuagaaacgugggggccggacacagugucucaugccuguaacccuagcacugugggaggccgaggcaggaggaucccaugagcuaagaauguuucuuuacauuuuuaaauaguuggaaaaaaucaaaagcagcguauuuuaugaugugauaauuuaagaauugaaauuucauggugcguagccugguuggaaccagccccacuggcucagcuguggucgccuucacccguaagcccguccguggugcagcugagugugugccaggagugugcugccugccugccgguggcuuugggcagcccucugcaccguggcuggaacucaucgucacugcauugggacguuuucaugacgacgucagaacgaggaaaggagaaaaggggacuuucagggcugcacuucgaagccgcagugaacucuggauuauuuuguuguugaacugucauuguugauggcaaagcaccgacuuucucauccgucauacuguagcuaugcugagagcaaacagccgacgauggagucacugacucaacaccagcaauauccccacucacaggaaagcaguauuuagacaccagcaauauucccuacucacaggaaagcaguguuuacaaaaugcugaaaauuuaaaauggaaugucucaucacagcagaauuucuucucagaagugaaaaugaagauauggcuguagucagaauaagcuuccaauuggcugauucguuagcguuaugccaacagugagcuccucagaucaggcuggacugccgcagcucaagagcaauguccagagacagugagcucuuauuuauuuauuuauucaaucauuuuugagacggaguuuugcucuuguugcccaggcugagugcaguggcacgaucucagcucacugcaaccuccgccucccagguucacacaguuguccugucucagccuccugaguagcugggauuacaggcaggugccaccaugccuggcuaauuuuuuguauuuuuaguagagacggggguuucaccauguuggccaggcuggucucgaacuccugaccucaugauccgcccgccucagccucccacagugcugggaugacaggugugagccaccgcgcccggccccaauaaauguuucagugccuguauacaccugacacugagugcugcuauuuuuaauccuucuuuauucuuacaggugaaaauuaaagaaaugggaacuagagccaagggucagggucugaagcugaguugcuuuccacuguguccguggggcucucuccuuugcacggaccuauguggccuguuguucccgucacggcucuucugcagacugaugggaacagccuccugcugucagccccugucuugcaggccuccauuccagcugcugggaugugauuauuuaagggaaacauuuucuuucaagcugcucucagauucuccaggcuaaucuuucagcauuucccuugugaggcuccagcacuccauccaccugcggccggccccaccuauccccuuggcucucaggguccccuccucucucugcccaggcucucgggguccccuccucucucucuccccaggcucucgggguccccuccucucucugcccaggcucucaggguccccuccucucuccccaggcucucgggguccccuccucucucugcccaggcucacggggcauccuccucucuguccaagcucguugccucacgcgggcauuggucccugcacgguugguguuugugaggcagcuguguagguugggguaugcccagagcguuucccuggccuggccgagcucaugguauguagggaggaaaucguggauaaaaaguuuggugaagaauuccuuggucacguagcacauacguuacuuuucagagugaugucuggguugcgguuugagcagcuuuuuucuaaccuuucuuugcuaccuacuguguguucccgagcagugacccacgucguccacuguguccccugggugugaacuaaggucacccuuagggggccuuugccgagagucuguuugcuuuucccuggaaccugcgagguucuggccagcucuugcuggccaucccuggagggucaggccuccucugguccggccagaggugacccaauggcaggugugggugaggaugcugcggcccgucugccgccgggcagucuccucccuggaauuugugccuguggcuguggccacagacaccagggggcgcucuuaacccacugccaggcaacggggugccagagcucauagcugugagcagcccucccugcaggcuguggacucaggcgccugggacacaugguccccggggcucucgggcccucgagggcucucuugggguuccucagugguggccuuggguaccugugagccggcaggaucugccacugcgcaggagcguggggggaacccaguggcagguucaucucugagcugcggguguccaggcaguccacuggcucagccgugaggucagcaaugaugucuggcauggcacugcuguggccacaguguuuaucaaccccuggugacgggugguucugcgccauuggacacucacaggcaguggcugagguggggaugacagucccgcaccuggguuucccaggccccgugccuguccuaggccuggagcagccggucugcgacucaacgucccacguggguugguggggcgggugcccggggggugcgcuucccgcugugcugagcccccaaaacaucucagucuuaauuugcugcuuucuuauuaguagccuucaaacuucauaaugcaaaucccuaauuuucuuuaugugauguuuaugaacagaaguuuaauagaauccacugccugugagaugaaagacuguguguugauuuuccgcagcggaaaugagaaagcagagggaguucuaucacaaauugggcauggaggugccgggagacaucaagggggagaccugcucugcaaaacagcacuuagauucccaucggaauggugagugcccugcgugcccauccagaagccccgggaauccccugcaugaggccuuuucuuaaagagcuggcgcugucugccggccccucccacacgcacucacgggagaacgugggggaaccugaggguguggggcgguuaggguucaaggcguuccuccucacuccugguaccagugggaacgugggcagaggggaaaagccagcaggggagagcaggagggccccccgagagugucuggggggcagaggucaggguucagaaggccuguggaaagaguaguggaaggugaacuuccugagacuucacuuggcuugcuuuacuguaaaauggcaaaauaaugguuugguuucuguguaaagggaaugguauguugaaaucugaggguaucacaacaaacguucaugucuugaggacauuuuauuuuccuaauggaccacaccaacucuuaggaaauguuuaggcuccuccgggcgucugugacaguuggagggugggaggggccuggcucugucacccccacggcuuugcgggucccaggaagcacagccaugaggcgugguuaggaagcgagucugggaaccaagcaguccugucagaacccuuuuaccugaggggaaguuuucauuuuaaaagcgguguugaaacaguggauuuuuaggagaaggcuuucagaucgaggggcugauguggucagcacugagcagcuccgggcgggccuggccauguggccagugcggagcgugucugugucccacgccggcuccggcugccccgucucugucuccugugcuccccacgccugcaccccacaggcccacacgcccguucugcauccuggggagaccccugcagacacuuugcggacggcuuuccuuugacgcuuacuccgcuccggggguccagagucucuuaauggagugaauuuuugacggcauuuggaguacaguguaguuuuuuaaauggcuugacaguuuggauuucauggugcgcuauguucuguuugugcuaaaaggugaaaccaaagcagacgacaguucaaacaaagaggccgcggaggagaagccggaggaggacaacgacuaccaccgcagcgacgagcaggugggcggggcccgggggucgcugcaguguuaguguucgccguggaggcgugagcaggugggcggggcccgggggucgcugcaguguuaguguucgccguggaggcgugagcaggugggcggggcccgggggucgcugcaguguuaguguucgccguggaggcgugagcaggugggcggggccccggggucgcugcaguguuagugcucgccguggaggcgugagcaggugggcggggcccgggggucgcugcaguguuagugcucuccguggaggcgugagcaggugggcggggcccgggggucgcugcaguguuagugcucuccguggaggcgugagcaggugggcggggccccgggggucgcugcaguguuagugcucgccguggaggcgugagcaggugggcggggccccggggucgcugcaguguuagugcucgccguggaggcgugagcaggugggcggggcccggggucgcugcaguguuagugcucgccguggaggcgugagcaggugggcggggcccggggucgcugcaguguuagugcucgccguggaggcgugagcaggugggcggggcccgggggucgcugcaguguuaguguucgccguggaggcgugagcaggugggcggggcccgggggucgcugcaguguuagugcucgccguggaggcgugagcaggugggcggggcccgggggucgcugcaguguuagugcucuccguggaggcgugagcaggugggcggggcccgggggucgcugcaguguuagugcucuccguggaggcgugagcaggugggcggggccccggggucgcugcaguguuagugcucgccguggaggcgugagcaggugggcggggcccgggggucgcugcaguguuagugcucuccguggaggcgugagcaggugggcggggcccgggggucgcugcaguguuagugcucuccguggaggcgugagcaggugggcggggcccgggggucgcugcaguguuagugcucuccguggaggcgugagcaggugggcggggcccgggggucgcugcaguguuagugcucgccguggaggcgugagcaggugggcggggccccggggucgcugcaguguuaguguucgccguggaggcgugagcaggugggcggggcccgggggucgcugcaguguuagugcucuccguggaggcgugagcaggugggcggggcccgggggucgcugcaguguuagugcucgccguggaggcgugagcaggugggcggggccccggggucgcugcaguguuagugcucgccguggaggcgugagcaggugggcggggcccgggggucgcugcaguguuagugcucuccguggaggcgugagcaggugggcggggccccggggucgcugcaguguuagugcucuccguggaggcgugagcaggugggcggggcccgggggucgcugcaguguuagugcucccguggaggcgugagcaggugggcggggcccgggggucgcugcaguguuagugcucuccguggaggcgugagcaggugggcggggcccgggggucgcugcaguguuagugcucuccguggaggcgugagcaggugggcggggcccgggggucgcugcaguguuagugcucuccguggaggcgugagcaggugggcggggccccgggggucgcugcaguguuagugcucgccguggaggcgugagcaggugggcggggccccggggucgcugcaguguuagugcucgccguggaggcgugagcaggugggcggggcccggggucgcugcaguguuagugcucgccguggaggcgugagcaggugggcggggcccggggucgcugcaguguuagugcucgccguggaggcgugagcaggugggcggggcccgggggucgcugcaguguuagugcucgccguggaggcgugagcaggugggcggggcccgggggucgcugcaguguuagugcucgccguggaggcgugagcaggugggcggggcccgggggucgcugcaguguuagugcucgccguggaggcgugagcaggugggcggggcccgggggucgcugcaguguuagugcucgccguggaggcgugagcaggugggcggggcccgggggucgcugcaguguuagugcucgccguggaggcgugagcaggugggcggggccccgggggucgcugcaguguuaguguucgccguggaggcgugagcaggugggcggggcccgggggucgcugcaguguuagugcucgccguggaggcgugagcaggugggcggggcccggggucgcugcaguguuaguguucgccguggaggcgugagcaggugggcggggcccgggggucgcugcaguguuagugcucgccguggaggcgugagcaggugggcggggccccggggucgcugcaguguuagugcucgccguggaggcgugagcaggugggcggggccccggggucgcugcaguguuagugcucgccguggaggcgugagcaggugggcggggcccgggggucgcugcaguguuagugcucgccguggaggcgugagcaggugggcggggccccggggucgcugcaguguuagugcucgccguggaggcgugagcaggugggcggggcccgggggucgcugcaguguuagugcucuccguggaggcgugagcaggugggcggggcccgggggucgcugcaguguuagugcucgccguggaggcgugagcaggugggcggggccccgggggucgcugcaguguuaguguucgccguggaggcgugagcaggugggcggggcccgggggucgcugcaguguuagugcucgccguggaggcgugagcaggugggcggggcccggggucgcugcaguguuaguguucgccguggaggcgugagcaggugggcggggcccgggggucgcugcaguguuagugcucgccguggaggcgugagcaggugggcggggccccggggucgcugcaguguuagugcucgccguggaggcgugagcaggugggcggggccccgggccuccgggacacuccuguauuagugcuccuguaauagugcaguccugggagcaccgagggagggcucacaccagaaaccuucccuggggaugaagggaagcagugacagccagcacccaagggcugcuguuuucuuccucccgacuucuuccuuuuucuuuuuuuuuuuaauuaccagaggaacacgugcuuaggguaaagcauggcagauauaaaacauggcaggucaguggccggcucuggccucagccccauggcccacguuuugugccuuuuccuccgggcgcgucucugugcuccgugaauguuacgugaaagaaaguaaagccuggcaguguguugaaaggaaagugagagugaacgucgagggccucuucgugugucauuuacuguauuaccagaugaagacagaaaaacuacacggucacagagaugcaguaaaagaauuugaugaaauuccauacccacgucuagagaacuuuuuuuuuuuuuugagauggaguuuugcucuugucugccaggcuggaaugcgguggcaccaucccggcucacugcagccucugccuccuggguucaagcgauucuccugccucagccucccgaguagcugggacuacaggcaccugccgcuccgucugguuaacuuuuguauuuuuaguagugacaggguuucaccacguuggccaggcuggucucgaacuucuggcccgccucagccucccaaagugcugggguuacaggcaugagccaccgcgcccagccaaguaacggaaccuuaauuuuuuaguuuacauuuacacguuguuuaaaacguucagugagcauuacagaaauagacacguguguccaacgugggaugugauggcguugccuugugggucaguagagaagagcggccaguucagagaagggguccggaggggcaggaagcgaggaaaucaccuucuucuuucaugaccccgguuucacugccaugccugguuuccgauguugacguaccuggugcuuccucuguugguggcuuggcggcucuccuggaaccacgcuguuuuucugucucugguguuggucucgucugcgcggaggccccugggucuuuccugguuggccuuuguuagguacuuguccuuacagcaguuccccaguggugaggaacccccugggaucucguggaaauucaguuuuggggucugcugggugggcugguguuccagaggggugcaggcugcugcuccccuuuacucuggugugguuuuccauggaucgauguaaagcugugugugauguccuccuccaguuuaaucucuguuuugcaguuuuaaauuuauaucaguguuuacuuuuacuaauauuuaccuuuucuuuugauccuugacgugcuaaagauuuauuuguugcuuucaaaagggccaauuuuuuuaaauugaucaaauauugaauuuuguuuuuuucuuuuuugagaugaaguuuugcucuuguugcccaggcuggagugcaauggcacgaucucggcucacugcaaccucugccucccauguucaagcgauuauccugccucagccucccaaguagcugggauuacaggcaugcgccaccacgccuggcuaauuuugaauuuuuaguagagaugggguuucuccauguuggucaggcugaucuugaacucuugaccucgggugauccacccaccucagccucccaaaguucuagaauuacaggcaugagccaccaugcccugcugaauuuucuuuccuuuuuuuuuuuuuuuuuuuuuuuugagacagucucacuuugucgccaggcuggaguguggagugcaguggcacaaucuuggcucacugcaaccucugccuccuggguucaagcgauucuccugcuucagccuccuaaguagcugggauuacaggcacaccccaccacacccggcuaauuuuuauauuuuuaguagaaaugggguuucaccauguuggccaggcuggucuugaacuccugaccucgugauccaccugccucggcuucccaaagugugagucacugcacccagccuugcugaauuuucuuaaaacuuuuuuuuuucugacaucuugaguuaaaagucuuuuguuauucuuugagacgggaucuggcucucucacccaaccuggagugcaauggugcaaucacagcucccuguacccucugccuccugggcuccugcccaagccuccagaguagcagacacuguuggcagaucacaccaguuaacuuuuuuaauuuuuuguagagauggauggagucuugcuguguugccuaggccggucugaacuccugggcugaagcaguccaccugccucagucucccaaagugccaggauuccaggcgugagcccacgugcccgccaagucuuuguaagcgcauuuccggcuguguuuccugugugcuccuggcugcucccugcggacuuugaugaauaauauuuucacuggcauucauuucuaaagaagcuguaauuucaucagaguuccuuuuuaaucgagaaguuuguucugaaacauuugaguaacguggccuuuuuggguuccauccacuccucuuucuagucuccuucccgggcggucagggaguguugucuacacggaucucugccuugggggauugagaucuucuugcuuguucacuugggugcagauuuuccagggguccuggggugauuuuccuuuggcugaguuugcugguuggugugguggguaaacaagcggaccccgggggccaguugcccacguccugcucugccuuuagccaggguguggcccuucacaagugaccuaccucugccucaguuucucugucuguggcgugaggugguggugagauugccucgagguuuuuaugaagauuaaaugauuuccuauuugugaggcacuuugagguguuaaguugaaugaaugagaaacaagcaggcagccugggagauugugaacuccgacauccaaguccggucguuuuucuuguggauucuuguuuucuccgugucucuguaaccucgcgguguugcuuaggagccgugcugcuggcuaugcaggcugaugguucuuacguaguuuugaugacuugcaccuuuugccaguguggauucuuuuuuuuucuuuuuuccuguucaguguguuuucgcucuaacccccgauucucuuguacuaacaucgcuacaguugcuguuggucucugcuuccacccucccugucauuuguuucagcuguguuacggaggccuuugcuuugcuuuuuugcacacaucucagguucucuuugauaggagaguuuaacccguugucuuuguugugagaauacauuuuuuccccucuccaugagggcuuggauccgguuuuggugucuucuuucucugcucuaaugguuugggaauuuugcauucucuuucuguucuucuuguggcugcccuuaaacuuggauuccguguccguuugugggauuauccgcgucuauaacuucgugaugaguuccugaucuccgucuuccaaaacuugggaagucauccgaggguuuguuccagauuguuuuggguaauuuuaaaauuuuauuucacacuaauuuuauucuaggaaucgcuucuucaucuuacugaaguuuugaugcgacguuauaguuauuuaggcuuaacgggagguugcauggguuuuguggccguuucuggugucuuccugguguguuuggauuugugcuucgccacguccgcacgucacuucugagcccagugcgguggccccugagcuccugccggucacgggcuguguguugucccccucacaccagagacagucguuucuucucuuaacucuuaagcccuccucagucacucggaugaacugauuaaauucugugcuuuuaauacuaagcauuaaaaaaaaaaaaacauaugagggaagcaccugccacccaggcccauguuucugcucucagccuugugcccucccccgguggccccuccaaagggcaugaagcuguggaugcugugccugugccuggaggcucuggcccucccaccccuggcugggcuccagcucuagguuuguucagcagccaacucagagcagccgaggcucaggguggcaucagccggccgcgcuggcuucacagccgaccucuucuccaucaucugacgggcgcaggcccccucgcugccacccccacuggugggcacucagccucaaggcacaggccuccugggacugguggcuccucugaaucuuccugagagaggcaaguuuagucaucgcugagcaacgcaaaagcgugucggguuuauuuacucacaacgaugucuucuaaaccaaaaauacuugacggggccuuucuuucuguuuuccgagggaggggauggggauccuccuggaagauggugcccccugcacaggugaauggcguuucccacacuugaccuugggaguuuggaaacuggcgaagccgccucuuccacugcccuugcuguucccuccugaggucccuggucguucuuucuccucucaguucugccucccgcagucccugcaucugccaccuucucugugugaccccauuccuuucacagccagaagccucuugguuagccucaggugacucauuugcuucacagcuguuuuuugcucucaucuuuuuuuaaguauaagccaucggucuguuuaauuccagaacucuccuuucuggagccugacuucuuugggagcagccggcggguuucauggaugcacggccacagcuguuccgcucuuuucccccagcugcugcuuccagagccuggcuuugcgugggcauccugaggccuccggggaccgggcgggcaagggugggguuuguggauaaggagugaggugggggacgggccugcugcccugagcugggguccugaguguccgcugggacucggggguggggggccaugcagucuuggggauacaggggcucuacauggacuucgaccccugugugugcagccuccuccgguuccaggcccccggggucuucccaccagacugaggcugggcagacgggaggggccugcgcguggcugugaccccgccagggcaaccccagagauucccgccgccuucaggccccugucagauccaaacacucggccuccgcccaucuucguuuucagagccucgggauugccagugcccuccuggugcccgucuguccagggcucuucugaacacgucccugaugaaacucuucucucacuucaguaggcuuuguccucugucgaaccacaaagguuuguguuugagauuagcuccauuaccuggauagugggagacagaucccggcccucacuggaggccccucugggugcugauggcucacacaccugagcugccagguggcccaggagagggcaugggcaccuucucucccagagcugacaagccccggagcaaauggcaaggaaguuagaacagaacuuuagagcuuuuuuauuuuucugagacaggaucuuacuuucuugccuaggcuggaguauaguggugcaaucucagcucccugcagccucgaccucuugggcucaagugcuucucccaacucagccucccgaguagggaccacaggugugagccacuguaccuggccuagaacuuaauguuuaagaagacucuuggccgggugcgguggcucacgcccguaaucccagcauauugggaggccgaggcaggcggaucacaaggucaggagaucaagaccauccuggcuagcacagugaaaccccaucucuacuaaaaauacaaaaaauuagcugggcguggucgugggcaccuguacucggaggcugaggcaggauaauggcguaaacccgggaggcagagcuugcagugagccgagaucacgccacugcacuccagccugggcgacagagcgagaguccggucucaaaaaaaaaaaaaagaagacuggaccaggcacgguggcucacgccuguaaucccaguacuuugggaggcugaggcgggcagauugccuaagcucaggagugcgagaccagccugggcaacaaggugaaaccccgucucuacuaaaauacaaaaaauuagccgggcaugguggugggugccuguaaucccagcuacucggaggcugaggcaugagaaucgcuugaacuugcagugagcugagaucgaggcacugcacuccagccuggguaacaagagcgagacucugaccuucuacgaacccuacauucagcuucccuuggagcgagcagcugcccaguggacuucaggggcguucuggguccuggcaggagucgccuccgucuuuggugguccuggcacccacagacccagugggacugcagggcugguguggucucugcucaucuucgcucgugcagaguuaggaaacccuuaccgggccuguugacuuggugggugugaugucccagcaccagaaacaggggaaauggcuccuauacccugagcaggcuggggguucugguguggggucccugccgcccuccagaggcuccaauggcucuugugucuggagcuggaaaugugguuuguuuucacuccuccgaguugugccucccuggcccacuggcuccuguccgcacccucgggcacgcgcugugcucuugggacuucacacccgagagccggucaccugcuccugcugcacgccugcuggaagugggcucugccugcaagggccucgcagccggcguggugaggguuggcugguggggagcggagagcccacccauccaggccagagccccuggagguagaaggggcggaggguagaaagagccucuccuggacuguagaggugaggcaggagguagugagcugggaccuggugccaggcugccccacgugccguggguggugaguccggggcagagugaacggguaaggcuggaggugagguuggggaccuugggggccuguggcgagaacuugcuguucacccagaggagggagaugaggcaguugggaugugagaucggggugugcugugggaugcagccuggcguggcuuuauccccagaggguugccacuuagcgcagcugcucugcagugagcugccugcacggccaggguggccaugcggagaccaggcaggcgucugagccagaggcccaggcagguggcggugcgggugcagcacuggguuuggggcauauuuaaaagggagggagccugcaggauucgcuggugauccagaugcagauggcagaucuugggcucuuuuucacuuccagguggacaaggagcucaguguucccaggcaggccgauguguagccauagacagcgacaggucuuucugcagugcccucuuuacaaucagaguugcauuucgagguguguaacguacccgcuugauggugacugcugugugcacacaggcccgcguggugucgcagagcacacggcguugugugcguggcacguguuguuacgcugugacuuuuuuacacuuaauuucccaucuaauacuggagacuuuuagguggugaccagcccaucacucuucuaagacauugcacuugucccccugggcagguguguuccacgguaucuguguuauuucugauuccagucuccugugugugggguguccagcgacucaucgcacgucucugggcuccucugcgugugaguugcuuacuuguucuuugcccaucucuguccugggaagacugacuuuuccuuaugugagcugcagggcuaccuccucccucgccgccccacgcucacugcagggaucgucuuuccuucugcggcugucggcuuucuucgaccuaucaucauccacaguuuuaaaauuugacauaauuaaauguaucgguauuuucuucugaaucuuaaaaauguuuccccauucuaaggucauaaauacauucucuuacauugucuuguaaaauauuuuaaagguuugcuuuuuaguuggguuguaagccccugcaguugaccuuguguguagaauggacaagguggaguucaacuuugccaaguuuccacacucucaggucccccugggcucucugcucuguuccgcuggucucuugucucccauugugccaaaacaacaaggaacuuacugaauugcaaugauuuauuuuaccauuaaguuguggucuucugggagaguacauaccccuccucauuuuucuucuucagaauuguccuuuuuuuuuuuuuuuuuuuuuuuuuuuuggagauggaguuucccucuugcccaggcuggagugcaaggccugaucuuggcucaccgcaaccuccaccucccggguucaagcgauucuucugucucagccuuacagaguagcugggauuauaggcacaugccaccauacccagcuaauuuuuuguauuuuuaguagagacgggguuucuccauguugaucaggcuggucuugaacucuuaaccucaggugauucacccgccucagccucccaaaaugcugggauuacagacgugagccaccgccgcacuuggcuuuuuuuuuuuugagauguagucuuauacucugucgcccaggcuggagugugggggugcaaucucggcucacugcaaccucuaccucccugguugaagugagucucccaccuccgccuccugaguagcugggauuacaggcacgcaccaccaugcccagcuaauuuuuguauuuuuauuacagacgggguuucacuauguuggcccgucuggccucgaacuccugaccucaaaugauccacccgccucagccucccaaagugcugggauuacagguguaagccacugcacccggcucuuuucuaaacucuagaguugaacauuccuuuaguuuccagcuucauaauuugguucuuauuaaaauaauucuagaauuuucauguuuuuuuuaaccagcuuucuaaauuguguuacaugcacauaaaauaugccauuuuaaccauuuucaggugugugguucaguggccuuggguacagacccaguguuacacagccaccaccaccaccaucaucuccagagccuuuuuaucuucccaaacugaagcucugcccccauuaaacacucacuccccaccccgcucccccagcaggguuagaucgcagaggggccugccgggggcucugaggugauggaaaccaucugagacugccauggcgaugaucgagaaagucugugaauuuacggaaaauuauugcauuauauacauaaaagagguguguguaaacugugccauaauaaagccuaaaaauuagaagcaugcuuguaacuuaguguauuuaaauagguaauucguucaguccugagguuaguauuauugaaaagguuuaauuuuguucucaucucugccgcugucuguagugaccuauagagaaccacugugaucaccuccuguauguaugcaaaucugagcaaacguaaacauauuuucuucuuguuuuccuuccacaaucccccccacucccacccccgcccaugugugucugcguuuucccgcaggugcaugcaggcccgcguucaucugugcagcccuuccugcugcccugcgggccccaugcacugcagaccccgcugccucagaccugugccugcguggcuggcacaccuguucccugagucggagacggcggcugccuguugagggcagggugcguccgcugcuuauagagacgugaagcccaccauggccauucuguuggcgugcguuugucaccagcuguguucccguauagaaacguuucucgucuuuggggggcuucuuccucauuaagcucuauuucuuaaagucccaugacauacuaaucuagcuaugccagcuuucuguuggugaauacuugugugauauuucuguucuuaaaaugucuuaaaugugacacuguuuacaacguagagcuagguuuuuuaaaaaaaucaaacuuuuuuagcuggcacguuaccuuacacauuccacgauuuuccauggaggaugugaguugguuccugcuuuauuuuuuuauuuugcucuuuucgucaguuuuuuccuaaugcuuccuuccucccuguugucuagugaauuaguaacuuucuuuaaucucuuucuuucuuccucugguuugcaagguauaagcucuacuucuguuauacuagugguuacaaaauguauaaacuauuuacauuuuuagaaauccaaaguuggcccggcgcgguggcucacgccuguaauccuagcacuuugggaagccgaggugggcagaucacgaggucaggagaucaagaccauucuggccaacuuggugaaaccccgucucuacuaaaauacaaaaaaauuagccgggcaugauggugcgcgccuguagucccagcuacucgggaggcugaggcagcggaaucgcuugaacccaggaggcggagguugcagugagccgagaucgugccacggcauccagccuggcuacagagggagacucugucucaaaaaaaaaaaaaaaaaaaaaaaaaaaguccaaagucacuguaagucugugccccucccugcacaagcacccccaccgcggcucucaccgggcacccccuuucucccugcuucucacuucuuccgccaaacuccaggucuuucuccccgcgcggccccucucccgaguucuucucgcuccggacuccaggucuuucuccccucgaggccccucuccggaguucuucuccuuccggacuccgggucuuucuccccgcgcggccccucucccgaguucuucuccuuccggacuccgggucuuucuucccgugcggccccucucccgagcucuucucgcuccggacucugggucuuucuccccacgcggccccucucccgaguucucccuccagacuccgggucuuuccccgcacggccccucccccgaguucuucuccaucccgacuccaguucuuucuccccgcgcggccccucucccgaguucuucuccuuccggacuccaggucuuucuccccgcgcggccccucucccgaguucuucuccuuccggacuccgggucuuucuccccucgcggccccucucccgagcucuucuugcuccggacuccgggucuuucuccccgcgcggccccucucccgagcucuucuugcuccggacuccgggucuuucuccccgcgcggccccucucccgaguucuucuccuuccggacuccgggucuuucuccccgcgcggccccucucccgaguuguucuccuuccggacuccgggucuuucuccccgcgcggccccucucccgagcucuucucgcuccggacuccgggucuuucuccccgcgcggccccucucccgaguuguucuccuuccggacuccgggucuuucuccccgcgcggccccucucccgaguuguucuccuuccggacuccgggucuuucuccccgcgcggccccucucccgaguucuucuccuuccggacuccgggucuuucuccccgcgcggccccucucccgaguucuucuccuuccggacuccgggucuuucuccccgcgcggccccucucccgaguuguucuccuuccggacuccgggucuuucuccccgcgcggccccucucccgagcucuucucgcuccggacuccgggucuuucuccccgcgcggccccucucccgaguuguucuccuuccggacuccgggucuuucuccccgcgcggccccucucccgaguuguucuccuuccggacuccgggucuuucuccccgcgcggccccucucccgaguucuucuccuuccggacuccgggucuuucuccccgcgcggccccucucccgaguucuucuccuuccggacuccgggucuuucuccccgcgcggccccucucccgaguuguucuccuuccggacuccgggucuuucuccccgcgcggccccucucccgaguucuucuccuuccggacuccgggucuuucuccccgcgcggccccucucccgaguucuucuccuuccggacuccgggucuuucuccccgcgcggccccucucccgaguucuucuccuuccggacucugggucuuucuccccgcgcggccccucucccgaguucuucuccuuccggacuccgggucuuucuccccgcgcggccccucucccgaguuguucuccuuccggacuccgggucuuucuccccgcgcggccccucucccgaguuguucuccuuccggacuccgggucuuucuccccgcgcggccccucucccgaguucuucuccuuccggacuccgggucuuucuccccacggccucucucccgaguucucucuccagacucccggaucuucuucccgcucacauugucccucuccugugaugcuugcaggcggccucgcuccaucccaccccggagcaaggaugucucuugcuuuuugcacagaauccacuuaucuccccaguggcucuugcggggccuuuaaugggcugugcucagugacugcaccgugucggaguggguauuucuuguauuuuggauucuuuugcuuccugaaucugaggacugcccuucacuguugugggagauccuuagucacuguuucuuaacacuuccuuuccuuucuguucuucccuuuggggcucccgucuucuccccuuucucuuagccuuccuuuuauuguuugaauugguguguuuaucucuacuccugauggguaacuuccucaagugaauuuuuuuuuaggacauuaaucuguccucggcugagaagaaucugugguucagccauccacugagauguuaguuuccgugaguguuuuuauuuuuagaaauuguaucugauuaccuucaauacuugcccgucuguaccccugguguccucccuuuuguaucuuuuguaauuuuagacauacauguuucaguuaacccccuguccauucuuccacugcauuuuuaggcccuaacugugccguuuguugcggcuccaccuguagaagcguuugccgugagcgucgcccuuccuugucaggcacaucuugggggccaagccggccgggcccuugggugaagccucguccugggcagauuccuuuucgcaccgggcagggagcccguggcugcugggacuccacaguccccuuaacagucacuuuuuauccugcggccaaacugcuggucaccuggaaggcagcugugaccuuccgccuguggcccugcucaaggcuucucccuacugucuuccugcagucgcugcugucuccccgagugcauucgcagacacggggccgcccacuccccuuugcgccauguuuguccggacaggcuuagcuggagaccaagaacccagugccugcgauggauaaguaacugugggauuaacucucaacuauuauguuaauaacacagaauuaacagggugagguuauaguucacaaaauggcaagcagacgauaaacagguuuucagauaagguauguaagauucuuuuucugcaguguugaagucaaagcagaugucugaucucaaaaaggucagcaguccuagauugaggaauuagugaaauaugucuaaggaagccuccagaaccguccgggggaacccuccugcugcgcucucaccagcguccuuucccgcaggugagcaucugccuggaguguaacagcagcaaacugcgcgggcugaagcggaaguggauccgcugcucagcccaggcgaccgucuugcaucugaagaaguucaucgccaaaaaacucaaccuuucauccuuuaacgagguaacaguugaucccuaaguagaaaccauaacaaguccucucuuauuucuaaagguaacuccaagauucuuugcuuaguuuuguuuuguuuuuaacaauuuuggagauuuuaaccagaaaaaaauccguuuugccugcuucaccggggagcgggauaggagacagcccuaaggguuguaggaugcccagagacagggaacguggaaugcuacugugaguggaagagagaacuagggcggggaugaugagacuguuuuaaaauaggauaaagguuuuccucaaaacgagaaauucugugcuuuaauuucacaaggggagacaugggcggaugcagagagggaggacccuuccaggcugugguguguaaggagacgaaggagugcuggcaugaggcggccuuggcagcgggcgcaccaugaacaugccagugugggucccugugagcccccaaggcagugacaccauggggaugcaggcgccagcaggguccagcuuugcauggagacagaaggcgcuggcggcugugggcaggagcaugggucuggugucguuuuugaaaaucgcucaggcugugcagaaauggacgcaggagaggccagcgccaggaguugcaggagaggcggacuguggugggggcggucaggguggagaaguggacagacuugagaugcugucuguagcagcaguggacucagugguggccccagaagauaagccacauccuaacccccagagccugcaaaugggaucuuguuuggaaaaggaucuuuguagauauaauuaaauaaaggauuuugggaugaaauaauucuggaauaucuggguggagccuaaaucccaugacacaagugaggcggaggaagacucgagacaggaggcccuggugaggacagagcagaggacggacuggaggcuggagggaggcagccucgaggcaagccagggagccccugggccaccagcagcuggaagccagggcaggcuccccggcugugguccgaaagcaucccccagauucauguuggaaauuccauccccagcagggcagugcugggaguuagggccugggggaggcgcucaggccgagggcccugccccaugcacggauugaugcugcugugaaaggacuggccagcauguguucucacuucugaucuuccccaacaugaggaugcagcagaaggccuucacagguggcaacguggugaccuugaaugucccagcucccagaacugugccgaaaucaauuuguucuucauaaaucacccagugugugguguucuguggcagcagcacggaauggacugugcuucuccccuggagccugcagagggaguguggcuguuauggacucuggaacugaguacauuucuauuguuugaagacaccaccucgugauaauuuccacggcagccgcaggagacuaauucagagaaagccacaauaaguugcugauguauuuggguggugaugcagagaaaaggaaggggucaggaaugacugcaggccuggggcugcucgguuuggggugggggguggugucucgggacaggcuggcguagcugcugugguggcacagagcagaggcugucaggucauggggggccaaugccagccuugagugucccacagguuggccggggauacggacagcacaccgggguuggggagacucacugagcacgggcugccuggagaucauggagaaaccaagucaggacacggggggaagggagagaaggaaauggggcaacgcuuuuugcuaaguuucuaucguuuuguuugcuuuucuguguagcgaaacagaaaagauggaugguagcuggggacagagcaggccgaggaaguccuuggauuuucauguggagguguagcgggaagcugccggacaguggggcugcaggggguggggaagagguuggccauuucccagcgcagggcugguuccuccagggaagagugugagguuugcgcugcugcugcguuaaccgugccucugagcccccaacccagccacucaggcagguggggcugcuucaauucaugccuuccccagggaggaaucugaagaacugucuacaugaucagggaaacgcaaggaaaacugcguggcaccacgcguaccccauagaagggccagaaucccaagcacugacaacacauucgggaaacgccgggagcgcagguucauuccugugggaaguggaacccgcaggcccuguggagaacagcuuggcagcugcugacaacacgaaacacacucucggcaaaccacccagcagccacaccucgucauuuacccacuggaaaucuccugcccacacaaaaaccugcacccggauguugauagcaucuuucuucauaauuaccaaaaccuggaagcgaccaagaugcccuucaguagauaaguggaaaaauaaaccguggugcauccauacuggacuauuauccaguacugaaaagaaaugagcagucgggccaagagcaggcacaugggagaaacaucaagucccuguuacuaaguagagaagccccucugaaaaggcuguaggccgugcgacuccagcucugcagcauggcgcacuggaaaaggcagaaccauccggaggcugcaggggcuugaggaggguaguaggagugggcgggcacagggcuccugggcggcgaugcugcuguuuguccaccuguggcugugccaccagggcgaccugacauccgcucuggacucgguggaggugaugucagugcagguuccuggguggugacuaaugugcccccaugcaggguguugguggcagggggguuccaagggggacgggaacucccuguaccuuccucucaauuuugcuguaaaccuuaaauuguucuuuaaaaagucuaauuuuuuuaaaagacuggggagccuagugcauuuuugcacuauggugagagggagggacagccuggaccggagguagggccuguggggagagggugccccuggaggcugcagccgugggagggggcugguguggacugggccugggugggauggggagggaaacacuucggcccuaugggccucucaggcaccugugccaccuggggaaccagggugcccgauuccggagcugucagggcugcucauggggcugcaaaccaccucuucccguugcucaguacggcaggugugguagacagggugugauggggccugucaagagaaaaaggguucagggcagcugcaggccagauaggggcgggaugggagcccaccacugcaaggagcuugugccugcgccugcacccccugcagaaacgucaucccccuaacuggcacgggccugcccuguaauaucuuauauguugcacuggauuuccguucagcugugagguagggaccacacuccaucucuaggcugugagguagggauggaggaauacaugaaccagccccccccaccccaucucuaggcacguucuugcaugauuggggaggggcugcagauuucauaccagcaucaagguggccaugucaguguggguugagcaccucuccgcugcuaaucaaaccuccuuaucccccagcuggacauuuuaugcaacgaggagauccugggcaaggaccacacacucaaguucgugguugucacuagguggagauucaaggugagacacgugauuugauuuucagagucugcucugaauggcagugacuuugcugugcaucucuuaucuaaaauguuaaaugacuccagcugggugcaguggcucaugccuguaaucccagcacuuugggaggacgaggcgggcggaucacgaggucaggagauccagacaauccuggcuaacauggugaaacccaaucucuacuaaaaauacaaaaaauuagccaggcguaguggugggcaccuguagucucagcuacucaggaggcugaggcaggagaauggugugaacccgggagacgaagcuugcagugagccaagaucgugccacugcacuccaaccuaggcgacagagggagacucugucucaaaaaaaaaaaaaaagugaugacucagcuacagaaauuguugugaaacacaguucuggucuuucugaaaucaucaaccccagagccagcuuggaaggugccagcugagcugcgaagggcacaggcccuggugggaaagugcugaggccaugagugccaugagcagaggguccccuggggccuuugggccccucugaagcaggaaaccaaugguggaacucucccaccucagcugguguugcugccuggggagagggggaggagccaaggcuggccuggggcugggccagaggguuugagggagaagggggcaggggaguggcagccagggccacaucagguacagguggccaccacggugugcacaguggucacugggucaccuggggccaggggagagggcacaugucuuccuagcccgucuucccccagcaacuucugggggacccuucuguugcucagaacagaagggucucugugcagcccugcauguggacugugccucacgggacgugauuccucagcacccuucccgaugaaguagguccuucucgccuccaccccugcuaagcaggcacugugcguucuugugucuuccagaaggcgccgcuccugcugcacuacagacccaagauggacuugcugugaauggugccacacagcgcccacagacugggcccucgcacccuugggugcucccggccgccgcgcuuaagaacauugccucugggugucauguggaccagacuucugaauagagaauauuuauaacuuuuguaugagagagaauucacacucaacaagacacuaccagcaccacguuuacagaggaugaaaacacuucacagucucccagagccgaucguccucucccccgccccaccccgugcuucagccuugcagggagagugaugcuccaggcaacacgguucugagucaccuucugacacgagcucccucugcuugcuuuccaggucuugaaaaucugaauucacuucaguuuaguuuaugaauuuuagguuucaugauaagccucaaguguaguuggacuuuuauugaauccuuccuaaguuauugaaaaaaugucuuuucauggugaaugacaauauuuauguugccuuuagcuucuugaagauuuagaaguuauauaaaaaauuaauuuaaaagcaaaccaaaagagguuuccauuaacauuaugauuuaaccauuguauuuaauuucccaccuuaugaaacacaacagcagcucccugacugguucgccuuucauugugugaggucggcacuuggacucacucagaacugucgcucaccuguggcugacacacccagcccuggaaacggggccccagacgccacgucgggauuucugacaugcucagcagguagaccagaggccgugugaccagcucagugcugguuuacggaacaacucuuacuuuuaaaaauuacuuguucccccaaauuguugagugccgccguuugguuuccuauguuuucuuucccuguuuugauuuugcugaagggagaggugguggugguuaggaucagagcucuccuggcauccguggggaggauuugcuggugguggcuucgggcucaugcccagacacacucacugccccgucuguccaaggccuccccuuccccuuugcuggugggaggagcucgugugcuccuuggccgcuuacuggaagggcguuuuucagagcugcagggacagggugagcagcugaagggcuaggagggaagccggcccccgcucugcagaagcugcauuucagcugaaucuguguuucagccucaguugguugcaccguuagccccucuccucccggauggucauguuuuugucacauuagagaauaaacagccacacacacauuuuuuuuuuuccuuuaaaacaguaacuuggaaauaugaaaaggccagaaggaggagcaagggcuguuuucuggagugguugagguguuguccugcaguugucauugucuucuccaccgggcuguucccauuuauuuccuguggaacugaaucccuccucccuccacuccuugggagcccaggugguccuuggccaccauucaggcuuuccaagaagccaaccaccuuggagauuuuuuuucuugaauuucgcuguuuucuucugcuuccuuuagauaaaaagcagcucaagagaccuuaucuuagggaugagaaaaacaugcauauuaauuccaucugagugauugucaguguaaggccuuuuaaaacaaaagcaaguucuuuguuaggaauuggucaaaauucaucucuuucuuuaagcccaucaacucccaggacgguuugaguuacucaguuaccuaagcuugcuauucauccaaaucauuuucuagagucacuguauaagggucuaugaguagcuguguaugaauaaauauuaccugucuaccucaaaauacacauacugcugaagcauucuguacaaccguguguuaucacagugcaguuuuaaguguaacguuagaacuuaggcauuuuccuguguggcggaauaagaaaggauuaaacaguuacaagccuccaaauucaaauaaaauuaaaucacaguucagaugaaacugaauaucauuguaauaaucucauaauauauauuuguaacuuuguagcuaucuuugaaaucacuugacuuugcaauggugcuaagcugauagauuuaaauacacagacgggcgaguggcgcccgugucgaugucuucagccaguggugacccugcuuuuguaaccgcguuaaccugacaaaaccucagcagcagaagucccuauuuuucuaggaguucaucgugcagacagucuucacuacaggacucggcccuggggccucugccucucgucugaccuugcagccuuagucguuggaggcuggagcgcaauggcccugccgucuguggagccucugggcggccuucuuuccuuucugucaaccucucauuucacagaaaaaggcugaauuucauuuuuuccagcaugaaagccaggaucgguuagugguuggauucuauugguuuuuuuuuuuuaaacagauggaguuacugugaagaaguuuucacaacuauuuaugcugguaaaacaaaugcuguuaaaucaccuuaugcgucguuuucaacagcaguggggcuaauuacccggaauacggucucaccgaugcaguuuucauggacauagaaaauucaaauagaauauauaauauugaauuuaagauuugggggguuaaaaaagaaaacuuaacuuuauaaaauuauuuauucuauuuuaagccuucuaucauauuuucccauccaauuguuugguuucagugguccagcuuuauuuacaggcauauaaaaugaaauugugagauguuuugcaagcuucuuuuuacuuugaguagcuuuuaauuuguauguuuuuauguggaugaagagcauuuuuuaugcuuuugugcaauagguuccaauaugcauuuauuagacaucuguuuaaaugguaauguagcauuuauuuugcuaaauugaaagggaacauagauggaauuccaaaauauguacauucagcuguuugguuuuucguuuuucauuguuauuauugugagaaugcuguuauugggguugugugugagugcccgucagccagugaugccucgggccacgcuguggggccaccucaguccugccuggguccuggugccuuggaccccacgugcuuguggccaggcugccccugggcagggccauguggccucagaccacaagagcggagcugcccuggcccaagcacugcagcugccugcacccccgggcuucgcagccuugcuuguuuucucugaacagcaacagaacaguguucacagcgauucaaaggguggcauuggguuggacguucuggguacaagccaaccuagucccacguuguacgugaauguuuaaugugcucucaaaacauggaaaauaaguuuagugcacauagcuaaaucacaaaacauccaauuucucuguuuccucaggaagucauuacugcgccaccacaucacaugaccuuaacaugaucaauguauuucucugccuugacauuuaaauacauaaauugagauaaguagauuagaaaaucauucaaaugauaccauaauuuguacgggacagggugcgggcaauggccacguggccaaggcccugcaggaacgcgccgaggucucccucacccuccagguguccuucgcacccaacagugcgucugaggaacgagcugcaguuugagcguuccccugagaugugcguagccuccguguaaauguccacucccauggcuuaauugccuaucagacgcauuuucccagacgaaagcaauguuggguuggggaagacagugcagccacccagccuuuaccagcagcguacggcagacgaaggcagucgagguguggaggugaucacgaagauacauguguuugacuguuuaauuugaaaguuuacauuuuuuaugcuuuguguugguguguaauuuuuguacucuugguggcuaguuuuugucaaaucuuuuuuggaauauugcuuaaauguuuugauuuuaugauagugaagcuuguauucaguguuuugccaauuaauauuauaugcuuguaauaaaagcaaaagaaaagcuuaagugaaaguguuucuggcuggaaauguauuacauaaaucauuuguaugagcaugagagaugacuugcucaugggaugagcaaugcuguggguauuggauggaccacucaggcagccuggccgcacacacacacaugcaugcuacauauguguacgcucagaccacaugccugcacauauguccacacaccagcccacggcucccuuccucaccccagcccuccccacucccagguuaaccaaugucucgauuugcuucaggcggcauuuguaaacugucacccugcuugcaaacccucauuuaaauugguccagcauuugcuaccagaguuuaggccacaaacuuuguaaagcucaguuugucuccuugcagaaagagguugcugcaguuuggagcugguuaugccaaggaaaauacggcuaaaaaagaacuuacugauucccauaggugugucaacugacaaaugaauguuccaucucccuacgacaauuugcugccccuccccaaaaaaagcacuauggccaaaauuucaguuuuuaaagguuaaguaa

SEQ ID NO: 191495 - RNA, 47267 nt, Homo sapiens
agcugagggagccgcaaugucucuugacagcggcggcggcgcagccgguuccggguucggcgcggggcggggguaagcgcggcuggcgagggggcugcggcgggcggcgaagggggaccugguugcggccgugggagggggcgcccgccggcguccaggccgggcugcggggcugcgugggcgcgggcggccgggccggggcccgcgggguggggcgggcgccgagucucggccucuggggucgggagucuccaugggcguuuccggggucuccgcagaugugaaucccgauggagcggcccgaggaaggcaagcagucgccgccgccgcagcccuggggacggcuccugcgucugggcgcggaggagggcgagccgcacguccuccugaggaagcgggaguggaccaucgggcggagacgaggugcggggcugaggccggggccgggggccggggccgggcagagccaccggguugcgggcaggccacacgggcggcggugcagugugcgcuccagauuuuuccguggagugaaaugucauguaagaacugguauuuauucgguguucugcccaccgauucuugcgcaugauucacgcacaucauuuagccuucguuacaacuguauaaguuaguuguguucauauacucuccagaaugcaauauugucacguucguugccguacagaguaucuuuucugacuguaauggaacgaaauuaaaaauaauagaaggaaaaguggaaaauucacagauauguggacaugaaacaccacacucuuaaagcaaccggugggucaaauaagucuuuacaacggggaccuuguuuugagacaaaugaaacaaaaauagaauacaccaaaagguauuuaggaugcagccaaggcaguacucagagggaaauuuauagcuguagugcuuauauuaaaaaagaucucaagucccagccccuagaauauuuauuuauuuaauaaaccuggaaagcuaaaaacuugaacaaagucauacaacgggugagagaaaguucccucagccuccacauucacugccuccagucucccaagugaccaucugguuguuugauuuccucugaagccuuuguauggggagagaaaugcgcugguccugucaacaaaaauguuuaguuugucugaaaauuaaugaauuagcuccgacauuauacucuaaaaaggagcgaggaugggaaauauuugcuguuuggaagcaauuuuuuuuuuuuuuuugguuaauuucaccccuuauaaugugcuugcaccugguuuuuuuuguuuuuuuguuuguuuuuuugagauaagagucuugcucuguggcccagacuggggugcaguggugugaucucagcucacugcacccucugccucccgguucaagugauucucccgccucagccucggaguagcugggacuacaggcgugcgccaccaugccuggcuaauuuuuguauuuuuaguagagaugagcuuucgccauauugcccaggcuggucuugaacaacugaacuaaagugauucaccugcuucggccuccgaaagugcugggauuacaggugugaaccacugugucugaccugguuuuguuuuuugggguguuuugguagucuuacauuccaguaucaagucaaaguuuauuuuacaacuuugaaaguauuuagauaucaucauaacauaucaaaauuaucccuuuaagacaagaggaaguauuugaagauuuuucccuuugucuuuacuugauagacuaggagguuuggugaagagcagaggcccuagagacaaauuauguggguuuccaaucugucaacacauuacucugggcuaacgacaucuuucugcgccuauguaccuacuucauagauuugcucugaggaguuaaugagaucauacacggacugcuuagaaggaacuuuagcguuagcacuuagcauuagccauuguuauuguaacauguuauacauguuauuacaugguaggacauuacauguuaagacaaggagagaaaauaugucguugaguuuaucuuuuaauaggaacgauuuuagugaauuuauaaauaauguugccagcaaaaacuuuaagauuauuguauuaguuuguucauacuaccauagcaaaauacuacauucuggguggcuuaagcaacagaaauuuauuuauuuauuuauuuauuuauuuauuuauuuauauauuuuuugagacagagucucacucuaucacccaggcuggagugcaguggcgcgaucucggcccacugcaagcuccaccucccggguucuugccauucuucugccucagccucccgaguagcugggacuacaggcgcccaccaccacgccuggcagugguauuuuguauuuuuaguagagacgggguuucaccauguuagccaggauggucucaaucuccugaccucgugaucugccugccucagccucccaaagugcugggauuacaggcgugagcuaucgcgcccggccagaaauuuauuuuuuauuuuauuuuauuuuuuuaauuuuugagauagaguccugcucugucacccaggcuggagugcaguggcaugaucucggcucacugcaacuucccucuuccagguucaagcgauucuccugccucagccucccgaguagcugggacuacaggcacguaccaccacaccuggcuuauuuuuuucuauuuuaguagagaugggguuucacuguguugcccaggcuggucucgaacuccugagcuccagcaaucugucugccucggccucucaaagugcuaggauuacaggugugagccacugugccuggccagaaauuuauuuucaugguucaggaggcugggaaguccaagaucaagguguuggcagauuggguuccuggugagggcucucuuggcuugcagguggccacuuucuugcuguguccucacauggcagagagggggacucugcuugcucucucugccuccucuuaagagggcaccagcccugugacaucugauucccaccuagugaccucauuuaacauuuaucagcucacaggccccauuuccaaauacagucacauuggggauuaggacuuaaauauaugaauuuuagggggguacagacacucaguuacaaacauucaguuccuaacaguuguagaacuugauuauuuuauuuauuuauuuuauauauauauauguauuuuuuuuuuugagacggaguuuugcucuuauugcccaggcuguagugcaguggugccuucuuggcucaaccuccaaccucccggguucaagcaauucuccugccucagccucccgaguagcugggauuacaaguaugugcuaccacgcucagcuacuuuuuguauuuuuaguagagacgggguuucuccauguucgucaggcuggucuugaacuccugaccucaggugauccacccgccucggcuucccaaagugcugggauuacaggcgugagccacugugcccggccugauauauuuauuuuuugagacggagucuuacucugucacccaggcuggagugcaguggugcgaucuucacucacuacaaccugcaucuuccagguuaaagugauucuccugccugagccuccagacuagcugagauuucaggcgugugccaccacaccuggcuaguuuuuugguauuuuuaguagagaugagguuuuaccauguuggucaggcuggucuugaacuccuggccucaaaucaaaugauccaccugccuuggccucccaaagcguugggauuacagccaugagccaccucgcccagacagaacuugauuauuuuaaagcaaugaugugccugccauuuauaaggcauuauuugggggaaaagggaaagccuagguaacguguaggaaggggugcaacaaccuuguuuucccaaagagcucuuuauccagucuggagugcaguggcacgaucucggcucacugcaagcucugccucuuggguucacaccauucuccugccucaaccucccaaguagcugggacuacaggcacccgccaccaugcccggcuaauuuuuuuuguauuuuuaguagagacaggguuucaccauguuagccaggauggucuugaucuccugaccucaugauccacccgccucggccucccaaagugcugggauuagaggcgugagccacugcgcccagucuuuuuuuuuuuuuuuuugagacggaguuucacuccuauuucucaggcuggagugcaaugaugugaucucggcucacugcaaccuccgccucccagguucaagugauucuccuuccucagcauccagaguagcugggauuacaggcacucaccaccaugcuuggcuaauuuuuguauuuuguagagacaggguuucaucauguuggcuaggcuagucucuaaguccugaccucaggugauccucccgccucggccucccaaugugcugggauuacaggugugauccaccgcgcccagccaagagcucuuuauucuaagagaguggcagaaauguacaucaacugcuugaaagauuuaacccaccaagcgucaagcgcagcaaaugcugugaauagaacuuuagcacaaagcaucucgguuccagauuagaaugcugauauucaggccaggcacgguggcucaugccuguaaucccagcaguuugggaggccaaaacaggaggaucucuugacccuaugaguuugagaccagcuagggcaacauagacccuguaucuacaaaaacuuaaaaaauuagcugagcgugguggugcauauugguagucucagcuacucaggaggcugaagugggaggaucacaugagccugggaguucaaggcugcagugagcugugauugcuccacugcaccacagcugggguaacagcgcaaggccuugucucaaagaaaaaaaaaaaaaccugauguucuggcauggagacgccucuguuacaaacuggcucuggcgacaccgugacuugcacugguuuuggggcuugaaggagacuguccuggcaguuaacgcucaauggaaugggaagagcuugaccacaggugauacuugccuuggauacaguacuuccaauaguacagaauguuugcacaaauaagauuuuuaauauccgguuucauggcaguaucauuuacuuguaguaaaauucaccuuuuuugggguucaguuccaugaguuuugggaaauguacucaccagugcagucaagauguagaacauguucgucacccugaaaggucccccugagucccggcuccuggcagccacugaucugguuucuuugccuucugcugcuuccagcgugucgugacacagggucacagggugucugccaucaucuucugcgccuggcuucuuucccuggcacgcaccuuguugcauggaugagcaguuugcuccuuucuguuaccggguaguguucugugguuuggaugcaccauggcuuguuaguuuacaaccaguggauggacauuuauacugcuuccuguuuuuguaagaaauaaagcuaauauaaacauaagugugcagucuuuguagggacauacauuuuucucuuagcuaaguaacuaugaauggaauugcugggccacguggccagugucuguuuaacuugcugagaaacugccgcauuguuucccaugugcuuguccauuuugcagucccacagcacaguacgagaguuccagguuuuccacuucccuuuuggccacuuguagguggucagucuuuuuuuuuuuuuuuuuuuuugagacagcgucuugcccugucgccaggcuggauuugcaguggcgcaaucucagcucacugcaaccuccgccucccggguucaagccauucucuugccucagccuccugaguagcugggacuacaggcacgugccaccaugcccggcuaauuuuuuuguaucuuuaguagagacgggguuucaccauguuggccaggauggucucaaucucuugaccaugugauccgcccgccucggccucccaaagugcugggauuacaggcgugagccaccgugcccggcccguggucaguauuuucagccaauucuuauuugguguguagugguauuucaugguuuuaauuugcauuucucugaagauuaaugauguugagcauuuugucaugugcuuaauuugccauccauaucucuucuuugauaaaguguuuaaauuguuuuaaguugcauuauuuacuuucuauuuauugaguuaucagaguucucuauacauucuggauacaagaucuuugucagauauguguuuuacaaauauuuccaccaguccauagcuugucuuuucaucuuuuuaaacaauaucuuugaagaacagauuuuuacuuuuuuuuuuuuuugagauggagucucgcucuguugccaggcuggagugcaguggcacgaucucagcucacugcaaccuccaccucccauguucucccaccucagccucucaaguagcugggauuacaggugcaugcuaccaugcccggcuaauuuuuuguauuuuuagucgagauggggucucauccuguuggccaggcuggucucgaaguccuggucugaagugauccgcccgccuuggccacccaaagugaugggauuauaggcgugaaccaccgcccccagccuuacuuuuuuuguuguuguugagccagagucucgcucugucgcccaggcuggagugcaguggcgugaucucggcucacuguaaccuccgcuuccuggguucccaccauucuccugccuuagccucccguguagcugggauuauaggcgcccgccaccaugccuggcuaaguuuuguauuuuuaguagagacuggguuucaccauguuggucaggcuggucuugaacuccugaccuugugauccgcccgccucggccucccaacgugcugagauuacaggugugagccaccacgccuggcccagaauugacuuuuuuuuucuuuuuuugagucggagucuugcucuguugcccaggcuggagugcaguggcaccaucuuggcucacugcaagcuccaccuccuggguucacgccauucuucugccucagccuccugaguagcugggacuacaggcgcccgccaucacgcccagcuaauuuuuuguaguuuugguagagacgugguuucaccauguuagccaggauggucucgaucuccugaccuugugauccgccccccccuuggccucccaaagugcugggauuacaggugugagccacggcaccuggcccacauuuuacuuuugacaaaccucagcuuauuauuauuauuuuuuccugguuugugcuuuuuauauccuaucugcgaaguccaugcaagacccaacggcacuaagauuuuugccugucuuuuccacuggaaguuucauaguuuuagauuuuacauuugucucugucuggccauccuuacacagccacaauacuguauuguuuacuauagcaugaugguaagucaguuaaguaauaugagucuuccagcuucauucuuuuucaaaauugcuuugguuuuucuacacguuuuuucugugaacuuuagaaucagcuugucagugucuacaagcccucugggauuuugacuggaauugcauugaauguaugaaacaaucuggaggacagcugacauuuuaacaauacugagucuucugauucacacacccauaggucagugaugggagcaaggcucaggcuaaagcagauucagggugucuuucuguguggaacguuuaggaaaaguauguuugcaugccacugucuccugaccaaacccuucgcuuuuuugucuucuaguaucuuuauguauccuuauagauuauuauaggcaguaaugauuaaugaugagauauuaaaacgccuuuguucuuuugauuuaaggagagggcaaguauugaggauuuucccucuugcuuuuguauucagggccgggcgcugguggcucacgccuguaaucccagcacuuugagaagccgaggcgggcauaucacgaggucaagagaucgagaccauccuggccaacauugugaaaccucaucucuacuaaaaauacaaaaauuaacuggcccugguggugugcgccuguaaucccagcuacucaggaggcugaggcaggagaaucgcuugaacccgggaggcagagguugcagugagcugagaucgugccacugcacuccagccugggccacagaaagagacuccgucucaaaaaaaaaaaaagaaaaaaaaaaucccaaagugucagaauuacuguauucagcuauagaugcaucccuguauauaagaugcaguuucuuauacguguacaaaugccuaucgcaggccaggugcgguggcucaagccuguaaucccaacacuuugggaggcugaggcggguggaucaagaggucaggaguucaagaccagcauggugaaaccccgucucuacuaaaaauacaaaaaauuagcuggguaugguggcgcaugccuguagucccagcugcucaggaggcugaggcaggagaauggcuugaaccugggagguggagguuguggugagccgagauggugccacugcacuccagccugggcgacagugcgagacuccaucucaaaaaaaaaaaaacaaacaaaaacaaaaaaaaaaacaaaugccuaucacaguuggcucagucacuuuuucugugacugucauugcuucaauuuuauguugauuuaugaaaccuaaguuuacacagaaaagaaauuaaggacuaaauuaagauacugaagaauuacuuaagccccugaguuuuuuuuuuucuuuuuuuuuuuuugagacagagucuugcucugucacccaggcuggagugcaguggcgccauaucggcucacugcaagcuccuccucccggguucucgccauucuccugccucauccuccugaguagcugggauuacaaggcgcccgccaccacgcccggcuaauuuuuuguauuuuuaguagagaugggguuucacuguguuagccaggauggucucgaucuccugaccuugugaucugcccgccucggugugagccaccggaccuagccaacccccugaguuuuuuuaaaguucuaauaauacucaucagguuagcuguguaugcaagcauauuguaaaauugcuuuuuuuuuuuuuuauuuccaguuggagucuagcucugucgccaaggcuggagugcaguggcgcgaucucagcucacugcaaccucugccuccuggguucaugcgauucuccugccucagccucccaaguagcugggauuauaggcaaccgccaccaugcccagcuaauuuuuguauuuuuaguagauaugggguuucacuguguuggccaggcuggucucgaacuccugaccucgugauccauucaccucagcuucucaaagugcuggguuuacaaguaugagccacugcgccuggcuguaaaauugccauuuaagaggcuguguguaacuggagguauugaugggugucuuugagaggguggggauucagaaagguucaggaugggccgggcgcgguggcucacgccuguaaucucagcacuuugggaggccaaggugggcagaucaugaggucaaaagaucgagaccauccuggcuaacauggugaaaccccgucucuacuaaaaacacaaaaaauuagccaggcgugauggcgggcgccugcagucccagcuacucuggaggcugaggcaggagaauggugugaaccugggaggcggagcuugcagugagccgagauggugccacugcacuccagccugggcgacagagcgagacuccgucucaagaaaaaaaaaaaaauuucuuuaugucuuucuuggucaaguguuuuuuuuuacauauguacaauggggauccugaguuggaaccacauacuuugguaaacaaagugcaguaguguucacaguuaccacgaucauaucccguguugacccacccucucuuuuuuagguugcgaccuuuccuuccccagcaauaaacuggucucuggagaucacuguagaauuguaguggaugaaaaaucaggucaggugacacuggaagauaccaggugaguauguucugagcuucuuuugguguuucuucuuguagcuuaagaagccugacuucgugcucugugcugugugccacggcugaggaggagaagaaaugcugucuuuagugugauaacagcggcucauuuuuauaacagcacagucaugugucccuuagcaacagggauccagucugagaaaugugucagacaauuugaucaucuugcaaacaucauggaguauacuuaaacaaaccuagaugguguagccuacuacauaccuaggcuauaugguauagccgauugcuccuaggcuaucaaccuauacagcgugcuacuguacugaaugcuauaggcaguuguaacacaaugguaagaguauuuaucuaaacacagaacaggugcaguaaaaauaugauauuuuaaucuugugggacuccuaucguauaugcgucuguugaaaaaaacauuauuaucagcccgggcgcgguggcucacaccuguaaucccagcacuuugggaggcugaggcaguuggaucaccugaggucaggagcucaagcccagccuggccaacauggagaaacccugucucucuuaaaaauauaaaaauuagccgggcguuguggcaugcgccuguaaucccagcuacucgggaggcugagacaggagaaucacuugaacccgggagucggagauuguggugagcugagauggcaccacugcacuccagccugggaaacgagugaaacuccaucucaaaacaaaacgaaacaaaaguuuauuaucuggggcaugacuguaguuaauuaggcucccaagguauuagaagauguauuuccugguuuccaggaugggacacuuagugacacuuuggugucuaugacccuucuugaauguauucaaauuaaguaugucucagaaauaagacuuaaaagaugcugguaauuuuugguucuugcaagccuauucaaguuugauuucuuucccucaaaucaaaaaaucauuuuuuaaaacuaauaaauucucguucuuguacaacugaaguacagauugaguaucugaaaugauugaaacuagacuguuuagauuuuggauuguuucagauuuuagaauauuuucauuauacuuaccaguugagcaugucugaaucaaaauucugaaauguuccagugaguauuuuuuugagugucuuguuggugcucaaaaaguuuuggauuucacauuucugauuagggacauucagcuuagggauauucaacuuggaaaguggaaagcuuuccaaaauccuauucauacguuaaaaaugcauauguugguauauauauuuugcauaaaugcaaucacacuacacauacuguuguagcgucagcuuuuuucuuucuuucuuuuuuuuuuuugagauggaguuucacuguguugcaggcugaagugcagugguacgaucucggcucacugcgaccuccgacucccagguuccagccauucuccugccccagccucccgaguagcuggcauuguaggcacacacuaccaagcccggcuauuuuuuuguguuuuuaguagagacgggauuucaccaugcuggccaggcuggucucgaacuccugaucucaggugaucugccugccucagccucccaaagugcugggauuacaggcgugagccaucgcgcccggccagcuuuuuucacuuacgguguuuuauggagcgcuucacaugucacugcaucuacauccagcucaucuuuucauuaucuuaggauaguuucuuugucacuucccuuauugguggacauuuauuguuuugacuuuuucuuacuauaaauaacacugcagugacucuuucccaaacucugccuucaugucuguuuucuugggaugauuucucggaagggaagucugugucaguguuacucagaaugugccuauuccuuuuuuucucuuuuuugagacggagucucgcucuguggcucaggcugaagugcuguuggugcgaucucggcucacugcaaccuccgccacccggguucaagcgauucuccugccucagccucccgaguagcugggauuacaggugcccgccgccacgccuagcucagaugggguuucacaaugcuagccaggcuggacuugaacuccuggccucaggugauccaccugccucagccuccccaagugcugggauugcaagugugagcccccacacccggccagaaugugcgucuuuuaaaucugcugcaaguggcagguggucuucuagcaguauguugagagugugcuguucucacugcaggauuuuuuuuguuugguaaagaucaggcucugugagauucuuugguaacugauaguuucagggauagaagacuaggaaguagguuuuaauaggaagaacugaugcuccguuuccuagucuaauagauaucagauuaaguucucuauuucuuggcacaaugggaaaggcagggugcuggucccuagcugucccgccugcuucagggccuggcuuccccaugcugggugcugguccugggcuuuccugccuacaucagggccuggcuucuccacgcugggugcugguccugggcuuucccgccuacaucagggccuggcuuccccgugcugggugcugguccugggcuuucccgccuacaucagggccuggcuuccccgcgcugggugcugguccugggcagucccgccuguuccagggccuggguucccugcacugggugcugguccugggcagucccgccuguuccagggccuggcuuccccacgcugggugcugguccuggguagucccgccuguuccagggccuggcuuccccgcgcugggugcuggucccgggccuuccugccuguuccggggccuggcuuccucgcgcugggugcuggucccgggcagucccgccuguuccggggccuggcuuccccgcgcugggugcugguccugggcagucccgccuguucuggggccuggcuuucccacgcugggugcugguccugggcagucccgccuguuccggggccuggcuuccccgcgcugggugcugguccugggccuucccaccuguuccagggccugguuucccugugcugggugcugguccugggccuucccgccuacaucaggaccuggcuuccccgcgcugggugcugguccugggccuuucuaccuguuccagggccuggcuuccuugcgcugaaugcugguccugggccucccugccuguuccagggccuggcuuccccacgcugggugcugguccugggccgucccgccugcuucagggcauggcaucccugugcugacugcaugguggugguacuuucuuauggcuauuguaauuuaccacaagcuuaauggauuuaaaaaacacaaauuugcugucuuacuauaguuauggagguccagaguccgauaugggucugauggggcuaaaauccaggucugaacagggcugguuucuucuggaggcuccaggggagaauuuguucucugccuuuuccagguuccagaggugccacguuccuuggcagaggugggcuggaggggaggggugcucaggcagaaggaaccacguguguaggggccccugagcauaagcagggcuguguggucggagcguguggugagcggcaaagucacacaagggagcuugggcuuuagccugagagcagugaggagucaucaaagggguguaagcggaggagugaaauaaucagauuuuuguuuggaaagaacaggaggaugagugauggcugcagucgccccucggcaucuggggggauuggcuccagcccccugcaugcacccaaguccgugcacacucuagccccguagccagcccuguggagcaggaggacacagaaagucaguccagcuccagcgccccugcaugcacccaaguccgugugcacuccagccccguagccagcccuguggagcaggaggacacagaaagucaguccagcuccagcgccccugcaugcacccaaguccgugugcacuccagccccguagccagcccuguggagcaggaggacacagaaagucaguccagcauaugugugggauucauucccucucauugaaaaaaacccguguauaagugcaucugcacagcucaaaaccgcaucuuccagggucagcuuuguguuguaacagcagaacucagacacacacagccacugccugguuucggagguuuuacggggagacggcuguggcaguucauuugcuuacugucugcauuugcuuuccugcuacagacggcagagcugaguaguggcaauggugaccacaaaaccuacacuguuuacccucuguuuauggaaaucguuugccacucccaucccucagcaaaccgugguggucacucggaugugaguucuguccacugcuggggccucgggagugaagcugcagagcugaggccugugugguuucagucguuuugcccgguugccguuuugugugucggguaugcugugcucuuggaucuuggucaccugaccaacaccugauuugcugucaggucucugcucagaaguccccaggaggcacuuccugccccaucaacuuagccuccuccugucugucccugggucagcagcaucugcauuggccucucccugggcagaguaccucaaggggcuuggcagccagaccacaagcucugagugcagggccauguccugcagcugacggcccagcauuuaguccgcuucugcccagagccagucucuugggagggaucaguacucauuggaggcaugaguucaccgggguugugauggcugcaaggaacagaacuguggauagcacaaguccagcucaggggaggcuggagguggaagcaccacacuguagacgaggccuccggguccacuaggaggcaaacggggagagaacccagcccugcagcagcagagcugccaagcacgugaggagguguaguggcugguuaggcugucagucagggagaagugggcgagccauuucuugagagaauggugaggggugcguggaugugugcaucguuacguauuuacacuguuccuaugaguauuuccagaguggucauaucgagcugcuugcuaauggugcuagaaaaaaaaucuuguaacuccaaguuauuuuaaguagaauaaauuguguuuuuguuuuuuuacagcaccaguggaacagugauuaacaagcugaagguuguuaagaagcagacaugcccuuuacagacuggggaugucaucuacuugguguacaggaagaaugaaccggaacacaguaagagagaggaaggcuugccggggucagacccgcacgggggugcacgugagggcgcucucugaacguuccuccuggcuacaucccuucccauaggaacguuccuccuggcuacaccccauuucuugcucacauggguuccugccgugaauagugucuguugagugggagugucgacuuugcagccugagcccagccauuccucaggaauaccacuguggccaugagcagccaaucccaaaauggcagccaaggagaaacugauggggaugguuuggguucuacaggagaagaacuugaguuauggggaauaaaaccuaggaccaggggucuggaggccauugaugguucugcuuuuggagaccuuacaagaaacaucaaagguuagacuggauuccaguaaguuuuuucagcuccagaagucccguuuuuguuuuguggaagaacaguauaggacaaggaaaguuaugggaguccuucgaaggucaccccugaaauacuuuuuuuuuuuugagauagaguuucgcucuuguugcccaggcugaaguguaauggcgcaaucucagcucaccgcaaucuccaccugccggguucaagcaauucuccugccucagccuccugaguagcugggauuauaggugcccaccaccacgcccggcucauuuuuguauuuuuaguagagacgggguuuugccaugcuggacaggcuggucucaaacucccgaccucaggugauccacccaccucaaccucccaaagugcugggauuacaggcaugagccacugcaccuggccaauacuuauuuauuuaauuuuuuaaauaaauaagagacagagucucgcucugcucuguugcggaggcuggagugcaauggcgugaucucagcucacugcaaccuccaccuccugguuucaagcgauucuccugccucagccuuccagguagcugggauuacaggugcacaccaccacacccggcuaauuuuuguauuuuuaguacagacaggguuucgccguguuggccaggcuggucucgaacuugggaccucagguaauccgcccgccucggccucccagagugcugggauuacaggcaagagccacugcaccuggccaccccugaaauaccuaaagaccacaguggugagggagaauggggcaaauaugucuuaggcaucuucagcauaaacuuaaccagccccuggccacacggaaggaucuuguaucugcuccuuuguguaguuugaaauuauaagugaggcauagauucuucaccuucuucugccuccugaugccauuuuuucccgaggcuuauuucuuuuguguugguagagauguuuuagauuacuuguuuugaaaucucuuaaacugaugaauuuguuauuagcugaugagucaaaauaaucaacaaaaacaaauggacuggagaacagaagagaaaaaugaguucucaguuugcacaggggccaccacuuuucugauuugauugauuuucuuuuagacguggcauaccucuaugaaucuuuaagugaaaagcaaggcaugacacaagaauccuuugguaaguaagaguguagcaaagaagugggugcauguuaggagcuauagcauuccuuuuguguuuugagauggagucucgcucuguuacccaggcuggagugcgguggcgcgaucucagcucacugcagccuccgccuccuggguucaagcaauuccccugcuucagucucccauuuuuuuuuuuuuuuuuuuugagacggaguuuugcucuuguugcucagccuggagugcaguggcgcgaucucggcucacugcagccuccuccugccggguucgagagauucuccugccucagccucccgaguagcugggauuacagguugcaccgucacgccuggcuaauuuuguuuguuuguuuguuuguuuguuuuuugagauggagucgcgcuuugucgcccaggcuggagugcaguggcgcgaucucggcucacugcaaccuccaccucccggguucaugccauucuccugccucagccucccgaguagcugggacuacaggcagucgcuaccaugcccagcuaauuuuuuguauuuuuaguagagaugggguuucaccguguuagccagguuggccucgaucuccugaccucgugaucuacccgccucagccucccaaagugcugggauuacagguaugagccaccgcgcccggcacgccuggcuaauuuuuauauuuuuaguagagacgggguuucaccauguuggucaggcuggucucgaacuccugaccucaggagauacaccugccucgacuucccaaagugcugggauuacaggccugcaccaccgugccuggccuuggggcuguugcauucuuaagagcauuucaaucccuagagugucugcuugagcccugguugugugcugcuucugcuccuuuuggguuacagaagcuaacaaggaaaauguguuccaugggaccaaagauaccucaggugcaggugcagggcgaggggccgauccccgggucccuccgucgucgcccgccacucaggugugcuuugaggaaccacagccaucaacaucgacgucagaccucuuccccacagccucggccucuuccacggagccuucuccugcagggcgagagcguuccuccaguuguggugaggucacaucucaugaggucuuggugcugguugcaugguuuuuguucacuacucuuuaccuguguuguuacagaggcagauaagcgacugaggacuggcaugagguucucaguagugagauuucuguaggagucaauauugaguguguuguucccuucacuucccaagagaagugaagaucagggacucuaguaccauuguguauuuugcaguuucauugagacuauaauucgcauaccauaaaagucauccagccgaaguguacauuucaguggauuuuaguacaucacaaggugugggaccaucaccacucauugacacgaaaaggaaaccggugcccaccagcagugacuccacauguccccuuccccucggccccaccagcagucacuccccauguccccuuccccucggccccaccagcagucacuccccauguccccuuccccucggccccaccagcagucacuccccauguccccuuccccucggccccaccagcagucacuccccauguccccuuccccucggccccaccagcagucacuccccauguccccuuccccucgaccccagcagcagucacuccgcauguccccuuccccucagccccagcagcagucacuccgcauguccccuuccccucggccccaccagcaaucacuccccauguccccuuccccucggccccaccagcagucacuccccauguccccuuccccucggccccaccagcagucacuccccauguccccuuccccucggccccaccagcagucacuccccauguccccuuccccucggccccaucagcagucacuccccauguccccuccccccagccccuggcagcugcgugugcuuucggccucuggauuuuucuguucuagacacuucacagacauggaaucaugcgugcucuuuuuuguuguuguugagacggagucucgcucugucgcucaggcuggagugcaguggugcgaucucggcucacugcaagcuccgccucccagguucacgccauucuccugccucagccucccgaguagcugggacuacaggugccugcaaccacgcccagcuaauuuuuuuuuguuuuuuguuuguuuguuuugagauggagucucgcucugucacccaggcuggagugcgguggcgcgaucucggcucacugcaagcuccgccucccacgccauucuccuggguccacgccauuuuccugccucagccucugaguagcugggacuacaggcacccgucaccacgccuggcuaauuuuuuguauuuuuaguagagacggaguuucaccguguuagccaggauggucucgaucuccugaccucgugaucuguccgaucggccucccaaagugcuaggauuacaggcgugagcugccgcgcccagccgugacugggcucuuucacuuagcgugguguuuucagaguucauccagaagaggauguuauuuaaaacuaguuuugcagaugcuguuccuuacggcaugacucuuaccucuuccauggucauugggaagaaauuccaucugggugcagcgugacgggaauguuuucuguuuucuuuuaggguuugucacguggaggauguguacauauggauucucuaaauuggaucgcgcuauacauauuauuuuuuuuuaauuuucuuagcuauucucuauucuagauuauguuuugaauuagcuuuuccaguuuaauagaaaaaucuuuuugagauuuuugauuuggggagaauugacaguuuuacagagcccaggaaaaugguguuucuccuuguuuguuaagcucuuccuguucuucagugaagucucacggcuuucuucgugucgucugggcucauucuuaguccuggagugcuuggcucucgcguucuuacauuccauagcagucugcagauuccuaugaacagaagagccucugaaucucagauuaggcuguguuucgaucugacaggaaagcugguucccugauaaaaaguccagaaaugcccgcucagcucagcuacuccugaggucaccagggccuucugugcacuccacgcugcuguuuuugcucagguuuuugccucgagguuucacaguggcugccagagcucugaacaucacugacacauucauggcaggcaccaggaagccuccggagaagggaccuuugcuuuccauggaucuguuggcugauccgcagcagcaagagccaugucucccagaagacugcucccucugucucaugagccagccuggcugcucugcuacaggacacuccuuguuuuuaugucucucuguguauuccagugggauuuggggaaggagcggcaucgggugcagggacucagugugccuucuugaaaccagaaaccucucacgcucucugggccuguuuccacuucuguugaugugguuuuuacuccguuguaugccguugcucugucuucacacgggcagccacaccucuccuguucguugauguucuugaggccuuguugcauccgcuccuuccuucuucagaggcuccuuuggaugagcccagcuccucagcagcagagugcucuuuauuuucuguuuuuuugagacagagucuugcucuguugcccaggcuggagugcaguggcgcaaucucggcucacugcaaccuccgccucccggguucaagugauuccccugccucagccuccugaguagcuggggucacaggcgcgcaccaccaccacgcccagaaaauuuuuguauuuuuaguagagacguuguuggccaggcuggucaccaggagcagaguguucuaaaagcauaccucagucugauggaugacaucccagccaucugaagaguaacauccagauguguuguaacauuccaguguguuguaacauuccuguaacauuccaauguguuguaacauucugguguguuguaacauuccuguaacauucugguguguuguaacauuccgguguguuguaacauuugguguuacgcgguguguuguaacuuucugguguguuguaacuuucugguguguuguaacauucugguguguuguaacaaucgcgguguguuguaacauccgguguguuguaacauuccaguguguuguaacauuugguguuacaugcuguguuguaacauucugguguguuguaacauucccgguguguuguaacguuccaggguguguuguaacauuccggugugguguuccggucuguuguaacauuccaacauuccgguguguugguguguuguaacauuccaguguguuguaacauuugguguguuguaacauuccgguguguuaacauuccgguguguugucacauucugguguguuguaacauucugaugugauuucgggacucaccugggaggacuucucaggugcuaauuggggacacuaaguugcaggcaagacuguggagagugagugcuauguaguuuccaccugauauuucuggagauaagaggaacagcggagaccaaacccaugacagacaaguuucuacuagccugucuccuguagacuaaacacaaccccggcuucucagagccucuuugauuuaccuuuguuuuaacaucauaaccuuaaauuuaugagugaaagaaaauaacacuucaagaugaaagcaucucagcacugggcacaguggcucacgccuguaaucccagcacuuugggaggcuaaggugggcagaucccuugagcccaggaguucaagaccaguuugggcaacauggugaaaccguaucuuuacaaaaaauacaauauaaaaaauacaaaaauuagccgggugugguggugcaugccuguaaucccagcuacuuggaaggcugaggagggaggauugccugagccugggaggcagagguuacaaugugcugagauugcaccacugcacuccagccuuggcaacaaagccagagcccaucucaaaaaaaaaaaaaaaaaaaaaaaagaccuguaaucccagcacuuugggaagccaagacaggcgaaucacuugaggucaggagcuugagaccuaccuggccaacauggugaaaccccgucucuacugaaaauacaaaaauuauccaggcaugguggcaggcgccuguagucccagcuacucaggaagcugagacaggaguuucaccugagagaggaggaucaccugaggcugggaggcggagguugcagugagccgauaccgcgucacugcacuccagccugggcgacagaccaggucucaaaaaaaaaaagaaaagaaaacaugccagauuugaauagccaccugaaugcugaaguuuuaccagcucucuugggcuguguacccuucaucguaucuuccagguuccuuaaaaccuacccuugggcacagcugggaugugcacuggcucuucacagcuagauccagcaugcacugacucuccccgugcagggacagccccagaggaauagagguggcguuccggccgcuccagcguggcccacagcguuucaagugcagcaagcacagacaggacgcgggguuacuaguauuuuggauugacugcagauuuugaacugucugccuagaugaacuauaccaugucccuagggccaagucccaugugcauuuuguggcuacuagacccucuucagaaaucaaacacaaaauagcucuggccuguaaagaaaacaaacuucaccaguaaaauuguuuccuguuccuauccaccaaugugcauagcacaguguguagucuggguaauacgguuugcauaauuuuuugauaauguucuacuuaaaaagggcagcguauuuauauauuacuuauguaauuaaaaaaaaaauucuucuggccgggugugguggcuuacgccuguaaucccagcacuuugggaggccgggugguuggaucgccugaggucgggaguucaagaccagccuggccaacauggcaaaaccccaucucuacuaaaaauauaaaaauuagccaagugugguugcgggcgccuguaaucccagcuacucgggaggcugaggcaugagaaucucuugaacccaggagguggagguugcagugagccaauauccugccacugcacuccagccugggugacagcacaagacucugucucaaaaagaaaauaaaaauaauaaaaaauaaaaauucuucuaucuguaugccuaaguguaugcauacuaacaaaauaaguauaguuacugcuuauugagcagcuacuaaaugugaggcagugugccagguacauucuguaagugguaagauggugcuccucuccacguuggcugagcacggggcgcuggagaugauggcgugagugggugccggcugggggccggcccacaggcugucucuuuccuucuguucguauaugaggugguuuguccccaaaacuauucuguuuucuuucagcugcuguaagccaguuucuuguguuuuuuuuuuucaaauaauaacacuuacauuugaauacuguaagcuagauauguauuaugcuguaauaugauaaacuaagucuuuauuaagauauagguuauucacaccuguaauccuuauucacaccuguaauccuuauucacaccuguaauuccagcacuuggggaggccgagguggguggauuguuugggcucaagaguuugagaccagccuggguaaaauggcaagacccugucucuaccaaaaauacaaaaaacaauuuagcugggcaugguggugcacaccuguagucccagauacucaggaggcagagguggaaggaucgcuuuagcccaggaggcagagguugcagugaaugaagaucucgccacugcauuccagccugggugaagagugagacccugucucaaaaaaaagauagaggugauuagaaagucugccuguuuuucugccaaggucauuccugucguuaugacucuggcuucuugcucguggagauagcgcucucccuacaagucacugugcuguauccuucccguuaucacaccucuuguaaaauaguucacacgcagcaccaucuccacccguuggaagcuaugcaucccuccacuggagcaucugugcuuuacacagacuucuguuuuuuuuuguuuguuuguuuuguuuuacuuuguuuuuuugagacggaauuuugaucuuacugcccaggcuggagugcaauggcgcgaacuucguucgcugcaacuccgccuccuggguucaagcaguucuccugccucagccucccaaguagcuggguuacaggcaugugccaccacacccggccaauuuuguauuuuuaguagaaaugggguuucacuguguuggucaggcuggucucgaacuccugaccucagaugauccacccaccuuggccuccugaaguucugggauuacaggcaugagccaccgcgccuggcauuuuuuuuuuuuuuuuaagaaaugaggucaggccgggcgcgguggcucacgccuguaaucccagcacuuugggaggccgagguggguggaucacgaggucaggagaucgagaccauccuggcuaacacggugaaacccugucucuacuaaaaauacaaaaaauuagccgggcgugguggcgggcaccuguagucccagcuacucaggaggcugaggcaggagaauggcgugaaccagggaggcagagcuugcagugagccaagaucacgccacugcacuccagccugggugacagagugagacucugucucaaaaaagaaaaagaaaacaaaagaaaugaggucuuggccaggcacaguggcucaugccuuuaaucccagcacuuugggaggcugaggcagguggaucaugaggucaggagaucgagaccauccuggcuaacacggugaaacccugucucuacuaaaaauacaaaaaaauuagcuggguaugguggcgggugccuguagucccagcuacuugggaggcugaggcaggagaauggcgucaacccaggaggcggagcuugcagugagccacugcacuccagccugggcaacagagcaagaguccgucucaaaaaaaaaaaugaggucuugcucuguugugcagguugggagagugauguggucauggcucacuguagccucgaacucccgggcucaagugauccacucaccucagccuccugaguagcugggaccauaugcucguacugucacgccuaguuaauuuuuuuuucuuuuuuguauuuuuuguagagauggugccuugcuguguugcccaggcuggucuaaaacuccugggaucaagugauccucccaccuuggccucccaaaguauugugauuacaggugugagccccaugcccagccucagaccucuauuuuuuauuuuuauuuuuuuuuccccagagggaguuucgcucuuguugcccaggcuggagugcaguggcacgaucuuggcucacugcaaccuccgccucccggguucaagcaauuuuucugccucagccucuugaguagcugggacuacaugcacucgccaccacgccugucuaauuuuuuuguauuuuuaguagagaugggguuucaccauguuggccaggcuggucucgaccuccugaccucaggugauccacuugcuucggccucccaacgugcugggauuacgggugugagccaccgcacccggcccaaagcucuguuguaacaaguuuaugacacaguguguaucauaugaccacggguauguggguuugcccugcguuagacucggugcucgagggcuaagccuggucacagacaucuccgcauuuguuucucugcaaaugggcuccuugcccccagcuccaccccacguagagauaggcacaaauagaguuaagaugugaguugagugagcacacacuccucguaagccacuugucauuccuaaacuacgacaucucaggcugccagcugcacugggcuccagucagugacaccuuacaggcaugguucucuccugagcuggauggaucagcaccuaucuuguuugauuccucucacagggucugggggugguggcaucuccccuaaaggaaguggucccucuguggcaagugaugaagucuccagcuuugccucagcucucccagacagaaagacugcguccuuuucgucguuggaaccccaggaucaggaggauuuggagcccgugaagaagaaaaugagaggagguuagugucugguuguguguguccucaguccucucgugugcuccuggggcaugcgggggccgcugccaugcuccgugcuguggggcauugcuuccugcaggggcauguggacccugccucagguugaugccuguaacaccuccggcauuuucauucagaaaaccugggccuguuuuuuugcgguuugcauaauccagauagaacugugauuugcuacaggcuguucucuuggucuggaaauagugcauucugaauugcagaauuaaucucaaaauccuccuuccuggccaggugcaguaguucauauccguaauccuaacacugggaggccaaggcaggagaaucacuugaggucaggcguucgagaccagccugggcgacagagcaagacuuuaucucuaaaaauaaaaaucaagccugacaccguggcucccgccuauaaucucagcacuuugggaggccaagguggacggaucaucugaggucaggaguucaagaccagccuggccaacauggugaaacuccgucucuacuaaaaaugcaaaaauuagcugggugugguggugcaugccuguaaucccagcuacuuggaaggcugaggcaggagaauugcuugaacccggcagguggagguugcagugagccaagacugugccauugcacugcagccggggcaacaagaacaaaacuccaucucaaaaaaaagaaaaucaaaaagaaagcccucuguccugguaggacaauaauuucuaaaaauguagcuuaaaucuucacauugaagaugauuuagggagaagucugcacuuugaaagccaaaguuaagauuauuagaaaacauuugggaauguuaugguagaagcauugcuguauagcaguccagagagcagccagccacuggggcacugugacaggaagguucuaggagggguccccagggaaagaaauuagguuaucugacacgugggguugaucgguguggggaagguguggaaagagucagcaacaguuacacaggaaaaauaagcacaggaaugaggaaauuuuaauucuagcaaacaugaaaaauuguguaagucacacaacuuaaucuaguaaacuacuuggcucagcagugaauacuugcauaagcauaauaauacaaauacaguaucaugaacuaauguaaucuguuaauguaauguuggcaggggugucucaggacagaguuuuucucuaccuuaauagaugucaggaaugaugucuaaaauugauaaaucaaauguaccaugauaacuuagaaacacagagguaaauaccagaagaaacagcucaaagacaugaaaauaguuuuccuccgaggagggaaauugggugaggagcggcugagacggagggugacugccuuuguuuucuucuaaauauauuauguauacauuuuuuuaagagacaggaucuugcuuugucaccuaggccagagcgccguggugcagucuuggcucacugcagccuccaccuccugggcucagacuguccucccaccucagccuuccgaguagcugagaccacaggugcacgcuaccauagcuggcuaauuuuuuuucccauuuuuuuagagaugggguuucauuauauugcccagacuggucuugaacuccugggcucaagcgaucugcccaccucagccucccaaagugcugggauuacaguugugagccauugcaccuggcuucuucuaaauacuuggcuuuuuaaauuguguacaguuucuuuaauuaaaaauaaaaauuaauugauuaccaacaucugagcauuauagaaaaauaaaaacaccagaagaggguggggcgcgguagcucacaccuguuacccuaguacuuugggaggccgaggcggguggaucacgaggucaggagauugagaccauccuggcuaacacggugaaacccugucucuacuaaaaauacacaaaauuagccgggcgugguggugggcaccuguagucccagcuacucaggaggcugaggaaggagaauggcaugaacccgggaggcggagcuugcagugagccgagaucgcgccacugcacuccagccugggcgacagagcgagacucugucucgaaaaaaaaaagacugcauguauuuccuucucgguuacgacaguuagaacacaucccuuucuccuguggacggggaccuugaccugaaccugcguguauuuccuucuugguuacgacagaacacaucccuuucuccuguagauggggaccuugaccugaacgggcaguuguuggucgcacaaccgcguagaaaugcccaaaccguccacgaggacgucagagcagcggcugggaagccagacaagauggaggagacgcugacaugcaucaucugccaggaccugcugcacgacugcgugaggugcgaccguguucacccuuggcucacggaacauggcacugcagguucuucgucccguguggggcagggcugggcaugagacaagccugcagguccuguuuggccuggcaucugcugagguuacucugucacccagauaaguggguggaguggguggaguggguggagcuuucucagcccacugcaaccucucccucccaggauugagcgguucucugaccucagccuucugaguugcugggacuacaggugcacaccacuaugccuggcugacuuuuuuuuuuuuuuuaauguucuaaauauuuuuuauuccuuuuuuuuuuuuuuuuuuuuuuuuuuuuuagauggagucucgcucugucaccaggcuggagugcaguggcacagucuuggcucacuacaaccucagccucccggguucagacgauucuccuaccucagcuuccugagcagcugggacugcaggcgugugccaccaugcccggcuaauuuuuuuguauuuuuuaguagagacaggguuucaccauguuggccaggcuagucuugaacuccugacuucaggugaucugcccacguuugccuccuaaagugcugggauuauaggcgugagccacuacucccagccacccugcugauuuuuguguuuuuuguagagacgguuucgccauguagcccggggugguuuuuuguuuuuguuuuuguuuuuuggaguuagagucucgcucugucacccaggcuggaguguaguggugugaucuuggcucacugcaaccuccaccucccagguucaagugauucuccugccucagccucccaaguagcugggacuacaggcaugcgucaccacaucuggcuaauuuuuuuguauuuuuaguagagacgggaguuucaccauauuagccaggcuggucucgaacuccugcacucagguaaucugcccaccuuggccucccaaaguguugggauuacagacgugagccaccccgcauggcuaccacuuucauucuacucguggcaccaacaaggaggaaaccuggaacccagagccggaggcuguagaccccacaaguuuugagugugugggucgugugugaccccgugaacucugcaaacagaugaaaggaacucugcacauuuuaaaugcuccuuaucugggaagguguauuucgcauagaaugaacguaggagccgcugaggaagggccuccuugcuuuuccgcgggaacucaagagugacaaccuuccaacuucugggccagaaacacuugcugucucuguuguuuguguuccugaagucauaaucuacucgccucugucuuuccugaaaacacagaggccguguggccucugauuucuuuucauuaaccaagacugacuuaaaggguuuuuagguugaacgauggcugggccccuguaggcccuuccgugguggggcugcugcggaccuuggucgagggucgcgguugcaucugugggacugucuggacacuguuccucuugcacuuucaguuugcagcccugcaugcacacguucugcgcggcuugcuacucgggcuggauggagcgcucgucccuguguccuaccugccgcugucccguggagcggaucuguaaaaaccacauccucaacaaccucguggaagcauaccucauccagcauccaggcaagugagggcauccacaccagcacccgggcacgugagggcggucccuccaccaccacccaggcacgugagggcauccacccagcagcacccgggcacgugagggcugucccuccaccagcacccgggcacgugaggguggucccuccaccagcacccgggcacgugagggcauccacaccagcacccaggcacgugagggcggucccuccaccaccaccugggcacgugagggcauccacccagcagcacccgggcacgugagggcugucccuccaccagcacccgggcacgugagggcugucccuccaccagcacccgggcacgugaggguggucccuccaccagcacccgggcacgugaggguggucccuccaccagcacccaggcacgugagggcauccacaccagcacccgggcacgugaggguggucccuccaccagcaccugggcaagcgaggguggucccuccaccagcacccagacaagugagggcggucccuccaccagcacccaggcaagugagggcauccacacaccagcacccaggcaugugagggcggucccuccaccagcacccgggcacgugagggcauccacaccagcaccugggcacgugagggcagucccuccaccagcacccgggcacgugagggcgguccgcccagaccccuccuuccgcagcacugcgcacgcgagcucccagcagugugagcugugucugccugccaugucucacugccggugaauggcgcuguguccuuucaauucuagacaagagucgcagugaagaagaugugcaaaguauggaugccagaaauaaaaucacucaagacaugcugcagcccaaagucaggcggucuuuuucugaugaagaagggaguucagaggaccugcuggagcugucagacguugacagugaguccucagacauuagguaaaucaugccccuggcucagagcagagugugugagccagaggagcaucacaaccgugaccgagagcucacuacuggguggacagcauggguccugagaucuaguucugcccugagcagccaagcucuuaaauggcuugagcuuguuuucugauauuggauaguauuagcaccuccccugagaggcguggcagggacugggugaacacuuagcgggguagccaggggguagccagcagagcgucagccgcaggcgacugcuguagacauuugcacccucggcugacacccuucccuuugcuucgacucgucauggguguggcaucucuggcugugacagagggacaucauuccauguuauuuuuucccacaugagcacauguauucuuuguaguugaucuagcgacuauaaaguccuauaguauaaauugcaauguuuaucauuugucaggacguuauuacagaagaggcaccaucaccaggccaagacaaucccagccucagagaccuuauuuaucugcugacauguugagguuuccuaaugcacaagaccggggucugaauguugggucgaggccaugauauuuaaaaagacaaugaacgacaaaaaaaaacacuugaaacuuuuaucuuuauuuccuuuugccaaguuuagcaugugacuguuaagcaaaaagaaggaaaccaaaaccacuuuagcauuaagauuuugcugccucuacccagccauucauacgugugucauaaucguuaacaaaaugaaauguaauguacuaacaaauuuuuuuuuucuuuuuuuuuugagauggagugucgcucugcugccaggcuggagugcagugacacgaucucagcucacugaaaucaccaccuccuggguucaagcgauucuccugccucagccucucgaguagcugggacuacaggcgcaugccaccacacccagcuaauuuuuuuguauuuuuaguagagaugggguuuuaccacauuggccaggauggccuugaucuccugaccucgugauccgccggccucgaccucccaaagugcugggauuacaggcaugagccacugcgcccugccaauggcacaaucuuggcgcauugcaaccuccgccucccggguucaagcgauucuccugccucagccucccaaauagcugggauuacaggcaugcaccaccaaacuuggcuaauuuuuuuuucuuuucuuuuuuuuuuuuuuucgagacaaagucucgcucuguugcccaggcuggagugcaguggcaugaccuucgcccacugcaacauucaucuccuggguucaagugauucucccguguuagccucccgaggggcugggauuacgggcauaugccaccacacccagcuaauuuuuguguuuuuaguaaagacagaguuucaccauguuggccagacuggucucgaaauccugaccucaagugauccgucugccuuggccucucaaagugcugggauuauaggugugagccaccgcgcccggccgcuaauuuuguauuuuuaguagagacaggguuucaccauguuggccaggcuggucuugaacuccugaccucaggugauuagcccgccucggccucccaaagugcugggauuauaggcgugagaaacaaauuuauuuuuuguuuguuuguuuuuugagauggaguuucgcucuguugcccaggcuggagugcaguggcuggaucuuggcucauugcaagcuccgccucccgaguucacgccauuuuccugccucagccucccgaguagcugggacuacaggcucccgauaccaugcccggcuaauuuuuuguauuuuugguagagacuggguuucaccguguuagucaggauggucuugaacuccugaccucgugauccgcccgccucagccucccaaagugcugggauuacaggcaugagaaacaaauauuuuuaugaagcugggauucggcugcauguacagcucgguaauguccccagcguuugaauugggaaacaguugcugcugugcauuucuuccauccguauuugugcacaugcgcagugacgucaauguuuagacgugaagcagucgagucacagagugugacugggaauuggaccuugauagacguuugauaaguuuguuauccagacaccgaucggaaagggugcaccuaaugcacucuacaaggucugcaugagggccucuuuuugccaguuuagaaggagaaguagguaaucucauuuucauuuacauuuuuuccuuaugaaaaaaaugucuuuucacugugccuuguuuuuuaccugguugggucuuaccuguuggccuuauuggccccuggccuuggugugaggcgcagaaaagccuuucaaauggagaggagagccucguguauuuuuuccuacagguucuuuuuuuacaguugacauuuuuaucugcucguuuuuggaaguacaagggaaguguggaaaagacaagugauucggggcuuugcaggcgccugguguggcucccaguacguugcccaccgcgcucugcuuuuaacgggagaguaggcggguccugaggagcacggggcgugcgcgcacgugcuggcccuugcccugcucuggcgucgucuccugggagcacacgucaguggggaccuagugacccuggggauggggcuccaaagcgugggggcugagcuggggaugcagaguggcguguccuugcccuucgacucguucuggucccucucuaacacuggggugcuggacaggaauggggcccggcccuuccccucacaccaagcagcugagcgacgguggagcugagcugugauggcugcggacccgcguugcaccggcccuaccugagaggcuuggggccugcacacagcucggcccugugcuuccuugcagccagccauacgucgugugccggcaguguccugaguacagaaggcaggcggcgcagccuccccacugcccagcacccgagggcgagccaggagccccacaggcccugggggaugcacccuccacguccgucagccugacgacaggugagccgcgccgcccucaggccucagccuucgcgugagucacuuuguggcugugcccggugcugacgugcacguggccgcgcucugcccgccuccugucugcacugcucgcccccuuugggcccuggccucauuggucucccugcacucacaguugguugcuuuucgugacugauuuuggguugggaaaucagauaaguaacuguucauucguagccccuccugaacacuccugggaauuaacaacccugaccuuaauacuuggccucuccccagccacugccucagggcagcugaugucccccaguggguuugccagacccaaagugaugaucgcauaucugucccucaaguaagaggcgggcuucuccccagcaguggcgaugucaccagaagcugcccugcgucaccagaguuggcuuaaugcgaaauguuuccccgucaggugccuuuuuccagcaaggggcuccaggugcuauccaggaagucagaggagagcugggcaggggguauggaggcuucacuucucugcccugcucacuccagacucauagaaugggaagaugcccucagggguccuggcuuccuggccacgggugggggcugagcacaucacgaggccacuggccugggauggauguagagccacauccuugugcugcauucucaguggcuucuuguagaacccguggacggaacggacaaagcagugcuuggcguugguauggaugcccauccaccagccuggguuugcuuccgccacucagcagcucugucugggucacuggacaagcuccuuccuuugcauggugggaccagcgccucccucugggguccugggucccucagugggugcucagugaaccuggguggugaaauugccguccuuauggccggcauguugaccucgcagggucuuuccuguguggguggcgaguguccagggaacuuggcugugugggcucagacuucugcugccacaucgauuggucuugugcaccguggcuguccuuuguuuauuugagagauggcuguucucucaccugagcggaaauugaacacacagcuuguuuuauucuauaucauagguucuaugggcuuguccucucuuuauaggaaauaauagaaaaccuucaacagaucggccgggcacgguggcucaugccuguaaucccagcacuuugggaggccgaggcgggcggaucacaaggucaagagauugagaccauccuggcuaacauggugaaacccugucucuacuaaaaauacaaaaaaaaaaaaaauuagccaggcguggcaggcaccuguagucccagcuacucgggaggcuaaagcaggagaauggcgugaacccgggaggcggagcuugcagugagccgagaucacgccacugcaguccagccugagcgacagagugagacucugucucaaaaaaaaaaagagaacuugcaacagaucuuugaaaucuugcuccagcugcuaaaucaaagaucauuuuugguuauuguuaaucuguuuugacuccccgaguuuggguggcagaagguccccggugguuuagcagggcaggucugcuucuuccccggcugucucaggugcaccucuccucgcugugcuucccggcggccucucuaaccugcugucuuucugcccugggucccacgugcuccggcugaaugugcgugugcuucagcaguccaggauuacgugugcccucugcaaggaagccacgcccugugcaccugcugcuuccagcccaugcccgaccggagagcggagcgcgagcaggacccgcgugucgccccucagcagugugagugcccgcgccaccgcacgcaggcggguuccuaucuguccuucaggggucagguuucaaagcgguguuggccuuaggguaaccugugaaguaaggaugccguuucuuuuuuuccaucagugugaucaguuuuccccacgucaccauauugaauaaucuaucuuuucccaccaucuaguaacauugccccuucacaggcuacaucuccauccaccgggggcucggcuuggaucugugucuauccccugccagcacugugguugcuuuauaaugugucacuguuaaaccucuuauaugaauguugaugcuuuaguauacaacucuggccaggcacaguggcucacgucuguaaucccagcacuuugggaggccaagguagguggaucuucuguguccaggaguuucagaccagccugggcaauauggugaaaccccaucucuacaaaaaauacaaacauuagccagacaugaugguguacaccuguaaucccagcuacucgggaggcugaggccaaaggauggcuugaguccgagaggaggagguugcagugagcugagaucgugccacuguacuccagccuuggcgacagagggaaauccugucucaaaacaaaacauauauauauauauauauauauauauauauauaugcacacacauacaguuauuauuaaaaauggagcuuguccuuuauuucauggcuguuuuaauguauuccugcagaaaugucugucuauguccuuugccuuuuuuuuaugacuuccuaauuugucagagcuucuuauaugugaaaguguuaggugaagaaagcccuagcccuguugagcaccgcgguuggcuccugccgcacacaccgguguugcucugugcacugagcccugugugagcagcacacaggaccacagcacugguucugucuggaauggcuuaaaaauguucugggcacucaggaaaccaaacagguuacugcuggggucuguacccugagacugggcuuggcagggguggggccuagccugcagcgucgggacacauggccgugggacacacccggugaucugggcggucgcugccucgggggucauccacggcaggcgcuggccacugcugaugcugcacgugggagggcaggugagaagccacagagaacagcuugucccaugucucacacacgcgguggucagcagauggcagcucggcccagcuuuuccccaggaauccaaacucuucacucuaauuucacagagcaugcuucguauauagaggcauuggugaaguggucguaggcguuauaagacuuaaggacucaauccugugagaauuuuagcgaggguuuaccuaacauuauauuuuagggauuuccauuguauagaauaucagacaauuaaaaauaauuuccuuugggaggcugagguggguggaucacgagguuagaagaucaagaccauccuggcuaacauggugaaaucccaucucuacuaaaauuacaaaaaauuagccguguaugguggcgggcgccuguaguuccagcuacuugggaggcugaggcaggagaauggcgugaacccgggaggcagagguugcagugagccgagauggcgccagugcacuccagccugggugacagagcaagacucugucuaaaauaaauaaauaaauaaauaaauaacgucuacaaagccaaggugacaacauggaaaaauaccuagguagaaaaaggccaccuaggcugggcaugggcucacgccuguaaucccagcacuuugggaggccaaggcaggcggaugaccugaggucaggaguuugagaccagccugaccaacgcggugagaccccaucuuuacuaaaaaugaaaaaauuggccaguugugggcaucuguaaucccagcuacuggggaggcugaggcaggagaaucgcuugaacccaggaggcggagguugcagugagccgagauugcuccacuauacuccagccuaggccacagagcaagacucugucucaaaaaaaaaaaaaagccaccugaauaugugcaguugggggcaagcauguugcauguucagagcuagaaugaagcccaucgaagccguguuagggugguggagcaggugagauuucuuucuuuugugucucucacuguuuuccugggaugagcaugugguguucaguuuaagaaacgaugugggucugaggccgggugcagugcaucacgccuguaaauguucaguuuaagaaacgauacgggucugaggccgggugcagugcaucacgccuguaaauguucaguuuaagaaacgauacgggucugaggccgggugcagugcaucacgccuguaaauguucaguuuaagaaacgaugugggucugaggccgggcgcagugcaucaugccuguaauccuagcgcuuugagaggcugaggugggaggaucccuugaagccaggaguuugaaaccauccugggcaacauggugagacccugucucuacaaaaauaaaaaauaaauuagccgggccugguggugugcaccuguaguccuagcuacucaggaggcugagguggguggaucccuugaacccaggaggcggagguugcagugagcugugauuguuccccuguacuccagccugggccacagagcgagacuccaucucuaaaaaauaacaaaccagaaaaugugagccucgccuuuuuucagggauacaacuccucgccaucacaguccaucacaaccuggguggcguuagcuggauguggccccgccccgauuuccaugagaccccuccugaacaauguuuccagaaagaguugagcuccugagccuggugcugacgaauuguguuggagacagcccucagcgcugagugcguguaacgaguguccucucuccacaggugcggucugccugcagccuuucugccaccuguacuggggcugcacccggaccggcugcuacggcugccuggccccguuuugugguaauacuggcucuucaggccccaguugcuuugaccuuugcauguucucuuggugaacuugagggcaggggauggugggguccauagccugauguuuauagggaugaggccacuguuggucaucaaaugauaccuauuccuggcuggacugcagaggugugucaaauucguguuagcucaaaaucaagccuuaacagaauuauuaggggagauacucccaggacagaauccuugcagcgggguucugcuguuacgauaccaagaccaggugcuggggagacucggagagcugaucuuuuuaaggagggaguggaauggaaaucauuucugcuuguccucuguuuaaaauugaguuuuaucauugaacuucuuauucuuucuagaaucuguaaugaaaagaaauauguuuauccucagugucgggcagacagugcuuuccugcgacaucauuauaaacagguaacauugccccuucaucucggcagagcucaaccugggugacaagugucuggacggcgugcugaacaacaacagcuacgagucagacauccugaagguaccgacucgcugcgggcuggggagccgggagccacauuuucucccuagugcagccagcugguucucugcauucuauugguguuuaucuguuuuaccugacccgcugcggguuggggagccgggagccauguuuccucacuggugcagccagcugguucucugcaugccauugguguuugucuguuuuuuccguauuccaaaaauagguauuucguuuuugugccuccugccaccaauucguaggagccgcuucccgcagcucuuguucccggcagcucuuguucccacagcucucggugagggcuucuugaaggugccgcccuuuagcaagaccagggccuuuucucuggucccugucucuucuggccauuugccuucccacgucuaggaagcuaccucgguuucuaggauuuacauauguuuaacaugcgcauucgcccuccugccgagcacuuugcugacagcacacacaaugguggggccuugaggcuugccacagacacaccuggcaggcgcccgcucagccccacacucugcuuugaugcccacagaaggagcucaacagcucguguguguuugaagggcacagagaacagaugccaaguccucagcuuuucuugugcaacagccugggcucguugcugggcugugugcacuguggccuggcuuucaugucucauucacaccugggcuguguaggucuuggcagaacuuuugagagacucugguaacuguuacacuggaaccuuuugggacuuccaggaggcucuuggacaagacuucucgugcugcaggccgugaacgugcagcccucugcaaaugccacuuauaagggucugagcuuuggcuuugcacacuuucaggggccuuuuaugaaauguuuucucucguuauuucaguguuucuuccucuaaacgaguauuucuuauuccucucuuuuuuugcgucacagaauuaccuggcaaccagagguuugacauggaaaaacauguugaccgagagccucguggcucuccagcggggaguguuucugcugucuggugaguucuucuguugccuccugcucuaaggcgcaugugaguguccagggcugugccugcgugucugcucucccagugacaacuccgaccuucacccacccuggaagagaggaaaaagauccugaugcuuucagguuguuuuuguuuguuuguuuguuuuuugagauggagucucgcucuuguugcccagacuggagugcaguggcaugaucucagcucaaggcccccucggccuccuggguucaagcgauucuccugcaucaaccuccugaguagcugggauuacaggcaugugccaccacacccagcuaauuuuguauuuuuaguaaagaugggguuuccccauguuggccagccuggucuugaacuucugacuucaggugaucugcccaccucagcuucccaaagugcuggaauuacaggcgugagccacuaugcccggccuucagguuguuuuuugaaaguugagcgugggccgggugugguggcucacgccuguaaucccagcacuuugggaggcugaggcgggcggaucaugaggucaagagauugagaccauccuggcuaacacgguaaaacccugucucuacuaaaaaaagaaaaauacaaaaaauuagccgggcgugguggcgggcgccuguagucccagcuacucgggaggcugaggaaggagaauggcgugaacccgggaggcggagcuugcagugagccaaaaucacgccacugcacuccagccugggggacagagcgagacuccgucucaaaaaaaaaaaaaaaaagacaguuaagcaugaaccuguaugacauauuccagcagcuucuauccuuguaggggaggguggguguggccgacugccacuacugcugcuugagacccucacuacagcaguuacugcuguuacugcuugagaccaucauuacaggacugaacaaagggacaaacguagaaaugaaaacaaaaagacaaaagaaacuuuuaaggaaaggcaacauggggaagaagaggagagcucccugcuucuagugaguaaaggcugccccugagcuucuacagcccuucauauuuauuggguaacaagagcaaggaggagguaacaacugggcagcugcuaaauugaucacagguucauacuguuacugacaggcuucaauuaugccuaaucauaagaaacauuuguguggccuccaacagguggggccagcuuggagggucucuaccacuugucuauccagagguccuggggucaguuguccugggacccucggggacuuggugaaucucuugcuugaugugucagucacuuggugagggucacuccucuccaggggggcacacgaugcuuuguggaguaugauaauuuaucacuaagggaggcuguagaaauauauauaugagacagguucuugcucugucgcccaggcuggagugcaggggcaugaucacagcucacugcagccucgaccuccugggcucaagagaucaucucaccucagccucccaaguagcugggaccacaagcgugugcuaccaugccuggcuaaucuuaguuuuuuuauuuuuauuuauuuauuuauuuuuuuuuuugagauggaaucuugcugugucacccaggcuggagugcaauggcacaaucucagcucccugcaagcuccgccucccagguucaacaauuguccugccucagccuccugaguagcugggauuacaggcacccgccaacaugcccagcuaauuuuuuuuuuguauuuuuaguagaggugagguuucaccaucuugguuaggcuggucucgaacuccugaccuugugauccgccugccucggccucccaaagugcugggauuacaggcgcgagccaccgugccuggccgauaucuuuguuaauuaaggguauagcacauuuucauuuguguugcaaauguuuccacuauaguaguaguucacuuuuguuguauuuauuuuaauuuugauguuuaaauuguagauagccaaauguacaaauccuuuccucugugcaauuugguuuucaagacauacuuagaaauagcuaauuuucucauuuucuucuuguuuuuugggaguuuuaauauuuaaauuuuauauccauguggggccgggcguggaggcucacgccuguaaucccagcauuuugggaagccgaggcgggcggaucaucugaggacaagaguuugagaccagccuggccaacauggugaaaccccaucucuacuaaaaaaguauaaacauuagccgggcacgguggcacacaccuguagucccagcuacucgggaggcugagacaggagaaucaguugaacgcaggagguggagguugcagugagcugagaccccgccacugcacucuagccugggcgacagagcaagacuuggucucaaaaaauaaauaaaauaaauguuauauccacgugggauuguuuugcuguaagaaaauaaauugguggccgggcgcaguggcucacgccuguaaucccagcacuuugggaggccgaggcggguggaucacgaggucaggagaucgagaccauccuggcuaacacggugaaacccagucucuacuaaaaauacaaaaaauuagcccggugugguggcgggcaccuguagucccagcuacucaggaggcugaggcaggagaauggcgugaacccgggaggcggagcuugcagugagccgagaucgcaccacugcacuccagccagggcgacagagcgagacuccgucucaauaaaaauaaauucguaucuagauuggcuuuguucuuauuuuccuaaugugucgcccguugucuucaccccauuuauggucagugcguuagucucccacugcugugaaguccgugcgcugcuguugggaagaugguguugcuggguaacuggcuguguuucuuccagauuacagagucacgggagacaccguucuguguuacugcuguggccugcgcagcuuccgugagcugaccuaucaguaucggcagaacauuccugcuuccgaguugccagguaaggagcccccgacuuccucauggcucuaguucugucuggguuggcuucuuggcuucugccucucuuuuuuuuuuuugagacaguuucgcuguuuuugcccaggcuggagugcaguggugcaaucucggcucacugcaaccucugccuccugaguucgagcaauucuucugccuuagccuccugaguagcugggauuacaggcacccgccaccacgcccggcuaauuuuuuguguuuuaguagagacgggguuucaccauguuggccaggcuggucucgaacucuugaccucggccucccaaagugcuaggauugcaggcaugagccaccacgcucggccagcacucuuuucuuuacagacacccuguuugcacuuugcucaauguucuaagcagaauuuggccucagucaggagccggcaggacgucaggccauacagggcugugguuguuuuaggcccugggucuauuugcaguuacucaugaguguaacguggguuucuaaaacagauuuguaaagacauccaauagucaacugggguaauuuuauuuccucaauuggguuuuuauuuuuuaauuuuuauuuauuuauuuauuuuugagacagagucugacucugucgcccaggcugaagugcaguggugugaucuuggcucacugcaacuucccucucccagguucaagcgauucuccugccucugccucccaaagugcugggauuacaggcaugaaccacuguaccugacccucaguuggguuuuuaguuaaacauguguuuccuuuccugaaaucucagaacgguccgaggaaacuaguuauggagggaccagaggccgugcguuuccaccgcagcgucugucguugggucucugcugggauucagguagcugagugggugcgugcaauacaucucauagaugcguaccccuucucuuuuuccaguggccguaacaucccguccugacugcuacuggggccguaacugccgcacucaggugaaagcucaccacgccaugugagugcagcugggggcacaggcgucagcuacagagugaugaaugaguuaacugccugcuuauaaauaggcugauauggucauuaugcuucucucagguugcauccuuuaggaaccgguaucuucauuuagaaauccugcucuuccuuuaucccuucguuucaugcaguuuuaucuccgucuuccacuucugugucuuccuggcuggaguagcuuuaucuguugucugaggcauccggggcacaccccaucauuucaggcuuagccguuucuaagucgaaggcugcagucacugagggccucaggccccccucgcaaagcgcugcacagcuggguucucguccgucccgugagcaggcauuugugauugcugucacaucgucacccucacguggugucuuucccgugcuccuuaaaggagguucacagcgccaucugcauugcccugggaggcguaggucaggaggcaucucuuagguuaggugaucacguaaaucacuccuguggcccaaggaguucagauuaaagugauggagacagugcccucaggacgagauguuguguggacucagagaaaggcgccucccucacagggauuuuguggaauaaaaaccuugcuuuguguuugagcacaaacagcacauggaagagaccauguuguuacaaaaagagauuucacuguugacuggcagacaguuuucaguagaaaugugcagccaugcugguccuccuugcccacagucuguggagagggaagguggccacaggccauccagcuuggugugucugccucagcccugucagcagaugccacggggaugccugaggaggugcagcuuuuauucucuucucuaaaaaaauuaucuaagauguuugcacuucuuuuuuuuuuuuuuuuuuuugagauggagucucgcucugucugccaggcuggaguauagaggugugaucucagcugauugcaacccugccucccagguucaagcaauucuuuugccucagccucccgaguagcagggacuacaggugcucgccaccacaucaggcuaauuuuuuaaauauuuuuaguagagaugggguuuuaccauguuggccaggcuggucucgaacuccugaccucaagugauccgcccgccucggccucccaaagugcuagauuacagacauuagccacugugcguggccagauguuugcacuucuguuucaaaauuuuuaaagggauaaagaaguuuaccuuuggggguuaguuucuuugauauugugagaagcacacacacucuuucucagguagcucuuucuguguaugguuuccgaaugcguuuauuugaaugccuuucugaugcucuguuguguaauuuauuugauugccucuccaaugcucucuuguguaauuuggccauuuucucccugcaggaaauucaaucauaucugugaacagacaagguucaaaaacuaagcauccagaggcccugagcagcuuucagcacuggaggugaagagagcguguuuuuaaaauacagagacaagcacgucaagguguuuucacagcccccugagggaagggacgcagggucuccgacaggugcucuggggugacucuucuguggagcuuuacccucugagugagacccuccccagagccccgggggccgcagcccgcccuccuggugagcgcugggcagggcucgugguggcaucagcagcagagacgaagccuuucuguaacaugcggccgucccgccgagaggggcaguuuugcucuuuuguacauuuuccgaaacuacaguuaaagcagaagucuguuuuuaggaaaaguuucaagggagaagggcaaguuuaucaaaaacauuguuucaggagaagggagcauaaguuuacagccuacaggacguacacaauauccugcugcugggaaaaccacagcauuuuaucuauuuuuuauuuuaauagguuuggugcuuaucuucuaauaagauuuaaaugucacaaacuguagcacaaauaauauaauuuauaauuuacaaauugacuaaaauuggguauaguaugguauuugaaagaauaagcauaugcuucuguuuauuaaaaaaagaaaccuuccaauguccaaaacugcuaacccucgacguggccgccaaguuagucgcuccuugcuaaccggugagugaccgcggccccgagccuggggcuggacgcaggucccaggacaugcugcucccuugugugagugaccgcggccccgagccuggggcuggacgcaggucccaggacgugcugcucccuugugugagugaccacggccccaagcccagggcuggaggcaggucccaggacgcgccgcucccucaugcugcccgggcccuuccuccaagacccuacagagccugaggggcaccuuggcuuccgccugugcuagcuuugccaugucaucuggaauaauacuugaaauuuugauuuuuggaaaaaaaaguuuuuuaucuuuuguugaaaucaccuguuauccuuguuuguaaacugauaacuuuuuugcuucuucucaggaauacaguuuucaacuguugucuugcucuugauagaaacugagaagcagcaaucuguauuuguggaggaaaguccucucuuuugcauauucuaauaaaugagccgcguuugcuccuc

SEQ ID NO: 191496 - RNA, 36198 nt, Homo sapiens
ucagggccaaaacguuuuacuuuccauuugaauuuacaaccauauacagacaauaugguaagauuuuagagaaaacagaucaucacuacgaauauccauauucugauuucuuuugagaaccaaggugccuuuuaaaaugcggcuuuuuagaauagcauguguuguuucugucugggaucuagaucuugucugcuacaaaacaaaugaacacacccuguguaacaaaaucgaauuuuaacauuuaaaucuugauuccaauauuccugaccuaucucuugucauaugaaagaaagaagccuuuuuuuaaaacaaaguuucaauucagaauuuuuacaaacaaaaacaauccugcgucuacuuaauaucccuguauauccucaaaaagcaaguucaggaaauuuaaaaaugauuuauaaaaggcacugaaguuagcaaaagcauugguggguuuucauuuuggauuaaacacuggaaauguucacagagaaacaacugugugagcaguugcccguaacacccaggaagaaaccgaccuccaggcagcaccuccugaacaccucagcggcuccucacacauuccaaccacagaccuucauucaagucaaggugaaggcuacagucagcacggcaagaaaccaagaugggacucaaaccucuaaaugcaacacucugcauacaggagaucccaacugaaaugaguuccaaaauaacggauaccuuuaucguauaaucauuuaugcucaacaaagccucaggauaaauuugaaaacagaacaauguauagacuguauuacugcugcacuggcuccugaaugaagcaggcggugaaggcucacgugcugaggaaacagggaacaccuuggcgccgcugcugagcucuguguugcuccugguaucacucccacgggcugcaagacuucccaagagaaaagcuacuuucaucuucugaucaguaauuuaaauauuccgaacaacccaaaucacaaugguugcugcaagucugaggcgcgcuccuggcucccugaucccugccguccaccucccucugucugaaccaugagacccacgggcgaaccaacaggcacucugccaccaucagaugccaccccccaacccaggaaaagacagggcggcaaauaguucaucuuggugagugcagguuaucaaagggacaucggugcucacgccuccgccaagccccuccucauccacagcgucugucggaugaggugaguacaggguaaguacagggcugccugccugcaacugccucagcgcccuuuccucugcuauauuucagaccuagaaauugccaccuaaaaagucuaccauuaccacauggauauuuuccagaaaauugguaacugaguuugcuuucauuaacuucuaacuucuuccaaaauaucagaaaucuaaguguuauauagaacauuuaaaucuucuaaaauucucacacccucaaagugaggaguaauaauuuaaucagaauauauuccuuuuugacaguuuagcaauaaacauaugacccuuccuucuuuaaaaaugaagaacaaaccgagagcccagcgccaagccuacagggcggcaagcucagccaggcgcgccauccugcggagcuggcucccgugcacggggcuguagcgcccaggacugcccaggccuggcuuugcgggguugcuuccagccacgcuguuucuccccggacuguagcugugagggccacugagaucuggcagcugagacuugaaccuuccuuucaccgcgggacugggccaacugcggaaagcaagaaagaacuguuagcagacgggcacaggcccggagaugaacagcaaaagucggagaauaauggccccagacucaggcacaugcgcccgggcggaggagaggcacuggugaacccuggcaccgcgggcacacacgcccggguggaagagacgcacugcugaacccuggcaccgcgggcacacgcgcccgggcggaggagacacacugcugaacccuggcaccgugggcacaugcgucuggguggaggagaggcacugcugaacccuggcaccgcgggcacugggagagucaagcucauggggguuucccggagaauccugugugaucugaguagaaacccugcugcuuccacccuucuagcccucagcuugucaggagcugacccguucagcuuuuccacccaaccagagcucuguccugugugcagagagccacaacacccaaauccacagccuggcugacgggccugccagcguugggaaaagccacugauagguucgcaugaaguggaacuggacccugcagaaguuuccaaaagcugcccugcgggugacaggcuguccgggccccacauaccucugucuguccgagggugaguagcacaggacagcacucuuccaucugugcacggccgggaacugaugggggucgacgucugcacauucaagagcggccaaaacauccugaucgaguuuugauggcuccucucuagaaagcacaauaaaagaagcaaaaacaucuuugguaaaaacauaaagacuucuaaaauaccacuacuuuuuuuuuuauuuugagacggagucuugcucugucgcccaggcuggaaugcaguggcgugaucucggcucaucgcaagcuccgccucccggguucaagcaauucucugccucagccucccgaguagcugggacuacaggugccugccaccacgcccggcuaauuuuuuguauuuuuauuagagauaggauuucaccaucuuggucaggcuggucuugaacuccugaccuugugauccacccaccucggccucccaaagugcuggaauuacaggcgugagccaccacacccagacaaauaucacuacauuuuaaacucaagaacccagcacacaaaacaacagugugcaaggaucgaucuggccugagcagauggaaccagggaaccagcagcagcaugucagggcauuagcucugcagagggaggcaucucccaaggccagggaggcggaugcagacucgcuguucugugaugagaagagcaggggccagggaggagucgccucugggugcacgccugcauucucuaugguagcaggauccacccgcuguuaaaaugcaguuuugcauacuugcacccccagagggugcucaguaccagaagguuagggacauuuauccccuguuagauugagauugaccccaagauggcuuuucuuccuagaaggauuuagaagagaucauucacaccacuggcaggcacaucccuagcaaauaacagccaacacuaggaucacccacgguccaaccagaggaagacccagaaagagcaucuagaagcuggacucagagacaggaacugaacgcacacggcaaguccacacaaaagcuuguguggaggccgggugcgguggcucacgccugugaucccaacacuuugggaggccgaggcagguggaucacgaggucaggaguucgacaccagccuggccaauauggcgaaaccccaucucuacuaaaaauacaaaaaucagcuagacgugguggcaggcgccuguaaucccagcuacucaggaggcugaggcaggagaauugguugaaccugggagguggagguuacagugagcugugaucgcaccacugcacuccagccuaggcgacagagcaagacuccaucugaaagaaaggagaggagaggagagucgaggggaugggguggggggauaggggagggggaggugagggggagaugaggggagggguaggggagggggagaugaggggaaugggagggugggaggggagggggaggggaggggaaggugagaggagggggaggggaggcaaggggagggggaggugagggaagggggagggggaggugagggaagggggagaugaggggaguggaugggugggaggggaaggggagggggaggugaggggagggggaggggggagggaagguggggaaggaaagugagugcagagggcaacacacuccuacccaaaaaggaagagccgccuggccgguucccuggugaccucgagcugauccucgugccuggggcugcugggacucaaggacauuuuagcgauccuggcugacauuucacuuucuguccuccuguggccauucccgaguuggucugcgggagaaggcucuaacaagucucuuucuacugcauugauucuugaagucaggaucugaucuuuaguuuuuguacuuucaucuggugucuuggaaacgcuacguccuauauuuugcaaauucaguuuaucaaacucaacagucaaauccgagacagguggcagaugggcuuccuccccacggggggccuuuggucucuugcccgccaggguccugcugugauucagaggauggcagagcccauuucugcugcuguguggaccucccggcucggcggcuucuaugaggucugccuccugcuccaaggggaaggcgcugcaccucguauguccaaaagcaccgacugugggcgggcuguuauuucgagcugcauuuugccgauuuuuuauuucuuccaagcucaugucaucuucaucuagaaacgcccucacggaaauggaauugcugccugugaggacaacaaggagcacuucagugaugggaacgacaggaagccacggagcugcuccgccccauccaugaccaacugccgugaccccagcaacagcaacucuuauacccaaaaccuccccacuccauccgcgaccaacugccgugaccccagcaacagcaacucuugcauccaaaaccuccucaucagauuucaggauggaaaaccacccacacgacucccuggaaaagggcaaacaggacccuccagacacaaucaggcugcuggggccaggcacagaagcucacgccugcaaucccagcacucugggaggccauggcaggggggucgcuggaccccaggaguucaagacugccugggcaacauagcgaaaccccguucucuauagaaaaauuagcugacaugguggcacgcaccuguagucucagcuauuugggaggcucaagugggaggaucgcuugagcccaggagggggaggcugcagugggcugugacugcaccauugcuuuccauccugugccacagagugagacccuauuucagacgaggagggaaauaaagcugccaggcugacuuuucuuucaaaggcagggacaugaaaacgccaagggcagcccaggugaugggcgagaugacugcccugcacccccagccacccuccagcuccgaucugcugcgaccccaggggcuccgagugucacagugccccagaggaucccgaagaucguccagaacaacuccaugaaguaacccugcugcgcuuuaggugugaagauaacacagaagagcucccgggcgcagcacugugcgacaggcaacagaaaugucccguuugguguucacgaugguggccgcggccacaggaggauccagaacacuugagcuguggcuccugcuacuuaggaaaugccucaacuuuauuuaauauuuacuaauuaaaauguacauagucacaagacaacacuguaaaugaggccgcuuuacagaagugaguucugugccaccaucagcuacaacacagcaaggucagacuucaaugauuccuguauaacgacggcacugacgucgcucuaguucugugguucagagucacaggucgugacuguugaagauucacugcuucuuaguuuaauguaugucaaucauuuucauuuucuaucauuccagggaguuuguuuuauaaaugaagugucuugcgggcuaaugguucuauuaugaccuuacacacacaaacucacacagacacacacucacacacacacacacacaguuuaaacuguauaucugcuuuaauuuguauuuuagcagauucgaaucucuaguuauuagcaaauuucuguuuuuuuaaaaaaauaaauagagacagagucucacuauguugcucaagcugccuucgaacuccuggguuucagcaauccacccacguuggccucccuaagugcugggauuauagugugagccgccacgcccggccgcugggauugcaggccugagcucccgugcccggccaucguugauguuuuuaugaaucacuuuuagauuuuguagauuaaccucuuccaucaugcucuuuccauucagugcaucugugcuuuggaagcacuuugcaucguggugucugauaugcaccgugugaagugcuuugcgugugcguccuggugucugauauacaccgugugaagcgcucugcguccuggugucucauaugcaccgugugaagcgcucugcguccuggugucugauaugcaccgugugaagcucucugcaugcuggugucugaugugcaccgugugaagcgcuuugcguuugcguccuggugucugauauacaccaugugaagcgcucugcguccuggugucugauauacaccgugugaagcgcucugcauccuggugucugauacgcaccgugugaagcgcucugcguccuggugucugauacgcaccgugugaagugcucugcauccuggugucugauacgcaccgugugaagcgcucugcauccuggugucugauacgcaccgugugaagcucucugcguccuggugucugauacgcaccgugugaagcucucugcguccuggugucugauacgcacugugaagcgcucugcgugcuggugucugauacgcaccgugugaagcucucugcguccuggugucugauaugcaccgugugaagcucucugcgugcuggugucugacaugcaccgugugaagcucucugagugcuggugucugauacgcaccgugugaagcucucugcaugcuggugucugauaugcaccgugugaagcacugcgcguccuggcgucugauacgcaccgugugaagcucucugcguccuggugucugauacgcaccgugaagcgcucugcgugcuggugucugauacgcaccgugugaagcucucugcguccuggugucugauaugcaccgugugaagcucucugcguccuggugucugauaugcaccaugugaagcacugcgcguccuggugucugauaugcaccgugugaagcucucugcguccuggugucugacgugcaccaugugaagcccucugcgugcuggugucugauaugcaccgugugaagcgcucugcauccuggugucugaaaugcaccgugugaagcgcucugcauccuggugucugauaugcaccgugugaagcucucugcguccuggugucugaaauacacugugugaagcgcucugcguccuggugucugauaugcacugugugaagcgcucugcguccuggugucugauaugcaccgugaagcgcucugcaugcuggugucugauacgcaccgugugaagcucucugcguccuggugucugauaugcaccgugugaagcacugcgcguccuggugucugauaugcaccgugugaagcucucugcgugcuggugucugauaugcaccgugugaagcucucugcguccuggugucugauaugcaccgugugaagcacugcgcguccuggugucugauaugcaccgugugaagcucucugcguccuggugucugacgugcaccgugugaagcucucugcguccuggugucugauaugcaccgugugaagcgcucugcguccuggugucugacaggcaccgugugaagcucucugcguccuggugucugauaugcaccgugugaagcucucugcgugcuggugucugauauaccccgugugaagcacugcgcguccuggugucugauaugcaccgugugaagcucucugcgugcuggugccugauaugcaccgugugaagcgcucugcauccuggugucugaaaugcaccgugugaagcacucugcauccuggugucugaaaugcaccgugugaagcucucugcguccuggugucugaaauacacugugugaagcgcucugcguccuggugucugauaugcacugugugaagcgcucugcguccuggugucugauacgcaccgugcaaggcgcuucgugcccuggugucugauauacaccaguauucugaugugcacucgucuuuuuccugaaaauauaccaaaucuaaaauaucaggcucagccaauggaguucagcuauuaugaguuuugagaaaacggcacagaaugaaacuauauuagauuuuggauaaugcaaacacaagcagaaacagcaauacugcucaaagcgaugccauuauuuuucauguacccuccccgacacacaacccauuuaacauuaaccuucccagcacucuaguggaucacgaggucaggaguucgagaccagccuggucaauacggugaaaccgcaucuccacuaaaaaaaaaaaaaauacgaaaauuagccaggcgugguggcgggcgccuguagucccagcuacucaggaggcugaggcagaagaaucgcuugaacccaggagguggagguugcagugagccaagauugcgccacugcacuccagcuuggguaacaaagagagguuccgucucaaaaaauacuaaccuaagggaaaguaccagaccuuuacguuaaaaacaccaagagacgagaaacagaugugcgcaucccgucagaccccggccauggggggccccucccagcugccacagccacgccugcacaugcuuaccagacgugguggcuuuaucucggcaggaggcuucccguucuccuguuucuuguugagccuuuuugccuauuuccugcugugugagauauucuucuagucuuugcaggccuuccugggaagacagaucaacaaaacagcccagaaauucccaguauucaacccagggauaccccagcucaugagcuagcucccuguaagaaacaaaacacaauuaaccagcugugaaaccagaaaaaauacucagaacuacacagaaaaaagccacuaaagcuucaaguaccaaagcaaugucugcaaucaugguuauaauuuuccuuuauccuuaacuggcagcugaaaucauacggugcauuuucugaaacagcacgccuccucacagguaagcaggacccggcacagcucucaggagccgugaaccggcugcaggcaggaaggaggccucagcccgacagacccucacgccagcaacccaggucacacaguucaacucccacagacggacguguucaugaucacggaacagcccugugaacuugcccgugguucuagucauggccaggcacacgaaagccuggagguccuuucuggguuccaguuguacaccugacacugggcacauauuuugagaaaauauucuaaacaauuccacgaagcuuuauuugauuacagcauaauuuagcuuuguggcuauggccuauuuuuucccaaggaauccauagcauuauaugguaccuucuauaaaauauuaagguuccuuagaaacaugucccagaaccaacaaggaauuccaauuagaaaaggaaaggaaggcacugcagacaucccccaggucugggacgggacuggcuuaagcuagaauuccacaacauccacaaggaauuagaccuucacgaaaaggaccaagucucccagaaaagccuucuggaaauugguacuuugaagcugugauuugaccuucugucauuaaucaaaaugcaaccaacugugugccccacgcugcugcggcucagccuuucaguaccuucccacucucucaaagccucuuuccggguccgacuucuugacguggugaaggaagccugcuuucucucgagguggaguuuuccagagcuugcgaaaaucuucugccuaugaagaaaaaaaaauguauugagccgugucaggcacugcgccccucagcugcggaaaccugaagagccgucgucaucgcaguagcugccugucuccgcacacccuuccuucucuccccuucacuagcagaucccugggccacgugcccaccuguggcauggcugaguggccgcacggcugcacucugaccugggggaggggaggcggucuccuuucuugcagccccgucugggcugugagguucagaaccaggagggcccgagcacgaggccucacccugaggacaguggacggcucggagcugccaccccgacgcacaugugacacugcucccaucgcaggagaagaaaccagaucuuucucagucacucucccuagagcuuuaugcuuuaugcaucucaccuaaccuuaccugauaccaccuaauuuuggggccauuuucuuuuuuguuuuggagacggagucucgcucugucgcccaggcuggagugcagugguacgaucucggcucacugcaagcuccaccuccgggguucaggccauucuccugccucagccucccgaguagcugggacuauaggcgcccaccaccacgcccggcuaauuuuuuguauuuuuaguagagacggguuucaccguguuagccaggauggucucgaucuccugaccucgugauccacccgccucggccucccaaagugcugggauuucaggcaugcgucccggcgcccggccuggagccguuuucaucgcaacugauuuagaaaguuucuagcacaggauggugcgugcaggucagugugugaaguauuccaacaggagaaagaauugucaacuguaaauaaaaaaguguacaaccuuugacccagcaacaccaccauuaaggauuucucugaacacuggggaugaguagaaccuggggcugaggcuuccaggagagggacuugucugagaggaagccagcgggggcugcagccacagggaaacguggucaggagguggacgugcagauggagcuuuccuagucacaacgggcagccucgcuacaccagcaaggugccuaggacgggccaucaacacagcaagaacagggcgacacgcgcacaggacggggcuggcccagggaaugucugcuuuguugagacaguggcucccagcacaucggcccugguaagcaagccacagagccaagaacacacauuucucugacaaacguucucaucaccaaucacugguggaugguuugagaugaggacaaccuuggggcuccacaggacauggucccugagaccacgcacaaggcaacaggcuggaacacccagcagcacaguauagggacagccaggcaccacuuccagaagcuucuacagcagcucaccuuggcuggacucaggggcccugcgaaggcucucagggucaguaccgggucucuggggcugccuccauagcggcugacgugagaggccucagccgucuggucuggggaccacagcuccccgaugacuggagaagaagucucuuccgcucucaggaggggcacguaguaguggccugagggaggagacaggcacuggcugcaggcuuccgcccccuccgcaggucaggccugggugagcaggacggggaucacgcgagcccuugccaaggccucugcaaauggauccaacagacggggcagagggugguuuccgccagagcucacugcacuuaaugcaaauggauacaauggaaacaaagucacacaaggucucagagcucacuucacuuaaccagccucauuuuccuccacugcuacaagaaaagaaagaaaagaaaaggaagccccagguaguuaaaggacuaaggggucggaccugagugaauaagaguagcacacaguaggagcuuaauacauuuuaaaaauguuauauuucauuccagccgggugcgguggcucacgccuguaauccuaccacuuuggaaggcugagguguguggaucaccugaggucagaaguucaagaccagccuggccaacaugaugaaaccccaucucuacuaaaaauacaaaaauuagccgggugugguggugggugccuguaaccccagcuacucaugaggcugaggcaggagaaucacuugaaccugggagguggagguugcagugagccgagaucacgccacugcacuccagccugagcgacagagugagaaucugucucaaaaaaacaaaaaaaaguaauauuuuauuccuucucuccuuuuuuucuccucuuaguuucagacagagucucauucugucacccaggcuggagugcuguggugcaaucauggcucacugcagccucgaacucccaggcucaagggauccucccaccucagccucuugaguagcugggaccacaggcaugcgccaccacacccggcuaauuuuuacuuuuuguagagauggggucuugcucuguugcccaggcuggucucgaacugcuggaugcaagugaucauuccaccuccaccuccaaaaguucugggauuacaggugugggccgcugugcccagccuccucgcuucucaguccugcuucucuuguaguuuaucacaggugugggcugcugugcccggccuccucgcuucucaauccugcuucucaauccugcuucucuuguaguuuaucacaggugugggccgcugugcccggccuccucgcuucucaguccugcuucucuuguacuuuacaauuugcaucacugaauacgcaucucucaacagaucuggaaucacacggcacuuggaugugaguauggaaaaagcacaaggaagaguagugucuucaggucccacgggacagcgcagucaagccauauaggauagugucgugagguucuguagguugcacggaggccacacaccaccucguccugcuuucaaacccagcuccuggagacccagagucaagaggcuuccuuuacagucaaucaugcuacucuggaaugccugggaauuucuuauguuaaaggcuuaucauaguuucauaguuuuuuuuuuuuuuggaaacagagucucgcucugucacccaggcuggagugcgguggugugaucucggcucacugcaagcuccaccucccggguucacaccauucuccugccucggccucccaaguagcugggacuacaggugcccaccaccacaccuggcuaauuuuuuguauuuuuaguagagacgggguuucaccguguuagccaggauggucucgaucuccugaccuugugauccgccugccucggccucccacagugcugggauuacaggcaugagccaccgcacccggcugcuuaucauaguuuuuaugcuuuuaauuuuuuucuaauuguaaaagugcuguaugcccaucaacggucaacuggauaaagaaaaugugguacauauauaccacaggauauuaagaacaagaucauguccucugaaguaacauggcuggagcuggaggccaugacccuaagggaacugacacaggcaagaaaaccaaacauggcucucacuuaugagugggagccaaacgcugagcacacauggacacaaagaaggaacaagaagucagcagggccugguugaggguggagggagugaggaggagggagaggauggaaaaacuaccuccuggguacuauacugaucaccaggugaaauaauccguaccccaaaccccggugacaugcagguuaccuauauaacaaaccugcacacuuaccccugaaccuaaaaugaaaguuaagaaaaaguacgacaauuuccauucaagaguacugaagguacugaagaauuuccauucaagaguacuaauuuuccauacugaaaauuagggcaauucaaauacucugucuuacauauuacuaucuuauauuuggaugcauccuauguauguuggcauuuuacagguuaauuggcaguuuuuucccucuuucaguggcacaggaaaagaagacauacaguauguacaguauagggugcaugguagguauacgguacaauuuaccuacacuuuacucauaaaauacuaauguuuacuuuuuuggcauauugauuugagucccuuuuaacaauuucugucuacagaugggacucacggucucuggacaguuuugugccuggcuuucugauccuauuugucucucauaacacuuuagaguccuuccucaucuucacacaagcgugggucucucucugagugacgggaagggugggaugcaggaugcagccagcccuguagcaggcucuguggcaugugaagcuacaacgugaccgaggccccagcgugaccacagaugcugaccaugccugggcuucgcaugagccucagaaggaccaggaaggagguguaggagcucuggaggugccguguagcucagcccacaggaacauggaucucacagagcugccuucuccucagcaaacagcugcuggggcagaucuuagaggcgacaguguuuuacugucacacauaggcaaggaucucucagacagaauugcuuccuaaauaccaucacaaagcaaugcuuaaugucagcguugcaaagcauuucugacagugugguuugaaaauccggagcagacucucggcucuucagggauguucuggcaacauagcuguguguucccagggccucugaagguuccggcugggccucugcagcgacgccucaacggcccugaggaggaacucucgccgcuaacagcaugcaggauucauuuccugugcacagcuacacacacugaagaaguguaauuaauaaauuauaccuaggacgggaacagaucaggggacaagcagaggcucuucacaccuuagaucacgcuugguaaacuucuauaaaaugucagacaguaaauaauuaggcucaguaggccacaagucacugugugcugggaaagaacccggacagugugcaaaugguggugacagcuuuaugcugauaaaauuuuauuuuuaaaagcagucauuugcggacccugcuuuaaauagagacagaguuuuggauaggaauggaauccgagagagaggaaagcaggcaggugggugaaaggaccucagcgucugcuucaaucucaccagcaagcagaagcuccagacuucgagcuaagauggcaaagaagaggcgcuucuagaagugucaucuuccaaaauucacugaaaacagaggaagauggcagggaaaagccaucccugaaaccagccguuuucacaugccuggcaccuacaaaccgcaaggcacaggggccaacaacuagaagcugcugacuagaagagggcggcccagaaagcaaaggccucucucccagaggcgaguggggagggaacgucccggaggcgaguggggagggagugucccggagccaagacaggagccugggcgugcaccaggaguacaggaggaggaaggaggcagcuucagaaucgaaggagugacagggagcgacccccaccccaacacaggcaaagagacacacaaaagccaggccagccacccagccaaggagcucuggacccugccucucccugagcuguucuuugccaacugcaggcuccaccugaagagaagccaucacaaugaagcuacugcgagagagaccgauggauccagggaugaggccaccagcaacaggcagcgacacacaaccucaaaaaaguucucucacagaaagcucaaggaacagauacaagacuucagagaagggauaacagaaaaaagguggcaaaugagcuaggagagcucaggagaagaaaggaugaucccgaggagaggcuuccgaggggagccggcacacgcccggggagcucaggaaagcaaagcucugcugugucccccaacgcuccaaggcccuucccggcguggaccccacgauccaggcaccaacuccccaucuuacccuuuaaauacucucugauccgcuccuucaguuccacagauuuauuuuugcuucuuucacaaauuaccuauuggaaaaaaaagugugucuaaaucuuauuugaucgcaacauuuccuuaucauuacaaugauuucagaaaaauaguuuuaaacucaguaaaguagaauaguaucuuaaugcuaaagauuuaauaaagcucacacucagaaaacgugugaagaguguggucuuucuaaaagucuaaggagacagcuaggagaacacacucugggauuauggguaaauuuacuucuuguuugcgcuacucgacauuuucuaacugucugcaaggagaggaaaagguaccagcgcaucgaguaaaagcagaagcacgugaacauguuucuaaccuucuugguugguugaguuccacuuacaggaagccuggucauacacaaacuuuuuguugugaggcugggucaagguggagcuccuaaguaacacggaacaucaaaguucuauuuuugccacuaaagaaaucaacuuucucagcccuugaagaauugcagcaauacgaacuuuugcuagaaacuauagaaaaaccaacaaccuucaaauaaaaggaaagaaaggaaccagccuaugagagaaacuaauuaaaacuaugaaugcaacuacauuuuugagucuguaccugauugugagcuuuaaaaagucaaaugcuuuuuaaaaugccaggaguuuuaaguugguuaccaaaugccauucuuauguugaaguacagauacacacacacacacacacacacacacacacacacacaaaaagaaucacauguaugcaaaauaauagcaauuucucaguuguagaauuuucuggugaauuuuauucuuuuugaucaagcaguauuuuaaguuuucuauggcaaguggauguauagcuuauguaauaacagcaauuacagaaggggugugggagaggccacugccaccagaagauccuuauagcuuuuauuucuaaagggcugcuagacaagggacagcucacagcuguaauacacagaaaaaucaaacucaucuuucaguucucagaagguccagauacuucuugcacuuugugggcacagaauauacuucugcccucugcaaggugcacuuugcucaacugcucaggaucaugacgaggccugacugaaggcuugucuggguccgaugaguauguaugugugagaagcuuagcacagcaccuggugcacacugagcugaauacaauuuagcugcuuucagcaucaucauccuuaccaccaucgucaccaucaucaccaccacugccaacaccaccaugaucauugcuaucuccauccucaccaccaucauccucacuaccaccaucaucaccaucaccaucaucaucaccaccaccaucaccaccucuguucucucugacucuggucaacugauguguucagagagggaacuugauaaaagacugugagcuguucaaagcaacugacugccaguuuuaggaaaauaaaaucagcaaacugcgucaguuccuucccuccugguucuacagaugcaucuucuucacaaagugcaucuuacucaacagccaagguucuaacaugugcccauaaagcaaacacaacucauacagagcuccuuguggcuucccugugccugugaucacagacuguaaauuuauauauuuccauuucuaacucuagauagcaacugcauuguaauaaguacuuacaucuucagguguuuuaucauauuuauuccuugaguuuuuuacaaucaaauggugugacgaaagcacguugacuacaucugcauuuccaaacuuacaagcaaaaugcaacggugugucauagcccugaaaaaaggugcagaggaaguacaauuauucacacuugucucaugagguugcucuaaggugaaaauacauauucauucauucauucauucauuuauuuauuuugagacggagucucacuggcgugaucuuggcucacugcaaccucugccucccggguuuaaccgauucuccugccucaggcuccccaguaccugggacuacaggcacccgccaccacacccagcuauuuuuuuuuuuuuuuuaauauuuaguagagaugggguuucaccauauuggugagacuggucucgaacuccugaccucaggugauccaccugccuuugccucccaaagugcugggauuacaggugugagucaccgagccuggcuuauacuuuuuuaaaaaaaaaaagacucacaaacaaaaaggccauaaaagacucugcuuuuauaauggaaaaauaauuggcauucuagcacauacccacuucgugccaaggcuugagcuuagcauacugaccugggugcccagacccuggaggagcuuaaauucuccauaaacagugaacagcagcuuuaaccauucagggcccaguacaaugucauguaaaacaugcccaggaagugaaauacacagaugaggaccacaaccagaauaaagcaaagcgcacgaauuuggucuguacucaaagaagucucugcggccugugacaccacaguaaacgaaauuuuuuucacugcugacgaugcugcaucgcgcccuggcugggaacccaggucuccguccaugacgcugcgucacgcccuccuuccccggauggugucacaggucuccacaccaucugccuggagcucccacagcugcaccucuauccuuccuuaugcucugggcagucucaaugucaccuucaacuguggccuacagaccagcgggccucauggucaacagugccccugagcccaagaccugaagggccaacucccucccagucaccucacuuggacaucccacaggcagcuccacugcaccguguagaaaacagaauucauuuacaccuagcacagccagaaacaccuucucucgucaccucugauuaccaagauucuggcugugaaguguccgguggcaucguaugccauggcagccaucccuaagcuucugcacagggaagaaaaacucaucauggacccugcggccugcacugacacccccgccuccacucccuggcaacacagccuaggucacccgcaaauguccuccuacagcucccucccgccaucacccacuagagguaucccuuacaacucucucacacgaccccaaaaaggucuggauguuugcauauaccaccacgcuaccuguacuccauccuucuguccaggggcuggcaagcuuucuuggacaaggaccagauaguaagcacuauagacuuuuuuuuugagacagagucucacucugucgcccaggcuggagugcaguggcgugauaugggcuuacugcaagcuccgccucccggguucacgccauucuccugccucagccuccccagcagcugggacuacaggugcccgccaccacgcccagcuaauuuuuuguauuuuuaguagagacgggguuucaccguguuagccaggauggucucgaucuccugaccucgugauccgccugccucggccucccaaagugcuggguuuacaggcgugagccacugcacccggccucacaaaucuuucuuaaacuacaauacuggcuaccauuccuauuaaaacagccagcagaggcagcucccgggcagcgugcgugcagugagcaacccugcugcugccugcucggcucccacagcccaucacucggcucccacagcgcccgcaccgcggcccaugacugccugaacacagacgccgccagccaagaugucaacccgaauucuccucacaaaggccugccguccaacuccaugaccaaugucccuguugacacagguggggcugcccaggcuacugcuguugagggucugacagaggcugaggaggaagagcucagggcccagcuaccaagacggaugaggaaacugucacucuacaccagugcuggcagccaaggagggggacuguggagagcuugagaggaggcugggccucucugccuuggaggcugaaacggaacccucucuaacgccuaugugaagacuucugagaaauguggaaguggaaugagaaaguggcccacccggaucucugcaagacucaggaaaugcucccacagcaagacagaagaccucaaccaagacagagaccucagcggcccuguccauggugggcucugccaucaguaggaagcucggagacguaaggaaauuugcaacuuucaagucguuugaagaccaaguugggcccaugaagucuaaggucgugggugacagagaacagcaaggacaaucucccuuccucagcagggaggggcgacgagcccgucggaucccgcaccucucuaagccuguggucgcuuacgcucagcugcagagcacacacacacacccucagcaucacagccggagcucugagcaacaaagcggccagccaggacgcacacgcagagccggcuuugagaauaguccugcccauccacaaggagacguggcuaccgcauccacaugaauuucaacaguuguguacauaguuauauacuaaaguuuguaggugaaacagauaacugugcuguccuuccuagggguacaggaaguggacagggcggaggauuugaaauacugagccaaagcccaggcucccuuuaagaaucacguuaguggccaggcacgguggcucacgcccguaaucccagcacucugggaggccaaggcgggccgaucacgaggucaggagauggagaccauccuggcuaacacggugaaaccccaucucuacuaaaaauacaaaaaaauuagccaggcaugguggcgggugccuguagucccagcuacucgggaggcugaggcaggagaaucaguugaacccaggaggaggagcuugcagugagccgagauugugccacugcacucccaccugggagacagagcaagacucugucucaaaaaaaaaaaaaaaaaaagaaucagguuagcccaucagaauguugaagcauugaagaguccuacgcauaaguggcauuuuugaccuccuccuucccuaacucacagaaggaaugcaaucacccagaaagcccuaccuguuccaugaguuuuuaucuugaaaugcuaaacaagaaguguccauuuccugcccacagaaaguaaacugaauaucaacaacugcccaauuguuguacuaaucuagcuuuaaugaaaagcaaauucauuauuuuuuuuuaaugcaguggacuuuucaaaaaucgaaauuaggcaaagcagcuuuagccuccuagugagagaauauuauuucuuuggacucaagcugaaauucaagccucacauuaccucaugcuuuauuuaucauaaacauauaaaugaggguugcucaauggcugugaguacugugugggauuuuacaccuggccugugugacugccuguuccaguugggguguugguuucacuaacacgcuccaucccaguguauaaaacuugcuucucuucucaagcagggcagcuccccuggcucccuacucugcccugaaggacuuuugggcucccaggggugggaggggcuaagagaaggaaaagccugucuuuagcacccuuuagaagagcugugcccgcuucccagugcugccuugcaugggccuggcccggggggcacucaucagugacuccaacccgccugcuggcugcacuucagaugaaaugaccccacaggucagguggaggguggggcaugggcaucggccaggauugcugucaccuuuucuccggagcuaccaagaucguuccuguuucuaagcagucgcaccccagcagccucucucucuccacagcccugcgugucaggcagccucucucucacaccacagcccugcgugucaggcagcaucucucucucuccacagcccugcgugucaggcagccucucucucucuccacagcccugcgugucaggcagccucucucucucuccacagcccugcgugucaggcagccucucucucucuccacagcccugcgugucaggcagcaugguuugcaggggcagcucugugccucaguggcucuugguaggacacugagggccugccuguggugugcacagcucugccacucccgggaggggaagugcugcucagcucaagguguccuguucggcagaggaaauguccucugacaaccguguccccagacaguucagacacccucggggacagcaucgcacacacgacgacaaugcaggggccagggaaccccagcgcucggugcccuuuguccagugggaugugguaagaaggcagguugcagggguguaauugauguaucuuuuccccaaaguuauuauacuaaugaguaacuugucgauaaagcauucuuuuggggaaagacuuuuaaccaauuaaauaaagaaagcgugaguggagggugugcacgcaccaucuugucggggguguugagguacagguccaccacguaacggauacgcuucugcagcauggccucgucgucaucaggguacaucagccucaugaagucaggguucuccaggacguccagagucagcuggcagauggaagccugguucucuuuggcagcaacaugcaucacguuguaccugcacccuuccugaaagagaaccgcaugcucugagcuuccuaucugauguguggacacgcccugugcgagugcugcgauggaacggccgggaccgcacaccugcccgagggaaccgccgagaccuaccugcacgauagugggguugucuccugagccuaucagauaccggggguugcuccagauaaggucagaaaagguguccuccucucccuucuccacagcuuuccgaagcuuggcggugagguccugcgugcggggauuuuuguaacuguucgcucgcucuuuguugacuguuucugauuccgacaagcacaaaccaucugucaguaagagacagaauuuaagaacaaucaguuucaccaaaagucacucaucacccaugcacccucugaugagggauaagcagcuuuccacagaggcuucugggccaacugggaggcacaggugagaaaagacgagaagggcccacggccaccggccccagcaugcaacgcaaucaauggcagccagcgugcccgucagcagagcaagugagggagagcagccagacccggccacaaucucacugggggccccagccuacaacggcagccagcgcgcccccaugagcacagcaaguggaagagcagccagacccugccacaaucuugcugggaaaggcucugugaaugaggccaaguuuggugaacuuuguguuuuuucagagacagggucuggcucuguuacccaggcuggagugugguggcacgaauauagcucacugcagccucgaccuccugggcucaagugaucucaggcccucaaguagcugggacuacaguuguaugccaacacgccuggcuuauauacauauauauauauauauauauauacacacguauuuuuagagaugaggucuauguugcccaggcuggucucaaacuccuggcuucaagggauccuucugccucagcccccaaaaguguuguaauuacagggacgagucaccacacccggccagugaacucugaaagcucggucaguagguggaggaggaauaacggcagcagcgggcaagggaacacucccagaaaucacgcaagaccuucgaugugcacaguguggcugcaaaggauuacaggauuaaggagccugccaccacgcccagcugauuuuuuugggggggacgcaguuuugcucuuucgcccaggcuggagugcaguggcgcgaucucagcucacugcaaccuccgccuuccaguuucaagcaauucuccugccucagccucccaaguagcugggauuacaggcaccugccaccacggccagcuaauuuucguauuuuuaauagagacgggguuucaccauguaggccaggcuggucucaaacuccugaccugagaugauccacccgccucagccucccaaagugcugggaucacaggcgugagccaccucgcccggccugauuucugucuuaaggugauuuccuucugaggaauccucacaaauugcaaagaaggaaauccguaccuguuagaagccacucugguuuccauccaggaagcaccuguauaaggcugacugagggcaggcggaugacuggaaggagagggcaacauuccucuggaguaccagcccgccagggaagcccagacaacugugagcugcgagagggagcaggaacugaggccagaugaaagguaaaggcggagguucuaccccacacugaccgugaagagccucuucacacaaaacccuaguucugagcugggaggugggcaugggucagacuucgggcuggaccgcuccuacagauaagcccgccuucuccagaugcccuaguccuugaaguagguauagcuucagguggggaaguagacugguuucaggauccaaaaaggcgcaggggcucacgccugucaucccagcacuuugggaggcugagaugggaggaucacuugaugccagcaauucaaccagccuuggcaacauggcaagacccugucuccauaaaaaaaguuuaaauucuagccuggccaacaugguggcuaaaaauacaaacauuagccggguguggcagugugcaccuguaaucccagcuacucgggaggcugaggcaggagaaucgcuugaacccgggagguggagcuugcagugagccaagaucgcaccacugcacuccagccugggcgacagagcaagacuccaucucaaaaaaaaaaaaaaaaaaaagaaaaaguuuaaauuagcugggugugguggugcacgccuauuucucagcuacuugggaggcuaaagcagguggauugcuuaagcccaggaguuugaggcugcagugggccaugauagcaccagacugcacuccaggcuggcaaaagaacaagacccugucucuuuacaaaaaaaaaagaaaaaaauccaacagacacggggacagauggaagcggccacagcguucuuuucagcuucuccagagucaagaugcuaauuacacgagcaucagagccagcauggccuccugguccacugagaccccaucgacucuacccucauggagaaaacaaguuaccacaucagaggaaagaaggcacaaaacagggugggaucaaugugacaggaacaucaagaugugaacggcugcaugauuuaccuuucaaccugucauugcuaaagaguggagcuguuuucacaggagacagugguaaggacguuuugcuuggagaagggaaauaaucacaaauuccucuagcaaauuucucagcgucuucucugguagaaaaagcuuuaaaucgggacccuuugaucaucuugacagcuugcaaugcuuccuuuuuauuuucauaaacauagauccuuucuggguaagaaaaguaacaaaugaaaaucagagaagagugacuggagagcugucaccuggccaugcccugggccuaaccaucagcuuccacaucugcuacccagucgccuggcuuaguucagaucuuuaauccugaagaaaaagggccuaagcuagccaaaauagaacaauuaacaagcucgacagugugcauauaugcauguaacaugauauauauuauguucauauauguaauucuauaugccaagauucuauccuaaaaacuaaauuucauauaaagaucuaaauaaaaauuauuaaaaggcaaauuaaaaaaaaaaacuauaauuaugucagccaagaacauaagagaauuuuaaacacaauuuugaacagggaacgccuuuuuauuuuuuacuuuauuuuuuuuuuuggagacggagucucgcucugucgcucaagcucaagugcaguggcacgaucuuggcucuugcaaccucugccucccagguucaagcgauucucccgccucagccucccgaguagcugggauuaugggcauccgccaccaugccuaauuuuuuguauuuuuaguagagacgggguuucaucauguuggccaggcuggucucaaacuccugaccucaggugaucuguccgccucggccucccagagugcugggauuacaggugucagccacggcgcccagccgggaauggcuguuuuuuuuugacauggagucucacucagcugccgaggcuggagugcaguggugugaucuuggcucacugcgaccaucaucucccagguccaagcgauucucccgucucagccucccguguagcugggauuauaggcaccggccaccaugccuggcuaauuguuguauuuuuaguagagacgggguuucaccauguuggccaggcuagucuugaacuccugaccuuaggugaccugcccaccucagccucccaaagugcugggauuacaggcaugagccacuguacccggcugggaaugccuuuuuaaacaugccaagaaaccauucaaaacaagauaauccugauuauauaaaaauauuaaagcucuguaguggaacuaucacaauuaaguuuuguaugagacuaucguaaauacauaagauauacacuacuggccaggagacaaaaauuuaugaacaauguaacagacgaaugguuacuguccacuacuggauaaaaauagccauaguucgggcacgguggcucacgccuguaaucccagcacuuugggaggcugaggcagguggaucaccugacguugagaguuugagaccagccugaccaacguggagaaacccugucucuacuaaaaauauaaaauuagccgggcgugguggcacaccccuguaguacuagcuacucgggaggcugcagcaggaaaaucacuggaacccaaaaggcagagguuggagugagccaagaucgcaccacugcacuccggccuggcgacagaccgggacucugucucaaauaauaaguaaauaaauaaauaaauaauaaaaauaaaaacugcaccaugaucauuucccaguguuacuuucuuuuuuuugagauggaaucuagcucugucgcucaggcuggaaugcaguggcacaaucucagcucacugcaaccucagccuccuaaguagcugggacuacaggugcccaccaccacaccccgcuaauuuucuguauuuuuaguaaagacggggcuucaccguguuagccaggauggucucgaucuccugaccucgugaucugccugccucggccucccaaagugcugggauuacaggcgugagccaccgcgcccggccccuacguauucuuuaaaaagaucuuacagaacaauauuccauucuauucauaguguuuaaccaauuauguacucauaggcgucaccacaaaugguaucacaguaauaacaauacucauaacagugugcaauuucuggcaucccaauuaauacugaguucucauuucuuuuuuccaaugcuaaaucuucuuuaaaauuacaauucuugggcugggcacaguggcucacaccuguaaucucagcacuuugggaggcucaggugggaggacugcuugaagccaggaguucaagaccagacuaagcaauaaagcgagacccagucucuuaaaaaaaaaaaaaaaaauuuaauuaccuagguguggccaggcgagguggcucacgccuguaaucccagcacuucgggaggcugagccuggcagaucacuugagcccaggaguugggagaccagccugggcaacauggggaaacauugucucuaccaagaauacaaaaaaacuggcgcguacuggcacgugcccgugaucccagcgaucccaagcuacuccggaggcugaggugggaggacuccuugagccugguaggcagacauugcagugaguuguugagauugcaucacuacaccccaaccugggugagagagagaccccagucucaaaaaaaaaaaccaccaaaaacaaccaauuagcuaggcgugcuggugugugccuguaaucuuagcacuuugggagaccaagguggguggaucgcuugagggcaguucgagagaagcgugggcaacguggcgaaaccccgccucuauaaaaaauacaaaaauuggcugggcgugauggcucacaccuguaaucccagaacuuugggaggccgaggugggcagaucacgacgucagggguucgagaccagcuuggccaaaaucgcgaaaccuugucucuacuaaaaauacaaaaaauaaaaaauuagcuggguaugguggcgggcgccuguaguucccagcuacucaggaggcugagguuacagugagcugagaucgcaccacugcacuccagcccaggugacagugcgagacucugucucaaaaaaacaaaacaaaacaaaacaaaaaaaaaccauaaaaauuagcugugcgugguggcguaugccuguggucccagcuacucaagcggcugaggugggaggaucaccugagccagaaagguugaggcugcagugagcugugacugcaccacugcaaugcagccuagguggcagaguaacacccuguuucagaugaaugaauaaauuaaaaaaauaaaauggccaggcgcgguggcucaagccuguaaucucagcacuuugggaggccaaggcagguggaucaugaggucaggaguucaagaccagccuggccaagauggugaaaccccgucucuacuaaaaauacaaaaaauuagccaggcgcgguggcaggcgccuguaaucccagcuacucaggaggcugaggcaggagaaucgcuuaaacugggaggggagagguugcagugagcugagaucacgccacugcacucuggccugggcaacagagugagacuuugucucaaaaaauaaauaaauaaauaaaaacaaaauaaaaccacaaaucuuugaugcugaaaaguauuuauacacucauuggccauuugcauucauuaacauaaaagaugugcagguuacacugcauuuuaaaaaggcggagaugacuaaucaacaaaguuccuaaccaacagcagcagccaguuaauauuaauaucucaguccagcauaucucauagaauccaauuuaccucacaaauuuuaacaguucucauguuaaauucacaaauauuucagaaaaguucuacauaaaaauguuaacaaugguuaacuggggugaugagauggaggggauuggauuuuuuccuucuuaaucuguaguuuuccauuuucagacgucaucccgccccuccgcguaugugcuaucugugugaggaaauccuacacacggucccauuaccauuucucgcugggacguccucauacacuggacacaccccauaguacaggggcggcuccuuagacgcagucgcuccagcucuguaggugucggugucacuagggggcaccgagcaggucuuggaugucacagcuuccuccucuggaggauucaggcccacacuguaaccaaaaucucugucuucagaaaaaccagccugaucaguuggguucccuucagcuggcuucaaaauccuuuguggguccuggcugagagcugugacaccugccucauggugguagaaagaagacagccuuccuccuugcuccaguaaagccugagccaauuuuuucucaaaaaugaaccuuguaguugauguaauggguccacauuucaauccggcuuugacgauuucuucucuaaggucaucuggauucagaaguuucaaucgagccaacagagcauccauugucauuucaccuaggcccaagacaaaaaaaucaaagagucacaaaauacuaacaccugcugaagcugggugauggguacuaggguucauuauauaauggcaucaguuucuguuucuuucauuaaaaacuuuuuuucuuggcuggacgcgguggcucacgccuguaaucccagcauuuugggaggcugaggcgggcggaucaucugaggucaggaguucgagaccagcccggccaacauggugaaaccacgucucuacugaaaauacaaaaaauuagccgggugugguggcggaugccuguaaucccagcuacuugggaggcugaggcuggagaaucgcuugaacccaggaggcggaggcugcaauuagccgagaucacaccccugcacuccagcuuagacaacaagagcgaaacuccagcucaaaaaaaaaaaaagaauuuuucuuuuuuuuuucgagauggugucucccucugucgcacaggcuggagugcaguggugcuaucgcagcucacugcaaccucuaccuccugaguucaagugauucuccagccucagccucccaaguagcugggacuacaggcgccuggaaucacaccuagcuaauuuuuguauuuuuaggagagacgggguuucaccauguuggccagguuggucuugcacucccgaccucaggugauccaccugccuuggccucccaaaguguuuggauuacaggcgugagccuuuuuucuuuuugagacggagucucgcucugucaccaggcaggcuggagugcaguggugcgaucucagcucacugcaaccucugccuccuggguucaagcgguucuccugccucaagccucccgaguagcugggauuacaggcgugcaccaccacgcccagcuaauuuuguacuuuuaguagagacgggguuucuccauguuggucaggcuggucuugaacucccaaccucccaaagugcugggauuacaggcauaagccaccaugcccagcccguuguauucuuugggaggcaggcagaucaccugaggucgggaguucgagaccagccuggccaacauggugaaacccugucucuacuaaaaauacaaaaauuagccgggcguggugguacaugccuguaaccccagcuacucgggaggcugaggcaagagaauugcuugaacccaguagguggagguugcagugagccgaaaucacgccacugcacuccagccuaggggacaagagcaagaccuuguuucaaaaaaaaaaaauuacccgagcauaguagugcacaccuacagccccagcuacucagggggcugaggcaggaggaucacuugagccugggagguggaugccaccacgagcugagauggcaacccugcacuccagccugggugacagaaucagacccugucucaacaacaacaacaaaaaaaaagauggcgggggggaguaauacaucugaauuuaaguuucuacaggguucugacuuuuaaaaacauguucgugauuuacauacucaaauaaguaaagccgggugcgguggcucacgccuguaaucgcagcacuuugggagaccgagguggguggaucacgaggucagcaguucgagaccagccuggccaagauggugaaaccccaucucuacuaaaaaaaaaauacaaaaauuagacaggcgcaguggcgggcaccuguaaucccagcuacucgggaaccugaggcaggagacucgcuggaacccaggaggcagaggucacagugagccgagaucgcaccacuacacuccagccugggcaacagagcgagacuccaccucaauaaaacaacaacaacaaaaaaaacaaaaaaaaaagaaauaaguaaauaaacaaaaagaugggggagacacccacauggaauacuagccagaagaaaugcaccuaacuguauuacaagugaguaacacaggggaagcuaaccuacguaacuuuggaaaacagugagugacuaggugcucuaaggagaaagacaaaaaggacugugcaccauuaccgugugaacaggcucuaggcaguagauguuuucacaaugguauagguuaacacaccuaaagcuauuuucuguggacucuagggcaaagcaaauaauuggaauacacgguggcugaugagagccaggacucucaaugacagaaaggaaagugggagugagaacaggguuucagcaaacgauuccuguaaagggcgagagaguaagcaucucagacucuaugagccaaaggccacgugagugcucagaacagccacaggccgcguguggcggcucacaccugucaccccagcgcuuggggaggccgaggcgggaagaucacuugagcccaggaguucaagaccagccuggguaacacagcgacacccuuucuacaaaaacuuuaaaaauuaucugauggcugggcgcggugacucaugccuguaaucccagcacuuugggaggccgaggcagguggaucaugaggucaggagauugagacuauccuggcaaacacggugaaacccugucucuacuaaaaauacuaaaaaauuagccggccaugguggcgggcgccuguagucccagcuacucaggaggcugaggcaggagaauggugugaacccagggggcagaacuugcagugagcagagauggcggcacugcacuccagccugggcgacagagcgagacuccgucucaaaaaaaaaaaauuagcugaguguggugacgugcaccugugguuccaacuacuuggggggcugaggaaggaggauaaauuaagccuaagaguuugaggaugcagugagcccuguuugugccacugcacuccaaccugggcaacagagcaagaccccgucuccaaaaaaaaaaaaaaaaagaacagccacagauauacauaaacaaaaggguaugguuguauuccaauaaaacuuuacuaaggaaaauaggugggggccaguuuggaccacaguuuacugacucuugcauuagaauaaagccagggagccggacacgguggcucaugcugguaaucccagcacuuugggaggccaaggugcauggaucauuugaggucagguguuugagaccagccuggccaacaugaugaaaccaggugucuacuaaaaacacaaaaauuagccaggcaugguggcaugcaccugucaucccagcuacucagcaggcuaggugggagaaucgcuugaacugggcaggcagagguugcagugagucuccagccuggacaacagagugagacuccaccuaaaaaaaaaagaauaaacccgcggacgucgcauugaaauuggaaguaucaguaugaucacaaggucuuugacagaucgauggguaaagaugugagaaacagcuaggucugaacacuggguuauaauguuccauuaacaauuuuuuuuuuuuugagauggagucuugcucugucgcccaggcuggagugcaguggcacgaucucugcucaccgcaaccuccaccuccuggguucaagcaauucugcugccucagccucccgaguagcugggauuacagguaccugccaccacgccccgcuauuuuuuuguauuuuuaguggagacugccucaccauguuggccaggcugaucuugaacuccugaccuugugauccaccugccucggccucccaaagugcugggauuacaggcaugagccaccgcaaccggccaaguacacaacuuuugagacuggcuuuuccuauucagcauaaugcccuugagauccacccacguggcagaguggaucgcugcggaguggcaccccggggcacccacguggcagaguggaucacgcaguguggcaccccggggcacccacguggcagagaggaucgcugcggaguggcaccccggggcacccacguggcagaguggaucgcugcggaguggcaccccggggcacccacguggcagagaggaucgcugcggaguggcaccccggggcacccacguggcagaguggaucacgcagaguggcaccccggggcacccacguggcagagaggaucgcugcggaguggcaccccggggcacccacguggcagaguggaucaugcagaguggcaccccggggcacccacguggcagagaggaucgcugcggaguggcaccccgggguaucagugugcaaguuuaaccauuugaguuauuucaguuucugguaauuacaaauaaaguugcuaugaacauuaaauauggguuuuugugugaaaauaguuuucauuugucuaauaaaagcucaggaaugcagggcagguuuaacuuccuaaaaaccugccaggcugauucccagaguagcugcaccacuuaccguccccaccugcaaugcacgaggcccaguuucucuaaaucucugcugacuauauauauguauacuauaugugcuauaugauauacacguaucauaugccaugauauacguauauuauacaucauauauaaaaacauauuuuuauauaaaauaaaucaguauuuuuuuauuucagccauucucaaaacaccacccucacccgccgccaccuuguccgcagcucugccuggaugaugccgcuggugacaguaacagcacucagaggugcuuaacacauaccaagugcugcacuuacccaacucccaaaaaagccuaaccagguaucacuaucauccccauuccuaaaagagcaggcugaaaacagguuaagcccacagcaauaagugguagggcccggugcgauggcucacaccuguaaucccagcauuuugggaagcugaggcagguggaucaccugaggucaggaauucgagaccauccuggccaacauggugaaaccccgucucuauuaaaaauacaaaaauuagccgggcgugguggcaggcgccuguaaucccagcuacucgggaggcugaugcaggagaaucgcuugaacccgggaggcggagcuugcagugagccgagaucgcgccacugcacuccagccugggccacagggcgagacuacauuucaaaaaaaaaaaaaaaaaaaagugguagggccgagacacaaacucacacaauuggacaggaauccccacucaaucaucagaaagcaccucuccgcagugacuaacagucugacaauuuagaguaaaaacaaacucaguuucucccacuagucuugcaacaugcuucggacaccagguauguggggauuuucuccccacaaaucacgcaggucgucaguucugcaguggacacaggcugggugucgucugucauccuaauucagucaucuauucugacagcgucuuccuggagauaccagcagacccccacagguuaacggcucagccccgcaagacugccccccacuuccagugcccagguuguuugaccugcgcuugggaccgacggggcguaacccggugaccuccucagguugcgguaauuugcuagaguggcucccgaacucacagacauguuuuacuuacacuuaccagcagaguauaaaggauuacaaagaauacaggugaagagaugcgugacguaaaaccggggggaagcgcuuggaaauucagggccucucugggcaccgccuccaggaacccccacguacuaucuggaagcucccugaacccagcccuuuuggguuuuuacaggaacuucauuucacaggcgugauucaucagccacuggugaucaacgcaaccuucaccccucucuccuccccagagguuggggguggggcugaaaguccccagaaccucuaacccugccuuggucuuuccugcgaccagccccauccagaagcucccuaggggcugccggccaccaguccacucagccuacaaaagacaucacuuuggagguucccgggauuucaagaguuguaugccaggaaaaggggauggagcugaaauacacaguucacuguaucaguuaccucaaacuuaaaacgaccaaaacccaccucugaucuccacaucacccagacccgacagucuaccgcaaagcaauaaauggccaccuucucccucuuccucuggccccaaaccccugaguuacauuugccuuuuccgucucugccuuauguuccaugaccaguaaccgcaauggcuucacguuccaaacacauccgggacccagggguuuccuccccgcgccgcccuccuuugggccaucccuccccaggucucgagagaccgcagcaagagucuccgcuaacgccucgccgggcccccgccgccuuccccggaggcugcuccagggcccgggaaagcucucacccccgaacccggcguggccccuccgcccccggcccgggaagccaaguccccgcaacugcccuuuccgcggccggaauggccuuucccgaccggcccugguuuccccggccgccucgcccaacugcugccggcuccaggggcgcggccgggaccccaggcccgaggagggcgucggggcggggaaggggccagggugcggggacccagcgaccgccugggccuuaccugaggcgggggcggcggccgcgcuuggcggaggaacuggggucccgcugcggcccagaccucccggccgcgggcccagccgccgcaccagccaccgcacagcgaucagcagcaccgaggcgcccagcagcucccaggccagcgccgcccacucggccgccgccagccgcggccacagcaucgccgccgcccgggccgcagccgccgagaagcccgcgccccgcgccgcgcccgucccaggaccccgc

SEQ ID NO: 191497 - RNA, 36198 nt, Homo sapiens
gcgggguccugggacgggcgcggcgcggggcgcgggcuucucggcggcugcggcccgggcggcggcgaugcuguggccgcggcuggcggcggccgagugggcggcgcuggccugggagcugcugggcgccucggugcugcugaucgcugugcgguggcuggugcggcggcugggcccgcggccgggaggucugggccgcagcgggaccccaguuccuccgccaagcgcggccgccgcccccgccucagguaaggcccaggcggucgcuggguccccgcacccuggccccuuccccgccccgacgcccuccucgggccuggggucccggccgcgccccuggagccggcagcaguugggcgaggcggccggggaaaccagggccggucgggaaaggccauuccggccgcggaaagggcaguugcggggacuuggcuucccgggccgggggcggaggggccacgccggguucgggggugagagcuuucccgggcccuggagcagccuccggggaaggcggcgggggcccggcgaggcguuagcggagacucuugcugcggucucucgagaccuggggagggauggcccaaaggagggcggcgcggggaggaaaccccugggucccggauguguuuggaacgugaagccauugcgguuacuggucauggaacauaaggcagagacggaaaaggcaaauguaacucagggguuuggggccagaggaagagggagaagguggccauuuauugcuuugcgguagacugucgggucugggugauguggagaucagagguggguuuuggucguuuuaaguuugagguaacugauacagugaacuguguauuucagcuccauccccuuuuccuggcauacaacucuugaaaucccgggaaccuccaaagugaugucuuuuguaggcugaguggacugguggccggcagccccuagggagcuucuggauggggcuggucgcaggaaagaccaaggcaggguuagagguucuggggacuuucagccccacccccaaccucuggggaggagagaggggugaagguugcguugaucaccaguggcugaugaaucacgccugugaaaugaaguuccuguaaaaacccaaaagggcuggguucagggagcuuccagauaguacguggggguuccuggaggcggugcccagagaggcccugaauuuccaagcgcuuccccccgguuuuacgucacgcaucucuucaccuguauucuuuguaauccuuuauacucugcugguaaguguaaguaaaacaugucugugaguucgggagccacucuagcaaauuaccgcaaccugaggaggucaccggguuacgccccgucggucccaagcgcaggucaaacaaccugggcacuggaaguggggggcagucuugcggggcugagccguuaaccugugggggucugcugguaucuccaggaagacgcugucagaauagaugacugaauuaggaugacagacgacacccagccuguguccacugcagaacugacgaccugcgugauuuguggggagaaaauccccacauaccugguguccgaagcauguugcaagacuagugggagaaacugaguuuguuuuuacucuaaauugucagacuguuagucacugcggagaggugcuuucugaugauugaguggggauuccuguccaauugugugaguuugugucucggcccuaccacuuuuuuuuuuuuuuuuuuuugaaauguagucucgcccuguggcccaggcuggagugcaguggcgcgaucucggcucacugcaagcuccgccucccggguucaagcgauucuccugcaucagccucccgaguagcugggauuacaggcgccugccaccacgcccggcuaauuuuuguauuuuuaauagagacgggguuucaccauguuggccaggauggucucgaauuccugaccucaggugauccaccugccucagcuucccaaaaugcugggauuacaggugugagccaucgcaccgggcccuaccacuuauugcugugggcuuaaccuguuuucagccugcucuuuuaggaauggggaugauagugauaccugguuaggcuuuuuugggaguuggguaagugcagcacuugguauguguuaagcaccucugagugcuguuacugucaccagcggcaucauccaggcagagcugcggacaagguggcggcgggugagggugguguuuugagaauggcugaaauaaaaaaauacugauuuauuuuauauaaaaauauguuuuuauauaugauguauaauauacguauaucauggcauaugauacguguauaucauauagcacauauaguauacauauauauagucagcagagauuuagagaaacugggccucgugcauugcagguggggacgguaaguggugcagcuacucugggaaucagccuggcagguuuuuaggaaguuaaaccugcccugcauuccugagcuuuuauuagacaaaugaaaacuauuuucacacaaaaacccauauuuaauguucauagcaacuuuauuuguaauuaccagaaacugaaauaacucaaaugguuaaacuugcacacugauaccccggggugccacuccgcagcgauccucucugccacgugggugccccggggugccacucugcaugauccacucugccacgugggugccccggggugccacuccgcagcgauccucucugccacgugggugccccggggugccacucugcgugauccacucugccacgugggugccccggggugccacuccgcagcgauccucucugccacgugggugccccggggugccacuccgcagcgauccacucugccacgugggugccccggggugccacuccgcagcgauccucucugccacgugggugccccggggugccacacugcgugauccacucugccacgugggugccccggggugccacuccgcagcgauccacucugccacguggguggaucucaagggcauuaugcugaauaggaaaagccagucucaaaaguuguguacuuggccgguugcgguggcucaugccuguaaucccagcacuuugggaggccgaggcagguggaucacaaggucaggaguucaagaucagccuggccaacauggugaggcagucuccacuaaaaauacaaaaaaauagcggggcgugguggcagguaccuguaaucccagcuacucgggaggcugaggcagcagaauugcuugaacccaggagguggagguugcggugagcagagaucgugccacugcacuccagccugggcgacagagcaagacuccaucucaaaaaaaaaaaaauuguuaauggaacauuauaacccaguguucagaccuagcuguuucucacaucuuuacccaucgaucugucaaagaccuugugaucauacugauacuuccaauuucaaugcgacguccgcggguuuauucuuuuuuuuuuagguggagucucacucuguuguccaggcuggagacucacugcaaccucugccugcccaguucaagcgauucucccaccuagccugcugaguagcugggaugacaggugcaugccaccaugccuggcuaauuuuuguguuuuuaguagacaccugguuucaucauguuggccaggcuggucucaaacaccugaccucaaaugauccaugcaccuuggccucccaaagugcugggauuaccagcaugagccaccguguccggcucccuggcuuuauucuaaugcaagagucaguaaacugugguccaaacuggcccccaccuauuuuccuuaguaaaguuuuauuggaauacaaccauacccuuuuguuuauguauaucuguggcuguucuuuuuuuuuuuuuuuuuggagacggggucuugcucuguugcccagguuggagugcaguggcacaaacagggcucacugcauccucaaacucuuaggcuuaauuuauccuccuuccucagccccccaaguaguuggaaccacaggugcacgucaccacacucagcuaauuuuuuuuuuuugagacggagucucgcucugucgcccaggcuggagugcagugccgccaucucugcucacugcaaguucugcccccuggguucacaccauucuccugccucagccuccugaguagcugggacuacaggcgcccgccaccauggccggcuaauuuuuuaguauuuuuaguagagacaggguuucaccguguuugccaggauagucucaaucuccugaccucaugauccaccugccucggccucccaaagugcugggauuacaggcaugagucaccgcgcccagccaucagauaauuuuuaaaguuuuuguagaaagggugucgcuguguuacccaggcuggucuugaacuccugggcucaagugaucuucccgccucggccuccccaagcgcuggggugacaggugugagccgccacacgcggccuguggcuguucugagcacucacguggccuuuggcucauagagucugagaugcuuacucucucgcccuuuacaggaaucguuugcugaaacccuguucucacucccacuuuccuuucugucauugagaguccuggcucucaucagccaccguguauuccaauuauuugcuuugcccuagaguccacagaaaauagcuuuagguguguuaaccuauaccauugugaaaacaucuacugccuagagccuguucacacgguaauggugcacaguccuuuuugucuuucuccuuagagcaccuagucacucacuguuuuccaaaguuacguagguuagcuuccccuguguuacucacuuguaauacaguuaggugcauuucuucuggcuaguauuccaugugggugucucccccaucuuuuuguuuauuuacuuauuucuuuuuuuuuuguuuuuuuuguuguuguuguuuuauugagguggagucucgcucuguugcccaggcuggaguguaguggugcgaucucggcucacugugaccucugccuccuggguuccagcgagucuccugccucagguucccgaguagcugggauuacaggugcccgccacugcgccugucuaauuuuuguauuuuuuuuuuaguagagaugggguuucaccaucuuggccaggcuggucucgaacugcugaccucgugauccacccaccucggucucccaaagugcugcgauuacaggcgugagccaccgcacccggcuuuacuuauuugaguauguaaaucacgaacauguuuuuaaaagucagaacccuguagaaacuuaaauucagauguauuacucccccccgccaucuuuuuuuuuguuguuguuguugagacagggucugauucugucacccaggcuggagugcaggguugccaucucagcucgugguggcauccaccucccaggcucaagugauccuccugccucagcccccugaguagcuggggcuguaggugugcacuacuaugcucggguaauuuuuuuuuuuugaaacaaggucuugcucuuguccccuaggcuggagugcaguggcgugauuucggcucacugcaaccuccaccuacuggguucaagcaauucucuugccucagccucccgaguagcugggguuacaggcauguaccaccacgcccggcuaauuuuuguauuuuuaguagagacaggguuucaccauguuggccaggcuggucucgaacucccgaccucaggugaucugccugccucccaaagaauacaacgggcugggcaugguggcuuaugccuguaaucccagcacuuugggagguugggaguucaagaccagccugaccaacauggagaaaccccgucucuacuaaaaguacaaaauuagcugggcgugguggugcacgccuguaaucccagcuacucgggaggcuugaggcaggagaaccgcuugaacccaggaggcagagguugcagugagcugagaucgcaccacugcacuccagccugccuggugacagagcgagacuccgucucaaaaagaaaaaaggcucacgccuguaauccaaacacuuugggaggccaaggcagguggaucaccugaggucgggagugcaagaccaaccuggccaacauggugaaaccccgucucuccuaaaaauacaaaaauuagcuaggugugauuccaggcgccuguagucccagcuacuugggaggcugaggcuggagaaucacuugaacucaggagguagagguugcagugagcugcgauagcaccacugcacuccagccugugcgacagagggagacaccaucucgaaaaaaaaaagaaaaauucuuuuuuuuuuuuugagcuggaguuucgcucuuguugucuaagcuggagugcaggggugugaucucggcuaauugcagccuccgccuccuggguucaagcgauucuccagccucagccucccaaguagcugggauuacaggcauccgccaccacacccggcuaauuuuuuguauuuucaguagagacgugguuucaccauguuggccgggcuggucucgaacuccugaccucagaugauccgcccgccucagccucccaaaaugcugggauuacaggcgugagccaccgcguccagccaagaaaaaaaguuuuuaaugaaagaaacagaaacugaugccauuauauaaugaacccuaguacccaucacccagcuucagcagguguuaguauuuugugacucuuugauuuuuuugucuugggccuaggugaaaugacaauggaugcucuguuggcucgauugaaacuucugaauccagaugaccuuagagaagaaaucgucaaagccggauugaaauguggacccauuacaucaacuacaagguucauuuuugagaaaaaauuggcucaggcuuuacuggagcaaggaggaaggcugucuucuuucuaccaccaugaggcaggugucacagcucucagccaggacccacaaaggauuuugaagccagcugaagggaacccaacugaucaggcugguuuuucugaagacagagauuuugguuacagugugggccugaauccuccagaggaggaagcugugacauccaagaccugcucggugcccccuagugacaccgacaccuacagagcuggagcgacugcgucuaaggagccgccccuguacuaugggguguguccaguguaugaggacgucccagcgagaaaugguaaugggaccguguguaggauuuccucacacagauagcacauacgcggaggggcgggaugacgucugaaaauggaaaacuacagauuaagaaggaaaaaauccaauccccuccaucucaucaccccaguuaaccauuguuaacauuuuuauguagaacuuuucugaaauauuugugaauuuaacaugagaacuguuaaaauuugugagguaaauuggauucuaugagauaugcuggacugagauauuaauauuaacuggcugcugcuguugguuaggaacuuuguugauuagucaucuccgccuuuuuaaaaugcaguguaaccugcacaucuuuuauguuaaugaaugcaaauggccaaugaguguauaaauacuuuucagcaucaaagauuugugguuuuauuuuguuuuuauuuauuuauuuauuuuuugagacaaagucucacucuguugcccaggccagagugcaguggcgugaucucagcucacugcaaccucuccccucccaguuuaagcgauucuccugccucagccuccugaguagcugggauuacaggcgccugccaccgcgccuggcuaauuuuuuguauuuuuaguagagacgggguuucaccaucuuggccaggcuggucuugaacuccugaccucaugauccaccugccuuggccucccaaagugcugagauuacaggcuugagccaccgcgccuggccauuuuauuuuuuuaauuuauucauucaucugaaacaggguguuacucugccaccuaggcugcauugcaguggugcagucacagcucacugcagccucaaccuuucuggcucaggugauccucccaccucagccgcuugaguagcugggaccacaggcauacgccaccacgcacagcuaauuuuuaugguuuuuuuuuguuuuguuuuguuuuguuuuuuugagacagagucucgcacugucaccugggcuggagugcaguggugcgaucucagcucacuguaaccucagccuccugaguagcugggaacuacaggcgcccgccaccauacccagcuaauuuuuuauuuuuuguauuuuuaguagagacaagguuucgcgauuuuggccaagcuggucucgaaccccugacgucgugaucugcccaccucggccucccaaaguucugggauuacaggugugagccaucacgcccagccaauuuuuguauuuuuuauagaggcgggguuucgccacguugcccacgcuucucucgaacugcccucaagcgauccacccaccuuggucucccaaagugcuaagauuacaggcacacaccagcacgccuagcuaauugguuguuuuuggugguuuuuuuuuuugagacuggggucucucucucacccagguugggguguagugaugcaaucucaacaacucacugcaaugucugccuaccaggcucaaggaguccucccaccucagccuccggaguagcuugggaucgcugggaucacgggcacgugccaguacgcgccaguuuuuuuguauucuugguagagacaauguuuccccauguugcccaggcuggucucccaacuccugggcucaagugaucugccaggcucagccucccgaagugcugggauuacaggcgugagccaccucgccuggccacaccuagguaauuaaauuuuuuuuuuuuuuuuuaagagacugggucucgcuuuauugcuuagucuggucuugaacuccuggcuucaagcaguccucccaccugagccucccaaagugcugagauuacaggugugagccacugugcccagcccaagaauuguaauuuuaaagaagauuuagcauuggaaaaaagaaaugagaacucaguauuaauugggaugccagaaauugcacacuguuaugaguauuguuauuacugugauaccauuuguggugacgccuaugaguacauaauugguuaaacacuaugaauagaauggaauauuguucuguaagaucuuuuuaaagaauacguaggggccgggcgcgguggcucacgccuguaaucccagcacuuugggaggccgaggcaggcagaucacgaggucaggagaucgagaccauccuggcuaacacggugaagccccgucuuuacuaaaaauacagaaaauuagcggggugugguggugggcaccuguagucccagcuacuuaggaggcugagguugcagugagcugagauugugccacugcauuccagccugagcgacagagcuagauuccaucucaaaaaaaagaaaguaacacugggaaaugaucauggugcaguuuuuauuuuuauuauuuauuuauuuauuuacuuauuauuugagacagagucccggucugucgccaggccggagugcaguggugcgaucuuggcucacuccaaccucugccuuuuggguuccagugauuuuccugcugcagccucccgaguagcuaguacuacaggggugugccaccacgcccggcuaauuuuauauuuuuaguagagacaggguuucuccacguuggucaggcuggucucaaacucucaacgucaggugauccaccugccucagccucccaaagugcugggauuacaggcgugagccaccgugcccgaacuauggcuauuuuuauccaguaguggacaguaaccauucgucuguuacauuguucauaaauuuuugucuccuggccaguaguguauaucuuauguauuuacgauagucucauacaaaacuuaauugugauaguuccacuacagagcuuuaauauuuuuauauaaucaggauuaucuuguuuugaaugguuucuuggcauguuuaaaaaggcauucccagccggguacaguggcucaugccuguaaucccagcacuuugggaggcugaggugggcaggucaccuaaggucaggaguucaagacuagccuggccaacauggugaaaccccgucucuacuaaaaauacaacaauuagccaggcaugguggccggugccuauaaucccagcuacacgggaggcugagacgggagaaucgcuuggaccugggagaugauggucgcagugagccaagaucacaccacugcacuccagccucggcagcugagugagacuccaugucaaaaaaaaacagccauucccggcugggcgccguggcugacaccuguaaucccagcacucugggaggccgaggcggacagaucaccugaggucaggaguuugagaccagccuggccaacaugaugaaaccccgucucuacuaaaaauacaaaaaauuaggcaugguggcggaugcccauaaucccagcuacucgggaggcugaggcgggagaaucgcuugaaccugggaggcagagguugcaagagccaagaucgugccacugcacuugagcuugagcgacagagcgagacuccgucuccaaaaaaaaaaauaaaguaaaaaauaaaaaggcguucccuguucaaaauuguguuuaaaauucucuuauguucuuggcugacauaauuauaguuuuuuuuuuuaauuugccuuuuaauaauuuuuauuuagaucuuuauaugaaauuuaguuuuuaggauagaaucuuggcauauagaauuacauauaugaacauaauauauaucauguuacaugcauauaugcacacugucgagcuuguuaauuguucuauuuuggcuagcuuaggcccuuuuucuucaggauuaaagaucugaacuaagccaggcgacuggguagcagauguggaagcugaugguuaggcccagggcauggccaggugacagcucuccagucacucuucucugauuuucauuuguuacuuuucuuacccagaaaggaucuauguuuaugaaaauaaaaaggaagcauugcaagcugucaagaugaucaaagggucccgauuuaaagcuuuuucuaccagagaagacgcugagaaauuugcuagaggaauuugugauuauuucccuucuccaagcaaaacguccuuaccacugucuccugugaaaacagcuccacucuuuagcaaugacagguugaaagguaaaucaugcagccguucacaucuugauguuccugucacauugaucccacccuguuuugugccuucuuuccucugaugugguaacuuguuuucuccaugaggguagagucgauggggucucaguggaccaggaggccaugcuggcucugaugcucguguaauuagcaucuugacucuggagaagcugaaaagaacgcuguggccgcuuccaucuguccccgugucuguuggauuuuuuucuuuuuuuuuuguaaagagacagggucuuguucuuuugccagccuggagugcagucuggugcuaucauggcccacugcagccucaaacuccugggcuuaagcaauccaccugcuuuagccucccaaguagcugagaaauaggcgugcaccaccacacccagcuaauuuaaacuuuuucuuuuuuuuuuuuuuuuuuuugagauggagucuugcucugucgcccaggcuggagugcaguggugcgaucuuggcucacugcaagcuccaccucccggguucaagcgauucuccugccucagccucccgaguagcugggauuacaggugcacacugccacacccggcuaauguuuguauuuuuagccaccauguuggccaggcuagaauuuaaacuuuuuuuauggagacagggucuugccauguugccaaggcugguugaauugcuggcaucaagugauccucccaucucagccucccaaagugcugggaugacaggcgugagccccugcgccuuuuuggauccugaaaccagucuacuuccccaccugaagcuauaccuacuucaaggacuagggcaucuggagaaggcgggcuuaucuguaggagcgguccagcccgaagucugacccaugcccaccucccagcucagaacuaggguuuugugugaagaggcucuucacggucagugugggguagaaccuccgccuuuaccuuucaucuggccucaguuccugcucccucucgcagcucacaguugucugggcuucccuggcgggcugguacuccagaggaauguugcccucuccuuccagucauccgccugcccucagucagccuuauacaggugcuuccuggauggaaaccagaguggcuucuaacagguacggauuuccuucuuugcaauuugugaggauuccucagaaggaaaucaccuuaagacagaaaucaggccgggcgagguggcucacgccugugaucccagcacuuugggaggcugaggcggguggaucaucucaggucaggaguuugagaccagccuggccuacauggugaaaccccgucucuauuaaaaauacgaaaauuagcuggccgugguggcaggugccuguaaucccagcuacuugggaggcugaggcaggagaauugcuugaaacuggaaggcggagguugcagugagcugagaucgcgccacugcacuccagccugggcgaaagagcaaaacugcgucccccccaaaaaaaucagcugggcgugguggcaggcuccuuaauccuguaauccuuugcagccacacugugcacaucgaaggucuugcgugauuucugggaguguucccuugcccgcugcugccguuauuccuccuccaccuacugaccgagcuuucagaguucacuggccggguguggugacucgucccuguaauuacaacacuuuugggggcugaggcagaaggaucccuugaagccaggaguuugagaccagccugggcaacauagaccucaucucuaaaaauacguguguauauauauauauauauauauauguauauaagccaggcguguuggcauacaacuguagucccagcuacuugagggccugagaucacuugagcccaggaggucgaggcugcagugagcuauauucgugccaccacacuccagccuggguaacagagccagacccugucucugaaaaaacacaaaguucaccaaacuuggccucauucacagagccuuucccagcaagauuguggcagggucuggcugcucuuccacuugcugugcucaugggggcgcgcuggcugccguuguaggcuggggcccccagugagauuguggccgggucuggcugcucucccucacuugcucugcugacgggcacgcuggcugccauugauugcguugcaugcuggggccgguggccgugggcccuucucgucuuuucucaccugugccucccaguuggcccagaagccucuguggaaagcugcuuaucccucaucagagggugcaugggugaugagugacuuuuggugaaacugauuguucuuaaauucugucucuuacugacagaugguuugugcuugucggaaucagaaacagucaacaaagagcgagcgaacaguuacaaaaauccccgcacgcaggaccucaccgccaagcuucggaaagcuguggagaagggagaggaggacaccuuuucugaccuuaucuggagcaacccccgguaucugauaggcucaggagacaaccccacuaucgugcagguaggucucggcgguucccucgggcaggugugcggucccggccguuccaucgcagcacucgcacagggcguguccacacaucagauaggaagcucagagcaugcgguucucuuucaggaagggugcagguacaacgugaugcauguugcugccaaagagaaccaggcuuccaucugccagcugacucuggacguccuggagaacccugacuucaugaggcugauguacccugaugacgacgaggccaugcugcagaagcguauccguuacgugguggaccuguaccucaacacccccgacaagauggugcgugcacacccuccacucacgcuuucuuuauuuaauugguuaaaagucuuuccccaaaagaaugcuuuaucgacaaguuacucauuaguauaauaacuuuggggaaaagauacaucaauuacaccccugcaaccugccuucuuaccacaucccacuggacaaagggcaccgagcgcugggguucccuggccccugcauugucgucgugugugcgaugcuguccccgagggugucugaacugucuggggacacgguugucagaggacauuuccucugccgaacaggacaccuugagcugagcagcacuuccccucccgggaguggcagagcugugcacaccacaggcaggcccucaguguccuaccaagagccacugaggcacagagcugccccugcaaaccaugcugccugacacgcagggcuguggagagagagagaggcugccugacacgcagggcuguggagagagagagaggcugccugacacgcagggcuguggagagagagagaggcugccugacacgcagggcuguggagagagagagaugcugccugacacgcagggcuguggugugagagagaggcugccugacacgcagggcuguggagagagagaggcugcuggggugcgacugcuuagaaacaggaacgaucuugguagcuccggagaaaaggugacagcaauccuggccgaugcccaugccccacccuccaccugaccuguggggucauuucaucugaagugcagccagcaggcggguuggagucacugaugagugccccccgggccaggcccaugcaaggcagcacugggaagcgggcacagcucuucuaaagggugcuaaagacaggcuuuuccuucucuuagccccucccaccccugggagcccaaaaguccuucagggcagaguagggagccaggggagcugcccugcuugagaagagaagcaaguuuuauacacugggauggagcguguuagugaaaccaacaccccaacuggaacaggcagucacacaggccagguguaaaaucccacacaguacucacagccauugagcaacccucauuuauauguuuaugauaaauaaagcaugagguaaugugaggcuugaauuucagcuugaguccaaagaaauaauauucucucacuaggaggcuaaagcugcuuugccuaauuucgauuuuugaaaaguccacugcauuaaaaaaaaauaaugaauuugcuuuucauuaaagcuagauuaguacaacaauugggcaguuguugauauucaguuuacuuucugugggcaggaaauggacacuucuuguuuagcauuucaagauaaaaacucauggaacagguagggcuuucugggugauugcauuccuucugugaguuagggaaggaggaggucaaaaaugccacuuaugcguaggacucuucaaugcuucaacauucugaugggcuaaccugauucuuuuuuuuuuuuuuuuuuugagacagagucuugcucugucucccaggugggagugcaguggcacaaucucggcucacugcaagcuccuccuccuggguucaacugauucuccugccucagccucccgaguagcugggacuacaggcacccgccaccaugccuggcuaauuuuuuuguauuuuuaguagagaugggguuucaccguguuagccaggauggucuccaucuccugaccucgugaucggcccgccuuggccucccagagugcugggauuacgggcgugagccaccgugccuggccacuaacgugauucuuaaagggagccugggcuuuggcucaguauuucaaauccuccgcccuguccacuuccuguaccccuaggaaggacagcacaguuaucuguuucaccuacaaacuuuaguauauaacuauguacacaacuguugaaauucauguggaugcgguagccacgucuccuuguggaugggcaggacuauucucaaagccggcucugcgugugcguccuggcuggccgcuuuguugcucagagcuccggcugugaugcugagggugugugugugugcucugcagcugagcguaagcgaccacaggcuuagagaggugcgggauccgacgggcucgucgccccucccugcugaggaagggagauuguccuugcuguucucugucacccacgaccuuagacuucaugggcccaacuuggucuucaaacgacuugaaaguugcaaauuuccuuacgucuccgagcuuccuacugauggcagagcccaccauggacagggccgcugaggucucugucuugguugaggucuucugucuugcugugggagcauuuccugagucuugcagagauccgggugggccacuuucucauuccacuuccacauuucucagaagucuucacauaggcguuagagaggguuccguuucagccuccaaggcagagaggcccagccuccucucaagcucuccacagucccccuccuuggcugccagcacugguguagagugacaguuuccucauccgucuugguagcugggcccugagcucuuccuccucagccucugucagacccucaacagcaguagccugggcagccccaccugugucaacagggacauuggucauggaguuggacggcaggccuuugugaggagaauucggguugacaucuuggcuggcggcgucuguguucaggcagucaugggccgcggugcgggcgcugugggagccgagugaugggcugugggagccgagcaggcagcagcaggguugcucacugcacgcacgcugcccgggagcugccucugcuggcuguuuuaauaggaaugguagccaguauuguaguuuaagaaagauuugugaggccgggugcaguggcucacgccuguaaacccagcacuuugggaggccgaggcaggcggaucacgaggucaggagaucgagaccauccuggcuaacacggugaaaccccgucucuacuaaaaauacaaaaaauuagcugggcgugguggcgggcaccuguagucccagcugcuggggaggcugaggcaggagaauggcgugaacccgggaggcggagcuugcaguaagcccauaucacgccacugcacuccagccugggcgacagagugagacucugucucaaaaaaaaagucuauagugcuuacuaucugguccuuguccaagaaagcuugccagccccuggacagaaggauggaguacagguagcguggugguauaugcaaacauccagaccuuuuuggggucgugugagagaguuguaagggauaccucuagugggugauggcgggagggagcuguaggaggacauuugcgggugaccuaggcuguguugccagggaguggaggcgggggugucagugcaggccgcaggguccaugaugaguuuuucuucccugugcagaagcuuagggauggcugccauggcauacgaugccaccggacacuucacagccagaaucuugguaaucagaggugacgagagaagguguuucuggcugugcuagguguaaaugaauucuguuuucuacacggugcaguggagcugccugugggauguccaagugaggugacugggagggaguuggcccuucaggucuugggcucaggggcacuguugaccaugaggcccgcuggucuguaggccacaguugaaggugacauugagacugcccagagcauaaggaaggauagaggugcagcugugggagcuccaggcagaugguguggagaccugugacaccauccggggaaggagggcgugacgcagcgucauggacggagaccuggguucccagccagggcgcgaugcagcaucgucagcagugaaaaaaauuucguuuacuguggugucacaggccgcagagacuucuuugaguacagaccaaauucgugcgcuuugcuuuauucugguugugguccucaucuguguauuucacuuccugggcauguuuuacaugacauuguacugggcccugaaugguuaaagcugcuguucacuguuuauggagaauuuaagcuccuccagggucugggcacccaggucaguaugcuaagcucaagccuuggcacgaaguggguaugugcuagaaugccaauuauuuuuccauuauaaaagcagagucuuuuauggccuuuuuguuugugagucuuuuuuuuuuuaaaaaaguauaagccaggcucggugacucacaccuguaaucccagcacuuugggaggcaaaggcagguggaucaccugaggucaggaguucgagaccagucucaccaauauggugaaaccccaucucuacuaaauauuaaaaaaaaaaaaaaaauagcugggugugguggcgggugccuguagucccagguacuggggagccugaggcaggagaaucgguuaaacccgggaggcagagguugcagugagccaagaucacgccagugagacuccgucucaaaauaaauaaaugaaugaaugaaugaaugaauauguauuuucaccuuagagcaaccucaugagacaagugugaauaauuguacuuccucugcaccuuuuuucagggcuaugacacaccguugcauuuugcuuguaaguuuggaaaugcagauguagucaacgugcuuucgucacaccauuugauuguaaaaaacucaaggaauaaauaugauaaaacaccugaagauguaaguacuuauuacaaugcaguugcuaucuagaguuagaaauggaaauauauaaauuuacagucugugaucacaggcacagggaagccacaaggagcucuguaugaguuguguuugcuuuaugggcacauguuagaaccuuggcuguugaguaagaugcacuuugugaagaagaugcaucuguagaaccaggagggaaggaacugacgcaguuugcugauuuuauuuuccuaaaacuggcagucaguugcuuugaacagcucacagucuuuuaucaaguucccucucugaacacaucaguugaccagagucagagagaacagagguggugauggugguggugaugaugauggugauggugaugauggugguagugaggaugaugguggugaggauggagauagcaaugaucauggugguguuggcagugguggugaugauggugacgauggugguaaggaugaugaugcugaaagcagcuaaauuguauucagcucagugugcaccaggugcugugcuaagcuucucacacauacauacucaucggacccagacaagccuucagucaggccucgucaugauccugagcaguugagcaaagugcaccuugcagagggcagaaguauauucugugcccacaaagugcaagaaguaucuggaccuucugagaacugaaagaugaguuugauuuuucuguguauuacagcugugagcugucccuugucuagcagcccuuuagaaauaaaagcuauaaggaucuucugguggcaguggccucucccacaccccuucuguaauugcuguuauuacauaagcuauacauccacuugccauagaaaacuuaaaauacugcuugaucaaaaagaauaaaauucaccagaaaauucuacaacugagaaauugcuauuauuuugcauacaugugauucuuuuuguguguguguguguguguguguguguguguguguguaucuguacuucaacauaagaauggcauuugguaaccaacuuaaaacuccuggcauuuuaaaaagcauuugacuuuuuaaagcucacaaucagguacagacucaaaaauguaguugcauucauaguuuuaauuaguuucucucauaggcugguuccuuucuuuccuuuuauuugaagguuguugguuuuucuauaguuucuagcaaaaguucguauugcugcaauucuucaagggcugagaaaguugauuucuuuaguggcaaaaauagaacuuugauguuccguguuacuuaggagcuccaccuugacccagccucacaacaaaaaguuuguguaugaccaggcuuccuguaaguggaacucaaccaaccaagaagguuagaaacauguucacgugcuucugcuuuuacucgaugcgcugguaccuuuuccucuccuugcagacaguuagaaaaugucgaguagcgcaaacaagaaguaaauuuacccauaaucccagaguguguucuccuagcugucuccuuagacuuuuagaaagaccacacucuucacacguuuucugagugugagcuuuauuaaaucuuuagcauuaagauacuauucuacuuuacugaguuuaaaacuauuuuucugaaaucauuguaaugauaaggaaauguugcgaucaaauaagauuuagacacacuuuuuuuuccaauagguaauuugugaaagaagcaaaaauaaaucuguggaacugaaggagcggaucagagaguauuuaaaggguaagauggggaguuggugccuggaucgugggguccacgccgggaagggccuuggagcguugggggacacagcagagcuuugcuuuccugagcuccccgggcgugugccggcuccccucggaagccucuccucgggaucauccuuucuucuccugagcucuccuagcucauuugccaccuuuuuucuguuaucccuucucugaagucuuguaucuguuccuugagcuuucugugagagaacuuuuuugagguugugugucgcugccuguugcugguggccucaucccuggauccaucggucucucucgcaguagcuucauugugauggcuucucuucagguggagccugcaguuggcaaagaacagcucagggagaggcaggguccagagcuccuuggcuggguggcuggccuggcuuuugugugucucuuugccuguguuggggugggggucgcucccugucacuccuucgauucugaagcugccuccuuccuccuccuguacuccuggugcacgcccaggcuccugucuuggcuccgggacacucccuccccacucgccuccgggacguucccuccccacucgccucugggagagaggccuuugcuuucugggccgcccucuucuagucagcagcuucuaguuguuggccccugugccuugcgguuuguaggugccaggcaugugaaaacggcugguuucagggauggcuuuucccugccaucuuccucuguuuucagugaauuuuggaagaugacacuucuagaagcgccucuucuuugccaucuuagcucgaagucuggagcuucugcuugcuggugagauugaagcagacgcugagguccuuucacccaccugccugcuuuccucucucucggauuccauuccuauccaaaacucugucucuauuuaaagcaggguccgcaaaugacugcuuuuaaaaauaaaauuuuaucagcauaaagcugucaccaccauuugcacacuguccggguucuuucccagcacacagugacuuguggccuacugagccuaauuauuuacugucugacauuuuauagaaguuuaccaagcgugaucuaaggugugaagagccucugcuuguccccugaucuguucccguccuagguauaauuuauuaauuacacuucuucaguguguguagcugugcacaggaaaugaauccugcaugcuguuagcggcgagaguuccuccucagggccguugaggcgucgcugcagaggcccagccggaaccuucagaggcccugggaacacacagcuauguugccagaacaucccugaagagccgagagucugcuccggauuuucaaaccacacugucagaaaugcuuugcaacgcugacauuaagcauugcuuugugaugguauuuaggaagcaauucugucugagagauccuugccuaugugugacaguaaaacacugucgccucuaagaucugccccagcagcuguuugcugaggagaaggcagcucugugagauccauguuccugugggcugagcuacacggcaccuccagagcuccuacaccuccuuccugguccuucugaggcucaugcgaagcccaggcauggucagcaucuguggucacgcuggggccucggucacguuguagcuucacaugccacagagccugcuacagggcuggcugcauccugcaucccacccuucccgucacucagagagagacccacgcuugugugaagaugaggaaggacucuaaaguguuaugagagacaaauaggaucagaaagccaggcacaaaacuguccagagaccgugagucccaucuguagacagaaauuguuaaaagggacucaaaucaauaugccaaaaaaguaaacauuaguauuuuaugaguaaaguguagguaaauuguaccguauaccuaccaugcacccuauacuguacauacuguaugucuucuuuuccugugccacugaaagagggaaaaaacugccaauuaaccuguaaaaugccaacauacauaggaugcauccaaauauaagauaguaauauguaagacagaguauuugaauugcccuaauuuucaguauggaaaauuaguacucuugaauggaaauucuucaguaccuucaguacucuugaauggaaauugucguacuuuuucuuaacuuucauuuuagguucagggguaagugugcagguuuguuauauagguaaccugcaugucaccgggguuugggguacggauuauuucaccuggugaucaguauaguacccaggagguaguuuuuccauccucucccuccuccucacucccuccacccucaaccaggcccugcugacuucuuguuccuucuuuguguccaugugugcucagcguuuggcucccacucauaagugagagccauguuugguuuucuugccugugucaguucccuuagggucauggccuccagcuccagccauguuacuucagaggacaugaucuuguucuuaauauccugugguauauauguaccacauuuucuuuauccaguugaccguugaugggcauacagcacuuuuacaauuagaaaaaaauuaaaagcauaaaaacuaugauaagcagccgggugcgguggcucaugccuguaaucccagcacugugggaggccgaggcaggcggaucacaaggucaggagaucgagaccauccuggcuaacacggugaaaccccgucucuacuaaaaauacaaaaaauuagccaggugugguggugggcaccuguagucccagcuacuugggaggccgaggcaggagaauggugugaacccgggagguggagcuugcagugagccgagaucacaccaccgcacuccagccugggugacagagcgagacucuguuuccaaaaaaaaaaaaaacuaugaaacuaugauaagccuuuaacauaagaaauucccaggcauuccagaguagcaugauugacuguaaaggaagccucuugacucugggucuccaggagcuggguuugaaagcaggacgaggugguguguggccuccgugcaaccuacagaaccucacgacacuauccuauauggcuugacugcgcugucccgugggaccugaagacacuacucuuccuugugcuuuuuccauacucacauccaagugccgugugauuccagaucuguugagagaugcguauucagugaugcaaauuguaaaguacaagagaagcaggacugagaagcgaggaggccgggcacagcggcccacaccugugauaaacuacaagagaagcaggauugagaagcaggauugagaagcgaggaggccgggcacagcagcccacaccugugauaaacuacaagagaagcaggacugagaagcgaggaggcugggcacagcggcccacaccuguaaucccagaacuuuuggagguggagguggaaugaucacuugcauccagcaguucgagaccagccugggcaacagagcaagaccccaucucuacaaaaaguaaaaauuagccgggugugguggcgcaugccuguggucccagcuacucaagaggcugaggugggaggaucccuugagccugggaguucgaggcugcagugagccaugauugcaccacagcacuccagccugggugacagaaugagacucugucugaaacuaagaggagaaaaaaaggagagaaggaauaaaauauuacuuuuuuuuguuuuuuugagacagauucucacucugucgcucaggcuggagugcaguggcgugaucucggcucacugcaaccuccaccucccagguucaagugauucuccugccucagccucaugaguagcugggguuacaggcacccaccaccacacccggcuaauuuuuguauuuuuaguagagaugggguuucaucauguuggccaggcuggucuugaacuucugaccucaggugauccacacaccucagccuuccaaagugguaggauuacaggcgugagccaccgcacccggcuggaaugaaauauaacauuuuuaaaauguauuaagcuccuacugugugcuacucuuauucacucagguccgaccccuuaguccuuuaacuaccuggggcuuccuuuucuuuucuuucuuuucuuguagcaguggaggaaaaugaggcugguuaagugaagugagcucugagaccuugugugacuuuguuuccauuguauccauuugcauuaagugcagugagcucuggcggaaaccacccucugccccgucuguuggauccauuugcagaggccuuggcaagggcucgcgugauccccguccugcucacccaggccugaccugcggagggggcggaagccugcagccagugccugucuccucccucaggccacuacuacgugccccuccugagagcggaagagacuucuucuccagucaucggggagcugugguccccagaccagacggcugaggccucucacgucagccgcuauggaggcagccccagagacccgguacugacccugagagccuucgcagggccccugaguccagccaaggugagcugcuguagaagcuucuggaaguggugccuggcugucccuauacugugcugcuggguguuccagccuguugccuugugcguggucucagggaccauguccuguggagccccaagguuguccucaucucaaaccauccaccagugauuggugaugagaacguuugucagagaaauguguguucuuggcucuguggcuugcuuaccagggccgaugugcugggagccacugucucaacaaagcagacauucccugggccagccccguccugugcgcgugucgcccuguucuugcuguguugauggcccguccuaggcaccuugcugguguagcgaggcugcccguugugacuaggaaagcuccaucugcacguccaccuccugaccacguuucccuguggcugcagcccccgcuggcuuccucucagacaagucccucuccuggaagccucagccccagguucuacucauccccaguguucagagaaauccuuaauggugguguugcugggucaaagguuguacacuuuuuuauuuacaguugacaauucuuucuccuguuggaauacuucacacacugaccugcacgcaccauccugugcuagaaacuuucuaaaucaguugcgaugaaaacggcuccaggccgggcgccgggacgcaugccugaaaucccagcacuuugggaggccgaggcggguggaucacgaggucaggagaucgagaccauccuggcuaacacggugaaacccgucucuacuaaaaauacaaaaaauuagccgggcgugguggugggcgccuauagucccagcuacucgggaggcugaggcaggagaauggccugaaccccggagguggagcuugcagugagccgagaucguaccacugcacuccagccugggcgacagagcgagacuccgucuccaaaacaaaaaagaaaauggccccaaaauuaggugguaucagguaagguuaggugagaugcauaaagcauaaagcucuagggagagugacugagaaagaucugguuucuucuccugcgaugggagcagugucacaugugcgucgggguggcagcuccgagccguccacuguccucagggugaggccucgugcucgggcccuccugguucugaaccucacagcccagacggggcugcaagaaaggagaccgccuccccucccccaggucagagugcagccgugcggccacucagccaugccacaggugggcacguggcccagggaucugcuagugaaggggagagaaggaagggugugcggagacaggcagcuacugcgaugacgacggcucuucagguuuccgcagcugaggggcgcagugccugacacggcucaauacauuuuuuuuucuucauaggcagaagauuuucgcaagcucuggaaaacuccaccucgagagaaagcaggcuuccuucaccacgucaagaagucggacccggaaagaggcuuugagagagugggaagguacugaaaggcugagccgcagcagcguggggcacacaguugguugcauuuugauuaaugacagaaggucaaaucacagcuucaaaguaccaauuuccagaaggcuuuucugggagacuugguccuuuucgugaaggucuaauuccuuguggauguuguggaauucuagcuuaagccagucccgucccagaccugggggaugucugcagugccuuccuuuccuuuucuaauuggaauuccuuguugguucugggacauguuucuaaggaaccuuaauauuuuauagaagguaccauauaaugcuauggauuccuugggaaaaaauaggccauagccacaaagcuaaauuaugcuguaaucaaauaaagcuucguggaauuguuuagaauauuuucucaaaauaugugcccagugucagguguacaacuggaacccagaaaggaccuccaggcuuucgugugccuggccaugacuagaaccacgggcaaguucacagggcuguuccgugaucaugaacacguccgucugugggaguugaacugugugaccuggguugcuggcgugagggucugucgggcugaggccuccuuccugccugcagccgguucacggcuccugagagcugugccggguccugcuuaccugugaggaggcgugcuguuucagaaaaugcaccguaugauuucagcugccaguuaaggauaaaggaaaauuauaaccaugauugcagacauugcuuugguacuugaagcuuuaguggcuuuuuucuguguaguucugaguauuuuuucugguuucacagcugguuaauuguguuuuguuucuuacagggagcuagcucaugagcugggguaucccuggguugaauacugggaauuucugggcuguuuuguugaucugucuucccaggaaggccugcaaagacuagaagaauaucucacacagcaggaaauaggcaaaaaggcucaacaagaaacaggagaacgggaagccuccugccgagauaaagccaccacgucugguaagcaugugcaggcguggcuguggcagcugggaggggccccccauggccggggucugacgggaugcgcacaucuguuucucgucucuugguguuuuuaacguaaaggucugguacuuucccuuagguuaguauuuuuugagacggaaccucucuuuguuacccaagcuggagugcaguggcgcaaucuuggcucacugcaaccuccaccuccuggguucaagcgauucuucugccucagccuccugaguagcugggacuacaggcgcccgccaccacgccuggcuaauuuucguauuuuuuuuuuuuuuaguggagaugcgguuucaccguauugaccaggcuggucucgaacuccugaccucgugauccacuagagugcugggaagguuaauguuaaauggguugugugucggggaggguacaugaaaaauaauggcaucgcuuugagcaguauugcuguuucugcuuguguuugcauuauccaaaaucuaauauaguuucauucugugccguuuucucaaaacucauaauagcugaacuccauuggcugagccugauauuuuagauuugguauauuuucaggaaaaagacgagugcacaucagaauacugguguauaucagacaccagggcacgaagcgccuugcacggugcguaucagacaccaggacgcagagcgcuucacacagugcauaucagacaccaggacgcagagcgcuucacacaguguauuucagacaccaggacgcagagagcuucacacggugcauuucagacaccaggaugcagagugcuucacacggugcauuucagacaccaggaugcagagcgcuucacacggugcauaucaggcaccagcacgcagagagcuucacacggugcauaucagacaccaggacgcgcagugcuucacacgggguauaucagacaccagcacgcagagagcuucacacggugcauaucagacaccaggacgcagagagcuucacacggugccugucagacaccaggacgcagagcgcuucacacggugcauaucagacaccaggacgcagagagcuucacacggugcacgucagacaccaggacgcagagagcuucacacggugcauaucagacaccaggacgcgcagugcuucacacggugcauaucagacaccaggacgcagagagcuucacacggugcauaucagacaccagcacgcagagagcuucacacggugcauaucagacaccaggacgcgcagugcuucacacggugcauaucagacaccaggacgcagagagcuucacacggugcguaucagacaccagcaugcagagcgcuucacggugcauaucagacaccaggacgcagagcgcuucacacagugcauaucagacaccaggacgcagagcgcuucacacaguguauuucagacaccaggacgcagagagcuucacacggugcauaucagacaccaggaugcagagcgcuucacacggugcauuucagacaccaggaugcagagcgcuucacacggugcauaucagacaccagcacgcagagggcuucacauggugcacgucagacaccaggacgcagagagcuucacacggugcauaucagacaccaggacgcgcagugcuucacauggugcauaucagacaccaggacgcagagagcuucacacggugcauaucagacaccaggacgcagagagcuucacacggugcguaucagacaccagcacgcagagcgcuucacggugcguaucagacaccaggacgcagagagcuucacacggugcguaucagacgccaggacgcgcagugcuucacacggugcauaucagacaccagcaugcagagagcuucacacggugcguaucagacaccagcacucagagagcuucacacggugcaugucagacaccagcacgcagagagcuucacacggugcauaucagacaccaggacgcagagagcuucacacggugcguaucagacaccagcacgcagagcgcuucacagugcguaucagacaccaggacgcagagagcuucacacggugcguaucagacaccaggacgcagagagcuucacacggugcguaucagacaccaggaugcagagcgcuucacacggugcguaucagacaccaggaugcagagcacuucacacggugcguaucagacaccaggacgcagagcgcuucacacggugcguaucagacaccaggaugcagagcgcuucacacgguguauaucagacaccaggacgcagagcgcuucacaugguguauaucagacaccaggacgcaaacgcaaagcgcuucacacggugcacaucagacaccagcaugcagagagcuucacacggugcauaucagacaccaggacgcagagcgcuucacacggugcauaugagacaccaggacgcagagcgcuucacacgguguauaucagacaccaggacgcacacgcaaagcacuucacacggugcauaucagacaccacgaugcaaagugcuuccaaagcacagaugcacugaauggaaagagcaugauggaagagguuaaucuacaaaaucuaaaagugauucauaaaaacaucaacgauggccgggcacgggagcucaggccugcaaucccagcggccgggcguggcggcucacacuauaaucccagcacuuagggaggccaacguggguggauugcugaaacccaggaguucgaaggcagcuugagcaacauagugagacucugucucuauuuauuuuuuuaaaaaaacagaaauuugcuaauaacuagagauucgaaucugcuaaaauacaaauuaaagcagauauacaguuuaaacugugugugugugugugugagugugugucugugugaguuuguguguguaaggucauaauagaaccauuagcccgcaagacacuucauuuauaaaacaaacucccuggaaugauagaaaaugaaaaugauugacauacauuaaacuaagaagcagugaaucuucaacagucacgaccugugacucugaaccacagaacuagagcgacgucagugccgucguuauacaggaaucauugaagucugaccuugcuguguuguagcugaugguggcacagaacucacuucuguaaagcggccucauuuacaguguugucuugugacuauguacauuuuaauuaguaaauauuaaauaaaguugaggcauuuccuaaguagcaggagccacagcucaaguguucuggauccuccuguggccgcggccaccaucgugaacaccaaacgggacauuucuguugccugucgcacagugcugcgcccgggagcucuucuguguuaucuucacaccuaaagcgcagcaggguuacuucauggaguuguucuggacgaucuucgggauccucuggggcacugugacacucggagccccuggggucgcagcagaucggagcuggaggguggcugggggugcagggcagucaucucgcccaucaccugggcugcccuuggcguuuucaugucccugccuuugaaagaaaagucagccuggcagcuuuauuucccuccucgucugaaauagggucucacucuguggcacaggauggaaagcaauggugcagucacagcccacugcagccucccccuccugggcucaagcgauccucccacuugagccucccaaauagcugagacuacaggugcgugccaccaugucagcuaauuuuucuauagagaacgggguuucgcuauguugcccaggcagucuugaacuccugggguccagcgaccccccugccauggccucccagagugcugggauugcaggcgugagcuucugugccuggccccagcagccugauugugucuggaggguccuguuugcccuuuuccagggagucgugugggugguuuuccauccugaaaucugaugaggagguuuuggaugcaagaguugcuguugcuggggucacggcaguuggucgcggauggaguggggagguuuuggguauaagaguugcuguugcuggggucacggcaguuggucauggauggggcggagcagcuccguggcuuccugucguucccaucacugaagugcuccuuguuguccucacaggcagcaauuccauuuccgugagggcguuucuagaugaagaugacaugagcuuggaagaaauaaaaaaucggcaaaaugcagcucgaaauaacagcccgcccacagucggugcuuuuggacauacgaggugcagcgccuuccccuuggagcaggaggcagaccucauagaagccgccgagccgggagguccacacagcagcagaaaugggcucugccauccucugaaucacagcaggacccuggcgggcaagagaccaaaggccccccguggggaggaagcccaucugccaccugucucggauuugacuguugaguuugauaaacugaauuugcaaaauauaggacguagcguuuccaagacaccagaugaaaguacaaaaacuaaagaucagauccugacuucaagaaucaaugcaguagaaagagacuuguuagagccuucucccgcagaccaacucgggaauggccacaggaggacagaaagugaaaugucagccaggaucgcuaaaauguccuugagucccagcagccccaggcacgaggaucagcucgaggucaccagggaaccggccaggcggcucuuccuuuuuggguaggaguguguugcccucugcacucacuuuccuuccccaccuucccuccccccucccccuccccucaccucccccuccccuuccccucccacccauccacuccccucaucucccccuucccucaccucccccucccccuucccucaccucccccuccccuugccuccccucccccuccucucaccuuccccuccccucccccuccccucccacccucccauuccccucaucucccccuccccuaccccuccccucaucucccccucaccucccccuccccuauccccccaccccauccccucgacucuccucuccucuccuuucuuucagauggagucuugcucugucgccuaggcuggagugcaguggugcgaucacagcucacuguaaccuccaccucccagguucaaccaauucuccugccucagccuccugaguagcugggauuacaggcgccugccaccacgucuagcugauuuuuguauuuuuaguagagaugggguuucgccauauuggccaggcuggugucgaacuccugaccucgugauccaccugccucggccucccaaaguguugggaucacaggcgugagccaccgcacccggccuccacacaagcuuuuguguggacuugccgugugcguucaguuccugucucugaguccagcuucuagaugcucuuucugggucuuccucugguuggaccgugggugauccuaguguuggcuguuauuugcuagggaugugccugccaguggugugaaugaucucuucuaaauccuucuaggaagaaaagccaucuuggggucaaucucaaucuaacaggggauaaaugucccuaaccuucugguacugagcacccucugggggugcaaguaugcaaaacugcauuuuaacagcggguggauccugcuaccauagagaaugcaggcgugcacccagaggcgacuccucccuggccccugcucuucucaucacagaacagcgagucugcauccgccucccuggccuugggagaugccucccucugcagagcuaaugcccugacaugcugcugcugguucccugguuccaucugcucaggccagaucgauccuugcacacuguuguuuugugugcuggguucuugaguuuaaaauguagugauauuugucugggugugguggcucacgccuguaauuccagcacuuugggaggccgagguggguggaucacaaggucaggaguucaagaccagccugaccaagauggugaaauccuaucucuaauaaaaauacaaaaaauuagccgggcgugguggcaggcaccuguagucccagcuacucgggaggcugaggcagagaauugcuugaacccgggaggcggagcuugcgaugagccgagaucacgccacugcauuccagccugggcgacagagcaagacuccgucucaaaauaaaaaaaaaaguagugguauuuuagaagucuuuauguuuuuaccaaagauguuuuugcuucuuuuauugugcuuucuagagaggagccaucaaaacucgaucaggauguuuuggccgcucuugaaugugcagacgucgacccccaucaguucccggccgugcacagauggaagagugcuguccugugcuacucacccucggacagacagagguauguggggcccggacagccugucacccgcagggcagcuuuuggaaacuucugcaggguccaguuccacuucaugcgaaccuaucaguggcuuuucccaacgcuggcaggcccgucagccaggcuguggauuuggguguuguggcucucugcacacaggacagagcucugguuggguggaaaagcugaacgggucagcuccugacaagcugagggcuagaaggguggaagcagcaggguuucuacucagaucacacaggauucuccgggaaacccccaugagcuugacucucccagugcccgcggugccaggguucagcagugccucuccuccacccagacgcaugugcccacggugccaggguucagcagugugucuccuccgcccgggcgcgugugcccgcggugccaggguucagcagugcgucucuuccacccgggcgugugugcccgcggugccaggguucaccagugccucuccuccgcccgggcgcaugugccugagucuggggccauuauucuccgacuuuugcuguucaucuccgggccugugcccgucugcuaacaguucuuucuugcuuuccgcaguuggcccagucccgcggugaaaggaagguucaagucucagcugccagaucucaguggcccucacagcuacaguccggggagaaacagcguggcuggaagcaaccccgcaaagccaggccugggcaguccugggcgcuacagccccgugcacgggagccagcuccgcaggauggcgcgccuggcugagcuugccgcccuguaggcuuggcgcugggcucucgguuuguucuucauuuuuaaagaaggaagggucauauguuuauugcuaaacugucaaaaaggaauauauucugauuaaauuauuacuccucacuuugagggugugagaauuuuagaagauuuaaauguucuauauaacacuuagauuucugauauuuuggaagaaguuagaaguuaaugaaagcaaacucaguuaccaauuuucuggaaaauauccaugugguaaugguagacuuuuuagguggcaauuucuaggucugaaauauagcagaggaaagggcgcugaggcaguugcaggcaggcagcccuguacuuacccuguacucaccucauccgacagacgcuguggaugaggaggggcuuggcggaggcgugagcaccgaugucccuuugauaaccugcacucaccaagaugaacuauuugccgcccugucuuuuccuggguugggggguggcaucugaugguggcagagugccuguugguucgcccgugggucucaugguucagacagagggagguggacggcagggaucagggagccaggagcgcgccucagacuugcagcaaccauugugauuuggguuguucggaauauuuaaauuacugaucagaagaugaaaguagcuuuucucuugggaagucuugcagcccgugggagugauaccaggagcaacacagagcucagcagcggcgccaagguguucccuguuuccucagcacgugagccuucaccgccugcuucauucaggagccagugcagcaguaauacagucuauacauuguucuguuuucaaauuuauccugaggcuuuguugagcauaaaugauuauacgauaaagguauccguuauuuuggaacucauuucaguugggaucuccuguaugcagaguguugcauuuagagguuugagucccaucuugguuucuugccgugcugacuguagccuucaccuugacuugaaugaaggucugugguuggaaugugugaggagccgcugagguguucaggaggugcugccuggaggucgguuucuuccuggguguuacgggcaacugcucacacaguuguuucucugugaacauuuccaguguuuaauccaaaaugaaaacccaccaaugcuuuugcuaacuucagugccuuuuauaaaucauuuuuaaauuuccugaacuugcuuuuugaggauauacagggauauuaaguagacgcaggauuguuuuuguuuguaaaaauucugaauugaaacuuuguuuuaaaaaaaggcuucuuucuuucauaugacaagagauaggucaggaauauuggaaucaagauuuaaauguuaaaauucgauuuuguuacacaggguguguucauuuguuuuguagcagacaagaucuagaucccagacagaaacaacacaugcuauucuaaaaagccgcauuuuaaaaggcaccuugguucucaaaagaaaucagaauauggauauucguagugaugaucuguuuucucuaaaaucuuaccauauugucuguauaugguuguaaauucaaauggaaaguaaaacguuuuggcccuga

SEQ ID NO: 191498 - RNA, 11931 nt, Homo sapiens
uccuuuuaaaaaaacaguaaaauuuuauuuauuaugcaaucauuuccaaaguagacagagaaauagaucagauaucccaacuguauugacuacagaaaauagucacaaccacuucauagaaauuguacuguuuuuccuaaauuaacagcauaucuggguacacacaacauguuugaauauuuuaaucccuggccaggcaugcuagcucacgccuguaaucccagcacuuggggaggccgagguggguagaucacgaggucaggaguucgagaccagccuggccaacacggugaaaccccaucucuacuaaaaauaaaaaauuagccaggcaugguggugggcgccuauaaucccagcuacuugggaggcugaggcaggagaaucguuugaacccaggaggcagagguugcagugagccgagaucgcgccacugcacuccagccugggugacagagcgagacuccgucuccaaaaaaaaaaaaacaaaaaaaaaaccacacauuuaaucccuaagcauaaaagauuaacuggaggcaaacuaagauugagcugucaaucugaaguauuuuacucaauaaggguaacccccuauugggcugucacuagcgugucaccucagccgagaccagcaugaaggucaaaggcgaagccaccucuguagacccaccucaccugccccucccccauccagucaccugugcagcuggcuagucccucggccccuaaagaccuaaucaaguuggugaguucagacccaacaucaucaggaaaucuguaaauuuggagaaacuuguuuucaaagcaaaaacccagaugaagaaaaaaaaauuuuuuaggccaggcacgauggcucacaccuuuaaucccagcacuuugggaggccaaggugggugaaucaccugagguugggaguucgagaccagccugaacaauucuauauugguuucuccaugaaacccugucuuuacuaaaaauacaaaaaauuagccagguaugguggugggcgacuguaaucccagcuacucgggagcugaggcaggagaaucacuugaacccaggaggcagagguugcggugagccgagaucgcaccacugcacuccagccugggcaacaagagugaaacuccguuucaaaagaaaaaauugcuuuaagucucccucgcuugcccaggcuggagugcagugacacaaucacagcucacugcagccuccagcucccgggcccaagugauccacccaccucagccucccaaguagcugggacucuagaugcccacgacacacccagcuaaguucuguauuuuuaguagagacagggucucgcuauguugccuuguccaggcuggucuugaacuccugagcucaagugauccucccacccuggccuccugaguagcugggaauacaggugugagccacugugcccagccagaaaaucuuuaauugacaaauauuuaagggacaagaggguuuuaagaaauuaaaaggauguaugaagugaagugaguugugaacagaaccugggugcccuccucauccacgugccucagucgcccucgugccugaccggcuuugccaauggagccuggacccucagcacgggucagcugugggugcgaacaugguggucugggucaggccucuuucaaguccccacaacaggccugacuugugcgugagacgcuuucaccuuaaaccccacgccauccuggggguucauggucagguauaaaacccugcagagaagucaggcugucugaucccaacucuccccuucucagccuggucacaagucaguucccagaugcagcauugcagguuucuacuuuccgccggucuccuugggaacaaaacguuaagugugugcggccugugcagggaggacagagggaaggagaggccggagcccucaggaucgagugaucuugucgggaggcaugaaccccguguccccgaggguccugagcgcaacucggccguugggucggaucaccaggugggugaugcugccauuauugagggagagccggagccagccuucaggaggaaacugcagugcucuggggagagagagagagagagaaagagcacguuagagccagggggcucuguccuuaaaacgggcugagcuaggccgggcaugguggcucacaccuguaaucccagcacuuugggaggccaggcggguggaucacaaggucaggagaucgagaccaucccagcuaacacggugaaaccccaucucuacuaaaaauacaaaaaauuagcugggcgugauagcaggcaccuguagucccagcuacuugggaggcugaggcagaagaauggcgugaacccgggaggcggagcuugcagugagcugagaucgcgccacugcacuccagccugggugacagagcgagauucugucuaaaaaaaaaaaaacgggcugggcuagagccaggggacucuguccuuaaaagaggcugggccaggcugugccagggggcucuguucuacaaacagaggcugagccccucagaagucucagagcagccucagggccgggguacacaucagccgagccgcuccugucuucagucggggcuucucggggaagaucuggcugggaucgacgugaaucgaugacugggaucgacaugaauggagccaucacacuuggggaccugcccucuuuaggacaggggcccaaccccaacucaagauuugcacagaucagaacaacgcugacuucuuacgaggaaacacaguuuaauuucugcuuuucccauauaaaagcagggagcagccaguuagugcaacaggucccuuucugggaaagcaaagaacggagaugggaucuacccgccguggcaucuucaugcacuucuuaggcacaauucgcauuugcggaaaagcucggaguugccuucaucgccucugagccacccaccgcccugucucagugggccgcauggccacccucacgcugcuucccgagccuccucagggcugccuggcggcaccggccggaacagcacagccauauucucguguccaggugcacgugccuggcccucaccacuguguggacucaggucggcuccacucucccgccccgguuauuucugugcauuuuuagcauuugugucaccucggggugacugugucauggacacacaagguggugguggcagcauagaagccacccauauggcucauucacaagcacagacaggaggcaacgaacgacucacagcaaacagguacucacuuagccugaggccacaccacccggaggcuccaacccccagaaaagcucuaucuggucuggagccaagcuugagaaucucggcccguacauccucgacuuucugggagcugcugcucuugaccauggugcucccagcagccccagcccuggugacaggcccaggugacagacgggcagagaccagggcccagccucacacggcaucacugaccagugccguccuguccucccaccacaggacucgucacacucaagagggcccccucagcugcggagcccacacacacauuuccuaauggauccagagaagaggcaaauuuguuucaaauuugcauuuagugagauuuggccaacccuucugacuguuucaggcauguaaccguagagcuggcccugccccccaaggggcccucuaacguggcugcagcccuggagcuccuuaaagaaguggcugauugcagggugguggcagggaaaacgcaaccugaacccggaucauucuguggugcugagaguggggcaccagagcagguugagggacaagggccccccgagggagcagcccgagcagcaacgugacucagcuguggccucgacccagaggggagcggacaccccgagccgucacgcuggcacacgggugggagcgcccacagaucagcaagugaaagaggucaggaccccagaagcacaaaauccccagcggacaacagcggcgggaugcugccagugggauccagccggaggcagaaggugguuggucgaguuugaggggaaacaggacguucaauuacaaagggaaaacaaccagggcagugcggacgcccagcaugcaccguacccaggaccccccacccagcacgcaccccacccaggacacccccacccagcacgcaccccacccaggaccccccacccagcacgcaccccacccaggacacccccacccagcacgcaccccacccaggacacccccacccagcacgcaccccacccaggacacccccacccagcacgcaccccacccaggaccccccacccagcacacaccccacccaggacacccccacccagcacgcaccccacucaggaccccccacccagcacgcaccccacccaggacaccacaggggucccucccugucugcaccacccuugcccaaaacagccuuaugagaagcuccaaguaacacgccaccuaccgcguaacugacuaggacucgcgggaaguggacgcccgggggcuggugaggccugacuaggguggcaucggcaguggaggagggucucgcucggcuucuuccucaugcuuuucucuaagucugaaauuauuuuagaccacgcccagcccagcagcugccuaccugcacacgauguagcggaugacguuggcgugacagaugaagaucucguaacuguccuccuccugccuggcaucugcgcgguggauguaguuccggaaggcggccucgauccgggcuccgucuucguaauacugcugggggcagagugaggagccgucagugcggaagugcucgggcagggcgggugucaggaggacagaccccaucgccgcccggggaagcccgugggacggccgggcacgugguggauggugagcccagcagggccgcuuugcccagggaaggcgagggugacacagcugccccccggggagguuuuuaccacagcuuccggcuuccaaugagacacgggcgggucuggcucgaugggggcgccuucccgcagcagaucugugcugacuuugcagacgccugcagagaagcacagcgaagcgcugggugaggcggccccgccggcggagaugcugugaccucccgguggccaggagcucaggccggggcccugccacgagccgcccacugcugcaagcauggaggccccgcgcgcagcacucaccuggcaggugccggcugaugauaucgguggucucuauggcgcgcgucauagacgaauggacgauuuuauuaaacuucaaccccaagcuugccaggcggagcccagugaguucagccugcucccgaccuggaaggugaaaggcaccugagugccgcaccugcacccccuccuccacccucaaacacccccuccuccgcccgcaaacacgcccuccuccacccucaaacacccccuccuccgcccgcaaacacccccuccuccgcccgcaaacacgaccccugaucaggcagcaagcucagcaagcucagccgauggcuccugcccgcccgaggcuugggccagaggggccggcacucaacugucuucacccccauacaggaaaaaacaugcaucugauuccaccaauggagcagcaagcaaaccggaugguggcuggcgcuugguggggcccaggggugguuucuggguccccccuugucacccucacucaacuguguccaaaaccugagccucacaggcccccaaccacgcgccauggcggaggccaacacagcgggaccuaaacaccccaagcugcuaugugggggccggacaccagugcagaugccuuuucucuugugagcuuuugcauccaggugaaaacgccucaggaaggccgaagccacuggaugcagccacaccugcaucugucacuccacuuucuuugugcacaagcagccaggacagcucuggggacuggggggcggcgucuguggaggacagcccugcacauuuuuacuaucugaacuuuuaguaugugcaugaacaggcacuaucccauucgaagaacuuuucaaaauguaaacucuaccuuagcccacccugcauuuccuucucuaggcaggcauuucuucuacagauccaccugcacagggacacaaggacaagguggaaggacccuccuggacgcugucuaugcagcaucugccaguggggacaggcgggauccuguugcucagucccgccuguucaacagggcauuaagaggcagaggccaggccgggcgcgguggcucacaccugucacccuagcacuuugggaggccaaggcgggcggauuacgaggucaggaguuugagaccagccuggccaauauggugaaaccccaucucuacuaaaaauacaaaaaaaaaaaaaaauuaggcugggugugguggcucacgccuguaaucccaguacuuugggaggccgaggcggguggaucacaaggucaggagauagagaccauccuggcuaacacggugaaaccccgucucuacuaaaaauacaaaaaaauagcugggaguggcagcgugugccuguagucccagcuacuugggagccugaggcaggagaauugcuugaacccaggaggcaaagguugcagcgggccaagaucacgucacugcacuccagccuggguaacagagcaggacuaugucucaaaacaaacaaacaagcagacgccaggcaucaggccugugagugccacaggccgcagagaagcgucuuuggcagcagguccaggugagcagccgagggcacaagccacgccgcuuuccaaggcaucaagcagguauaaaaucacugcugggauaugcacugcauuuggucucaugcaaacaagaucuguccaacauuugcuaaaaguuaagggcuuuuuuuuuuugagacggagucucacucuguuaccuaggcuagagugcaguggugcaaucuuggcucacugcaaccuccaccucccagggucaagcaauucuccugucucagccuccuuaguagcugggauuacaggugccugccacugcacccggcuaauuuuuguacuuuuaguagugacgagguuucgcccuguuggccaggcuggucucgaacuccugaccucaggugauccaccugccucggccucccaaaguguugggauuacaggcgugagccaccgugccuggccaagguaaggacauuuuuuuuuuuuuugagacggagucucgcucugucgcccaggcuggagugcaguggugcgaucucagcucacugcaagcuccgccuccaggguucacaccauucuccugccucagcuucccgaguagcugggacuacaggcgcccaccacugcaccuggcuaauuuuuguacuuuuaguagagacaggguuuugccggguuggccaggcuggucucgaauuccugaccucagguaauccaccugccucggccucccaaagugcugggauuacaggcgugagccaccgcgcccggccaagguaaggacauuuugaaaagcuugucuucuguccaaguucagcugacaguuacugguaauaaugugugauucaggggugauggucucggacaugggccccaggaggcccagugccccaagcacuuucaagaaagcugaccaagggggucggcggaggaccugcacccagucacauaaccaaggcgccagcagauaugcaccuggccacauaaccacgaggguccacagaggaucugaacccaccacauacccagcggggucagagugcgguccuucuccagggagccauccacgugguacugggaaugccugaugaggaagaugugccgcguggccuuggcuuuguagugguccagcuuggacgccagcucuucuuccccagauuccacguuccucuuccgcacguugaucagagacagugguucucgccugauguugaaauacaagauauguccuugagaccucuguucccaaguuugaguuuuucugacaagauguuauuuccaaauugucagacuauuugggaagagcauggagagaagacaaggcccuuggcacagcccuggggaggccucucugagcauaccgccacucucccucccacaaagcuagugccaggucuguucugagugaugcgcuggagagcaaaacagacaagcaaagcccugugcaucuucuucucuaaugagaggcagacagugaacagcaggagacagacuaccccaaacgcaacugugguuacggagaacgccaggcuaggaaagaggacagcggcuaucggggcgcaggcggaaaguguccacggggccaagaugggccucccugaccaugaugcuucagcagagccuagaacugcaaugcccaacagcagccacuagcuaugaggauguuucaauucaaaauuuaagcaaaauuaaauaaaauuaaaacaucauguccucagucauacuaagcacauuuuagacccucaggccgggugcaguggcucacacguguaaucccagcauuugggaggcugagguggccagaucaacugaggucaagaguucgacacuagccuggccaacauggugaaauugcaccucuacucaaaauacaaaaauuagccgggcuugguggcacacgccugugaucccagcuacuugggaggcugaggcaggagaaucgcuugaaccugggaggcggagguugcagagagccgagaucgugccacugcacuccagucugggcgacagagugagacuccgccucagaaaauaaauaaauaaacaaacacucagugaggaagaaaacauucccauuaugaaggucuguuccagagcugcuggaaucugaaaaagaguggaucccagcacuuugggaggccgaggugggcagaucacuggagcccaggaguccaagacuagccugggcaacacagggggaccccgucucuacaaaaacauuaaaaaauuagccgggcaaggugguccacagcuguagucccggcuacucaggaggcugaggugggagaauugcuugagccuaggagggagccaugaucuugccacugcacugcacugcacuccagccugggcaacagagcgagacccugucucaacagcaacaaaaaaaguucaacgcggcagagcugggaauagcaaaagucgaaccugcugguauuuacucgcugagacaguggcggaaaaggaagcuguggaagggcacgguggugacucaagggcuccguuugggccacgccgaccugggggccugucauaaaccaggccaagacucaaauuggcagguaugggggagucaggcugagccagagaaaauauuugggagcuauaggcacagagacaggaagccguaaacugcaugagaccuccaggaagaagcuggagauuucaccagaugaggcucuggaacuuucaaguguggacaggugagacucaagaagaaacaugcugucuucuagcaccuuccuguaguugcucaugccuucugucuguauaagucuuucccaacccacaaggcccaauucacuucuccccagacaugacaagcaaauacagaacaccugcuuaaaagagaaaggcugggcucagcucccgguucuacuucaaguucuuuuuuuucuuuuuugagacagaguuucacucuaucacccaggcuggagugcaguggcacgaucugggcucacugcagccuccaccuccugggcucaagugauuguccugccucagccucccaaguagcuaggacuacaggugcaugccaccaugccuggcuaauuuuuuuguauuuuuaguaaauacagagugucaccguguuggucaggcuggucucgaacuccugaccucaagugauccgcccaccucagccucucaaaaugcugggauuacaggugugagccaccgcacccagccuacuucaaguucuuuaacggcagaguaaaucuguuuccuuaaaaagaccuaagaaauucagaauauugauucagaauuucugauuuuucagaauucugauuuuuaaaaaagaauauaacaggcugggcaugguggcucaugccuguaaucccagcacuuugggaggccgaggugggaggaucaccuaagguugggaguucaagaccagccugaccgacauggagaaaccccgucucuacuaaaaauacaaaauuagcugggcauaauggcgcgugccuguaaucccagcuacucgggaggcugaggcaggagaauugcuugaacccgggaggcggagguugcagugagccgagauugcaccauugcacuccagccugggcaacaagagcgaaacuccgucucaaggaaaaagaaaaaagaaaagaaggaaaaagaauguaacuccagucuaaucaugagaaaaccuucagagaagucucaauugagggaccuucuaccaaaccccugaccaggacgccucaaacacucaugaucaucaaaacaagucugagaaauugucacagccaaaacaugccuacggaggcaugaagacuacuugucaugugggacccuagaacagaacagcagguaaaagcugaggaaaucucaaugaaacaugaaccuuaguuaacaguaauguauuauaaacuaauauaauaacuauaauuaaucuauauuauuuuggcucauuaauuuugauauauacaccaugcuuaguguaugaugcuaauaauagaggaaauaagguuaacaaaagauaaaaaucuaauauaaaguaccuaacgcaaccacaguaguauaauucugugcccccuuucucaaaguacugaguauaaugaggaguuaggacugggaaaaccauccuugccgcuagagcaguccuggccgacagaaacagaaugccagcaacaugugaaauuauacauuuucuaauagcaacauuaaaaagaaacaggugaauuucgaucauacuuuuaauucaauaugcuaaaaauacuauuucaacacauaacuaauguuaaaaaccugcacuacuuuuuuuuuuuuuccuuugagacaggcucuguugcucaggcuggagugaaguggcgggaucucggcucacacugugcagccugggaccccuggacucaagggauccuccuaccucagccucccgaguagcugggaccacaggcgcgcgccaccucgcucggccaauuuuuuuuguauuuuuuguagagaugggggucucacuauguugcccaggcugguuucaaauuucucaagcgauccuccggccucagccucccaaacgcugggauuacaggccugagcuaccgcacccggcccugcuugcguuaaguuuaaauugacguaaacuaagcauucccuucaggaaucacacgagccauauuucaaacgcucaauaaccgcacgcagcucgcgggcgcgcuccugcaaacgccccugaaggaggcccggcuuccaccucagccucgccccggcccgcgcuccggcgauggcacccagggcggacucgcaggggcggggagaagggcgaggacgcgacggagcucggccacagaagccggcgggaagggucagccgcccccggaacccuccgcgcagagcggccccggaaagcggcuccuccgcuggggaaagcagacggcgaccccagaucccgacccgaucgcaaccuuaaaccuggucccgaucucgaucccaacgguaacaccugcccugacccccaucccgaccccggccccaaacagccccgcgcgcaccugucccaguuggggucccagacaccggggcccggccgcgcgccccccgcccaggccggcggcucagccgggcguggcuccgcguccccgccugcgcgcggcuucccuaccgccacggccgagaagagcacggcggccgagcccccggccagcccgcaggccgccagcugcagcgccugccggaacgccaugccgcuugcucccgcgccggcccgcgcaggcgcccacggccccgacggcgcuccgcgaggaacacgcuuc

SEQ ID NO: 191499 - RNA, 17386 nt, Homo sapiens
ucaccauugaagaaccugcauuaucguuuauugugauccuaauucgguccacaguaacaauugaaacugccucgacuaaauuuuaaguuucuggggcagcaccaccugaaggcagcgacugccuuuuuaaaagacaggguucugacauucagagauuucuguuucucuauccaucauuuuugggcaucuugaaucaccugauuuagagucagugacauccugacuggauugguucugcucucgcugggcgggugagacccccagacccacguccacagugcaccugauguucucccagcggucgucacuuccccaaggaggccagguaggcauaccagaacagagcugccagguuggcgaagagcacccggaacugccgaaaagaacaguccaacaggccacggucagcgggaggccguggccaguuauccagccucagucacccaguucauuuguuuacccguuuguuggucagcugguccaaccacccauccauuacugcauuuacugagccuuuguucguaccaaacgcugugcuaggccccuagcagagaggaguggagaagaaaaacgguccccuaguuacaguguucacaggcuacagcggcccaggaaucccaaagccaagucacucuccuuuugcccccuucaccgcacaccuuagcuccugguucagccucucucacuccaggaccagccaucaugcagguggcugcacccuccucaggggacacagcugacgaacagcggaggggccccagaccuucccuccucuaacccaucaccaucccacugcccugcuuuggugacucagcagcuucacccuuccccagaauccucuggcccagugcugagucucucccuggcacguggugcuaugaaaguagcagcccaugugucugguuaaucgccgcgucuccgagucuagcagcauggcgcacagucacugcucaggaaacgcuugcugaaugaaugcugcuuccgcauacaccugcacccaccuaggauggcgacucugcccccacgcuacucagaggcgcggcuucccagcucuccccucuuccaucccagauccuccguguucccggccagucugucuucucaguugucucugcuuccuucucuaaauucccgagaaccaguggcccauggcuguagcuuccuuagccuacuguucuucagucacacucccuggaaaauccuuuauccuuccugccuucucacuuccccagaugcugaccacagcuggacaagccccagcccccucugcccagaggucuuugucucugcagucagcaugcucucccauccuccacauggccaaacuugccccuccuguauccccuuaaaaugcccgccugacuuccucugcccucagucccagccccuggcccuccagagaggcacgugggggcuugaggcaggaugucccacucuccuguccgcucagcugucacuuucucucuccucucucaucacagagggcagggccucuguccaagcaccacugugagugugcugggggcucacauccacccugacuccuuaggggaccccgcagagcugcucuuucuggacaugcguguuugcccaucccacaagcagcuucacgucugcacccaccauggccgcaucucugagugucagaacccccucugccacccagccuucuuccaucacuucucaccuucucucaaacuuuuuaaaauucauuuuuauaaaauagagauggggucucacuauguugcccagacuggucucaaacuccuggcuuugagugauccuucugccucagccucucaaaguucugggauuacaggcaugagccaccaugccuggcccccacagacuuugagagcauguucuagacuugugauuuuuaaaauaauucccacccacucuucaaggcaaucuggcuucagccccauagagcugaaauugcucugggaagggccacuguuaaagccaaaggaaauuuuuuuauuuugcuuuaacuccuggcaacuuuggcuaagggugaacugccucuuuguccugucugugugcaccccugguuuccugcugcuucuugguguguuuguggugugugcagugugcacacacugggccgccucccuccucucccucgggggucacccugguccuuuccucccuccugggcagggcucagagccggugcuaaugcaggaaggcccucugcagcugagguccagccacugcaggccuguucagguccucccuagcagcagccugggcugggacggcacccaccuuucccagaagggccaccugcccugugccuggacuguuugcaccaacaaugcaggcuccacacagcugcugucuuucuaggggucuggagcuuuggggcagcaggcagagaugcccgcccagaguaccaguaaaaaacccugaugggcggcauaccuucugggggagggaagcacguggccccugcaggcucugccaggccuccuccuguagcaucuggggguauccugccaugcugcagggggugcugcaccccauccucccagugugggagugguccuggggacccuggcugugcauaaagacaguugaucccaguggcagagccuggagcuccagccuccacaccaccagcccagccccaaucugacaccuuugacucagcccccacagcagcuccuucaugcacaggauagcggaaaggcucagcuuacccagaaggccuucacucugcaccuggaugggcccaccccuugcccagguguggcugccauggcugcaggugaggcagcucuuccaggccagcggcaggacccauggccgcacagugccugccuucaggcucagcuguaauucaugagcccagggaccacgaaugcuuuguuucuuuuuaacauuuuauuuauuuuuugagacagggucuuacucuguugcccaggcuagagugcaguggcacaaucucagcucacuccaaccuccgucucccggauucaagugauucuugugccucagccaccugaguagcugggacuacaggcaccugccaccaugccuggcuaauuuuuguauuuuuaguagagaugggguuucgcuauguuggccaggcuggucucgaacuccuggcuucaagugauuugcccaccucagccuuccauagugaugggauuacaggugugagcuacugugacggccuucuuuuucuaaguauaacuagaguuuauuugggccaaguuugaggacugcaacccaggagcauagauucaaguugccugcauguacauuccugggacugggaauguuucaaaggcuagaaaacucauaggcaucccuggcaugggggcuuuuaaugagaauuugcugaacgaacagaagaggcaaagacgaccacucgggacacccuucucuguugcuuccugaaucccgaacuagcaaugauucagggucaugggcaaaauccaaggguaguugaggagucuagacacggaugaaacuaagucuagcggaaaacuaccaaagaaagaagagaagagaaaagaagaggggagggagggggggaggaaagaggaaggaaggaaggaaggaaaaggcugacaaaguaauguuagcagaggcugagccccguggcccucaccuucagagggacguaguugauguugaugaacuguaguggcguccacacccgccaguucauccucagcgccggccagaagcccccccucaucuuggcggcgaaggcugaggcgucuuuccccugcaaaggagggaaggcggguggugaacagucucacugcccaucagaacugaauuccgggcacccagacccuaucgugaugguuuuuaaacugcuauuggauuuuguucuguguguacgcagacagcacacauguguacucagcacugcggcucuaaggagccaaccagcaagauggaaaaugaucagugagaugccagacagcagccugcucaugcuggcagugaugucuguccuggcccaaaacuccuugcggacaacuggaggaggugacucccaaggcuggcccugggcaccagaacugcuacucagagcuacgcugucaauuccucccaaauaaccuccaaagucgaugucuuuccaaucaaaacuuguuaggaguuaugaaaaaaaaaaaaaaaggacuccaguaaguucauucuaaaugucagcugguggauucaagaccugaacccaagaccugacaccauaaagauccuaggagcaauuccucuggacguccgccaagacaaagaauuugugacuaagugcucaaaagcaaauacagcaaaaccaaaaacagacaaacaggacuucauuaaacaaaaaagcuucugcacagcaaaagaaacaaucaacagacagucuacagccugggaaaaaauauaugcauauuaugcauccuacaaaggacuguuauccagaaucugugaggaacuuacacaacucaacaagaaagaaaugaauaaccucauuaaaaaagugggcaacggauacaaacauuuuucaaaagaagaaaaacaaguggccaagaaacauaugaaaaaauguucaacaucacuaaucaucagagaaaugcaaauuaaaaccacaaggagauaccaccucacgcgagucagaauggcuauuauuaaaaagucaaguggccaggcgcgguggcucaugaccguaauuuaagcacuuugggaggcugaggugggcggaucacgaggucagcaguuugagaccagccugaccaacaugggaaaacccugucucuaccaaaaaaaaaaaauacaaaaauuaguugggcaugguggcgugugccuguaaucccagcuacucaggaggcugaggcaggagaaucacuugaacccgggaggcggagguugcggugagccgagaucgugccacugcacuccagccuggcugacacagugaaacucugccucaaaaaaaaaaaaaaaaaggucaaaaaacaauagaugcuggcaagaauguggagaaaagugaacacuuacacacugcuggugggaaugcaaauuaguacagcccuucuggaaaacaguauggaaauuucucaaagaccugaaaauagaaccaccauucgauccagcaaucccacuacugggccucuacccaaaggaaaaggaaucauaucaaacaaucccugcccucguguguuuaucacagcgcuauccacaacagcaaacacguggaaucaaccuaaacgucccccaacagaggacuggauaaagaaaaagugccauaaauacaccacggaacacuacucugcuauaaaaaaaagaaugaacucggccgcgcacgguggcucacgccuguaaucucagcacuuugggaggcugaggcaggaaaaucguugaaccuggggggcggagguugcagugagaugagauugcgccacuacacuccagccuggaugaaagagcgagacucugugucaaaaaaaaaaaaaaaaaaaaaagcaugucuuuugcagugacgucgauugaaccgggggccauuaucccaagugaaacaacucaccaauggaaagucaaacacugcauguucucacuuuuuuuuuccaagacagggucucgccaucucacucuguugcccaugcuggcuggagugcaguggcgugaugucggcucacuuggccucaaccuccugacaucaagccuccgucucagccuccugaguagcugggacuacagccaugugccaccacaacccuuugauuuuuaauuuuuuuguagagaaggggucucacucuguugcccaggcuggucucgacauccuggguucaagugaccuuccugccucagccgauguucucacucauaagugguggcuaaacaguggguauacauggaccaacagagggaaauaacagacaccagagacuugaaaagguggcggggagaagaggguugaaaaucaccacugacuacuugggugaugggaaguaaaagcucagacuucaccacagcacagucacauaagaaaucugcacucguacccucuaaauauauacaaacuaaaaaaaauuuuuaaagaaaugcuuaaauauuuucuuguuuaaaguaagggggagaagcuggguacaguggcucaugccuguaaugccaaggugggcauaucacuugaggccaggaguucaagaccagccuggccaacacagaggaaccccauugcuacuaaaaauacaaaaauuagccaggcgugguggugggcgccuguugucccagcuacucuggaggcugagacaugaaaaucacuugaacccgagaggcggagguugcagugagccgauauugugccaccacacuccagccugggcgagagugagacuccaucucaaaaaaaagaaaauaauccagcaaaagaacaaagagugcagauaauugccuguacagauggaaaugagaauauuucaaaauacuggggauugcccaauaaaugguaaugagaaaauuugcuauguaaguggaaaaaucaacacagaagucuaucuccuacuguacacaaguaaaaccauaagaauaccggaggaaagcagaggagaauauuucuauuaucuuccuguaaggaaaggcaugaaggagaauaaugucauguuugaauacaugaaccuuuauaacuucuguauggagaagugaaugguuaaaacaaauuuacuuucaggacagaaggugacgccaggugcaguggcucacaccuguaauccuagcacuuugagagaccgaggcggguggaucacgaggucaggaguucaauaccaaccuggccaagauggugaaaccccgucucuacuaaaaacacaaaacaauuagccgggcaugguggcgggcaccugcaaucccagcuauuugggaggcugaggcagagaauugcuugaacccaagaggcgaagguugcagugagcugagaucacgcacuacacuccagccugggcaacagugugagacuccgucucaaaaaaaaaaaaaaaaaggugacacgucucagacacacagcacaaccuggcuggugcuccuagagauggugaggauuugaaggugcucgugaacgggggaggugggacagucagaacagacacaccugcugagugcaggugaacacgccucccaugcguuggauucugacugggauuaugccgguagguuaaccuccaggcccggaacucuucuguguuaucaguaggggucucaaacuucuugugccacagaucucuuuggcaguuuagugaagccuguggacccccuucucagaauguuuuguaaucuauaaaauaaaauacggcugggcgcaguggcucacgcuuguaaucccagcacuuugggaggccaaggcaggcggaucacgaggucaggaguucaagacaagccuggccaacauggugaaaccccaucucuacuaaaaauacaaaaauaagcugggugugguagcgggcuccuguaaucccagcuacucaggaggcugaggcaggagaaucguuugaacccgggaggcagagguugcagugagcugaaaucgcaccacugcacuccagccugggcaacagggcgagauucugccucaaaaauaaaaaauaaauaaauaaauaaauaaaauaggacuacaaaggaaccaauaauacugaaauacaguuaucaaaauauucagaaaaaauuuugacagacuaauguguuuauuuauuuauuuauuuauuuuugucuuuugaaccagugucuugcucuguuacccaggcuggagugcaguggugugaucucugcucacugcagccuccacaucuugggcucaagggaucuucucaccucagccucccaaacagcuggaacuacaggugcacaucaccacacuggcucauuuuuuacuuuuugagagauggguauucgccauguugcccaggcuggucccgaacuccuggccucaagcuauccacuggccuuggccucacaaagugcugggauuacaggugugcaccaucaugcccggcccuguuucuuuuuucuuuuuucuuuuuuuuuugaggcagagucuugcucuguugcccagacuggagugcaguggcacaaucucagcucaccacaaccuccaccucccggcuucaagcgauucuccugccucagccucccgaguagcugggauuacaagcacgcaccaccauaccuggcuaauuuguuuuguuuuguuuuuuguuuuugagacggagucuggcucuauuacccaggcuagagugcaguggcgacaucucggcucacggcaagcuccaccucccggguucacgccauucuccugccucagccucccaaguagcugggacuacaggcgacugccacugugcccagcuaaauuuuuuguauuuuuaguagagacgagguuucaccauguuggccaggcuggucucgaacuccugaccucaggugauccacccgccucgcccucccaaagugcugggauuacaggugugagccacugugcccggccuguuucuuucuuuacacagugacaagaccucuaauggcagguccaaguaguaaugagcauaaauuauauuucgagauaucuguaacaacugaugugauauaaaaauaucugauuagcugggugugguggcacgcacauguggucccagcuacuugggaggcugaggcaagaggaucgcuugaacccaggaguuugagguuugcagugagcuaugauugugcuacugcacugcagccugggugacagagugaaacccugucuuuaaauaaauaaauaaauaaagugacucuacuggguacaaacagguccugccaauacuagauguuugcuuccuauauucauaaaagaaaaugcaaaauuucaauuugagugaaaaaucugcagacccucugaauucugccgagaaugucaggugaagaaucccugugcuaaacgaagagcugcaguaagugcuguggcagacacccaccuccagaaaguucaugaugaggaagaacaacaugaggaaggccggugcaaagacgaggcgguccaggagaagccuccugagcccugccagggggaccucaggagggauccaauguuccaugaagaaguagaagaagugacucagcggcccugugaagaagaaccugaggcccccagggggugugagccagauugugguucucuggaugugcucuucucuggucuagcuucacccccaaaucccagguccuaaccccugcuuccugaugucccucaguauuggccacacaggucuguacagauaagucggcuucaggggcgcucugucucuguugcucuaacagaccagacuugcuccugccguugacucucugcucccagcgcguccccgccuagcuauguuggcucgcuccuccucacacugucagcuuccaggucgucccagcacgugugcacgccugugcuaacacucuuggcccugguucauuuucugccuagcacuguccuuaucucauauguuagguuagucugugccucucguccccccuagaaggcaggcuccacaagggaggcuacgucuucuguccacugcagugcccagaacagggccaggcuucgagaagcacucaauaaugaaucaucagacaugucccugguuguggagcuuuucauuaaacucacuaggcuaacuggcaagggaacucacuagguuaacuggcaagggcacucacuaggcuaacaaacuggcaagggaacucacuaggcuaacuaacuggcaagggcacucacuaggcuaacuggcaagggcacucacuaacuggcaagggcacuaacuggcuaagggagcucacuaacuaacugucaagggcgcucacuaacuaacugucaagggcgcucacuaacuaacuggcuaagggagcucauuaacuaacuggcaagggagcucucuaacuaacuggcuaagggagcucacuaacuaacuggcaagggcacucacuaacuaacuggcuaagggagcucacuaacuaacuggcuaagggagcucacuaacuaacuggcuaagggagcucacuaacuaacuggcaagggagcucacuaacuaacuggcuaagggagcucacuaacugacuggcaagggcgcucacuaacugacuggcaagggcgcucacuaacuaacuggcuaagggagcucacuaacuggcuaagggagcuaacuaacuggcuaagggcgcucacuaacuaacuggcaagggcgcucacuaacuaacuggcaagggcacucacuaacugacuaagggagcucacuaacuaacuggcaagggagcucacuaacuggcaagggagcucacuaacuggcuaagggagcucacuaacuaacuggcuaagggagcucacuaacuaacuggcaagggagcucucuaacuagcuaagggagcucacuaacuggcuaagggagcucacuaacuaacuggcaagggcgcucacuaacuaacuggcaagggcgcucacuaucuaacuggcuaagggcgcucacuuaacuaacuggcaagggcgcucacuaacuaacuggcuaagggagcucacuaacuggcuaagggagcucacuaacuaacuggcuaagggagcucacuaacuggcaagggcgcucacuaacuaacuggcaagggcgcucacuaacuggcaagggcgcucacuaacuggcaagggcgcucacuaacuaacugacuaagggagcucacuaacuaacuggcaagggagcucacuaacuaacuggcaagggagcucacuaacuggcuaagggagcucacuaacuaacuggcuaagggagcucacuaacuaacuggcaagggagcucucuaacuagcuaagggagcucacuaacuggcuaagggagcucacuaacuaacuggcaagggcgcucacuaacuaacuggcaagggcgcucacuaacuggcuaagggcgcucacuaucuaacuggcuaagggcgcucacuuaacuaacuggcaagggcgcucacuaacuaacuggcuaagggagcucacuaacuaacuggcaagggagcucacuaacuggcuaagggagcucacuaacuaacuggcaagggcgcucacuaacuaacuggcaagggcgcucacuaacuggcuaagggcgcucacuaucuaacuggcuaagggagcucacuaacuaacuggcaagggagcucacuaacuaacuggcaagggagcucacuaacuaacuggcuaagggagcuaacuaacuaacuggcaagggcgcucacuaacuaacuggcuaagggagcucacuaacuaacuggcaagggagcucacuaacuaacuggcuaagggagcucacuaacuaacuggcaagggcgcucacuaacuaacuggcaagggcgcucacuaacuggcaagggcgcucacugacuggcaagggcgcucacuaacuaacuggcaagggcgcucacuaacuggcaagggcgcucacuaacuaacugacuaagggagcucacuaacuaacuggcaagggagcucacuaacuaacuggcaagggagcucacuaacuggcuaagggagcucacuaacuaacuggcuaagggagcucacuaacuaacuggcaagggagcucacuaacuaacuaagggagcucacuaacuggcuaagggagcucacuaacuaacuggcaagggugcucacuaacuaacuggcaagggcgcucacuaacuaacuggcuaagggcgcucacuaucuaacuggcuaagggcgcucacuuaacuaacuggcaagggcacucacuaacuggcaagggagcucacuaacuggcuaagggagcucacuaacuaacuggcuaagggagcucacuaacuaacuggcaagggagcucacuaacuaacuaagggagcucacuaacuggcuaagggagcucacuaacuaacuggcaagggugcucacuaacuaacuggcaagggcgcucacuaacuaacuggcuaagggcgcucacuaucuaacuggcuaagggcgcucacuuaacuaacuggcaagggcgcucacuaacuggcaagggagcucacuaacuggcuaagggagcucacuaacuaacuggcaagggcgcucacuaacuggcaagggcgcucacuaacuaacugacuaagggagcucacuaacuaacuggcaagggagcucacuaacuaacuggcaagggagcucacuaacuggcuaagggagcucacuaacuaacuggcuaagggagcucacuaacuaacuggcaagggagcucucuaacuagcuaagggagcucacuaacuggcuaagggagcucacuaacuaacuggcaagggugcucacuaacuaacuggcaagggcgcucacuaacuaacuggcuaagggcgcucacuaacuaacuggcuaagggcgcucacuaucuaacuggcuaagggcgcucacuuaacuaacuggcaagggcgcucacuaacuaacuggcaagggugcucacuaacuaacuggcaagggcgcucacuaacuaacuggcaagggagcucacuaacuaacuggcuaagggagcucacuaauuaacuggcaagggagcucacuaacuaacuggcuaagggcgcucacuaacuaacuggcuaagggagcucacuaauuaacuggcuaagggagcucacuaacuaacuggcaagggagcucacuaacuaacuggcuaagggcgcucacuaacuaacuggcuaagggagcucacuaauuaacuggcaagggagcucacuaacuaacuggcuaagggagcucacuaacuaacuggcucagggagcucacuaacuaacuggcuaagggcgcucacuaacuaacuggcuaagggagcucacuaacuaacuggcuaagggagcucacuaacuggcaagggagcucacuaacuaacuggcuaagggagcucacuaacuaacuggcaagggcgcucacuaacuaacuggcucagggagcucacuaccuaacuggcucagggagcucacuaacuggcaagggagcucacuaacuaacuggcaagggugcucacuaacuaacuggcaagggagcucacuaacuaacuggcaagggcaggaccuggugcagcacucuagguugugugcguugcuacuaaucauuccccuguguguuugggagagaauggaaccagcugccacaucuacugggacaagaggccugcaguuccauaaaauucagcaacaaaaagaggggucuuucaacuugugacguugacagucuuuagauaagugguucucaguguuuuuucccacccagucauaggggguuauguggccuaugcagggauucucaguggggaaggggacugaaguccuguggaugggaaaacuguacuuggaugaggccugcuaggugaucucaucaccugccccucuuggggggauuacugcuuuaaauacaguauggaaaaauccaugaugacucaaguuagcaagcuuggaaguauaaaaaugaucuucaggaauucugaauuaaagaaaacaucacuguaguuggaaaauacuucacauuacuguuggccgagagcucacgguggauuaaauugguaaaacucuugaauuacugugcuuuugcaacucagaaagugguucagaaacuggacauuuuucaggguaccgaagcauuuauuuucuggauguuuacacuaugaaaauaacaauagaggccaggcacuguggcucgcgccuguaaucccagcacuuugggaggccaaggugggcggaucacgaggucaggagauccagaccauccugugaauggugaaaccccgucucuacuaaaaauacaaaaaauuagccgggcgugguggcaggugccuguagucccagcuacucgggagacugagucgggagaauggcgugaacccaggaggcagagcuugcaguaagccaagaucgcgccaccgcacuccagucugggcagcagagugagauuccgucucaaaaaaaaaaaaaaaaaauuaaaauaacaauagaaacuaacuggucaaauuggagucaguuuucccuuuccaugagcccagucuaggacgcuuucaggguuuuugaauccugaagucugacuuuagguuaaguugaguuacuuguccucagguuugccucucagcccaauuaagacagucaccccuacccauccaauuaaaaagaaacaugauaaaaccacaaaugugagccuguacuccuagcacuguaaucccagcacuuugggaggccaaggaagguggaucacuugaggucaggaguucaagaccagccuggccaacauggugaaaccccaucucuacuaaaaauaacaaaaauuagcugggcauggcggugugugccuguaaucccagcuauuugagaggcugaggcaggagaaucacuugaaccagagaggcagagguugcaguaagccugggugacagagugagacucugucuccaaaaaaaaagaaaaaacaaaaaaaaccacguaugcguauauaugccauacaaacuauaugaaccauucgaguuuuuucccaugaugauuacuacaaugguuuuuaaaaaauuauauuuccaaauaagaguacuccaacuacucgguuuuggugcccagcuugguugcacucagcggcuacaagguaaacccaccccuuguauggcacucacccguaaacggcauaucucagaggcccaccgacauccagacuucuagaguuuucuuuuuuccgcuucuucucaaucaucugggccaggaaguucccaagugcugacaaaaugccacuguggagagggaggucaucagaaaacagcagugaccagcaggagggugucccuuucccauaggugaauuagcagggccguucugaggccaugcagcagaugggcgggggguaggaauucuuguuaaagcggcugcaauguauaguucuuguaucaaaagguggagacgguggacuuaaacacacagguaaggacaaguggcuuuccaguaucuaugucaacauccuggcugugauguuauacuauaauuuggcaguuugggaguugggaagcugugugguuaugaacgggcaacaggacagcccuaucaugacgcuguucugcauuuugacugugguagugaacacaagaauguacagaugugauaaaacuguacagaacagauacagcuacaagaaaaauggagaaauccgaauaggaucuguggacuguguccacgcaaugcccuggucgauacugcacuacguuucacagaauguaaccaaugggggacacugggaaggugugcaaggaaucucuccauguuagucuuguaacuguuugugaaucuacaauuaucacaauaaaaauuuccauaaaaagguggaacaggcccaguggcucccuccaggccuugguuuguauuugccuucugagaagcucucuggacuauaaaauccaaaauuccuagcacggaccuagacaccuucucgaucagaucccuggcgauucccuucacaucuccugccucuugcucaggguucacuuucuccacacacagaucuucccucccucgggacugaguccaagcugcaccucucuccgccuuucuuuaacgccggccuucccuucaaaaccuaacagagaccuuugcccugcuguucccugugccaggagagccucugcuccacuucuuuacacagccuguucaaugucaccuucucaaaacaccuucccuggccgugucuccacccgcgccgugcggacccgcgccccgcagacucgcucccuuggcccugucuccacacgcuccauguggacccgcuccccuggcccugucuucacccgcaccacgcagacccgcucccuuggcccugucuuuacccgugccccgcagacccgcuccccucgcccugucuucacccgcgccccgcagacccgcucccuuggcccugucuucacccgcgccccgcagacccgcucccuuggcccugucuccacccgcgccaugaggacccgcuccccuggcccugucuuuacccgcgcccccaagacccgcuccccuggcgcugucuucacccgcgccccgcagacucgcucccuuggcccugucuccacacgcuccaugaggacccgcuccccuggcccugucuucacccgugccccgcagacccgcuccccuggcccugucuucacccgcgcccccaagacccgcuccccucgcccugucuucacccgugccccgcagacccgcuccccuggcccugucuucacccgcgcccccaagacccgcuccccucgcccugucuucacccgugccccgcagacccgcuccccuggcccugucuucacccgcgcccccaagacccgcuccccucgcccugucuucacccgugccccgcagacccgcuccccuggcccugucuucacccgcaccacgcagacccgcucccuuggcccugucuuuacccgugccccgcagacccgcuccccucgcccugucuucacccgcgccccgcagacccgcucccuuggcccugucuucacccgcgccccgcagacccgcucccuuggcccugucuccacccgcgccaugaggacccgcuccccuggcccugucuuuacccgcgcccccaagacccgcuccccuggcgcugucuucacccgcgccccgcagacucgcucccuuggcccugucuccacacgcuccaugaggacccgcuccccuggcccugucuucacccgugccccgcagacccgcuccccuggcccugucuucacccgcgccccgcagacccgcuccccucgcccugucuucacccgcgcccccaagacccgcuccccucgcccugucuucacccgcgccccgcagacccgcuccccucgcccugucuucacccgcgccccgcagacccgcuccccucgcccugucuucacccgcgccugcggacccgcuccccuugccguggcuuccccgggcgcgcggggccccuguuggguccuuggguggaaccucagcgccgacccccgggucugggcgggcccuccacgcgcugggagggcgggauccgcaaggcgccucacaaucgcugacugcggacgcgggugucgccgcgggaaguucagcgccgggucggagggcgcccgcuccggggguucugacccgggcgcgcccccagccuggucccggcccggcgcucccguccaggccccgcgccgcugcggccgaccuggggccggggcggcguccgauucccgcgcccccgcucaccugguggccgccuuggugagcaccggguagagccgcaggaagagcagguacugggcgagcgcccgccgcggcagcgccccgagcccggcuucggcccgcagccuggacgcggccggcgccaucgccuccccagcgccgugccgccgggggcaccgaccccaccucaggcuggccgggcgcggagccc

SEQ ID NO: 191500 - RNA, 94617 nt, Homo sapiens
auggaggccaagguccgcccgagccggcgcucgcgcgcgcagcgggaccguggccggcgccgggaggccgcccgcgacgcccgcgcccagaguccgucgucgggcgacgagcccgagcccagccccggcaaggagaacgcgggccuccgcggcgcgcccccccgaggcgccgcccccgcgccccgcaccgcgcgucccccgcgccgccgccgccgcgaguccagcucgcaggaggaggaggucaucgacggcuucgccaucgccagcuucagcacccuggaggcccuggagguagguggacgggugcggcuucgcaggcguugaggcgagaacggggcccggaguugacgcgucgggcgaucccgggaccccugggcuugcgaccgcccgcgccgugggcagcccugagggaagccccggccacuugguacccguuccagggacccugggugcccaccgcucgcccagaccgucgcaucuggaagacccagcagcgucggguggguuuggggacguuuuaaguugcagaggcaaaaaaaucuacgcuucgaaauugggggcugucugacagcaccgucggccuuuuaucaguuguguuucuguggccagcauaucgcucugccugguucaggacgugcuagggagcagugcuggaucuuagggagguggugauaaaauggauacuccgcgggccaucccguucccuccucccuucgagggcucugcugagaaggggagaaggaggguuaaucucaagaccccucuuggugacugcugccugcugcaugguuaauagauuggccaaaaauauugcuugucuggcugacggacaguauuugcugagcaaauacugcuccucuuacaugaacucagcugagcagagaaggaaauuaaaugcugucugagaguuggggcaggcgcugucuccccaggacuggcaugggcaggaaugcuagcaaguugcccugcaccagggccgagacccgcccagcgaggugugccccgugcagcacuuacuuugggggacccucaucugcuggacuuugacucccagaaucaccccauuuccaaccccucucacuuuuccaggggcuugggagcccauggccugggaucccccagucucagaagcugagcuuugggaaaaggggagaugccuacugcaggccccugaagcagcaaguccucuucaaguucucauccaaacucuggggacuguagagagccuugggucagggccgguggccagggaaguggccccagaacaggugccgcaucgugucccgagugcacagucagagcuggggcuucgugucccaagugcacggacagagcuggggcuccugugggcccaggacggggugggugguggccaggcucaucacacaggcuggccauccucuguccugcacauuauuagauggcuccagggcuggcacacgccauugcucugugcugggacgggauggcccuggggcugucuucugcccucucaguggugauaaugacacagacuguacguguacugagcaauacugcaagccaggcccugcgcucggcuccugcacugcagcugagaccacgaggaugcccacuuuccagagcugucgccacccaccugcaccuccugggucccuaaccgcggcuuccucacugcuccgagcgggucagcccuuguacccugccguucucugucugcuuuauguuuggugccauugugucuuugcaaaaacgucaccucagacuccucugaaguggugccccccacccccgucgacguugcccaccuucuuuuugucauccccacucugcaaagcuguuuuagaaugucuuugcucuccauuuucgucucccacaagaacuuguaagcugaaagagagcagacacugugcuguccugugugucuccuauggggucuggugccgggaagagcucgauguguagaaagugccccagaugcgugugucaggaaucugagugaggagaugaacuguacucaggagauccagggccaaucccaggcccacguguuuugcccgcagcggcucugacuggcuguccaccugcucuggcagggucacgugcccccagccugcaggcaguggguucaguggguuuuggugacuucggcuuagaccagcuggccccucaggucauagugagacaagucugcugcugcguggcguuaacacagccacagcaccccagggugguuucaugucccuuccucugcccuucggagccugccugggaaaguacggggcuucugcacaagucauaaccucgugaucaucccauacgugucucuugguugucuacauuuuuugccaaaguauggugguuuuuccccaaaguucagauaauucauaauuauaucaauaguagugacugguucaguaagcauucucuccaucaggcaguguucugagcugccuuucacagacaucaacucauuuacuccucaaaugacccacgaggagggcuggaugcccccauuccacagauggggaccuugaggcuccccauugaggcagagcaagagcaaggagcacugggugccacgccuguccggccuuagagugagcgggcgcugcccugcgaggccacccacacgggacaccgagggagauguggccaccaggacccagcccagaggcacagccugcccuuggcucugccgccuuugcucacagucccucugcccccacccgcgucuugagggcucuuccuacucugggaugcuggaggaugggacgcucaggaguuggaggaagcccuuguaaccccagaggcuggcuugugcccgcgggacacugcagugguauaaacaaccaaacacagguguagacuugccggggaggugcagccugccugcaggaguccuguuaccucaccccagaccccacacacacugggaccaacucucggccccagcccuggccccuggggcagacccccacucgcagccccuucugaccccaggcagaccacccucuccgccugucugaacaggcaccccuugcccugugcccggggcaggucucuguaccuguuuugugcccccggcaggucccugccccuuuucugugcccuggaugggacacacaggcuguucugugcccggggcaggcccccgcccccuuuguguacccugggugggacacauaggccguucugugcccggggcaggcccccagcaucugcacauuuauaugugcuccuguaggggaggaggaguccccgcuuguccugggccugugugugcugugaacacagcaggcacucccuaaaugguggugguggugguugugggcugaggagggccagggucuggccuggcucagggugugccugcagcccuggagacagcauuaaugauuaacugcccauagagaugggagcccuguggcagggcugaggaccugcagaggggcgugcugggcugggugugcugggguggguggggcggcgcggcagaccugagccagcccccgcuugacuuucuacucuguaaccaggggccgugguauguggggacaggaggccugaggaagccccgcuggccucuccccugcucuuguucugaccgggaacucugggugcuugggaacguggcucuugcugucccuuuuguuuccugugacaacucuguccccugguuguacugaccagaggacacuggaagcccccuaccccuggagcagugcuguggccauacgugccuggucagugcugcuguucucugccugggguccucccaagaagacuggggucugagagguguauccagggcugugucagaccccaucuucccacauagcaaaggccauccuuaucuggccucaggccacagaacagguugugccggucccugugucuccugggagauaggccaggccugcuuagcccagugggcugcaccgcccacucccacaugcuggccgcucggccccagugacgcuggccauggugcucugggcugcgccugggccacagggagguggcagggugcccaggagcacauuggccacuagcuccaggcggacaccaccauucugguuuggugucugugauuuuugguuaauuugcauuuuucaaacagcaaaucacuuucaccuggugacuuucacuugguccacacgucaagcuccauaagaaggugcgugcugaagcuugagcuguucccugacuggcacacgggccacgcagaagguccacgugugucccaggaauaaaggcggaaggaaagcacccagccuccuggcucgguggccagcggucuccucuaacgccugugcuuccacauucucugcucagcauaaaccacaggacaugcacccaaaaugcugcugaaccugcacagacgguugugcuuaagaaaccccaggcuacugaucgugugcggcccccggccucccagggcugucugugggcgagcugugaccccugcugaaaauggcccagaacccuggugggcauagggugugagccuggagccggugggccuuggccaaggggaggguacagguuuugagacacggcccgucguggggaaugugagggugugagggacuggcccagacacugcccugcccugcauccuggaggcugagccagguggucucucugugagccccuagugggccuggugggcuucacagaggggccaggguuccaggagcaagagcccaggcauaggaucugggcuggaagugugaccuggccaugugggggcggggcugggcccggccugccgagcaccgcguguggggccugacagugucacuuggaccuccggggaccgcugaggccacacuguugguggugccagugggggcugaguuugccaggggcacugugaguccaugccuggcccaucucucagaugguggugggggcugagaccgcagacauuuggguucagugaggagagccagggagagggcaggcuucggcccaggaacuccuuguggcugcuuccuggucuccagguggggaaacugaggcacagagaggggaagugcuuuacccacagccauggggcaggggugcggagcugagccggggccugcccugugacaaugaggggcugccuggaagcugcauggauuccuguuccucccacagagucccacagcugugggcaagggcugcucccuccggggagguggacucagaggcccugaaagcagcgucgcuggccccucgguccacgugggugcccgccaccuguccaggcccugucugggggccagcagcuccucaggcccugccauggcuggagcagggcuugcaccuggccugcuuuggcucugggaaggguuccacguccucugccugugcuucugccccucacgggccccugcccaguggcuugcuggccucggggucggggcuguuacagcaggagucaccggcccucuuccccauccccucccucccggcugcuugggccugucaguucuuggcucagguuuccaaggccuuccuguccuugccguggcuacgccgcgugccugcaccuccgcacgugcugcgcaccuucgcguuuggggccuggugccggcugcccuuugccuggaggggucucccggggucccugugagucaccgcacaguccugcagcagggagucagacccacacuagacccuccuuccccacuaggcucucgugccccagcuguccuuacggggaggucugucgccagacguccgccauaucccgccuuugugugauugcuucucuggagaaagagaagugcccagaacuggcccugcugucuguggcuggcaguuuuaaggcuccugaugguugugagggucuguucccugccgaggggcccguguugcguauuuacccgggcuuguguuuuugucacucuggaagccucguuucacuguguuuucuggcugguuguugcuguuugucuucccaccugacaucucuaccuggguacuuuguuggauucccuccucagcacaggcaguuucuaggggacucuuaggggguugucauuggcccugcuggcgucugcacauggcugugacguugcugcuucccugcggcugcgcuggauuugugaguguguccagagcgugaggauugguguugcuguuuguggguaucugugucccucccuccuucccuguuuccccacauucugaugggcgcucugucuugcacgggacgcaucucugguccagcaucagguaggggugacccugcucacccagcuugugccgccgccccgcgcuuccuucccaggcccugcgguguccuguguugcgcggggcgcgucucugguccagcaucggguagggguggcccugcucacccagcuugugccgcugccccgcgcuuccuucccaggcccugcgguguccuguguugcugucaggcuguccgugaacuccggacguggcccuggcgggccguguugguggagucucauuucggguuguuugccgacgguucggauuuuugccacccuguuucuaguaaaguuagucugguagucuugcuuccgcugguuuugcugcauuuugguugggaacuuuucauuuuuuucuguaacgucaaaauggcauaagaauuuaucacuuucucagcaccuggacagaauacucgggucccagcacuccagcccauuuacuggugaccaguuagagaccccaagucagcaugguuugggguggggacacggguaaugagggagaggucaugggaccaccucgcuaggaguggaggcugggggagaggagcccgggguggccuggcuggcucaggagggcccucuaaguaggaggaccacagagcuggcccaaggucccagggcagacccagucuggcugcccugagucagaggcagccacgggaggagcccagcccaccugagucuccaggagucccugagugaccccugugucccaggcugcccccucccuccggacucccccuccauacuccccuacccagauggcaccaggacccccucuggccucagcuccugcuuucaggagcccacgggccugaccacccuucagugcccccaggccuccugccccuguccagaugagcugagugaguggccccaggcuagaauccaggcucugggccucgggaccccuagggcgccgccucacaccugcugaggcaaccccgggcuggggaucuaacccuucuuaguggcccggggucaggcccugacucccgccauguggcccaugacaaagccauuugucccuaaagaagggugagcauguaagcagcccccaggucccugagggagggccagggcuuguggcgugcgauguguguguuugugccacgcaugugccuccccuagagaccccucgggccugguguccuccccggccccaccccaggaguguauggcaucugaaguggucguguggcagcagcugggaggcccauugcugagccuggccugcaccccugggagagcuggggggcccgucacagccuggcuggcugcaccccgggagagcuggcccacagggccucuggggagggugccugcuguuucuuugggagccuggggagguggcuggcagggaaagccggccguccagaucugucaagccccacagcuacgugcccccugugugggugugggucucucuccgggccccucgcucacagugaggccugugucgggggcauggggccgggggcuguguugggaugugacagcagucggaauguuccaguggggaggccugcgggacccacaggcccccagccacccuugcagaggcgccgcagcagcuaccugccugucagacaccuucuggccaaucccggcuggaggcugagcuacaggcugucgaggaccgcagcagaguggaucuguggcugccgaccccucccggccccuagcccuccacucucauccuacagacccuccagggaaaugaggaggaugggccauccccacacaccuguccugggcugcccccaccacccccauguggggaugugggucauggaagucuggguucuccugcucuacagccuggaauguccagauccccugggagcuuugggaggugccggggccccuugaggugcuacugcacagggccccccauccuggucagcaggcggcccugcgugggccuugcagagcuggguggggcugugcuuggguggccaccaaccuauucuaggggagggaggucagaggcugaagagccaucaggugcugguguccccgugggccaggacagcuggaggcgcagcugcagcuacccugugugaugcguggaaacugaggcuuggccaugguacucaccccacugggggcugggcagagaggccgacaaccccagccaggucccguggccaccugcccaugcucccgucugcucagcgggcuuccucugcucucaccacggcaggcugggccccuucugccuguguaugugaccaaggguaccugccaccucugcuguccccugggacagugcucugcaaggccuccaggagcuuggguggccagacuggucccugggacuggugggccucauccggccucggcagccgccccgcccauuccagaucucugcucugcccaggucuugaugcugcacaguggagccuccagggccggccaggcagggauggugccgggcagggguggugccgggcagggguggugcuggaccucugggagaggccaggugagccgcuggccagcagggaagggccagccaggcagggguggugcugggcagcaguggugcuggaccucugggagaggccaggugagccgcuggccagcagggaaggguucugagcuguucugcuuucccugacagacuuuauaagcauuuauugagcaccggcugugugccaggcccugggccggcccccaagauacacccacaggccccauugccagugaguauugggauggcaguaaagagucugucgucgaaggcuaggagucacagaggaggccacgagggcuucuggggaagagugcaggcugugaggggcagcaccguggcguggcgguucccgagagcccgucaggaagggcacauguagcaggugguacagguuuggggugccgguggcaggcaggcuggagacagcugggggcuguggcuggggggcugcagggcugggggguggggcgcugcgcagcaccuaaacuccgugagaucaggugcucuggggacucagggcaaaugggguacuugguuccacguaccuguggaggacggcaggcguccucaggagugugagggacagaacggccucugagccccagcuccguuggcgcagcagagcugugcugaucugguuugugagcuggccugugggguggaugggguuccccagagcugugcuggcgucagggaggaggcugggugggcuacugggcucuccgcagcccagacaggugugaaggucuccacgcccgucuucccggcccacguguguaccauguacgugcacccgggacccucuggccggaauccguggugucuggcucaggaggcgccggcacugcccucuagacucugcgggagccaucaagcgucuggggcugggagccgcacgccgugacccugccccacugaggccagagggacaccugcccagucuguggccgccaccuucccucuguugagaacuugguccuggcuggcggcuuuagggagcagagcagccgagugugucccaggcuuacacccccacugugggugcugugcuguccccaugcugcacaugaggaaccugacgcacagagccgugcagucacuucccgugucuacacugcuggcgaguggcugagcaggaucagaacucaggcaagggcuggaggcuggggcugccccucucuggccugggcucauggggccggccucucugcucccuguccucugucccccauagggccagccgguccugcuguguguccagaccagccuccggggaguccuggcccuguugccauccccuguccuggccccuccacccacccaguccauaguuuccugaauccgaccucauccagcugcuguccugccugggagcccagggcccugcagacuccauccagcccgggacagcccauucacacccuuacagggaucccaggcccugcagacuccguccagcccgggacagcccauucacacccuuacagggagcccaggcccugcagacuccguccagccuggaacagucuguguccucacagggagcucaggcccugccacagccccacccucucuaaccucuccugccgcagugucccccacagcccuuggccccugccccaguugcugcugcucauaccccagcaggccucuggcuguccucggccagacccucaucccaugccucacucgccugccccucacacccuguccuguggccggcguggcugcgugccucuccccagggaccauguggccaggagcugggcggggaaggagcccaaggggccugcagccacugccagggaggggacccugauguggaccgggccccugacguggacuggacugggugggggcuacauuggucccccugcaacucugcucccuggggcccugaggucagaagugggucggccucgugguccuguucacucugggagcccagccccuaccagccccuagccccaggggucgucaguucugugggcacagcuggacuagaauuccgggauaaagcuggggccgagcggcggcugccccugugguccucgcgccccaggccuguggcuuuagcgacaccuggcuagcgugggcccgggccgcccuccccauggcugaggaagaggcucugugugucccaggcugcugcgugggaucgccaguggcagcugucagcaggggugauggccgggggaggggcucccagggccaggagccucagagaccagugugggcugacaaagcccagccccagugguuggugcgcugggugcccucacugcugucaugaguucacaggggccagugugggccauggaaaugaagccugagccugccuuccgcucggggcccaaggccuuggacaggagugagaggggcugccgugagcaaaugcacggcccauuccugugcaggggccagugaggggaggggccaggacaggggccucuggagagggugggaccccagugguggauuccucgucccagcagcgcuggccacacagcagggcccagcaugcagggcggcugagcaggagcuggcggggagcaggacacccaggcccguggcuccucuccuuccuucgacugcccagaucucugcucacaggguccugcccugcguccccccuuuggggacagccucaccugcccggugucuccagcaccuggcuucuuucuguugucuuccucuaaaucuaaauccaaaugacuugccuuuccuuuuauucuuuucguuauugugaggaagucuguuuguacagagagugcauggacgggacauauguugguuuugaagaggugaccucccgggucugagugaugcgucccacucaguguguugaccaccauccugaugcguccucaugccccaaccugcggcagccccgcauuuccuuagggacagagggggcagcugccugcuuucccccaccugccagcaauggugugguccguccuucugggggcccuucuagaauccuuggcagaccccacugguggccggggcaggcuccagcccuuugucaccucccuccuggcaaacugccgcccugggccaucuucccuggugccaccucagcccuccacccccggcccuuauggccacccagaggaauccugcggaaggccuuugguuugaagggugagacugcgggccacagccaggugugauccguggucuuccaguaaaucggagcuggagggaggaacguccgagugcacagcaggacugaccuccaggccuggcacgugacaguggccucccagucgggcuggucagagggugacugggcagccucuuucacccuccaggcucagccccuaucagacgguucuccaggcguggcuggacuggaacccugggauaaaaccagggccaagcaguagcuccacugcaguccucacaccagccugccccuuacaccaucccccaccucccugcuucaggccucgagcccgcuauccccaugccugccuguccccgcccccuccuguccccgcccccuaccgucccugcccucuccuguccccgcccccuccuguccccgcccccuccuguccucacccucuccuguccccgcccccuccuguucucacccucuccuguccccgcccucuccuguccaccugccgugcccccugcauucacacccguccuggcaccacuccaucccaggcagcacugcuguucuccaugacaccgucaccaauggucugggucuccgacuugucugcagguagcucuucccggcccgcacagggccaggccacagccuccauagcucccaagggguggagugcagcaguaacggccaagcugggccucacagugccccgccucccaccccaccccccaggagcccugacccuaccuccuugccccuagagugcagccacaugcccucacugggugcuugggaaugucagccagccccgagaggcagcagccaccaugcuuuuggugguccugcaggggcagcccagcucccagcugcugguccguugcuaggcgagagccgcaagcccgcaggaccacauccuggaggccauaggagcagcugggcacgaccuggaggccucuggaacaagugaggugucagugaggcuugccggggcaguuucugugggugcgugaugugggguccccaucagaaaaaaccggccaaggcgacauuggacaugggacgcccugggcggggggagaugugggggcugucgcccaccaggugagugugagccaugggggagaugggucauggugggaaagggucccguucccaccuucgcagcuggagggguaauuagacccaguccccacacggggccaugggugggccucccuguagggucuccugugccaguuucuguucagcuuuugacccaaggcagagaggaugucggggcacaggccaccacaggucccggguaugggaggcagccaugccagcugggugcugagcagauuuucaggugcucugcagggagagcugugggguuugcacacagacugaacacaguugagagucagaggcucugggcuuugggccugagcucuuggaaugacagagacaagccugacgaaggugugagccaacaagguucugggagccaagcagcugcagccucccucagccuccugcccccacuggagagcagcuuccaacccauccgagaagaccccugggggcucccucagcccccugcccccauggagagcagcuucugacccaucugagaagaucccuggggguuccaggccugacuuugcccaggggaacauggucaucacucuaggugggaagcagaggggccugccagggaggugaggucuuggguaggugguucuccagagccuccugccuggugccaaggaggggagaggcccuugcugugguuucaggagcagggcguggccaccuggcugcagggggugggccaggccuuggugcaaacaggcagccccgucccaaagaggggcagcagggcucugugugugcugagguagaauuauuuuaucucuccgugucugguucacuguagcgugauuaggaauguuauuggugcuguaugguaaugacauuaagagagccaaaagcagucgcauagaauugcuacaggaaaaucugucuagcaaugucacggcagccugcgcccagcccuggugguccuccugggagaggagcagggaggucuggggcccuagccacuacugggggugcuggcgccacugcagggcaguggcguugcgcagggagggccuccaccgcgccuucuuggagggccccugugugcgcagguguggugccacgggugcugacccaggugugcacugcacaccugugggggguucaaggccuccgcugccucagccuagcagggguuccugcagcugggacaguggccugaggcggcccuggcuggcaccccagggcugggcugggugguggguggugcuggggacagcuccuggagccuuuccaggccucucugugucucuugugucuucauucgacacugggguggucacugcgaccaacucaugggguccuguuuguguggauuagauaagcggggcccaggccaggcacgguggcucacgccuguaaucccagcacucuggggggcugaggugggcggaucaccugaggucaggaguuugagaccagccuggccaacauggugaaauucugucucuaguaaaaacacaaaaaaauuagcugggcguggugaccuguaaucccagcugcucaggaggcugaggcaggagaauugcuuaaacccgggaugcagaaguugcagugagccaagauugugccacugcacuccagccugggcagcacagugagacuccaucucaaaaacaaaaagauaagcggggccugacccaccacuuagcagagcaccuggcacagaccucacugcggugaacacgaugaagugggugagcgcggccgcugcuggucuccuuggcuuggugcagggcccccacccggagcucaugucacuuccccaugcgaaccuucugggcccuuccuuccacggagcccaggcauccuugggguguggugguuggcaccgcccaugggguggggcuguugccuagcuuacaaaugaggacacuggggcugcccagggcacgcacugucccucagucccuggggacugccccccgucuggccuggacuccugucccggccccacccccacccguggucugccccaaggggaacucugguccucacaggagcgggggugaccacgcugcugccugucaugguggccuuggacgggacgcuguauggucucugagcugcaccaccaaccccucagguguacguggagugacugagcgacugggcagagugggguguugggugcagcgguggggcuggcaagggccccugccugggccuccuuggucgugccucucucagcagcugggcagggcagugcuguggcguugcuguggggccucugaaaccugccaggcgaagcccacagggccagccuuacccuggaaagccccggagugaccagcagaggggccagccgcacggcucucccaggccuggguaccuuucccaccgucuuaagguagcaggcgaagcgcuggcuggcaucucaagagcagagugcugggacagcccucccagagcuuccugggaauggccucuguucucugcagugagcguggcugcagugcuggcugggggugugugggcacaggggcugcgccuggagccggagaugucggaggccucuccuccucggugugggcacccaccccaugcugucuguucucuagaauguucacucagcagcacuugugagcccugucuggggcugagcagggggcaggacagauggacauucuggugggggucagacgggacaggaaacugccuugugcuuggugugacuguggccgggguggggagggagcuggagggugggucuguggaugggaggaggggccggcagaaaucuuuauauuuuuuugaaagcagaguaacacuagagcagguuuacagaaaaugugguaaauuuaaacaauuugcccuugacacaugcguccuucuggccagcugugagcacuguggcaauggggagagguguggagcgggccugggggagcgucugugccccgaggguaccacccggucccgccuccucagaucugcccucugccuguccccucugacucuuugcccaguagaaagacaaaucccagcacaguggugcccugcguggcaggcugcccuugcagguuuccuaguuacugugaaagguaacaccuugauuuguuccugcuuuugauccagcgcugcaaacagccguucucugggcugcagccuuugauucauccaggcugagacccucagagcucacugggaaccguuucugcaguguuagcagauugcguccacagcugccugggaugggcagcccugacagauccugggugggcgagcaggaacucuggaggccaugggcucucgggcuugugcaggagcaggccgcucacagcagggcucugggccuugagugguggcucugcagagagcauauggcgggagcugggccucggggaggcaaggagucuuccuggagccggaaacagcaaagaguuggagugacaggaucagcccucgugggcagggggcccggaaacgcugcugggccucucagggccuccagcucagacugguggggguggcgcuugugucauggggcgggcgcccagccggagagggcguggccggcaccaccauggcucuugucucugucgucugcccuuaccggagggacagccaagguccuucuccccagggacaccauggcucuaugcgggggcggguccuccucggggacacuguggcccuccgugggggcggauccuccccaguggcuucccaggguucuuggcagcagcucugacauggguucuguccugggcuucacugcugcuguuuuccucacagcugugcccuccccgagaggauucuguccuuucguggacgcuucucccuggccggcuggcuccucuggacccuaaacuugacgcgccguaucugucugcaccagcccuggugccaggagcugagccagcauacagaaggugcuuacuagugguuuaucgaguguggagguggggaccccagaaccuggggcugcccgauguccaccggcagggcggaggcuggaguguccuggggcuguccgcaggcuagaaggugcucugaaggagucgagaugggacgagaggggaccaggggaggccagcagguuuacagggggccuggggguguccccagggucugguagcccaaaggugaacacggggaagcaucucugucccaaauccacagacccgucugggagcacuggccagaaccccucaggcccucuggaauauggugucaccugggggagcacuuccugugggcugucaccugggggagcacuucuuguggggccuggguguccccuggagaggcuccuguggucccuggcccccacugcagggcacucgcucuugaaagguagcccuggucucagcagggaggggcaguccugggcagcccugggcuggccuccugugaagcuuacuggagacucccugcuggacuaagcuuuuucucgucuggccccuucgauggcugagcccugggaaacucccaucccccaucccgcagcagcaucucaccugccaucguccuuccccucccaucccccgucccacagcagccaucuuccuuucccucugaggugccccucccaaguggggaggcuccuucccaagagcugcucaggugggugcuguccugggcccaaggcccuggggucccgccaauuaacuggcguuucccugucucccugcagaaggauauggcccugaagccacaugagcggaaggagaagugggagcgucgucucaucaagaagccccgggagucggaaaccugccccccugcggagcccagugagaacaggcggccccuggaggcaggcagccccgggcaggaccucgaacccgccugcgauggggcgagaaaggucccacugcagcccuccaagcaggugagcaggucccuccccgaccggaagcucugcggcgggucagugcucaccgccccagggccaugccagcaccuggacaccacgccacguggcccccgggccugccuggcagcgcgcccaucguugucaggcuuggggugcaggacacguggacagggcuggggccuagcagaggcaggagccggcugggucacggaggggccgugacgugcccagggccacagcaggagaggugccugucuggggcagcaaggcgcgcguuccgggcuggggcgccaagcugauaggccggccccguuucccugccguguccaucaggcuccgccgacuacagguguccagagugucuauaaggaggggguccaggcucauugccgagggcuguccuguccacacgcagcgccauccgcucacgugugcggcguggggaagggaauacuuggucccggcaguggcugcaggcacgugacuguggucaguggucaggugcguggcccagcugggaacagggcucugccugcccugcccaggggccuccugcccaggaggggcugucagagcaggugggggcuuccccagcgcguggggcucuguccugggugcagcucagccugcagcugcuuccuccgcggggguccgcuggugugcgccuuccuuccaggguggggcucugcgcgguguccucggcucuccucggcccccuugggaauugggcugcuggagaagggcagcaugccuccugggcccgggcuggacggggguuccgcgggcggugacaccugcccagguggacacgugcucuuucuuccaugcaggugugcuccccagaaggggggccgcucccagccagccacugggaccagaacggcccggcccagcgccagcaacagcuccagcccagccaguccagccagccccaggggucccucccagccccgucggcacucccggacccugggcagcccugccagcccucccagcggccacuccugggucagcgcagcuggccccagcggucacuucugggccugaaacagcccugccagccccggcggucacuucugggccccggucagcccugccggccccagcggcuccuuccauccccagaucagcucugccagccccagcggucacgcccggcccagcccugccggccgcauugggcacucccaggccccaggcagugcugcaggcgccugcggucccugcugaccccgugucaccacugccggcgccugcggucccuccuggccccacggucccuccugguccccugccucuacugccggcgccugcgguuccuccuggccccaaggcaccgcugcaggcgccugcggucccugcugacccuguggcaccgcugccgaccccugcggccgugggccagcccgugucacuguggccagcccgguagggcauccucaggacagcgcagccggccccuguggucgcugcuagcccagugccagcgguaccagcccccgcggccacuccucacccuccgaccacgccgacggcccgccagcuuccucccaggacagugcugcugcccccggcgggccuuccuagccccgugucaguacggccagccccgaaggucccugcugggccagcccagccgcccccggcggucgcugcugcgccccaggcagccccagcgguuaguggaagccccagagcagcccggcccacucacgccuucacuccugggcccgggacggccgaggcagcagaagcagccgcucaugggcccggagcagcccugcccacccaagcggccgcucaugggcccagagcagcccugccagccccugcggccgcucaugggccccaacaagcccugcaaaccccagccguugcuccccauucccgaucgcccuucacuccuggggcagccgggcccacccugccggccucuccuggggcuccugugccagccgcggcggucccuauuggaucuggugccggcccgucagccccggcucucgcuccuggcccugggccaucccugccggccccugcggucccgguggacccgauccugugcccccgggauggcccgucaggccccaucugugagcccuggagccugaugccugcaggcaccuccccauauggguuuuccagcccacuccagugugaucugcacccuggcagggccccaagggccaaggccgcauugcccuucgggcuggagaugcuuugccggacuagccugaggccuugucuagacagggcugagcuguuugucguuggaaauugaggcucggccagaggcgggagccccuacagugccacgaucaggcugaggcucaccacaccaggaagagagaugaacccgcgucugccugccgccccgccaugcucccucuccccccacuggcgucacagugcccccacccgcguugcugccuguggugugcgugcccugggaggggaacacagccccugagggcggggaccuugcugggggccccucagcgucuuucugugccucugaauugccaauacuguccuugcaucucugagucuacgugcacgcuugccccuggcgugccaccugugcggagcgcgugagccuggugugugcgugcugugugugcaugugugcgagagggugugagagugaguggcgugcugggcaugaaggaucuguggggugcugcaguuccugcagaguggcccaguggcgaauggugaagguguggguuucaguccaggcccucccccugguagucaggaggugcugguguccaccuccagggcccccaagcuacagggggcacaugggcccaucuggugggucaggaccugcaggggacccggaggcucccacccccaccucucaggacucugccuccaccacccccgugggcaugcacugaaggguugccugcagggucuccaggcgagggggaccccacagggugggcagcgccuucucccggcuuccccacaguccccugcagcgucccgucuggcuguugaccuacauguggucgggcacaccucacacuacaaggcuaccccugggcccaucccugccccuuccacggcccccaccuguggucagguguugccacccccucaggaccuggucucaaggcagccccacucgagucuucuggaguccaaggcacgccacucgcccaaaagggaggggguguuugggggggcuuugacugucuccagaccucaggggagcugggcaggcucuaaccagugguccuccagagagcagcguugaccaccuggaccccugcgccacgugacaggaggcucugguccugcaggccuggucuugcccagcugggcugccucaggugucaggaaggggaugggugucccuggcucccaggccaggcagcugcugaccuccagcaccccgcacuugcucaugaggaccccacccccgcaggcccucccggguccugaccagccucuggugcagcaucugcuuuggccuccgggcccccucgcuccccacccacccgggccccuuccuccggugcucaccuggggccuccaucccagaagcgcagggcuuauuuuucugauuaaagaaaauaaaaagugccgugccacuauuuuuuauaacagcaucagcguuuguaauuuaaacagacgagcaugugucuuacgugauuuauucccacaaagggcuuuugugcugggcuuggcucgggauucauugcacucugaccgaacagaggggagaccuggagcaucuguuccugaccuuccugcccacccaucugaggccuggaauggggguuuguacugugcucagcaugggggcaccggccuccagauccccccaccgcaaggcuacugugugggccagugugacaggggucgagaccccccucucggcucaugccuggggggcacccauccccgggaucaguguccuggggacuggugagggagggugguucagcucagaguccucugcauggccugggcacgcgugagggagcaugguucagcccagcauccucugcacagccugucaggugcuuguguucugcucacggaaggccggggcauggaggggccgaguccuggcugcagcgcccuggcugagcuccaggcuggaccuggcacacuuggggugcgggcuuggagggcggugccaucucagagucacccacacaagccauugccccgcagaggggcugaaguugccuucagacgucccuguugucaggcguggggaacagugaugauuuaaacagucuccugcccucuuuccacuuucaggccccugccccuacccccgggcuccugugaguacagagggggccgagugaguagagccaugucuggggcaggccugaacgggcugagggaguggggaggggccauccaugcuggagcugagcaguggcacuuggcugccccuuaauggggaaggccaggcugccagggagggcugaggagagcuggaaacugcagccugggucccuguggccaacagcugggggugcagaggacacccguggaggaaacauucaggacccagaggggcucucgaggccuggccaugacccugcagccuccagcucgaacccacugucugcacuggcuugcggucggggugccgccauggggagggcagagacaccagggcgcuauggugcuggacauccauguuguguccuggggcccgcgcccugguggggacacugcugccaggcgucgcccugggaaaugcagauuucguguggccagaucuuugauguuucugaagagcugggaauccagguuucucuggauuuggcaauguugaaauguugguggucaauucuaauuuuuaugacucacuuugcugaccagaagaugcagcugugggccugcgaggccuccggcaagugggauuuggcucccaucacaggcagcagauuggagccugaggccugguuggaacauggcuuguucccuuguuucuggaagggguugguacucaguggggcugcgccugcccaggaagaugggcuuguguccuggcugcuguagagggggugggggcagcccagccugaagguugaggauggaggugucuuccggggggugacaguggggaucugggggaggcugcccgcugcccgacuacagagacccuguugcugccucaggaaccccucuggagacuggggccugcgugcagugcuuuagugaccaucagcccucuggucaccucugugggggccucugcccaccuuguuguuguuggcacaggcaggcugguccccucccaucugcagaagggguuauggggagggcgugagccuucugggagaggccgaggcguguuccugcagagcccacggcagacgagggcagugguugguuuguuguugggggaggagaaggggaggucgggguggauuccuggaagaugggugacacugagacuguggcgguggggccaaccccacgaggggccuggagcucuaaggcccuuggguccuccccaggucaggccaaguccaugagccaucgcugagcagcccccagggagggaggggugugagcgugggugggcucccggcaccuggcccagcauccacgccuggugugugggcaucugccugcagacccucguccgagggccccgucucucuggaccccucacugcaggugaauagccacagucccucccccaggcccugcccugcguguuggaaacaccaccuccugggccuuccccguuugcucauucgggauccuugucugggcacugaggacgaugagcuccgccucuguucucgcgucagggcucggcuccuccguguguggggagacaggcugggauagcaugcugggcgacuguggugagggcaaagacacagagggcaugaguggggggcugggggggcaccuggauguucagaggccagaaggcaggacuacccgcaggugcccaagggagacccagggccgcccagaaguccagggggaguccuggggccucggagggaucugagcagggcugcggccugacccaggaucucucuggccucccuggcgucuucccagguggcccaggaccgcaguaccagacugagcuggacuggcauugaccaggccgaggccaccggccauccuccuccggccagaagcugcagugauaggggacaucccuagcaguucacaaagcuguggggagaccccgagggggaaggguuuccaugcugagccacaggcccggccacggugcaaagcuguggggggacuccgaggaagaaggguuuucaugcugagccacagucccggccauggugcagggauuuggcacgaagccucuccuagggccgguacacgaccuagagggcucccugguguacccugggaccuggcagagugcagcuucucauccagcagggguggguagggcccuggacucuccuagggcagcacuguuuaauaggaguguuaugugagccacauauagaguuaagaagaaauaaguaaaauucauuuuaaugaaguauugcguuucacuccauguacuuugaaaauaguauuucaacaauguaaucuauauaaaaauugucacaucuuuuuuacucuuuuuuuuguagagucugggaaagccagcagguguuuuacauuuacaacacuugaguuuagacuggcagcuucugcgcccaauaaccacaaggcugacagcagggaggugugggggguccagaacaauauacccucugugagugcuuaucucaugcccaugcuguucccaggcgccugcugucugucuccucauccucuaccucaucggcucuaugguuugaggccagaccucaugcaucaggccagaguguccugccgagacccaggaugcaccccucacuuggcacagacaaaccagacacaccagcuucugucuuuccccauuucagugggugaaccuggaaccacccagaugacugggcuagaaguugacagucauucuccucuccucacuccccuguccucccacccagcacacccagccaggcagguccuuagcuuccaccuccugaaucucugaccugaauuucacuagaaaauaaggaauacuacgucaaaauuuaugggaugcagcuaaagcaauccuuaaaggaaaacuagcuugugcuuauaugggaaaagaagaaaggucuagaaucuuaagguuuuaccuuaagaaaccaaaaaaaaaaaaaaauggaagguuuguaaaccuauaaaggaaagccauaguauagacaagaacagaaauacagaaauuaaugaggcaggccaggugcgguggcucacgccuguaaucccagcacuuugggaccccaaggaggguggaucacuugaggucaggaguucaagaccagccuggccaacauggugaaacccgucucuacuaaaaauacaaaaaauuagccaggcacgguggcgcacaccuguagucccagcugcuugggaggcugaggcaugccaaucacuugaacccaggagguggagguugcagugagcugagaucacgccacugcacuccagccugggcaacagagugagacuccgucucaaaaaaaaaaaaaaaaaaaaaauuaauaagguaggaaacagacaauagaggaaaugaacaaugccaaaagguguuuucaaaguugagaaaucccuagcuagaucaaucagaaaaagaaaacacaaauuaugaauauuaggaacaaaaggggaaauaucauuacaggcacuauagacacgaaaaaggugaaauggggacaauuuuauuccaacaaauucaacagcuuaggugaagugggcaaauuacuuggaaaacaaaacugacacaagaugaaauagauaauccgaauagucuuuuuuuuuuuuuuuugagauggagucuugcucuaucacccaggcuggagugcaguggcacaauguugcgcaagcucugccucccggguucaagcaguucuccugccucagcuuccugaguagcugggaucacaggcaagugccaccacgcccagcuaauuuuuguauuuuuaguagagauaggguuucaccauguuggccaggcuggucuugaacuccugaccucaggugauccacccaccucggccucccaaagugcugggaacaggcgugaaccaccacgcccggcuuagauaaucugaagagucuuacaucuguuagauggaguuucuggauguccacguuuucugucuucagugccaccucccccagccugcucagcacccugucgccagccuagccuaacacuugaagucuuuucugaucguaccaggcacauuuccaccaguuaacaugcaucagcuuguuuaacugcaacccuguaacuauucccauuugccggaugaggaugcugaagaaaaaaagccgccuguaaauaacuugcccaagguucacacagugagcagcuggaccaggauucaagcccagcggcuuggcuuuguuguggaaucuguacccugggccauuaccuggagggcagcuuucugggccucaguuuuccugucuguaaaacggggauguuacuaaauaguucauuuguuuucggguuguugagaugauaaaaugagcuaacaugcaagguuuguacugucuacauagcugccaugaugauaucgauuccugcuuuuauuauuaugaauucucagaguaauuucucccgccuccugggcccagccuggcugguuugaggcccagacgcuagaggcuuaucuuugucccgguugccaggcaaggguccuccugugcagggccuguggagagaggcacucaguuaaucagugccuuagacacugggccugggccugccaccugcagggagcagcaggcugggucacaggguccuagagcuuccucccaccugacagggcccuccuacaaaccaagaguugguccaggggaaggggccacucaggagggcugggggccacgccggccagggugcuguuaggugggaguggaagaggaaggcugagcaccugggccuagcaggcacugcuccccacagccuggggcuagccguuccggggcgagcauggccaccucugcuuucccagccucacucuggucgggaaggcucuuccgacuggcauccauuuuguacuuuuggucauuccgccccuguucugggccuggggcugcagugacaaacaagacaagugaccgugcugcccucgagaaguuaaacuauaacugggacaacagcagagcggguggagacuguucugagugugagcacagcugugccugggaaggagagaaggcaccguuagaccaggcggucagggaagagcgcucuggguagaggguguagccacccaggccucugguggcgugugccugaggagccgagcgggcauggggugggcagacagggcuaaggaggggccuggucucauacagagggaaaccacugaggguuuuaagccagggaacaacgugagcuccuguguuuuuacaaacucgugggggaggcagcacgguugugggggugguggcgccugucgggaggcugcugcagccguucaggaggggguggcaguggcuugaauuaggucauucuucuguuggacagggcgccaacugagcaagaccaagugaugcagcccaggcggcaaaugugguggagccaggaguccaguggccccaacuccagagcuggcggcacacaccugcuggaguccacucugacacagcauagcugcuguucccaccccuccuccggcacacaggacugcacaggcagggccuugcagacacuuaccugcacuugcccacacacacuaguguccccaagagccugcuggcaacgcacuuccuaggccuuaacucagccagcaucccucauaucaucuguaguguaucucauccauccauccacccaucuguccaucauccaccugucuguccauccauccacccaugcaucuacccaugcauccaucauccacccaucuguccauccagccacccaugcaucuguccauccacccacgcauucaucauccacucaucuguaguguaucucauccauccauccaccugucuguccauccauccacccaugcguccaucauccacccgucuguaguguaucucauccauccauccacccgucuguccauccauccacccauguguccauccacccaucuguccauccauccaccaugcaugcaugcauccauccauccauccacuugugcauccauccaucuacccaucuggccauccauccacccaucuguccauccauccacccgucuauccaugcauccacccaucuacccaucuguccauccacccgugcauccauccauccacccaucuguccuuccauccacccaucuguccauccauccacucaggcauccaucauucaccccaugcauccauccacccauacauccacacauccauccauccacccaucuaccugucuguccauccauccacccaugcauccacccaucuacccguccauccauccacccaugcauccaucauccacccaucuguccauccaaccacccaugcaucuauccauccacccacccacccgucuguccauccauccaccugucuguccaucuauccacccaugcacccauucaucuaccuguuuguccauccauccacccaugcauccauccauccacccaucugaaucacaauagaagaagguggagcagcguacuggagugucccgcacugggcgggcaguacccugcucccugacacugugcugacucagggaacacuuggucucucccaaacauugccugagucccuguuuacugugucugccugugcuagguaggcaaggauaaaagacagccccgcccacuggaugcuuacagucuacugaagagagacacagaaacaagcaaccccacuucucuuuuagagagacacuuaggggacugugggagccuggaggagcucuuuaccuagccugguuggcauguggagugaauggagugucaggaacgguuucaggaagaagcagggccacagccauacugcgugguguuagccuggaggaggggauggcaugcuuugcuaauaccaggguccuggagacagacaacagaguuucccucauucuggagcuucugacuccccacucccaacucugagagucguucuccuucccauaggcuaugcagucucauacagcugggcugcagugccacaccucaccaguaggugcugccuucagcucaaugugacuccagccugagcuucgagcugugggugcuaagaaguggcuaccccuggcugggcgcgguggcucacgccuguaaucccagcacuuugggaggccaaggcaaauggaucacgaagucaggaguucaagaccagucuggccaagauggugaaaccccaucucuacuaaaaauacaaaacuuagcugagugugguggcaagugccuguaaucccagcuacuagagaggcugaggcagagaaucgcuugaacccgggaggcagagguugcagugagccaagaucucaccacugcacuccagccugggcaagacucugucucaaaaaaaaaaaaaaaaaaaguggcuacucuuccagucugaggguuguagguugaguauguguggaagagagcccagaggcugugcaggcagcguguauggguggugaggaaguugggccccucuuccagugcccccaccagcagguacacagccuuccucgcacuccuccagcacccccuccuugcaccccuccagcacacccuccuugcacaccuccagcacccccuccuugcaccccuccagcacacccuccuugcacccuccagcaacccuccuuguaccccuccagcacacccuccuugcaccccuccagcacacccuccuugcacccuccagcaacccuccuugcacaccucuagcacacccuccuugcacaccuccagcagcugugggagagcucccuuucccuggcugcuccugcugucugggacgcuccccagggcucucccaucucuuucuuugcagauggcaauuuucccgaggcagccccugcucagguugaccccggaacugggucacuuccuuuccccaucaggcucaccuuaggaguacaaguucuggagcagcaccagugacugccacaaagccccugcccuccaaacgcccgaggguggggacaacaguccacaaaacagagcaggaugcagucgcuggugucacgugcugugggugcggcaucggcuccucccgaccagggacaugagcccagcccccaggagguagcagcaggggacugugguagggcugaaggcagggcguagcaucugccugcaagucccuguggccugggcagguucgggacagaggggccccagagucgggcucugcucuugcugaaugugaggggcccauagucaucauccauggcucaaccaggccuggggacacugugagggcucugggacugucccuucgggagcgaaggcagcggagagagguaccacccacccacaguugugccaggcaccugcucucaggauucggggacggcuuugugggcucccaaaacaggcaggaaaccaggaccagcugggagcugguagggacugugggagguggggaaauggaguguuguggacgaaagcagccacucccucuuugcccugcccugcccugcccugagccagggagcuggacacccacugcaguccccugaggcugcucaaccuugguggguggggaacuuggaaagucucaagucuggacccaugacauccagucccugggggaggcccaggaguccugaaagcuccccgagggagcacuguuugcacugggccaggagccauguucuaggggcucagcuccuuaagaggaagcgggagcugcgaggaggagggagcgcaggcuguggggcuggggcaggggugcgcuguguccacacucauuuccacucagacacggauggcggcagcuccgccucugcauaccugugcuccauuucugcaggggcgucgcguucccgucuccugcuggaacuguggcccagcccaacuagggggugugggggccugaccucugccccaucucccagggggccuguccuuggccuggcaggucugaggaagccguaggccccuucucaggguucuccagggucugcauuagaacagcagcccaggcagcccccgacucucacccucgcucccaggccugcaggugcagaggcuggaggcaucguggccggccagucucaguucaugccccuguaggauaguccuugucugaaugugaugccaugggauggggugugagagucgcccuggugugauccgauuggugugagacuucaccagggcugcagaguauggcugucagaguugugcacugcaccgcuccagggcugccauucccaccgugccguauguagugcgugcauuugcccugaccauugcacauuccccgggagggcaccuucugcucaguuugcacaagaggacacgggggcugguguggggccucuugggugcuccacuuugggcggggccugcgcaggacagugcgugcuuagagccuuggggcgggucuggggagcagguggggcgaugaguccgugugcauggggugagguguguacagggccagugugacugcugugguagagagggguguggguguguguaugcagccagcguggccccucagccugccggcgccugugggucugcgugggucucugugugcagccggcgcggccccucagccugggguggugugugugccugcgggucuccgugcacccuagaggguuuccuggcugcauggcggggccacugcuggcucccgucucucuggccccuucccagcaacaggacagcucaagggcacuagaaccggacaggccaggccgcaccugagcccccgacugagcccgagccucccaguggaaccauguuucugugggcaacccagaggcagugauuuuuggacgugcagccuggagcugggggacgguguggagggaggggguuggugaggggaggggaccuugggggaggggcucugugcgccuggagccaccauguuccuacgguuacugccagaacccucagggccccagugcuccuggucccaccagcggcuggucugcggcugcccaguggagugcagcuuguaggagcagguugcugaggguucaggaaauuugaagccggcuguuaaacuguuaguggcuuccaucagcuuugguuuggauacugacgucacagaaacugacaggcgcuccaugcuggcccacagggagcuguuccuccugcccugcuccugcugcacgccccaccugcugacauaacuggacagacucagccuuccuuccccaccccaggaagcacaggcuugguggagcagcagggugcccugugaggagggcaacucagggcugcagugugugugcugggccguuggugccgucagugagcuguguccggggcccuccccggccugcgcugccuuuccccccgcaccugccgccuggcagacggagccaccuucugugugcacugggaacagucacuccuuugucacucuagggggggcaggggcuugggucggcucugcucacugcccagaacgguaccuggcucgucagggcuccauaagcaucgguuggacggguggacagauaggugggcagaccacaaggcuggggugggcacaggugcaguagcuccugcccacccuccagggcaaaaggggcccccucuggccccagacguggacuugucauccagggacugugaucuugucccuccagcuccugcugggaguggacguguggccuccccggccccugguguggcuggcagcacugagaagcggcugggcugagggcagccaccuuggcuguuugagguccugccuggggacagaguggggugaccaggacacagauucccaguucuacaggguuuuucgagacgugggacuuucagagcuaaaaccggccacccgaggaaggggaagagaccccaccccacgaccggccuggccaccuuucagggccuccggguuugggaggagcacacgcagggcagcccaccgagccccucuguggcaugggggugacgcguuccaucugcgcccagcccugaccggagguggcuuuugugugggugugaaguguagagaggugcccuacuccucacggcucagcuguguggguguuuccgacccaccucccuucccaucggccagguguccuugggcagugagcagccugcaccacuauacucagcagcccuguggcagccuuucccaucgcugccagguacugcccugagccucugucccuagaagugagugcagggcucauggggccaucgccaauggucagacuccccagggggccggugauacacgguuccuggagcgggcuggaaacucauuccuugcaggcucugggagacgaugaugcauucccgggaccccgcguugagaaccgcuaggagugggacacguggcuuccugcagagguggacagaaccccugauggccccagcagggcagcaagugugggacccggugggcagggcugcccagcugggaccguggugccagcuccgggggugagaaaggagagguugugagaguccagcuggugacaacagugaccccugguggccuggaaggugccggccccgggcucugcugcacaggccgugccuccaccuaaaccucauugcaccgaggggcccugccaggguucccgaauguuacaguuacagaugccgaaacugaggcuggggcaggccagucgcuugcccgaggccacagugccaggaagagccgggcagccuggccagggccugugagggcuacugugcagcugagcaggucacuagcccaccacccugcccccggcucccgcccaguaaggcucagacuccucggggcugcaucccugcccggccagggccuccuccagugugggugccugcuacugugcggcuugauggaccucaugggccgggggcauuugaccucaggggccugggugacaucccuuaauucgcacuggcaccgucugccuugugugcacccugucagccacccagggaggccuguugcugcaggaggugcacagagcgggccucuggcugagccgaaggucggcagggagccaggcucauggcugcagcgagccacaccagccaguccugggacggguuuccccgggcuggggcgugcuccugacuuggaugacucaaaguaaagaaccucaccaggggcccuggcaugcgaggccugggggcccagaugugcuggggcgugucacuacaaggugcagaauuguuccagauccaaguuggccagagagggagaccgcugggcuuccacgugagucugggcgcuggcugugcaggggcgucccugcugggcgcuggccagcaggagcucuggccucucacuucccucagcuuugugcagguuugaaauuauuuccaaguaaaaaaaguaaauacaugcagggcucggggucuggucccugcauggucacuuaaccugucugcgccucuguuuucucauccgugaaauguaaaggaaaauaguuucuacucggggccaccgugugagcaaaugugugagugugugcaaagcgcccgggccaggcccuggcacgcaucggcgcccauguuggcuggugucaggggugguggcggugggcguggggcguggggguggggugaagggaguaugggugcucccuucagcaggugaugaaacugaggcacggggaggccgagcaguggcccaagggcccauggccagggucaggcaggucccaccaccaccucgcugcuugcucuggcauggagccgaccgaaggaggugcugugggcacagccaggggacaguggguggcacugaggcucgaccuggaggucauagcccuguacagccagaugggguggugcgaaccagccaggguguggguggaggcccugccuguggucccuagcacccccaggaugccuucaaagucagcggcuuguggaaggggcggcuccaagcacguggcgguucucgugucacugagccgguggguccuggguagguccuccccguccugguagaguguguuaucagugugugcgcugucagcugggauggcauuccuggcugugcagagcucuguccugcugcugcucccgcccccagaccaggacccagcccaccacagcucgucacaucccaaagcgcccagcggcugucggggcgccuggggccggggugcuggggugccgggagcaggcauguagcccuagccagggggccccgaugcggacgcggugagguggggguuugccugagacagugucucucucugucccagaugaaggucaccguguccaaagggggcgaccgggacagugacgacgacagcguccucgaagccaccagcucccgggacccgcucagcgaugugaguacccagcugcccgcgcccggaggcuccgagucugggccgccugcccgcugcgccccgcacaagggcguccaguccgagucugggccgccugcccacugugcccugcacaagggcguccaguccgagucugggcccccugcccgcugcacccugcacaagggcguccaggaagccgcugguuaggguccgguuucccaccaaggcuuugucuuagcaaugagcauuuugccuucguuaaagcgugauuuuuuacucauuaggacuuucccauuaggagagauuuaaaugaagaaauggugagugagcuggcaggagcccagaggccaaaacguuaagccuuggacgcugugccugcacugcuggccuguggguggagggcaggcggacggccgccgagucuugagaugggcacuggcggggcaguggggagguuucugcugacuggaacuugaggcaucucauuaucauuuaaaugaaggccucacugcccggcuccccaucuuguugccacaaguuaggaaaauaggcugggaauuaccugggacugccgcugccuugguuuguccucuaauugccagccccuggugaaggaagucacauucugggcacaaugcagcagcuggggcugaggcucaaacucagggcaacgaaggcccucccaccccucuggcagcugggagcuggcgggugggcccaucgggacccagggccuugggcucuguccccugacauccuggggcccuucaggagcugaccuguccccggcaagggucugucuugggaaggggaggggguguccucccugacucugcaguggggguuguggauugauuugggagaguggaggacugccgucagcuggccccaaagcccuccuuuucuuccucugccuugccccucagaggggguguuggaucuuugcaucugccccccacuccucagggggcucuggacccucccugugagccccacuugcccagcucagugacccaccccauccacuacagcagcccugagccuguuuccccaccccuccugcugggggaggcccugguggucugaguguguagcuggugugauccauaccucuguccugaagaccucacaacacccacucgagccagagggauccaagggugugggggaccucagcagccccugcaggccagagggauccccaccagagguguggggggccccuagcugccccugcagaccagagugugcccugaugucugaggggcccccagcuaccaucccccagccccaacccccaccaccugucaggccccuguggugaacccuccuuugagggcuccaucugguaccuccucccggaagccuuccuugucuagccagggcacccuccccaaaguccugcaaccauggaccccucuggcgggugggcacggagggaggucagcagaagcuggggcccugggcugaccucccccaggucuuccugccuccucugaggagcauuucugguggggccuucccucuuggggacagggagcuagccaagggcgucccugugggagccuccucggguuuggaucccagagcugcugcaggggagccucagacuggcugggccccucaggaggacgacagccccuggggaggaccccaccacgacgccuaacucuguccuccucccugcggccucagcccucguggccccugccugagaggaugucucgcugguggucuugggucugggcaucuggaccuguccccauccgaguugagggcugcggggcugcggggcaggguugagggcugcggggcugcggggcaggguugagggcugcggggcugcggggcaggguugugggcugcggggcuguggggcaggguugugggcugcggggcuguggggcaggguugugggcugcggggcaggguugagggcuguggggcuguggggcaggguugugggcugcggggcugccgggcaggguugagggcuucgggucuguggaucugcggggcagggcugugagcugcagggcugcggggcagggcuaagggcugagggcugcagggcagcugucgggugcaucccugggaguuuguuccgaguggcagccucacugacuguccccucuuccuuccugcagagcucugcgcaugcggucucggggagaggcuacucuguaagucucccagcaccccuccuccaucuuugucccccuggggccuuaggaccagguccccaccucaccuguccgaggccccacaacuuagcucaccccagucccgugcccgcuuucccucuggagccccagacugguucuggccucaaacaccaugggguuggugggggguggacaagcuccagagugaagauuugggggugcguccugcucacgguuugccagggggcccccaggcuaacaugcugccccagggggacgggcuggcccuguggcuguggccuugccaggagccucagaguagucagccugcacagaccccagcugcagcuaagggugccgggauccgcggggccaaggccgggcugcuucuugggguccuguugggggccugggacauuuggugugggaggugcccauggugugagcagccaccuccaaugcccugaccggcaccugccucaccccggacagaaaggccugggcccaggcugggcaacacccagggagccagcaccccguggcgggcagggggaaggagaccugugugcagccuucaugacgggugugugcccagggggagcggguguguuucccggggggagcgggugucugccuggggggagcggguguguguccgggggagcggguguguuucagugugugcugugccuccccgugggugcacggguguguuucagugugugccugagagaagcagguguguuucagugugugccgugccucccugugggugcacggguguguuucagggugugcccgggggaagcagguguguuucagugugugccgugccuccccguggguacacggguguguuucagggugugccaugccuccccgugggugcacauggcacgguggagggcuccuugcacaugugccuggacuugcugugggaauggccugggaggcugggcgccgaccccugccccccggaccuggaggcccagcaccaucuccccggcccccaucaccacuguccccugcccuccucaugacuguguuucauuuucccuuaaguaucaggaggaacauuaaugacaacauaaaacccagagcuccauaaaagccauuucuacagauugacggccugcugggcucgugggagggugggggccuggacucugcccaccccaucccugcagcccccgaaauuuccaggccguagaggcucccucacuaaaccacagcagcuuuuuauaggguguguaauuaaaccaggaaugacccaguguggccaggccagaggggacacagccugguggggacggccccccacugucucugucccacagcuucugcugguggcagagcaggaagcggcaagggagcggcaugggcggcgcggccacaggccaggaguggaccccaggaucccuggacccagccucaugggcaggaauuggccacuuggcugggucacagcaggggcucagccaggcccuuugcacccccaccccagcuccccugaggcugcccuuucaccugagguucugucuaaagcccugggcucagcucuaccauccugggcucuucucugccacccugggcucggcucugccacccugggcucuucucugccacccugggcucugccacccugggcucuucucugccacccuaagcucugccacccugggcuuggcucugccacccugggcucggcucugcaccccugggcucugccccccugggcucuucucugccacccugggcucuaccacccugggcucuucucugccacccugggcucagcucugccacccugggcucugccuuuggccucucaccugguuuggcccagaguccgugagcuguugaccugggguggcuggagcucacuucugggcagugguuccuggagcagcugccugcccaagggcccucuuccuaggguuuccuuccuccugugcugcauggggucucaggcagccuugcuguugucaccugugcgcgggggcaaccccucagagguggcuguggguguccugacagccauggucaugaguaugaugacacuccuccgcccuucccauugucaugaguaugaugacacuccuccgcccuucccaucaucaugaguaugaugacacuccucugcccuucccaucgucaugaguaugaugacgcuccuccgcccuucccaucaucaugaguuugaugacacuccuccgcccuucucugggcaguguccugacagaccagcuccuggugugcguguucagggucagaguguggaaaugggcuaaggccaccuggcuccggcugcugggaggcaccugggucaagugggguguccugaugcagacuccaugggcaggaggacuguggcccccacauaggugccagacugugagugucagugacaucuccgagugcugggcaggacuccugucggcucacugugggucagggggagggccgggucuuaagcucuggaaggugggcucugcccccuguugcuggugaggugugcacguggccaccuccuguggccaccccagcuggucugagguccccagggcaccugggucucucugcccugagccacugggugcccuucugcuucugggucuccacucauuauucaagucuucuccccagagcacucuguguuuccugagaaagcccguuauuaacuugccagcugcuugcagcuuaacccccacagccgaggcacacaagugacagauggcggggugggggguggggcugggggguggggggagggggaaggggggaggggcuggccugcugcacuggggaugggguuccccuccaagccgcaggagccugggaggacccugagggcugcagaggguccugugcgugugcacugggccccagcacacacauaccuguuucagacccuggugcauacagaugggcccugccaugugcaggugugcacccggggccuugguccaguguggcccucaguugcccaugcugucagcccugcgggccccuuguguccagugugggggggggggugcaggugagagcccggggugcaggugagagcccaggcuccaggcagagagcagggaggugccuggccuccuuggaagugcucuuccccggcacugaggacuggaggcagguggaggccagaccaccccagggguggaggaccaagaaccggucccaugggacgcaugcccaggagcaggacaggacccaggagcaggacaggacccaggagcaggacaggacccaggagcaggcgaggggcccaggcgagggucuggauugugcugaagccugggacccacuaguggggguuugggacuucccugaggccucagacuccuggguugcucccuaggcugaggcugccaugugugugugggcgugugugugcaugugcauguguguaugugugugugcgugcaugugugcaugugcgugugggcaggucugugccuguccugugugcagcucguguccgugguacccccguguggugggcugcauggggcugugcguugccuuguagaacagugucacggguuccucucugggccucugugugugcgugugugugugugugugcacccgcgugugugugaccuguguuuguguguuugcaugcugugcauguggcauuguguugugcacauggcguugcguguugugcacuuggcguuguguguugugcacguggcguuguguguugugcacguggcguugcguguugugcacgugugcaccccuugccaccugccugugacuggggccuccagccuaaugagaaggcacagccaggccagcagccucccguguugcugaguggcacaggcauucaucaccuggucugguuuuaugaaccauccuuagagugguguaauuuuguccacauugguggccagcaaagccccagcuauugcucauccucagcagcuugugccccaagugugugguuuggccuucucagccaccgucagugcuguaagguagaguugcuuccacccaaggauguggugacugacuccagcguggcagggggcuaguggaucgauuagacagaaugaggauccacaagagcuugcugggguuggagccauuccugccggcacaggacccuggcuugcccucccacacccaugcacagaauguucuggaggggccuuuggccagcaggagccagagugaggggcugggugagcugcaggguggugguggcagcccauggugaggcccaggccucagggacccaucucacccugcacacggcauuuaguuaccagaucaucccguucuccagacaggaucacaggcccagagaggccaacagggccccccaccucagugacugggagcugagacccucagaccucccucaccacucggccaugcccacccagaauucuccuccaugcggcugcccagccccuugugcccaucaagaagagccaucugccuggcuaugcccacaugcccuacucugcccccaguagcacccacuuggccacagcccccccaggcccuuccuguccccacuggcaagguccuccaucagggucacagaugcccacccugcacaaacugagguguggagaaauccguccccuugccuccccuccagcccaugugugcugagcguguccauggccgggcaugcacacagggagaaagaugggaaagaccuggguaagggaagccaaggagucgcugucccaggcgggguguuaagcgcagugcaggagggugggagggggggccaggccagccgaagcaggcauagguuugaacagaggggccggugagaggcccugaggccccugaggaaggagcccaccccgugugcuugggggcaugccugggacagggaggcuggaggugggugggaggagcagagacccagccaggugggacacugcagaugcccaccagccgcuggggucccgcugcccucgcucugugccagggcccgauacaggcgcugucuuuacaaggcagguuugugacacucauuacggggcuccuugggccucuucugagcagccacaacuuguacagaagcaauaaaaacccaucagccucucccuggagucagagagccacggucuccucccaacccagccucucccuggagucagagagcugcagucuccucccgacccagccucucccuggagucagagagcugcagucuccucccgacccagccucucccuggagucagagagccacagucuccucccgacccagccacagucuccucccgacccagccucucccuggagucagagagccucagucuccuccugacccagccucucccuggagucagagagccucagucuccucccgacccagccucucccuggagucagagagccacagucuccucccgacccagccucucccuggagucagagagccucagucuccucccgacccagccucucccuguagucagagagccacagucuccucccgacccagccucucccuggagucagagagccacagucuccucccaaccucugagcauagaagggucuuucaggcuggcugcuguguggguaccguaggggugggggcugagccauguccucgccccauggugggcacagcccgcacccaucugcucacccauuuguccaucugcacccacccacauccaugcacuuaccaccugucccucgucugccacccaucuguccguccaugccacagugaucaugugccugagggcaguggccucagcacagccugacucugggcugggcuccaugccaggcacuggguugugaggagcacgucacacagggucccugcccccagggagcugccauuccagaggggagaggagccagucaguaaagagagcagcagcugccaggucggaaggaagguggccggggucagggcagcaucucagaaggggcaggccagggugucugaguaggggcaagccugugugugcagaaccugaggcgggugggugccacugugggagagaacagggaggggugcaggggagcugggccguagaggaugggaggcugugcagauaguaccacuaucccccaccaccccaggcuaagugacaaaggggcugacccacccagugcugagaggggcaggguccaggccagguuuguuccagcagcccaagcaccaccacucagcccugggaggucagcaugggggcagcagggacuugggguccugggagguggccauccugccguccgccuccacuccaguccuggccuccaugggcugcgggagggugggacgccacgugcguugucgggccccaggugaagggagugucugcgugugagaacaccuucaucuccauggcauuuagaucaucugacuccuccaccugugguauuugauugcaaacaggugagguccaugaggagaccucgccuccaucugcagaugcggaagccgaggcccaggcaucagcugcaccugucgcacccucugccagggcgggguccagauggggccaauggauuugguccccucccuguccaccuuuuucuccucgccaccucccugccccacaugugcccacacagggcucacuucccgcagcgggcacgcgcucuuuuaucuccuguuuugugggucagaauugagcaaggcucagcccggguggcuccuccaugcugcacugugcucacuggggucuccuggggaugguggcugggcuggguggaggguucaggguggcuuugcugacgugccuggcuucugggccuugguggcucaaggcccaggcagcuguggccagcccuugcagagccuuagccaggcuggcagcaccauuccagcacauucugcaggucagagccccccagcccagcccagguucuaggggagggguuggacccuggccuggaggggccucaugagugccgccuuucaccccacccacagcucccugcagcgcucccagguaugggggccacagccauccaccaggcaggacagccccacagggcagggagaugccugaccaaggaggguggcacaggcagugaagguggcggcgcacagcccugcuggagagggccaggccagagucuggggugcccaucaagcugaaauccaauuaugagaacaggccgggcugcugugacacggggguuaggaauuaauguuaacacuguuucugguuaagacuuuuuguguugauaaauaauucaugaggcaguuagcacuuugagccugacaacacgagaauauauuaauacggucggcuccaagaaaggucagccacgugcuuggggccagggggccaucuuuuauucauucccugacacaggcucauuaauuauucuggcccagccggagcugugcucggagggacacuaaugagaaaaaggagaguggauuugagauccacacgccauccgcuguggggacguagagggagagauggaaagaaacacuggugaggccucugaggcgggauggggccugcagccuggcucccugacagugcugguugggugugaagaggugagcggagcugauccgcagguguguggggcacuggcugccacaucccagcucucccagagagaugaggaacaggagcagaugcagccaguaucagagagcaggaggugcauggggaagugaggcugaggcugugggugccccaagcacacuaggcccagcgggugcaggaacccccagagaagccacugagcagagacccagaggggaggcucgcagggccagcgguuaggaguccugcaugugugcacguguacaugacagugugagugcacguguguccaugauggugugcgugagugcacguguguccaugauggugugagugcacguguccauggugugugagugcacguguguccaugauggugugagugcacguguccauggugugugagugcacguguguccaugauggugugugugagugcacauguguccaugauggugugugagcacacguguguccaugauggugugagugcacguguacaugaugcguggauguuuguacaugguguguuguuuacauguacaugacagugugugugccacgugugcaugauaguguguucuguguguacauggugugugugugugcauguguacaugacagugugccauguguacaugauggugugugagugcacgugugcaugacuguguacacgauggugugugagugcacauguacaugauagugugugugagugcacguguaaaauggugugagugcacauguacaugaccucgugccauguguacaugauggugugugagugcauguguacaugacggggugugugagugcauguguacaugauggugugugugccacguguacaugacaauaugauuguguacaugauggugugugugccauguguacaugacaauaugauucuguacaugauggugugugugccauguguacaugacugugagugcauguguauaugacagugugugaaugcacauguacaugaaggugugucguguacaugauggugugagugcauguguacauggugugugcuauguguacaugacagugugugugccauguguacaucacagugugugagugcacguguacaugacggugugugugugagugcauuguacaugauggugugagugcacguguacaugaccucaugccauguguacaugacgugugagugcacguguacaugauguacaugacagugugugugaguauacguguacaugaaggugugugugccauguguauaugauggugugugugagugcacauguguaugugaaaguguauuguuauguguacaugcguacguauaacugcaugugcaugcaugacugcaugugagugcacguguguacauaaauguauguggcugugcacauguguguacguaacggugucuuugcaugcauguauaugugaucauguugugccaugccugugugguaacgaucacagugaggccaggggcucugcaggcacucgggggucuucaggcugacguggggugggguagaguggaagcggcugguggccagcucuugucaccaggaacccccuugcuguguggagacagcuggagggccagagcacaggggccccagguggccacgcucgacaggaugugagggcagaggguuagggauggccgcccugucguguggugggugcccucugcugugggugugaagcccacggaguguguggccagggacauguacuuaacaggaagagguggcacucggguguagaauggaaagcuguucagagugagacuguuccuguccagugugugagucgggccgagcccagagguggcugaggugggugcuuuccccacccacgucccauggcgucacagcacaaaugccaguccagccuguccaguguguggguugggccgaacccagaggcagcugugguggguccucccuggcccgugucccagggcgucgcagugcaaaugccaguccagauguuccuauuuguggcagucgcgacuugagaaaauuaaaggugauuuugugcauuuuaaagcauuuagacccaaggcucagguggugcuaagcaggugucuaauucugcacaugucugauggaauguucuggaauuguauuggggcugggcagugcucccuugaggacuggcccccagcaccuagugccccaaucuuugugacaguugggagcccccacgaggauaguuuuguccccuccaaccacaguguggggcaacaggcaaugcggacuucagagcccaggccgcccacacgugugccugcuaugucuccagcuaaguggaccccauggauccuugggaacaggauccauguucucaacagacaagaccauggauaacaaauaagcagcugaucggagaucaucgcugggugggaucaggguccugagcaggagcuggccacacucgugugcaggcgcaguggccaccacugcacggagagcucgggggaggggccgcagagcccugagugccaggaggagccagacuggcugggacucgaagaagagcauugggggaacgggcucacccagaucccuggucagagugagcuuggguguggcugggcugaggcccugugacccaggggccggucccuggggccaggccugggagggaguuaguuugauucauaggagguccugagacggaaggggccugggaggguguguucuccagcugccuguccuucuaaccagggcuccagccccacguucucgccgacgcagggcucuccaggccugcucccuuggcagcucucagggaaaguucagaaaugcaucgggagauccuggggccagaggcaggggugccagcccugcagccccaccacuccccuuucccauccccagcugucucuucacgggccuggacuggaggucaagggcugccugaguccugcaaggcccaaggcaagcacggacugugccaggugcacugagugggggccuccagugggcgacgcagagcccagagcuuucccuggcagugauggccacggggccgccacguggcacagccucuccugagggcuugagcccccaccgggaggcacccucgcaggcgggcgcacagcccauggggccuuggcacuguggggagggugcacaggcaaguccggcucuggcgugucugcuccagagccucacucaccugcagcuccuggaggcuguggcuguuggcugcagugacuugauugcuuguuaauugcucauuaauuggguaauuagugcuuuguugugcuuugaagccuaaauacucauaaaaacugaauuugcugaguaagcaaauauagcauuuuucuucaggacccaccacccgguuaucuuguguaaccagguugcaagggugccuccaccucccaggacagcgagaggaaggugggccucaguguggcggggcccugaccggagggugagaguggccuccagggcuucugccacagauuccagagccuggauucaggauucagaacccacccagucacccccggucugugcccuggugggcucccaugcacucaguccucaguuuccccauccggcagcaggugggucuguggcgacuugcaagugagcccagugugagccgcauccccacacacugcccggcccccaccccucgggcuccauggcagcucuuuccaggcgccugcucuuccagucuccagagaagaaaggccuggggagcgggcggagagugucuaugcuaggaucagggucagagagggaggagcuggccgucaggugggccaggaagccucagucccaugccccggcccuccagcccgaugcccacccaguccugcccuccagcccgaugcccacccaguccugcccuccagccccauguccacccaguccugcccuccagccccauguccacccaguccagucucccagccccaugccccacccacccaguccugcccuccagcccgaugcccacccaguccugcccuccagccucaugcccacccaguccugcccuccagccccgugcccacccaguccugcccuccagcccgaugcccacccaguccugcccuccagcccgaugcccacccaguccugcccuccagccccgugcccgcccaguccugcccuccagccccaugccuaccuaguccugccguccagcccgaugcccacccaguccugccuuccagccccaugcccacccaguccagucucccagccccgugcccccacccacccaguccugcccuccagccccguguccccacccacccaguccugcccuccagcccccauccaccuagucguguccuucagccccaugcccacacagcccagucucccagccccgugccccacccacccaguccugcccuccagcccgaugcccacccaguccugcccuccagcccgaugcccacccaguccugcccuccagccccgugcccacccaguccugcccuccagccccgugcccacccaguccugcccuccagcccgaugcccacccaguccugcccuccagcccgaugcccacccaguccugcccuccagccccgugcccacccaguccugcccuccagccccgugcccacccaguccugcccuucagcccgaugcccacccaguccugcccuccagccccaugcccacccaguccagucucccagccccugcccccacccacccaguccugcccuccagccccguguccccacccacccaguccugcccuccagcccccauccaccuagucguguccuucagccccaugcccacacagcccagucucccagccccgugcccccacccacccaguccugcccccagcccucucucaguugaccccaggucccucccgccaggugccaccuccccucggccuugggccccauucccugugggccacccugagagugcgcccagcuggucccggccaccuacccacccuggcccgggccaccuacccacucuggucccuggcacaccuccaucuggccuggugcagcagcagagcccagccccacacugucuccugcacccaacccugccagaauggaggccagacauccccucucaguggacuccacacgcccccugacccgcccaccacacacugucacugccagccaucccgugggcuuccgagccaccugugguguguguggcgccugcucugggcucaacacaucagcaccuggaaccaggcuccagggcaagcccacugcucacugcaccugccucacccgggggggccccuccccgauggcaggaggacucccagccccacaccuauggccccacaagcccagauccccagauccccagauccccagcucugaguccugggcucagcuccaggcccuugcugaguagccauacagcugaagaaaguuauuucccucugaaccucugcuuccucaccuaugaaaugggcugauacugcugugacacuggggguacagccucccaccacaccccuaccccaaggcacgucaggugcaaauccacugugagccuggggggcagagccccacaccacaccccuaccccgaggcacgucaggugcaaauccacugugagccuggggggcacagccucccaccacaucccuaccccgaggcaugucaggugcaaauccacugugagccuggggggcacagccucccaccacaccccuaccccgaggcacgucaggugcaaauccacugucagccuggggggcacagccccacaccacaccccuacccugaggcacgucaggugcaaauccacucagugggccccacccauccauucuaugccaguaccguggauggccaaaggugccucacccucaagugccagauuugggcccugcagcuccagcacccacacccguaacccccugcccacgaggggccagcagccccgccagaggucaugcacccccccaccccggggacagcugcccagcugcguggggugagugcacaaguggcucccaccuggcggugcccccccaggcagcccaguucugcccaugcaggggaagggaaguggagccugggcuaagcccacaugguggaggggugcggauucacaggacugaggcggccgaaaggggcugagagugaccuuuccaaucgugagacauuucacacagugugaagcucaacucgaaaucuccccagcugcucucagcccugggggcugccggugccacgccagccccugucccuuauuucagccgaaucgcuugauuggaaugcauugcauaucccgcccgagcgugcggcccaaaugaaggugggccccuuggcacugccaucugggaagauggggucccacagggcagggcacggggcccacagccacucaugcuucugccccaucccuuccagagcugcuccccccaccaccccgaaccauccggguugcuggaguuucugggcugcagguucagacagaauaggugaagcagccaagcugccgucugccccacgagggcccagcacagguggcgcaggugguccuuuuccccacucggcggcacguggcucuguggcagguccugaggcacccacaugccacguacagacauugggacacguggcaggacacugagggcagaagccaccaagggcaggaugaccagauggcacagggaggggccaggaacuggcacacgcaggacgcgccacggcacaugugcacacggcagaugcuccucguauccccgggcaccugggugggcacgcgaggcucaacagggccccacggaggacacaugugcacacucaggccacacaugcucagccaggguggggcuuccgcaccgguguucccagcagcucggccucucacccgacacucaggcugggccuuuccacuccauccugcccacaccuugccacuguuagagguaccucggguuggugcaggcgcccguguuguugggguguuuuuucugcuggugaggaggggucagggcccccugccccagguaguucugcucaggaaccuucaugcagugccucagagcagaaacccggcccucacuggcccugccucagccccucucccacccacugggcccagacagcucuccuggaugggaagcuggggagguggaagcagaggcuggcaguguuuccagcacccuuccccaaugcugggccuagacccuccgcaggacagccccuuggccccucugucuccuaucuccuccccacccugccuggucggggccagacacugagggaccccugggagcagcaaccucagcgcagggucccugcuuaugaauuuuucaugccuuuguuugagcagugggaucaggcggccccugagcacaccgaagccauaauuaacacuugcacugggaaggggaggcauguguucuuugcugcuuaauagccgugcugcugauuugugucuccccauguguggggcugacaggcagccccaaccccaacccguagccgcccagggucuggaaggggugcagggaggccugggugaugggggccaagcccccuccaggcucuucggguagcaagggugcacugccuggcuguggggugggcucagaugccucugagggaugagggaagggggagggguugguggcagugguggugacagugacagugaagaugacacugauggcagcucccauuuaugaagccuggccgccagcggcugcuguccugagccugccacgcacguugccuccuccgacucagaagccccaugaaggugccacugucucugcagaugaggaaacaggcucggagaaacgaagagaccuuugccacgguguccaguguccacgaagcaguggggccaggaccugcccacgccgggcuccgugaagcaguggggccaggacccgcccccagacugaguuccagggugcacguuaacucugggcugugcccagcauucgacaccccagggcuggggcccagaagcugggggagguguugggaacccacagggagcugucagguggggaugcaguuuccuguucucagcaggaagcagccaucggugcucaugagaagucuccaggugcucaaauguuggcagccaauuuuaaaaaaauaaaucaggccagaccaagcccaugugccccccuacccagcuuguggcucuaaaagccaugucucaaggccguuguccacccacgggugagggucugggaaggccgcuaauggagccuggaggugcuaagcauccccaccgcauagccacaucugugaaaacagugacacgcaguggccccuggggugguuggggaagccacucucacggaggacgaaaccggugccugugcuuccgagccccacugcggcucucacacccagcccgggauggagguggggcagauagagcuucccagggccugggggagcugagcugcgggcuugggguggggagcccugacucacgccuggccucugacucgugccgcugaguggucuggaaccccugucgggugccucccucuggccaccccacaccuuaggcgugagggccggggcccugggcaggaggaaggaacagagcccagugguucaggggcagagccugcccccacggccaaucaccggaaucacccggcugcuacuccccaccccaggcacccggguuuaaguggucuaggggccccgagccucggugcggcuuaaaaccagacugacugagggcguggguggagacaacaaguacugagaaguggucacgagggccauuauuggauggugagguccgacagacucagaggggccuuguaggcuggcagaccaugguacagggagcugcugccuccuggcugccauuggagcucaggacaagcagagaaggagagacuugauaucggggucuccucguggcuacaggaaggcucaccuuuccagccuuggccaucagggucauagacaagcgugagcacugccagggcuaagagacucuaaaacucccagaccaggacuucaccuacgccaggguaaauggcaucuucucguucuuggcuuugugggcagacaaugauggugaugaugguggugaggaugagggugaggacgaugaccugaugguaacgacagugaugguggugaagauaacugaugguagugcuguugaggauggugacgugaggacggcgauacugaugaucaugguggugguaaugaggaugguguugguggugguggugugaggauggugacgauggugauggugaugguugugacaauggugauagugauuauggcggugauggcgauggugaggaugauggugaugguggcaauggcgaggaugauggugaaaaugguggugaggaugauggugacggugaugagggugauggugaugaggauggugaugguagugaugauacugucauguguauaauguacugacuauauaucaagcacugccuuagugcuuugcacauauucacuuauuuaagccacacaguaauccuaugagcuguaagggacaacccuguaaauuguuccuauuuacagaagcacaaacugagacacagagagcucagggccucgcccagcauggggccgugcggcacggagcucagggccucgcccaguguggggcagugcggcacagagcgggcgucuucuuuggagccugagucuuggccuccugaccaugcccagcaugucccuucggggccuggggucuguccucugcucccaggcauuccugccuaucacaaacccacaccagggugacguucccugagcccccgagcccagccccggcgccgugaauggucgccucacucgggcagcuuccgagagguggaugugucucuccuuuucuccucgcccugauuaauugccucauucaaugccgacuccacugcaguuaaacauuaauucaguaggacuuaauaacacgaauucauucacgccccugccugcgccuggcugacagugccgugcuauuugguuaaugagaggauccaugcagcguccucuggugcgcuugcuggaaagcaccccucagugucuccuugcuguuggaugcauuaaacccucgccuguguggucagccuggcuggguccagccacagaccugaaacccacggggagauccguaaccagguccgggcuugugggagcugcuggcucuggcccaugggucucggggccaacccaggcucaagcagggaucugggugcggggauaagagcagaggcuggacugggcagguggcccccaggccacgggugcacccauguggccccaagugucaggcugcucucgaggccugauuggccagaacccugacagucuggugggauugcaguuuccaagucaaaggcucugcagcgcaaauucagcagggagaggccucacuggggguccccagaaaucccacugugaggcuagaagggcaccugacuccccugcaggccucuggaugcugguggggcugccuccugucccaccuccagggcgcacucccucucggcccuccccaggcuccccaugugcagagggcauccuuggcacagucucggcuccugcuuugcccucuuccgguccccucagcccuggcguguucuggcauguuccuccccuccccugcgcuccccgcaggagcuuguggcuuuccccugccccacguccuggucuuugcuuccuuugcuccuggcugagccugggcaguuccauuucauacuuuccucaccaaacaccaaggcccgcccauaucacagcaggggagauggaggacucagaggcccagggccaccagcaaagcuggucugcaugucgggguccuguggcccagcccuuggugagcuccgcaccugcagccuccggggcgggaugggcccgguucugacuuggagcccucaguucuuguguggugggccgggcugggcgggugcaggugggacugaggcccuucucuaccucucacccugaaggccagaccgggggaacccuaggagagggcuuggccacggcugaaaggccagaccggggggacccuaggagagggcuuggccacggcugaaaggccagaccggggggacccuaggagagggcuuggccacggcugaaaggccagaccgggggggacccuaggagagggcuuggccacggcugaaaggccagaccaggggggaccagcacacagccgggacagacagccugggggagccugucagccucaggagaccccccccacaggcccaccccagcugcccagcuuccccaggggucccagcuggggucccacuuguaggagccaccuggagugugacucgucaugcgcugggagcagcacguucucgcugcagagugucugcuaaagcgcauuucacaccguacugugagcuccgucgcugaacacucggcagccgcggcugcacauggaggguggcugugcguuugguucccugcauuaacccagugggcuccacauaggagggcgccgcccacacauccggcuggcacucaccacccuccgugcacugggggguuuauucuuccaccaggucauucauucgacgugaaugccucauaauugcaguugccaggaggggauuuuuccccuuuugacuguuucgggggacauugcagucaguguguucuucguagagcucugcuuacugaaaacggagaacggacagucaguguguucuucguagggcucugcuuacugaaaacggagaacggacagucaguguguucuucguagggcucugcuuacugaaaacggagaacggacagucaguguguucuucguagggcucugcuuacugaaaacggagaacggacagucaguguguucuuuguagggcucugccuacugaaaacggagaacggauuuguuuucgggauuaucacacccccacccuaaccagccaagcugacaaauggcgcuggcaucgagugucuaacccugagcggccguggcccuccgugcgcugccagccccuccucugcccccggcuguccugaccccaggggcucccaggcucugcccaccaucaggagcuggggugccuggaucucccagcccauguggugccaucgauccccucagggggucacuggggacaguggggcuguccugggccggaggcugcccuccuuccuggugugaggaaggcucuggcuggcccaggaugggggucuucauggccgcccugcucugagggucuggccagugagggcuccucucgggcugcagggccagucuuguccccaucgcuggcuagucggccuggcugugccccuuuguccaucccacccggggggcugugauccaggucugucuggugcagcacugggcccuggcccagguuccuccuaaccgccccgaccaccugggccugcugguaccucccucuccuggcagcagccagggccgccccacccgugccccugcagccuggcugcugccgugccccggggggugacacugguugguggggccccgacucacuucugucucucugucccugcagugugacagcgagagcggcccggacgacaagguaagcccagcguccuccuccugggcucggcugacagcccugcccuucccugcugaccuuggcccugugaggugggcccuggagaccaggcagaagaucgggccuuggggggauccccccgcccggugggugcagggggcuuguggccucccagguaugggggugcuggccucuccuggcuguggaagagccuguccagggcuggggccgguaccgugucuggagggacacaggcccaggugggcaucagugcugccccagccaggagggugcccugggcagggcugccauggggucgagcacaucagcuccagcuccugggcagcagagggcagcugggccugugccccaggacuggccccaucaguccugagggagcaggggcagagcccagcccccacccuaaacccgguggaccccagaaccaggagguagaugcgcagccuaugaccacaucacagucacccucagugcucaggagcaagcaggauuccugcagccucagccaggagugaaccccccgggcagccccugagccacguccccucagccucggagcagccuccgggggggcucuccuucugccccgcuugccccagagcccugcggggaggaaccgucaccugcuguggccgaggagcaucaggccccggagggcgaggaggccaggcagguggcgugaggucccggcccguaaccacugcaccucacugucucccugugacugccaagggcuacccgggggcaccuggacgggggugagggcccugccagaugugccaggggaauggucaccccggccucagggacggcccugcagaggcccgaggcggacugcaugugugcgacgauucucgcccugagccagggagacgcugcccuggguuuccaggcagguuuuuaugaauggaacaguuccaugaggggucugcacagggguuaggggacgcccacuguggcccguggccuggcaggagcugucugggcuguggggucucacagcugagggcccgguggggguccagauauuggagucaguggcgguggccgggggaggagggucugggcgguucaguuuucgacguaccaagaagucaagguaagucgccguggaagccagaggccgcaccgucgccgcggccuggggucuggggcaggcgccgugugggccgcagugccgggcucagccgugucuggggcuccagcauccugggcugcuuccagccacgaugucccugcccaacacaccucuccucgcccguccgcagauggacacuguuggggacgcguccugguggucacaaagcccauaggaguggccucacccgggaccccgcguggcuccgcguggcccucagccccugcccacagcuuccgcgcccgaaccgugacgggccuaacauuucagaugaguaaccuuguccugaucucaggaaugaaaugaggucacgggcacccaggaaauagccacucacccccuccccaccuccuuucauuuaaaagcaguuuuuggggaagacacccuccacaaccaaggguugcucugagagaggcaggaaggaggggauuucgggagccuggggccuacugggggcucccucuccccuccccgccugccuuaccgagaugaggcaaagccaccuguggccccggaggccagguccacguggagucggcgaugccggcggggaaggcugacagccgcccccauaacugcacgccccccauguccagcaaccaaggguaacgccagccuccgagacccaaacgaugucugugcaggcugugccugcagagaugcggccccugcccgggccugggcuggaggccgagggguccaugggagagcacaggcugaaagaggguucuagaauggggucagguggagucugcacacuggggcguuuauuucugagacgcccaagcagccccaggggagaugaccagcucugggcggugucggggaggcugaguccaguccagggcucugcacacggagggucccggcagggcgaguuuggcauuccugcacacggagggucccggcagggagaguuuggcauuccugcacacagagggucccggcagggcgaguuuggcauuccgugccguuggggccguguuggggcuucuagggcugugguggccacagguccugaggaggacagcaggggagggagaggggcugcggaggacggcaggggagcggagaggggcugccagccuuucuccagggcagaacuucgggucacgcccacucuggggagagcagagaggccuggcggggcggggacggagaaggcagcuccgccaaacacugaguccccgugaugguggcuccuucuggcugcggcaaggucugagcgccggcgcacaaagcgggggcacggugcuggcagagugggugggaccugccuguggccccguuugcuucuguuggggggcagcucccggaggcugcucggggagagcagcagggugggccaggaaaacugcaggggccucuccuuguuggcccgucagccuguccgucugugugaccuuggggcaugcucugaggggugugucccaggcugacucaagacagcuaagccagagguggggacgacccuggugcguucugggagccggcagugcauccugggcugcagcggagcgagagagaggagcccagagccggcagcaggaguuuccguuucccuccgagugcaugggaugcugcaccguaggacucccccguccagacgucuccguuuccccauggcauccagccccugaugcucagaaauuagcuuccugaguuugggagaguugggagggcaggaggccucaggucccuccuggucuucucugcccggcgcuggguucagggggucaggaacuuacgcugggcggagggugugcguggagcccauccagacgcacacagaggcguaggcaggugugggaagucagccagcaccccacuggccguccccagcccuccucccuacccgcugggagcagaggcacccagaucucugucccugggcacugcugugcgaggccggcaccccugccagggagcaggcaggagggacagagcccugcaggcuccagauggcagaauucccggcucugagacaggaacaugggggugcuucgcaucagcagugcccagagccccucagcagccccgggcuuguguggaacccgucugugaacuggauauggaaggaagguccccgagugcccacauuuacagggacccucagagaccucacucagaccugggaggcccauugcucacauggccuggcugcucccggugggcagaagauggagaagccacagacagcguccugcguggggucugugggcgcugacccagcagccgugcagggaacagcccugcccgcagaagcggaugccggggcagguggcagugcaccccgaggaagccuucuggacggagugguggggagggcgcgggcgcaugucucaggccagugcacuucacaucucaucccacaccugcggguuugagcuugguuuggggugccagcucccaccuggccagccaccccuuggggacucacccugggcucuccugccaaucaagguggagacuuugggacagcccuccuccacgugaacagacugaccgagacaccucuccaccaccucccucacacugugcccgcccagccgcccccuccccuggcccuuggcaggaggcuccuuggcagcugacgggaggcucgggcacugccagauggccccuucgcaagucuucgguuugugucuaaccacuuuuuccuuggaaaaguguggggugaagagcgauaugggacuccauaggcagccgccagguggugguggccucgcuccuccugcugccgggggcugccacggccaccuccagggauggcugucuggcccgucuguggaagcccaucaggaagcacccccagugccgggccucagccaagagcaccggccuggaaggggcagggcugggggacaguggcaugaggucagacauggcguggggccgaccccgcaggcagcccaccauccacagccuccauguucugucugcaaaauggggccacaguggggccugggcagaggagagaacugcccacugccccaagcacgguccccagagagcuggaggccagccaguccuccacacccagccccuccccagcagacccuucuuccaguggggcgcugugcccgacuggguccucucugaaccucugccuuuucgucacugaaguucguagguucuuguucuugggaacugugaguucaggcacuaccagcacgacagccagagggacggacggacggcuggacaggcuggaggccccugccaugggcacucaccccgugggacagacagaaggauggauggacgguuggacaggcuggaggccccugccuuggggcacucaccccgcaggauggacagaagggcggauggauggcuggacaggcuggaggccccugcuauggggcacucaccccacgggacagacaaaggauggauggacagcuggacaggcuggaggccccugccaugggcacucaccccgcgggacagacagaaggacggauggacggcuggacaggcuggaggccccuuccauggggcacucaccccgugcgacagacagaaggacggauggacggcuggacgggccggaggccccugccguggacacucaccccgcaggacagacagaaggacggauggacggcuggacaggcuggaggccccugccguggacacucaccccgcaggacagacagaaggacggauggacggcuggacaggcuggaggccccugccgugggcgcucaccccgcaguugcugggccuccgugggguccugggaaauuucaacagcaguccagugugcgggccgcgccuuuguucuguccagccagcggcccaggcugcgccuuuguuguaucuggccgccggcaggccaggcaccuucugaggaaggguugcugcgugucuguggcucacggaggccuuccucugugugugacucacaccccccacccaccccagcccacuucugggagcaucuuccugggggcuuuggaggcccauccauucuucccuagggacaaaagugcagggagcggcgucccaggugccaccgucucuggggaacgugggccaggacucccuuugcuggacacagacccugcccacaccgggugaccguggggugaccucacagggugugugggguuccgaagccgccacccuccuuccugagccugcacuuugaccugggacugcugagcccagaagggccuugagagggcuggcucaguggcacgugggggccuugggugguuggguccccgagacaggccaucucgcuccuuguguggcaggcugcggggcccugcuugccugggucccacgugguagaacucggcguuuggugggggccugcuggggacaggaagggacagcaccccacccugagcuggcacucaugcuucacuggagccaggcggaggggccgagggcaccggcacaaggugcagacgugucggucccuuugaggaccgagaucaugaccaccacggagcaagcgcccggguccucagaucaaaggcccaauagccagugaggcuucucugcacuggucccagcagaagcggggccuggcugaggcaguggcaucagagacucggggcaaugggagugcgaggggggucucagcgucccacagcugcuguaacaagucgccguaaacacagucacucaaaacggcacgagcugauggcagcaguggagcuggagguccaggaugggucucaccaggcugaagucaagguaccgaccucaggggaauugguguccugccuuucccagccucagaggccccacuuggcuguaccugggcagcugcuccgcuccacgggccuagccucgcucacagggcuccaagaacagagccuggaucguccugagggccccgugauguccccgucacagcaaaggaagauuuaggaugcacuggaagcccagaaguccagagaaggggcucagagccaucggucgccacggggcaccucgggggucccacgaacacugcagcgggcgucagacccucaagcgucgguaagggccucaccgccuugggaggggucagcaguuaccggaggacucugggcaguggcagggagcagcaacaagggccccccauucaggcccucacccccggcacuuggaggaggugccgccccugccucggaagccucgagggcaaccugcacccucaggaggcccagcugggggcgucacugcagggcaccggcagaaacuggggucugaaaacagcagcccagaguggauuuggaacagaacagggugucacagaaaggauguuucaugagguggguuuugaugaguauguuuaaauaaauguaacuuaauugauguuaaauaugcaucuuaaugcuuuucuaaaaugugcaauugggccaguugcggugacucaugccuguaaucccagcacuuugggaggcugaggcgggcagaucacuugaggucaggaguucaagaccagccuggccaacacagcaaaaccccgucucuacuaaaaauauaaaaauuagcugggcgugguggcaggcgccuuuaaucccagcacuuuaggaggccaagcggguggaucaccugaggucaggaguucaagaccagccuggccaacguggcaaaaccccgucucuacaaaaaauacaaaauuagcuggcugugguggugugcgccuauaaucccagcuacucaagaggcugaggagggauggucaccugaaccccggagguggaggcugcagugagcugagaucgcgccauugcacuccagccugggcgacaaagugagacucugucuccaaaaaacaaaaaaaaugugcgguuggaacuauaucucgaaaucggaaaccagacauucugaagacaagcuuguguggccuuuggcgccauccugcccccugcugggggcgaccuccaccgcagacgaccuucugagcccugguuuccuugccuguaaaauggaguagcgccugccaaggacggcuguggggauggcugaauucaaugcauuugggggagguacguguuuccugugauuuaauauuucacgaacguuaaaccugugcugggcacagcucucccucgggugggaguguagcugugguguaucucuggaggggggucacggcuuucucuggcaggcagcauggggcccuggugucccguggccuccacgguagccgccccacccgagcgugagcguggccuccacgguagccgccccacccgagcgugagcguggccuccacgguagccgccccacccgagcgugagcauggccuccacgguagcugcgccaccggagcgugagcguggccuccacgguagccgccccacccgagcgugagcguggccuccacgguagccgccccacccgagcgugagcgugggggccacgguagccgccucacccgagcgugagcgugggggccacacccacaagucuggcaucaugguguuggguucaugcucccuccagaggccccagaggaggauccuuccugccucuucccacuccugcugacuccggcaucccuggcuggugguugcauugcuccuaucucugccccuguccguccucacauggccccuccugugugugugucuuugugucucuucuccucaaaaugacgccaguccucggauuuagguccaccuggauaaccugggagggccccaucugagggucaggaugggugugggcuuggggccugcaggcggccccaccuuucuccccgcaggcacucgugccuguguaccagccuucagggccgguuguggccucgggguuccaggaggcgcugccauccagggccucgggcacagcaucccugggcucuucccccagccccugggguccucucuucucagaggcuuucccuggguuucuguguuuccgcgaaguuccggugccuucugcacuuucccugggagcugaaauucgcuaggauuugcauuuccaggccggcagccuccagggaugcugagcagcaucugaacaucccuauaggugguucuggcuuuugcuuuucucccgacauuccggguggagauggugaacacacgcuucuccgggcucccccugaugcugcccucaggccuugggggucuggccuaccccucaccuaugcaccacagccuugcucagagagugcacaccucugcgacagacagaaccucagagucguuccauggcaaagccacacugccagcguggcuguggccuacacaggccgggcaacagcaggcgcaggcccuaccccccacgccacgacucaaggcccaagccugcugggugcgucugaguguucguccugugggacgcuccucuccaggccuucgugcugcaccccaaccccuguccugugggacgcuccucuccaggccuucgugcugcaccccccuccacccaccccuguccugugggacgcuccucuccaggccuuccugcugcccccgccacccaccccccuccugugggacgcuccucuccaggccuucaugcugccuccaaccccuguccugugggacgcuccucuccaggccuucaugcugccuccaaccccuguccugugggacgcucuucuucaggccuucgugcugcaccccaaccccuguccugugggacgcuccucuccaggccuucgugcugcaccccccuccacccaccccuguccugugggacgcucuucuucaggcccuugugcugccccccaaacccccgucccgugggagguuccucuccaggcgugagaggacacggcccaauucaaggacacgugccccgcggaguggcagccuugaggaagcagucuuguggucuccuggccccagcgcucggcuaaccauggccgaauggagguugggugccccccagggugguuuccagggcgauccgguguccugggguggcuggggcagcauggcugagaggacccugugugcucugcacuccugguuaaugguuggggccuccagcaccuucccaugccuucccaugauggcacccccuggccacccgcugcguaacgauggcagacgcaguuacaguguugguuucugaaccguaagcucuggauaaaugugccucugaacaccaccgucaagucccuaacuggauuauguauauuuggccuggaagccugauacuuaauaucagccugcucuccggugaaugccuuucuucccccggauaaucuauucccacuccgcuuccuucuagacuucuaaccucacuacaucuuucauaucagagcuacucuccuuucuaaacaaaacacagaccugccccugguucugagucuaguuucacccccaaacuggggcgcagggcuguggggcggggcucggggcucggggcuggguuuucggccccguugacccaggccaggaucucugccuguuccaggauggucagugcugaaggcggccucaggacugagguuagaaagugggguuggaagccucguuuguggcaggaagauggcuucuccugugauuccaguggugaggucccaagagaggagccggccacauugagacuggccguagcccaauuggagcuggccaguugcugccccucaauuccuucuuccugcucccccaacuccccagcccccuggggucuccagucagcagggagagugggcacagcuuggcgggaccgaggccugcugggcagccgcuucccgugcccuguacccagagaaggagcugauggcagcacagcuucucagggggcugaggaugcacuggauccaucugugccgaguccccagagcagggccuggaagaggggacuggggauggcauccucccagggccaggcacgcaggaaggggcugagcuaggguucugccugagucugucuucucuccuccccuccccccgcccguucccucucugugggccucaccaucuggaccccccauggacagaaaugaccucgucacagggccccuucacggccuuuguccucacggccccuccuggcuggcuuugcccaggccagcacccugggccugaccuuaacccugacuuaucccugagggcuccacgcauuucaaauggagcggccccauccccaucucaggaguggcccaccaccuucccaggggagugucccugcugagccaugagcccugcggccagccugccggcucagcccagcccagcucugccacagagcagccacgccagcagcacgucuguuuucucgucggugagacgagugguggcuuauccaaguccucagaguacaggcuucagggcccuguggcuugcggcaugcagugcgcccggaagugccuauguggacacagugugugugcauggacgcaagcgcgugccguuuucauggcaggaaacagcagggcuuugggggcgacuuguugguaaagggaguacguguauuugguaaguaguucaaauagaaccugagggcuggaacucccuggcugaggccgaccuuggugauuccuucuauaccguuggaggcauccugcgaacguuggcgccuuugggagcagaaagugcugguccagcuugcagagggcuccaucgaacccgugugggagcugcucccgcgguuugaauggcugcgggcuccgccauggauaggcccugcccggggccaggccuuccaagcccagaaauagaaacguggccacagcucccaccucagucccgaaacuggagcccaagcccucugucccuggccgcaccagagccggccucccugugugcugccagccacgcagcagcuuggagaggacccguccuuaaacacuucccgacugccggguccagagcugcgcccucccucccuuacucaucgcguuugaguucgcaguugguguccugguuuuccaccugagugggcgcugggauggaagggucccgcccaggcgucuggugcggucaggcgcacauaagcagccuuugcaggaagccguggcugggccucgauccgaguucuagcgccccaccguaagggagagccaggugcuuccugucccucccggccaccucaaguguaaaaucacgggguucagggcgguggucuugggggcugcgcugcacagccguuugcagcuacagcagcugcucggagcugucuccgacuuugcacccccguuucacagagggagaaaccgaggcccagggagggcggggcuugcagcggacgggugggggaagggcuccuccuuucaggucccaacucuccacaguggcaaugaggucgcucuuuuuuccuuuuuuugagaccuugucucgcucugucaccuacgcugaagugcaguggugcaaucucggcucacugcagccuccaccucccgggcucaguugauccucccaccucagccuccccaguagcuggggccacaggcgcgugccgccaccuccggcuaauuuuuuuauuucguagagacgggcggggguggggggucuuccuauguuggccaggcuggucucgaacuccugggcucaagugauccgcccaccucggccucccaaagugcuguuucaggcgccggccaccgcgcccggcugucgcccuuucugacucaguuuccccuucugggagcgggguggcagguguccguaacuucuuguugugaggaccagaggagcagcgcccacacagcgcucagugaggccggcgcugcgcgccuuuccccggguggccgugaucggaggcagcgcguucggaccccgggccggcggcgggcgcggguggaucggcgccucggggcuggauuagucgggucugcccgcgccccgcccccgccccgcccgcgcucccgccucccgcgcgcccagcuccgcgcccgccgccucggggcccgcgccgcgcccgacguccgcccgggagcccagagcgcaccgagcgccgcccagagcgcgcagagccggcgcggcggacaugcgcguccccggcccgagcuccggcugagcagggcacgcggggagaggggucgccuggacgggccagggccacccggggcucgcgcuccacgcccgcguccaugcagcccggcuccggccccgggacuaggggcgacugccuggggcgccggcgaggugagugcgcgcugcggacuccagagagggaauugggacuuuggggggacaggggagggggagcgaccgcccccccagaagagcgggacgcccgagaucuccgggccuucugcccacaccgccucucccggagccaagcgcggagaccgcguccucccgggggcgcacguggcggcgggcgggcgggggugcggcgcggccgagggucccaggcccgggucagggcacccgggguccggggguggaggcggggccgagcguuguggguggcgcgcgccuuugucugcgcccaggugcggaaucggccacccggguucccggcgccgcgcucaccugccccgaguuggaguucuuugucuggggcggggcgcggcuggcccaggcugcgccgcgugucuggccgaggcugcuccgcgggucggguccucgcagacaaagcgcgcccugaccuccgcccgccgccgggauugugcaccucgcgggggcugaggcuugcccgggcgcccccgcugccucuucgcagggacccugagccugcggacccggaguccucccaccuguacccugggcuugagugauccucuaccccacgcgggcuaggaggcagaggcggcugcucgugccugggucacgucccugcagaccauggccgagaaguuaagcgggucugguggccccuggggcugccaccccauuugggucaucuggccacugccagaagcccuguccuagaagggaaagagcugagggaccgcguggaggaacgagccccagaaggugcagcugcuguguguggucuaggaagggguuggagccugggccaggcccccagagggccggccccuguucugcucucagcccucccggaugggcguggcugcaccuggccagguguucagguucucacugugagguggaggccaccugccuccggggccucugcuagggccgaggaccccuggagcacccauucucagccucccugagcaaacucgucugcuaaguguagggcccacuguggcgugaccagaaugggugcuggauggccccagccgcgcggcccgugcggaagacccuccccuuccuugcagcccucuuggcuucgcuggugucuggggcgcccccuuguggcccuggggagcuuguguucgaaccugggacguggagcggaacccacuagaguguuugggucccagugaaggggagggcagcagagccccagaagggcuccaaccugugguuacccuagagacgagggccggcuuugggggcugugcuuuggggucugccuuuuggguuggccgucaaacugcgggcuaagcuggcuucuccucccucugcccaccugggaggccucagcacccgccuccuuccuggccccuggagaguccuggcggcgugguggggccugcugccccaaccacagagggggcaguuaacaggugggccaccuggcgaagaggccacucaaacccgggacgccagccaagaagagggcccgcgugcgugccagagacagugcagccccucagaugagggguccagaaguccucccaggaggauggugcaggcccaggagagaccccaggggucuguggcaggccuggguguucagugccugguucauggcuggcauggagcagcacuggauccccauccuugcugugugaggggcccagauuugggagccuggcccaagggagcacuuggugcuggcacugcugggggaugggcacggccaaggaggugccgaggccuuucuggggagccgcagugcccccuggaggcccaaaggcuggucuggacuccucccugcccaccugcacaggccccuucacuauuccuccuguuucucucggaguccuuccuguuuccgaugcugggauggucacugcguagccugggucaccggcaguggcuggacggggcagggagguggaggcggaccccaugggagccacacuucugggggaugauguugaggcgagcagagaggagaaagccacaugccccaaccuccaggcccccuggcuucccaggggugagagguuccuguccuucuuucuuuguaacaagccaggauucuaggggugguggccgcaaggcugggggagggagagggucaucggggcccuggacuggggcugggagggucccuuucuggggugccggggucuccuagcuuccauccgacccggccccugugugguugagcugggucugagcagaaacaaccuccucagaaggauguccuacgucacugccuggggguugguggcugggggcgcuggacauagaguugguguuucacccugcagaagccugggcugcaggaccccgaccccggggaccgcacagggugagcagaccaaguagcgucagugccaggagcucagcaucccuucccaccagcugcaccgcagcccuuuaacacacgaacgugcggggcccaaccgcugcuccuuuccgaggggcccaccuuccuccagugcaggggcccuuccggcgcguguggguguggcaggcccgccucggcucuugccaucuuacaggcauggaccugcugcucuucucugugguucaggcccuugcgacgugacuaggaagggcuucccauuccagcaagaagguggaauccacaccuggucuucucugauacguugaugguuuuucacuucuauguuugcgaucugucuggaauuauuuucagauaagaggugaaacaggagcuugcucugaaggaccuacgccacaccuggcccccacagccugcaccccacaccuggcccccacagccugcaccccacgccuggcccccacagccugcaccccacgccuggcccccacagccugcaccccacgccuggcccccacagccugcaccccacgccuggcccccacagccugcaccccacgccuggcccccacagccugcaccccacgccuggcccccacagccugcaccccacgccuggcccccacagccugcaccccacgccuggcccccacagccugcaccccacgccuggcccccacagccugcaucccaugucuggcccccacgucuggccccccagcccguaccccaugccuggcccccacagccugcaccucacaucuggccccccagcccguaccccacgccuggcccccacagccugcaccccacaucugguccccacagccugcaccccacaccuggcccccacagccugcaccaugucugggguuucucauucgguucuguggaucucuguccgucgcggcaucugugggaacucuggggcuucucauugcgcucuuggaucuccuuccgucuguccguuugccuguccgucugucccagcaucgugucacaucuuuuuguugguuuccaaugcugucauuuacuggcaguaaaauucaccuauuuauuuuugcaguaaaugcagcuauuuuaagugugugguuugcuuuuugacacauaccuacgacuguauacccacccccgucgccccugaacccccgagcuccugugcacccccugcaccccuccggcugacacauaccuacgacuguacacucacccccgucgccccugaacccccgagcuugugugcacccccugcaccccuccggcugacacauaccuacgacuguacacucacucccgucgccccugaacccccgagcaccugugcacccccugcaccccuccagcugacacauaccuacgucuguacacccacccccgucgccccgaaccccugagcuccugugcacccccugcaccccucggcugcuguggcuggggccgcgcucacggucacacggcugcgugcucuuuguggucuggcuuuggcuccugugauguuucugaggcucacagagcgcgugccgacagcaauuccauauguggcugaggcagacgcgcucacuguugauccgucugccaguugcuggacacgggugucccucugggcagcugggccuggcuucaccccagccccacaccaggccccgguggacccugagccgccucccuucugcccugaacagcagcccagcucccuuggcugggccacgugggauucaggggaagcagcucccacagugaggaccuaguaauccacguguuccagaucccugcuugggauuuugguuggggugauaggaaacgugugcuguggcauggggacagcaggucucuucccagcaccagugccccucugggcuggcuacgccuggugagccuccuggcucugggagggccccugcccucgcccuccaagguuuuuuuuuuugagacggagucucgcucugucgcccaggcuggaguccagugguacgaucucagcucacugcaagcuccgccucccggguucacgccauucuccugccucagccucccgaguagcugggacuacaggcgcccgccaccacgcccggcuaauuuuuuguauuuuuaguagagacgggguuucaccguguuagccaggauggucucgaucuccugaccucgugauccgcccuccucggccucccgaguagcugggacuacaggcgcccgccaccacgcccggcuaauuuuuuguauuuuuaguagagacgggguuucaccguguuggccaggauggucucgaucugcugaccucgugauccgccggccucggccucccgcagugcugggauuucaggcgugagccgcggccggccgcccuccuagguuuuaguagguuggagagcugugggucucgcacgcuucaccagccaaauuccuaagucccuuuuuaucguuuuaacccuaagagucacaggucguguuacagaucagggggacagacaagcacagaacccccaucucccagcacccagccuccgagucagaugccccccgcccuggucucucacagcugugcucacuaggcaagccuggccggccccucccugguagcagugaagcuguugauuauguuugucguuguugcauuucaguuacacaaguguuaccagaaugcagucuccuuuauacaaacuuaaaaguaugaguuuaagccuagucucuugugcccuccacccccgccauucccagaggggacugcucucuccugguggacacauucuacaauuucaccaacauagacgccgacacgcgggcaccuacguaaacacacaugugaugcucauguaaacaaacauccaugcacacacugccacccagguacacacacccgagaaugugugugucccuguacgugaacccgagugugcccacguacacguacccaacuguccucauguacacguacccgagugugcucauguacacguacccgagugugcccauguucauguauccguguguguacguacccgaguguguguaugugccuguguguacguacuugaguuugugcccauguacguguacccgaguguguguacgugccugaguguguguacgugcccaagcacaggcacauuguccagauccacauaacacuccuucuuugcaguugcuuccuccacacacagagugucccccaucucuccaggguacacacugcagugugggugaacgucaaaagccgugcagugagagaagccaaucacaguagguccgugccgccugacaguguucacauggaaguucggaaaagacggcucuguagagacagacagauuugugguuucccaggguugggggugacgguuaggagucaggguuucuuuuuggggugaugauaauguucuguaauggaucguggugacaggugcaucacugugaacauacuaaacgcuagugaauuguaagcguuagacggugaguuggaugguaugugauuuacaucucaagucuuaguccgugcgggcugcucuggcccaguucugcagcagacauucacagcucacagugcuggaggccgcaagcaggucaaggcauggcagagucccugugagggcuuccugguccauagagggugccucuccgcugcguccucacaugguggaaggggcuagguggcucuggggcccuuuauaaggcacugaugccgcucgugaggcuccacacucaagaccucaugaccucaucaccuuccaccuccugaucccaucaccugggggugaggauuuaaacaugugaauucuugauagacagaaacguugaauccacaacucaaugaagcuguuuaaucaaaaaaaaaaaaaaaagaagaagaagaaacuaggagggaaauaucuauuuaaggucauucuuaugaagcucauuccuggaaacugccgugaagucccccagagcauggggcccuccguccaccccuccccaucagcggccacauucucgccaccugcuuguggcaggugguugagcgaguuucucuggaagagauggaggaguggggcugagcaauuucugcgauugacccucugagagcucccccacauagccugggacacucagcugccucucagcaacacugggcaccaggccuagagcuuggccggccugggagcauagcgcagcauucuguggcugcugggagcuuggccggccgcaggcacauagcgcgguguccugugggcucugggcaccaggccuagagcuuggccaguccccagcacauaaugcaguguccugugggugcugggagcucggccgaccccaggcacauagcgcgguguccugugggcgcugggcaccaggccuggagcucagccggcccgggagcauagcgaggugcccugcagccuugcggacccacauguccagccuggucgguauccugguucucucacuuucgccagggcgccugugcugggcagugguugggagcaggaggugugucccggggcucuccaucauccgccucuggccugaugggugggggcccagcagggcccacagcuacuggugcugguucuccugggaggggugcagauuugccaaaugccggcgcucccccaguccacgccagcagcagccuugguucccgauccccccacaaaccccgucuucacucagacccccucuaggaagccugcugcucugagcagagaggggccugugugcccccagcgugagcacauguauacacaugcguggagcucaggacuaagcguguucaccucguacacgggggcauccacaagggcacaucccgccuggcccugcuggaaaaccacccagacuugugugugggcauugggcgcaagguccacgaggaugaggaccacccugacugccccugaccccccuucucucucuccaggcauccgugggcucugagaagcucuuugcgccgggaaccgauaaagguaaguggguccccucggcccagcuccugggccucugaagagacacaaugcgcccugcgucuuggcggcaggacaucccccugaagucaggggagagauggucuuggcaccuggggugcagagcugggugggaccagggugcugggauugcugggaagcccccaggagcaggggagaguagacgaagccacugagcccuaggcagggccugggcuccgcucguagcagcggcucccagaguggaaccguuaggaaugugugcucucaggcccuccccagguucguggggucagaugcucgguacugaagggccaccugccacgagcaccacaaucaccuguggcugcugaguuaaagagaaacgggacugagacucacuucccuggcucugcugccugcgcgccucuguggugcaguggaggggccuggauugcuguuccaggccaggccuucgaaaccuguggcugugagcuaugggacagggugucuacaggccagcaacccucuccagaggggguagccccggcgucuuaggggccuucguaaccuguggcugugagcuguggggcgggguguccacgggccagcaacccucuccagaggggauagccccagcgucuucuuagggccucccuggcgcugggauccugggauucccacaccaaggccuaggcgggcagcaucuccggcagggccacggggucucggcuccugccucccuggguuuccagcuggaaccacccuuuugcugggacggcuucauccggaugugauuggacaggacaggcccugccaaugccggcaaggaugggcccuacugcccuucagcaggcauggccuucaccugccuucaaguuggaagccuguucacaucagagcaucacagcaaagcaggcgcagaugggguggugucagaaggggcgugcaugggacgggccccgguaggagaggcagcuggcuucgcagacggugucacgcggggcugcugaauacucagcucacugccgcggcugcugccgcaucuggacggacaaugucccagugagggcuggaggugcuagaagggcacaggaggccccgcacguggggucuaguccaggucugugcggcccaagccucuuuccauccugaucacagcucuuacuauaugcaaggcuggcuuggagaugugggagagaggaggagaggucccguggggcugacccagggagcugggaaagccgguggagauagugcccgugggcucccucucuccuguguccuccgcgcagccucucuguggucgcugggugguggcugcuguggaaggccuggccccaggugaagagugaagauggggcugcuuccugcugccuguuuucaccugggaggaacuccuugaggccccagaagaccaggccccauggucacauggggcagggacggccgcagcuguccccaugggccauggcucacugucccaaggccucaggaaggaagcagggucugccggggacgugaacaggaggcaugcggcacguggaacguuguuuuguuucuccugcgaaacuggcccccugaccguggcagcuccugaccccaggcaacaggagcuccaccacauggacgcugcccucuccugacuccuggggacuugaucugagaccugcccgaaggggccugaaaaggaggguuuggggugugcggggguggggggggcaggccccaggggcucagaggggcccacaggaccugcgggggacgugccuaggugggcagaaggguggccagggagcagggcugaggguggcgggugacgggcagucacaguagggggaagccucccacccagucccugcccaaguuuccaggaaguggucaagccuuccaccaggggguuccagaaagaaaaggugguuacagcugugggcgcugcuguugggguggggcagacccaugcccugggcugagggcacauccaggggccgugaacaugaggccuagguacacaggcccuagcucccguguucaaauccagcuccccucuugggccaaguccuugauguaucuugguuuugucuguuaaaugaggucauagcagccccuguccagggacugacucuugcagggccuguccugucccugccagugaugcgucuucgggcaggugggcuacccacccccaccccuggccacggcccaggcucccaagccagcucccuccgccgggcggggccuggagccucgggugagauccagcuagcuguguggccuccgugccugccuccucaucugaaaugggggcauagccggagcccagacauagccugggcaccgggcacguaccagggcucccugggccacaggaggggcagggacgaggcccugcuggucugaacgcagccacccucucucugcaggcccagcgcuugagaagucggaggccaaggccgggccggugcccaaggugucaggccuggagcgcagccgcgagcucagcgccgagagcuuccugcccacugccagccccgcgccccaugccgcgcccugcccggggcccccgcccggcucccgcgccaaucccuuggugaagaaggaaccccccgccccgcaccgccacaccccgcagccgccacccccgcagccccgcggccugcucccgacacacgugccugcaucccugggcgccuucgcgggccacagccaggcggcagccaacggccugcacggccucaggugggguccccgcgggggacggggccuguguggucucaggaugggggcucugcaggggucgggcuggcaggcacugagccccgugucccgcagcaggagcagcagcgccccccugggccuggggaagcacgugucgcugucgccacacgggccgggcccccaccugucuaccucacaccuggcgcuccggucccaggcgcagcaccagcuccacgcggccauguuugccgcacccccgacacugcccccgcccccggcgcugccggccagcagccugguccucccaggacacccggccgguaggugucucggccacaaucucgcccagggcagggguuggggggugcggggacacggccaccggggaggggcgcacagccuggcccuccaccugcuguggucucugcggacccugcgcgccucucugagugguucccccaggugugccuuuccccaggagucucugcugggccacaggccaucugugugcggggacaggcaggacacgugcccaugcacguacagacgcguguucacacugagacgggcgcacgggccuccccuccuggggccaggccucccccgcagccugcuggguccugagcccugggaggagggggccgcacaucaagcaggcgccaucccaguggaaccccgaccgcgaaggcuuccucccucggcccccaggcgcuuccugaggcuccgagucagcccggcccaggcuggggacggccccgugucccgggaugggaccaggaugcuggccugcggguggcuggacccuggcucccggggaggggcucaccguguucucucuugccucuagaugccagccuggcggucucauucagccagccaaucauguauugccagccucauucgggaauucugauugguacuuggucacaggcuccucucuuaccugcaccccugggcccgcacguggcgagcggccaccccggcuuggccugccgaccccgggagugccaggugacuauccgccucgccccgccgggagcccgcggccaacgugccucucugucucucucucuuuuucucuuguagaucacgagcugcucaggcaagagcugaacacgcgguuucuggugcagagcgccgagcggccuggcgccucccugggcccgggggcucugcugcgggcggaguuccaucagcaccagcacacacaccagcacacgcaccaacacacacaccagcaccaacacacauucgcccccuuccccgcagggcugcccccgacgccgcccgccgcacccccgccggugcguaggcccgcgugcuggcagggggcgggggcgggcguggggcggggacacgcagcaggcacacacagacacacgcucgcacacacaccagcccaggaggagguggggggccggcggcaccucucugucgucuguccgguccccaacgugccuucugguguccccaccccaagcugugccaugaggcccccacccucggcagugguccuggacuuaggcaggcaccccgugcccacgugcaugggacacccucacgccugcacuagauccccagugccagggcuggaggcccagacaggccugagggcacagggaccaugacucagggugccucccguguuccccgccccggaggcccggucugaggagggaguugcugggggcuggaguccccuccacucucucgaguuuuauucggaaacuggccaguuugucaguaacccgguguguccccagcgcgacccagcagccagggcuucacgccccaggccucagccaggcacacagacugccugggggggccgaguucccaccccaugcaaggggacccuuagaauggcagggccgcccuggucugagacugaguucagagccguggggcuggcgcucuagaggagccugggacggcuggccgaagccgccagccucaggaagcacaacgccguccugucacugcccagcccggccaggugggcggggcccggggcccagcaacggugucgugugugcggggccucacccuccucuccuucccuuccaguuugacaaguaugcgcccaagcuggacagccccuacuuccgacauuccagcgugagugugaguguccccgaggggcccggcgcgugucgcugugcacgcagguccuggccacggggcgguggguggggcugccccucgccuggccucgccccugcugcauuggugccaccuucugguuacaggcagaggguggggugaggacuugggcccccccuccauccgcucuccuucucuuacaguucuucccguccuucccuccugccaucccgggacugcccacccugcucccacaccccggccccuucgggucccugcagggcgcuuuucagccuaagguaccgcugccccuggcagguggggcgggcacagcggguggguggauuuuggggggagugcaugacaaccucgccaaacucucugcccacaaccaccccccuuucccucccuuguaccugucgucaucugggugcuggcgugagcagccccugccaggauggggggcccugcggucuguguguggccaccgugggagggacaggggguccagccugggagcagcccugggagguggugggaccguguggagagcacacuguggaagccucgaaggagaacauuccaguccuuggcaggaggcccugguguggacagcagccucacaggccguccuuaccgcaaggagguucuuacggggccauccacacugcgaggagguucuuacggggccguccacaccgugggggacccgggccuuacggggccguccacacccgcaggggaccuggguagcaggagguugugugccaucucagccaggggagagggaaccccgugacccuccucacuguuccuggccuugugcuguaaccccacccucugcggaggggcacacagcucucaguccugaagccgccucaccugugggccucagguucugaagacggggccuggaccauccccgguagcugccaagcccuugaccucccaggauccugcagcgcccacucauugcccacagcugcccugaagggcccagcacgcaccccugggcuccccuggggcaccgcccacaucguggacgggcagauagugcuuccgaggaccaggcaccccugggcacuagagggucuuggacccccagaccccgugguugaggaauucagaggaauggagaagggauguauguggcccaccugcaggugucgagcagggacccccagacugggacucggggguacugcccugagcccagacagccaggacgcugaggcccugagucugggagggaaggaaucugucccggccgcaccccgagcacagcugcuucugggcagggugguagcccagagggaaggggcgguagagccagucuggggaggagggggcuguggugugauggccggucuuugcugugggaccccccuuucccuggcgccccuggugggaaacgaccaucuccccuuggcccauccaggcucacagcagcuccuccugggcuggagacuaggugugcaccacucccccucuggguggggcugucucggcccugguggcaaguggcuccccggggagggucgcccaccuucccuggcaagagcaccugcuucccaccuuugcagaaacuggcgggccaaaaguguggugguccugcgagggagggcaggcugucccugggagacagcgugcggggccccacggcaaggcaaagcagggcacaggcccacgccagaaccaggaagcccgaggcguccuccugccugggcggccccaggcgcacacaagcugucucuuucuccccucagacuucaagccccauugagguggcccgccgggcuggugcgguucacacacuccugcagaaagcgccugggguagguguuagugggcgcccguccccaccccgggggauggccugccccggccgggcccugugcgggcugguggccacagcagacgggcuguguccccugcacccccaggacucagccuccugaggggcccggaccucacacuccuuuccugucuccacaggugucugacccguaccgggcgguggucaaggugagcacguguugggaaggcccguggcaagggaggacucuggugcccccggggcggccucggggggcccgugacagcaggagucugcagaaaacauggguggggguggcaccagccccacugagcgcuuccauccugucgcagaagccggggagguggugugccgugcacgugcagaucgccuggcagaucuaccgucaccagcagaagauaaaggugagaccaccugggcuggggcagggcgcuugugaacccgacuccagccuggucgggcccugaaggccaggcaugaggcuguguguguucacacgcgugugcacgggugugauccucacgcgugagccgccugccccuuccucuggguacugggcuuuuaccguaagcaggucagcgaggccacagggcagugcugggugcccgggugccgcaaggcccucuccucggcaaggugugccggcugggccacggggagcagagcaggggcacggggugccgcaccagcuccccacgucacuggggugccucugggguccucugccgcccccacuccccacagugauugagugucugcuguguucuucggucuucagcagugacccagggggaccgugagugcucacaacugaugugcaccugggaaggcugaggaaggcgggagccccgcgggcagcucggugcaggucccaccaggcuaggagcugcgggagcgggagaggguccugggaggccaggacagggggacuguugccucagccccgugggacccugcaccucugcugucccugcgcuguccugaugacgcacgucaccuccgcacacaacucugaaaaaucauuguccuaaaugcccuuugggacgggacucagagcagaaugcuguaugucuuucuuuuuuuuugagacggagucucgcucugucgcccaggcuggagugcaguggcgcgaucucggcucacugcaagcuccgccucccggguucacgccauucuccuaccucggccucccgaguagcugggacuacaggcgaccgucaccacacccggcuaauuuuuuguauuuuuuguagagacgggguuucaccauguuggccaggauggucucaaucucuuggccucaugauccacccaccucggccucccaaagugcugggauuacaggcgugagccacugugcccggccagaaugcugcaugucuuuauacuugcaugucuggguggaacuucuggacacacagcagagggaucaggugcuccugguggggggccguccacggcagagucgggagaccucaucacuccugguuuuguccuuggaacucggggcaugguugcuccacagaggagggcagauccugcaagaggccggcgguccagggagagggcgcacacagggucugcccagcccucacgccugcccccacguagugccagaguaccccagcaucaucauggccagugaaaccaccccagugccagagcacacugcagggaccaggaggggccggcccaggccagccugagugcgggucagaggcaggacaggcagaggcagcgcagucaccaggacaguggggucuuguuuggcuacaccccuccuggcucugggccccucugcucccaugggagggcaugggcauccccagucuccacccaagccuggcccugccucccacagccgccuggcagcgugggcaccugaaguguggccagugcaggugaggggcacauguuguaguuucauauaauuuuuaacacauuuaacuuugaaaacugauaccaaauucagucacugagaaacuuuucagcauauuuggaacaacuugggcacgugagcaugcuuuuucaguuucuuuuuuuuuuucuugagauagagucucgcucugucacccaggcuagagugcaguggcaugaucucggcucacuguaaccuccaccucccggcuucaagugauucuccugucucagccuccugagcagcugggauuacaggcgcccgccacugcgcccagcuaauuuuuguauuuuuaguaaagacgggguuucgccauguuggccaggcuggucucgaacuccugaccucaggugauccgcccguaucagccucccaaagugcugggauuacaggcgugagccaccgugccuggccuuaacuuuuaaaagaaucuaaauacaaaaaaaguaaguuauuuuccaugacagcguagcaucccagcugccaugugccaaguacguaccacaguucagaggacgugagcucucccguucagcuuuuuugcugaucauguguaacauuuccgucauccugaguagagaauacacccuugaaauccaucccaccugcuccccuuacuggacuggcucacacccagucccuguggccccucaggccugggcucccuguguucagggccaguccccgggcaggcggcccucacccguucuauccucccaggagaugcagcuggacccccacaagcuggaggugggugcaaagcuggaccuguucggcagacccccugccccgggcguguuugcaggcuuccacuacccacaggaccuggcccggccccucuuccccagcacaggugagacuggagucgggccagguggggggcacagaaaccucccgcucgugcccagcugagccugccuuccugugccaggagugagagcgcucucuggaccgcagcaccagccuuugcuucuugaugcucaccacuuauucaggucaaagccuggcaacucccucaccucaccccaccccucaccucucuucuccucaccucuccucuccuguccuccccaccagccuccccaggguggaccugggccuggggcugcugcuccuccccaccaaguccugcccaguguguccuggggggccuucagcccacgccacacggcucugaggcggcugguccuggccaccccuccucccuggggcucccuguucuggccccaccagaggcaaaggaauggcagggacccaggcccacgcgaggcugccccuuucugucucccagcccccgcuuucccaggaggaguuuggccucucgcugaacaguaggaagcugcuccugaggccaggcugggcccacaccccagugccccuuccucacaugcaugguugcucccggggucccaggacgggcccagcugcggugguuuccuaggaaggguuccaggacuuggccuguacuguccucaguagcacggcccagggugggaucugccgggagcagcgagggccucccugcccucagucacccacucccccgagucacccccucccccgggucaccccucccccagcaacacaacgugaccacacccgagugucauccuccaggcacgcagaggcacgaagacucuggggugcugaucuguaggcaccacugccuggcacaggcccccaggaggaaagugggcucgaaguucaacccacagugugggauggacacagucugggugccuagaggcuggcugagggccagcugugugcacagaccuuuccaaagauggugucucagccugcacggugcacgccuuucuacacauacacaguuacacacaguuacacauccacauccacgcguguacgcacacgugaagcaugagcauccacauacagcugacccuugaaccacacagaggcugggacacuccccaccacacaguugaaaauccagguauaacuuuugacucccccgaaacuuagccuacuguugacaggaauccuuacgauagcauaaacaguugcugaacaccuguuuuguguguuacauguaugauggacuguauucuuacaaugaaguccacuagagaaaagaaaaccuuaugaggcagaccaugaccaggcgugguggcgcacgcccguggucccagcuccucaggaggcugaggcaggagggucgcuugagcccaggaggucaagguugcagugagccgugauugcaccacugcucuccagccugggcaacagagcaagacccugucucacacacacacacacacacacacaaaaucauagagaaaagauauuugccauucgcuguguggaagugaaucauccuaaaggucuucauccucguccucacacggagugggcugaggaggaggaggggccggucucgcugucucagguggcagggaugggaggaaaucugugucuaaguggcccgcacaguucaaacccauguuguucaagggucagcugcaugcacacguacauacccacguguacaggcacacguacacacaggcacaggcacacacaugggcacugcguugcccaguuguccugcugauggaaccuuucccagccaccagguccuugaggccugucccuuccucagagcucccaacccccgcugcagcccccccucacucuccccucaccguguuuggucucuuccauguucaugagcauuugauggcacguugcauguggacgugugaaggcagagcccuguccacauaagggugaugggcgugcccagcagccacaugaggcuggcuucacaagcaugguggccucugggccauggagcaucccaguagucuggcuuucucagaaagcagaaguccaggcugcaguuucuggcuguccgcauccuggcucaagccccccggacacgugcucaguguggcgcccaguucugggcccuccacacugcccgccccaccgacccugcuccucccccgccuccccuucccuccucuggauaccugguggcugucccucggugcucugccauuuguccugcgaggcugggcccccucagucccggggccagugcugccuccuccaucuccuuggcaggucuugauaucuugcuggcagggggcaggaugauuccuuguugcucuuuucucucuuccauauaaacuuucaaucugccuguuagguuccagcuuucacuggaguuggguuaaagggguacaucgaccuaagagggauucguacgucaucuccgguaucauuuuccuaucccugaucaugguguaucucauuuauuuagguauuaguagaauuacucauagaugcuuuauauuuuacuaauauuaugauuggaauuuguaaguuacauucuuaagcuguugcuagaaaacagaagugcguaucuguuuugaagauuuguaugccaucucuugaugcuguaacuagcaauccugcuaaauucuuacgaaugcaaagacauuugucugucaauuccuuuaccuuuucuguguagaaagucauaucuaggagugggugguuugcccccuuguguaaacugucgguacguuucuggagccacuguuccagcgcuuuguuccagaugaguuuccugaguaagccuggccuuuacuuuccugugcugcaccuggcagguuuugucacgagggcucuuugccgucuucagugaguuaaggcgcuuuccuuuuuucugcucucuggaagagcucuugugaggucugauccucacugccuucaaggcuuggaggcucacaguucagguuccaaguacugauuuuuuuucuccacugggugugguauuccucaagcuguuucuucuggcaucgguuucaguaacgcgaguguuuccaguaaguugauuuggggcaggcuccguagcugucgguguccauccgucacgccugaacuccgcaggcccuggcaauucuuaauguugcuuggcugugucgucuuuuuuccuucauuaaucucaccagaaguuuguccauuucaccaguauuuuauuuuaauuuauuuauuuugagacgaagucuugcugugucgccaggcuggagugcaguggugcgaucuuggcucacugcgaccuccaccucccggguucaagcgauucuccugccucagccucccaaguggcugggacuacaggcaggcgccacuacaccuggcuaauuuuuguauuuuuaguagagacaugguuucaccauguuggccaggcuggucucaaacuccugaccucagaugauccuccugccucggccucccaaagugcugggauuacaggcgugagccacugcgcccggccaauuucaccaguauuuuuaaaggagcagcucugaccucgcugccuucucuguguguuucccugugugucgcucacuuuucuggcccugucuagcuugaucuggugguugagaauauuaauuccucagccucucccagugcgggcauuugaggcaguguacucuccaucuccuccugcacacgcuuugacaagcuguguuuucguagcauggggcaggcugucuuccucucuaguuuagaagaguggcaucagcuuucaugccacagcucaguggagaccagaagcucugaauacaacuugccgcguccuacaugggaggcaugagcaccccaucuuugaggucccuaagauuagggcugggagggagucggaguaaccuaaagaugacgcccugcuggucuuuaccagaaaccugcucucuggacccauguggaggacggccccugaccaacagcacugaauccccugcagcagccccucccagggcccgggcccaggccccacacgguugcucuccaaggguuguuggggggccagggcugauguugacguggugcugugggcugggccugugcccaggaaugccacaaggggcugccaugugcagccuccaagacagaaccguguccauccaggccugaggcccagcaccacauuaagaagugaggaccaucuaucagcucccaggugaaagcucugagauaaaggcuucaggagugguccgaucaaggugcauguuacuuggacuuugucucugcccaaguugcagccccuuugcuccgaggguugcaucgcacucagcaccucccucccugccccccuuggggucccaggauggcugccacugcggcuccaagucaaaccuccuccgaauugugggguagauuccaccucuuacucugacuggacacgcuucaccccucagggcaugcgagagaaugggaggugaagguucacagaggaaauuggggugcucccugugaacagagcugcagaugggaggcccuggugcucucuccuggcuucugucaaaccuggcugccccccccaggugccgcccauccugccuccaacccauuuggacccucagcccauccuggcagcuuccugcccacuggcccccugacaggugggugucucugaauucagcccacgcagccuggcugguuccucagcagccuuguggcgggggaauuaggugggcgggaagguggccccgagccccagggagccccuugggucaugcaggcaguacccaccaggcccaaagccucuacagcagcccccacugggccaggugggagccgcagcccacgccucacagaccucugggucccgcgguugcccccacagacccuuucagcagaccgagcaccuuugggggccugggcagccugagcagccacgccuuugggggccugggcagccaugcacugggugagugacccagccugugccccccucccccgaugcccgcgccccucccccaugccuguguccucugcaggaaccccgaugccuggcugaccucccuccucucugggcugggccuccuuggggcacccccuucucagugucagccugggacccuucuaaaaccccuaccggguucuccuggggaguggcuggggagcagacagacccaaccucaugcuccccggccucugcccccagcucccgguggcagcaucuuugcccccaaggagggcuccuccgugcacggccugcccagcccccaugaggccuggaaccgacugcaccgggcaccgcccuccuucccggcuccgcccccguggcccaaguccguggacgcggagcgggugucagcccugaccaaccaugaccgagagccggacaauggcaaggaggagcaggaacggugaguggcccucuuguuccguauccccaccacacaccccuaccccguucuuuccccccucccgucauccccgguucccccucccccguucccucuucuccccguuuccucucccucaccguucccccucccccuguuccccuuccccguucccccucccccauucccucucacccuccucgccccacugcugcgcacucacagucuguccagcucugcugagccccgggguacgggggccaaagcucugcuccccggcgacuccucccugcgguggggagugaagccugggcccuggggcuaggaaggaugaggagggugaagaccccaccacaggcacccacaccugccauccgggagaccuccagguggccgcgcccugacccacggaguuugagggaggaguucgggggugcggcugccgggaggccccccuguccuaacagggaggggcccguggggagccgaagucgcugcaggcggcucaucccgcuuccgucucccggccaagguuuccaggccgcccagcggggagaggacgcguagguuuugggagccugugggggugcgggagcugugggugcugaggggucaccggccacccagaaacuggaggccccgacaagcaacgggaacaucccggggcugcgccgcgcggcaggacggaggucucgggagugacggguccgcccugccgcccccagggaccuccuggagaagacgcgccugcugagccgggccucgcccgccacccccgcuggccaccccgucagcggccuccugcuccgggcccagagcgagcugggccgguccggggcccccgcggagcgcgaggccgaaccucgggucaaggagagccgcuccccggccaaggaggaggccgccaagaugcccgcgcgcgcauccccgccccacagcaaggcggccccuggagacgugaaggucaaggaggagcgcggggaggacgaggccuccgagcccccggcgggcggccugcaccccgcgccccugcagcucggccugggccgcgagcgccugggcgcgccgggcuucgcgugggagccuuuccgcggccuggagcugccacgucgcgccuuccccgcugccgcccccgccccgggcuccgccgcccucuuggagcccccggagcgccccuaccgcgaccgcgagccccacggcuacagccccgagcgccugcgcggggagcuggagcgcgcgcgggccccgcaccugccgcccgccgcccccgccuuggacggcgcgcugcugcccucgcugggagcccugcacuucccgcgccucucgcccgccgcgcugcacaaugggcuccuggcgcggaccccgcccgccgccgccgcccucggcgcaccgcccccccuggugacggcggccgggccccccacgccccccgggccgccgcggagccggacuacuccgcuggggggccucgggccgggcgaggcgcgcgacuacuccccgucccgaaaucccccggagguggaggcgcgguagccccggggccgcagacgccucuccgagcggagcgcaccgcuguccgucucuccaucaguuccuagaacucaagcacagcucccgccgauccuggggcggcgccgccucuccacccgcagccugcggaggcggggacuugggugucggcuuuucugagggugaucuuuuguuuuccgaguuugggauucggcuguugggaaaaaaaaaucgcguuuguaccuuuuccccccacagaugagaaguguuuguaauggauuuguauuuuucuuaauuuuaugcucuuuagacguuuaaaagaaccaaaaaagaaacuuuugcuucuucguuuucgguugggauuugcaguuuaauggccucagauccuucuccagauccccaggguuucuuugucuuauuuauggagaaaaaccggucacuuuguccagcgcacugugaggcccccacucaggccagcccuggcccccccuugguacuuggaaccgaaguuacagauuauauuaaaauaauaauguacaaaacuuuguuuuuuugccuuauuaugcagaaguguaauuucuuuuuugguuuguuuuuuuaaaagcaaacgaaacguguaaauagucuguugauauaaauauaugacguuacuaaauucuuaaucuagauagacuuuauaaaaaccguuuccagaaaccccucugguuguuugucuaacauggucacaaaaacccaggcgcugcuggcuguaaacauuaucagaaguuuaauggcagcaacuuuccuucaacuaugcaagcgcuucccggcggcucugcugguugggggaggaagguuccgccagcgaccucccagccccuggguccguggagggguugggucccccagcagagccccugggccagcagaacagcacuccugggcggcuccugugggcuucaggacuggccggcuccagccgcaagggcgaugcuguggacguuuguguggauggugcaguguucuuggaaucuguagaccagaucgguggagguauagaagugcaagagucuaaaggcugauuuuacacacacacacacacacacacacacacacacaaaaucacugcuguguguuuucuuccgccugaggcaucagcgucaccucgguguggucgucgccucccaggcccuuggccuggccuccucucaguuuggguuuugcccucacccacaugagcccccccaugcccugccccccuugcggccuuuuguguuccccgaugucugggcugugucccugccgggauucccagccuucggggucagccgucgagccacuugcuuugcucaguucuguguuucagccacauuuccacgguggacccuguuuguuuuaaauauucuguucccaugucaaucagugacgauaaauacagccuugauuuggaugaa

SEQ ID NO: 191501 - RNA, 28429 nt, Homo sapiens
ggauccggauucggauuagcagcccgggaagagugccguggcacaggcgccggagggagcgcgacccucggaccccgccuggcccgcggggcugggacccggccccggccugcccgauggggcgcgcggccccggagaugcgcccucgcccggccccgcgcccccggccccgcgcccccggcccgcccgccccggcccgcgccuccgccugagucccccgcgccuuggcccgccaccccccgccccgcgcccccggcccgccugcgccauggagcccggccgcggcggcacagagaccgugggcaaguucgaguucucccgcaaggaccugaucggccacggcgccuucgcgguggucuucaagggccgccaccgcgaggugaggcccccguccggcccgggaucccccgcccaggauccccugccccugcauccccgccccgagauuccccgccugucccgggacccccccacgccucccgagagccccacucgacuuuccaggccgacccccaccccaggauccccaccccgcgacccccagcccgacuuuccaguucagacucccgccccgagauccgcugccgggcuuuccagcccagauccucacuccgagacccccagcccgacuuuccuguccaaacccucaccccgggacaccccgcaaccuggucccacagccggcuuucgaggcuggaucccuaccccaggacccccagcgcgauccucaaccuggcuccccacucggccuuccagucccgggauucccaaccgggaucaucucagggccccaccuguguggacuggggucugggggaggccugcgaggggcagcccuggccuugaaggugcacguuuggcuuucagaagcacgauuuggaggucgccgucaagugcauuaacaagaagaaccucgccaagucucagacgcugcuggggaaggaaaucaaaauccugaaggugagccagugcugggggagggggcgugggcgugggcgugggcaagccccccuccccacacugauaacaaacuuggguuucuguccuaggaacugaaacaugaaaacaucguggcccuguacgacuuccagguaaggccucugggcugcggucugcuggggaccgggcugggggacuguggccccaggugcuggauccccuggugagcacugguguugagccuguccaggcuggggucuacugggccccuggagacuccacccuggguccaggccugggcuggugcuggcucuugcugugacuuccccagcugugagaccggggagggggugucugggccgcagggcgccccagggcagggcugaguucuccugaacaggcauccccuccccgccgggcgucaguccuaggggcccugccugaguccggcguccccggcuggcccuggcagcacugccggccuggcccaccugucuaggccguguguuuguugacauugcuccugcggccggcauuggccggccucgcucugcgucagacggggcgggggaggggccgccggagacuccugcucgcuggcagucagggccgggccggggcacaggcggcugccgcuggcuggccaaggagaugaccucgggcccggcuggccccaagaagcaagcggugggaccagcuggcuuucgugcugccuccgugucccggggcccagggcaggcagggcuggggcugugggagccagggugccguccuggggaccaggaaccugaggcgggagauccgccccgccaaagugcugacuaauggcucugugaccuguuuacugagcccagggcccagccccuggcugagggaagggcuggcaggccguguuuugguggccuccuccguccgccucucagagcuuugcuguggccuuggggaccgaggcuugucacaaggugccggguggggggggcccagguccagcgaguaccuggaaacccaggcacacuguguccuggagcugggccaucccuccugcugcuuuucccgcccucuucccaccccuuuucucccugcuuuccucccucccuuccuccucuuuccucauccucuccauguuuggaagccuccugccuggaccacagccugcacaugcgucauggcucugggagccagcaaggaguggacagcugucccuggccaggcagcgacucugagggacucccccuccacccugggcuacacugccugcugcuccccuccagggcuccccagguccaguccugggcaucuccaggccaggcccugugacuguccgcacgacccccgcagacccgggaccaguauccccaggcccagcuccaucccagucagccacacacaccugguugugggcaucugccacuuccuccaguguuggcaacucugcggcuuucucuacucaggaagcacuuggagccgccagcugcaggcgcuccugucuccgggcaccgggcucugcuggagcugcagcuuagccugcccucgcccccacaggcguggggauuguugcccugugucgguaaggcaauguuugaggcaggcacccaaacccaggaaaaaauaacuggguuuuaaaaauggacaaugaacgauuugggugauaaaagaaaauccucaaacauuacgggagggagugcggucgaggcuagaguccugcccccgaucgagucccgcugcccuccguucucaggccccugcuuuaguuguuuccgggccaccggggacagccauccuuacaaggcgauguguucaccgguguccuuccccgccacacccaccucucugcgccgugaauuuugucacuuaagaguauaguuugcacuccauccagccugggcgacugagcgaggcccugucucuaaaagaguagagcuuggggaagguucugugcuggcucaauccauaucagaaaguuuaccccucggccaggcacaguggaucacaccugugacccuagcacugugggaggccaagacagaccagccugggcaacauagcaagacucgcucucucuaaaaaaaagaaaaaaaaagaaaaaaaauuagccaggcauaguggcaugucucagcuacuauaaagguuguaggaggauugauuaaacccaggaguuuaaggcugcagugagccgugauguugccaccgcguuccagccugggcagcagaguguaacccugucucaaaaacacaaaacaaaacccucaaaaaguuuaccccucucuguuagaggucaccaucuguaagcacaguggucgagagccaggcugacgcugaugaggggcccaguccuggcugccauaugugcacacacagcuucuuuaguuugcgguccuauuucuuccucugugaagcagaaagcacgggcugugagggcugugugagggaggagggagugcucucggguuggaggagccaucguggaggugcuagcugcuggccugauugggucugccguggugauuuucagccauggcgugccuguugcccgagauuccauaacugauuucaccaaggcccuguaggugggacaugagguuauuuugggaugcugguacaucagggugguugugacuggauccuuagaaguagaauccuuggguaggagggaugcugguuuuuaauuuggguagcuauugccaaauggaccuccggagaggcaaugccacuggucucucagccugucuccaagcaugugucucccuagguccuugccaggaggguggcucucagagguuuccaucguggcucaugugagaaguagaaaaugacaucucuuaugguuuugcuuuucuuuuuuuuuugagacugaguuuugcucuugucgcccaggcuggagugcagugacacaaucuccccucacugcaaccuccgccuccuggguccaagcgauccuccugccucagccucccgaguagcugggauuacaggcgccugccaccacgcuaggcuaauuuuuguauuugcaguagagacacgguuucaccauguuggccagccuggucucgaacugaccucaugauccacccaccucggccucccaaaguggugggauugcaggagugaaccaccaugccugggcgguuuucuuuuacauuggugaugaaugagcuucccuauccgagcaugggaauguuagaaauaccaccuguccuuuguauaguguauuucuuuuuuuuuuugagauggagcuucucuuugucacccaggcuggagugcaguggcgcgaucuuggcucacugcaaccuccaccucccugguucaagcgauucuccugccucagccucccgaguagcugggauuacaggcaccugccaccacgcccggcuaauuuuuguauuaaaaaauuuauacaauuuucgccacauuggccaggcugaucuugaacgccggaccucaccuucgaccucccaaagugcugggauuacaggcaugagccaccaugcccagccugccugauauauuucuauauuuuauauauacguuuuucugagauguaguuucacucuuguugcccaggcuggagugcaguggcaccaucucgacucacugcaaucuccgccucccggguucaagcgauucuccugccucagccucccggguagcugggauuacagacaugcgccaccacgccuggcuaauuuuguacuuuuaguagagacaagguuucucuguguuggucaggauggucuagaacucccgaccucaggugauccgcccacaucggccuccgaaagugcuaggauuacaggcaugagccaccgcuucuggccuauuuuaauauauuuuuuaaagagacugggucucacucucuugcccaggcuggagugcaguggcauaaucauggcucacugcagccucgaacaccugagcucaagagauccucccacuucagccuccugaguagcugggacuacagauacgcaccaccauacuugguuaggcacauauuucuggcaagcucuuggucccuuuugugccaaggcuggaaggguaccaugcuuaacaccauggccccugagccauucugccauuugcuggauccuagcuccaacauuuaccugugugacauugggcagguagccuccuggcaccuccguuuucuuaccuuuuaaaaacuguuggcugggugcaguggcucacgccuguaaucccagcacuuugggaggcugaggcggguggaucaugaggucaggagaucgagacuauccuggccaacauggugaaaccucgccucuauuaaaauacaaaaauuagcugggcgugguggcccgugccuguagucccagcuacucaugaggcugaggcaggagaaucgcuugaacccaggaaguggaggcugcagugagcugagauugcgccgcugcacuccagccugggcgacagagugaaacucucucaaaaaaaaaaaaaaaaaaaaaaaacuguugugguugugauggcaucuugaguauguuaagucuuuagaacugugccugccacuuuguaagugcucugucaauguucuugaaagguagguguccuuuauauaugaagcaaaguagcuucuuugugauagguuacagguauuccccgccauguuguuuguugacuguugagguuguuauuuuuguucuuauuguguuggguuuuguguauuggguuucuuuuuuagccauacaaaauugugaaaaugugagugccugggaagugugugccuugggucacgcucuuugaguccaccacagccgcugggaggcggcuggagcaccuggggagcaccuggccuccuuacugagcauguggugucccugucuggacuugccuggccccaggagugcggccaccacagaaaucaggguauagggcuguggagccaggcugggauccugcccagcaugcccugggaggagggcugauggcuacuggccuugcugaugguggccccccuggccagcacgccaucugacagguuccuugcagcuaaaggucuugcugggccacccaggugugacucacucaggcccugcagacagagccgcugccugugaguuacuugcaguggagaccugagucaagagguguccagcccugcuugggguccugggagaccauggguccaggcaguccagcccagcaugagacuguaacuccccaucccagagugaggagggggcugccaggccuggccuggucuggccggggggcugucugcagugugaguuggggcaggaugcaggccgaguagaaacccgugggguggguacccagcuccugggcaggggccugugaaggggcucccagggcccaggcaguucuggaauuaccuccgaaguuguguauaucuuuuuuuuuuuuuuuaacuuugaaaacaaugggaugagacugggcacaguggcucacgccuguaaucccagcacuuugggaggccgaggugggcagaucaccugaggucaggaguucgagaccagccuggccaacauggcaaaaccccaucucuacuaaaaguacaaaaauuagcugggcgugguggugggcgccuguagucccagcuacuugugaggcugaggcaggagaaucgcuugaaccugggagguggagguugcagugagcugaguuugugccacugcacuccagccugggugacagcgagacucgucucaaaaaaaaaaaaaagaaaaaaaucaugggauaaaaauacuggaaagugcaaaacagaugagaagauauaccacaacaggcccuguguggcguagcaagcgccagcccaaagccaugcccgcgucccgggccgcucuccucccuccuaucgagggcacguccguccuccugugugccccccucccccucugcuuucucauucuucacgugagccagcuccugguucccacacgcucccuuugccacaugcugacuuuaagccuggaggugggaugucagccguagguugaggggugcugugucuccgugggugacaggaguugguuuuuguuugugcgcagcaccccguggugggacugucaccugguaucaguaucuguccgcgauggcugggggucaggucucagccaccugaaggacagagcugcugggaacaguuuuuacuggggugugcgccaacuaggauggccgggucucggggggaaugugaggaguuggcgucuuccugagggucucugcagcuuacacccccugcaccccccaacucgcacugggguuguuuccugcuuuuuccaagcaaggucgugcccucagaaggguugggccacccaccccugccucacugcaucuagggaccugccucaacccccugcggcuggcucccggauuguccagacccccaggcccagcaggcgggaggcugcagaggucagccuugggcugcagccccaggaggcccauacacaaugggcggcugcaggugguuccccagggccagaggguggcccuuccuucuuaggguggagccggcaucccuucccuuuugggagcuguccaggagccccgccugggggugcagagugguucuguccagccacagcuguggcuuuugccacuuuccggagccagcucuggaggugugaacuaggucagugccugcucaccaggcccagcccaggaucaccagacaagaguagggcuggcagagggugggagccuggauccuauuaaguaaagcaccuuagcaccccagggguggggcagccuccuacgugcccagacacccgugccaggcugccugggacaccuggcucuggccggccgugggugcgugugugcagggugugggggccggccugccuggggagugcugucccaggucccucaggcaugcugccuggagacagugggguguugauauugcugucuuuuugaaguguucugagccucagaugcauguguugggacuuuucagggacagcccuguggaauggucagcagccguucccuguuuccucccuuuaaauaggcggcaaguugggacccaccucccggggugggggugauggugcagggagccugguguguuugauuagggcaugggcgguguggccacaacugugugugucaccacgggacggacccccggacccugucuugggaggcgagcugcucugccugggguggccgguuuccuccccuggagcccagggaggcaguuguggcccuuucuggugucuuaacugggugacuugauucugggagcuugcccgguccccacugcccaggguagcuugugaaaaccaaauguagcugcgaggcagacguggagcccgaugcccuguguggguucugcaaggcagagcuggagcccgaugcccuguguggguucugggugggcccaggggaggucagcuguggccggugaggcugugcucucaccugaccccccucaagagcccuagagagagucgcugccugugggaaggguggacaggcccagcugggggcccccgucgggggguguuguggcgcagggccugggccugcagcugcccuggaggagcucccccagcccuggcagaggugguccugggcuuguuuguccucacuucucaucccugacucugccaggguuggagacagcaaggcuagguccuuccggggacacagagggugacuggcuuggcauuggcacugggcagagugaggacaggacuccagcccaccugcuugggcugugcugccauuucccagccugggcacgccucccaaccucuggggccucagugugcucguaugggaagugggcugguuauggccugcugccugggcuccugcagggcugguguaguucaacuucacaggaggcucucggaggcacgggaaaggcccuggugugccccgaugcccagcucagggaguuggaugcccacagcccugagggccugucugaagcugucaucugucccaggggaguugggaagacccgaaugccuguggugagguggaugcccccacccuacccugcagccccacccccaguggccuugagucaccugcuggagaggaccuuuuaggagagaggcugagcaugggccaggccuugguuucugcaagggaccauuugaagugcagggaagaggcuggaggugcuucggucccacagcccccugcccacucccuccugggagcuggugcccccugagguuuuggggacagaggagggcugccagcacaguggggagggcagaggggucucuaggaaggugaccuagggggugacaucugugacucuggggcaaggccaggggucuagacgugucaguagcgagguggguuccagcacccaugaggccaguguggcuggagggauggcagggccaggugcccuggguagggguguuggggacccuggcuagagugugggcagcagauggggugggggaagagccuccuugccaggguccugugggccagucacuggugccacaggggucucccuggugggccucugccuuucuucuuuuugagacaggugucauuccgucacccauccuggagugcaguggcacgaucucccggcucacuguagcuguggccuccugggccuaagccacccucccaccucaguccugaguagcugggacuacaggcgugcacugucacaccuggauaauuuuuguauuuuuuuguagagaugggguuuugccauguugcccaggcuggucucaaacuccugggcucaggcgauccucuuggcuuggccucccaacaugcugggaugacgggcaugagccaccguacccggccaggccuuugccuuucuaggggugagagguggcugccuuaguguuugggggugggaggaggcuacagggcuucaguuagcacccccugcccagagggagcuccugucccacacagcccgguccugggugaguggcugggggauggggugcugggcuccugcucugcacacauggguguucccccaggauaccucugacuuugacacaucccugcuuguccuggcuuugcugguggguuuggagcucugaugagcaggucaggucuuagggaaccccuggcucugggauccagggcagguggcccccagagaggagaggagaaaugugggcaccuaugggcacucacuggaggggcuguggggaggguaauggugggcccaggucagggagugggcauggccguccugaaguuauuucugagucuagcuucaucucccccuccuuccuggguucugcccggagcugucccugcagucccccuugccccauccugugcucuguggauuguuucuccccacagcugcugggagcccugggcuccccacgugcucuuccugggcaggcaggugaggccaggcggggcuuggggugcacaggcuguggguggggugggcugaggccugccucauggauaggucccaccuucucuaggcugugccuggguuucugggucucccucugggccggcccugcagugucuguggauccugggguugcugccugagcaccaucggccuuagccucccuaaaggcacccucuccugagccuguccccacucagcauccucguccagcccauagcuccucugcgggggcagcucugggacacgggcuucucacguuuaugaagcaggcaucacccaguggcuuugcggcugucccccccaccaggggugccuucugauugguuggggccuccugggacugggggcugagcagggguccugugugggacgcggcuccugaggcgcugagggguguuccuccugcagacccccuccagacacggcuccccuuugcuuugagagagccugggcucgcucagggguagaagugggauggcccuacaacagguguggacucgcuucccuguaagcaccuagagcauguggauguguacagggcagagggagggggcuuuguguggaaagggcuuccuccuccuguucugaggccuagagucagguguguggggcccuugcuccuccagcccagccugccugguuugauguggcuuccugggccucacucuccuugucugugaaacgggggugaugaggacucgucccuguggcugcggggagugaguggugggcuacagggaggcucccagucccaggugaggguguacgcaugcuggccguuggggugugugcugugucugcaccgguggcuuacucugaguuucaugggggcaggaaagggcgggguacugguggcacccccggucaggucugugucugagcugagggcugagcagcugcuggucaggucuuguuggcccagcagcggaggggguggcugagacgccucugaccgaaggcauuggggcgagggauggcagccugagcugcagccagguuggguagggcagcuggaggccgcaggccucugcgucaaccuggcagcgccaaccugcaaucuguuggcgucuucuuuuuuuuugagauggagucucacucucucgcccaggcuggagugcaguggcacagucucggcucacugcagccuucuccucccggguucaagugauuuuccugccuuagccuccuaaguagcugggauuacaggcacgcaccaccacgccuggcuaauuuuaguauuuuaauagagacgguuucaccauguuggucaggcuggucucgaacugcugaccucaugauccacccgccuuggccucccaaaguguugggauuacaggugugagccacugcaccuguuuaaguuuuguauuuuuaguagagacgggguuucaccauguuggccaggcaggucucaaacugcugaccuugugauccacccaccuuggccucccacagugcugggauuacaggugugagccacugcgaccagcccuguuggcgucuuugauccugggcugaggagcugagaagcuucuauggccugagggucacacacaccugcccacacaccuggccuucacccuuccugcuaggggguauguccucugccaggagcuguugcucuuauggggggaccaggggccuuugccuugaucagauggagaccuggcuggccacaaaacagaacacacccaccuacaaagcacguggcccagagauguccucgucucccggccgcuggcugaccagcuaaguccuggcacugcagggccugcccaggccgaauuggggcugagccagacucccugcaguggggcccgguggcacugggaccucucacagccucuuuucugucuugcaggaaauggcuaauucugucuaccugguuauggaggugagugccuuguggugccaggacaagugcaggcugauggccauggcccugggagccccacagggagggacauggcuggggggagggugaugagcaccuuuucuuuuuuuuugagauggagucucacugucgcccaggcuggagugcagugcugcgaucucagcuuacugcaaccuccaccuccggguucaagcaauccuccugccucagccucccgaguagcugggaguaauuacaggugugugccaccacgcccggcuaauuuuuauacuuuuaguagagaugggguuucgccacguuggccaggcuggucuugaaccuccugacuucaagcgaucugcccaccuuggccucccaaagugcucggauuacaggcgugagcugccacgccugcugaguaucacuauugaugucuuccagcagggacuguggggacaccugcccugggcugggcaggugccugcgggcucagggaguaguguccaagugugagggguggggaggcugggcagggcugggaggugggcccugggcccugcugcagccugaugcgugucuggucucuugcaguacugcaacgguggggaccuggccgacuaccugcacggugagugcacagcugcgccaccugggcugccagccggucccacagggcccgcacccagggccacacuggcccagucugggaggcagccuggcucgaguggguccuuggcucauugugagauuggcucuuucuugucccccugggccucuugaggggaugcagggagcugagcugcucccggcuguuaaggaugcagucccuccgcuggccucccccuugcuugaggagacagcugugaccagaauagcccgaggggagccgcacaaaccaggggugggggcuguugucuucauaguguggcuggaaggcggcucuuggcccacccaaaguugagcccuguggcggaugggaggggaugugcugcacggggcggggcggggcagagggaaggacagcaggggggcggccgcgcccgucuguucccaggcucucuggguggggguccgggccacagugccggcgggcgcggggguggguggggcgccggcggccucuuggggguguccugagggucuggagguggcucugggacaguuccggggacuugggccugagcacccgggagccggcaggacugcucaaacgccggcucagacccgcgucgcccucauagcgcuggggcgggagugcggggcugguagauggacaggacccgcuggcccccucgccucgccccacgcgaggaggaccccacggaccaagccugggagacagacgcugaggccgcgcguagcugagacuggggcugcgggucgggucgggcugugcgcggcuggcaccugucuggaugccgggaagaggggcaggagcgggacccgggcggaaccgcgguggcacugaggcugggcuucggcggccucccgucucuggagcagcugcagcccggggcugagugguggggccggcgcgccgggcucugcgcaggagcuucaggugcgcccuggucucggcggcccgugguggcuugugccccuccugacccgggguuuccucccggccugcggcccugccuggcgcucuccauccguguggcgggaccggccuggcugcgcgggacucaccccugggggaggaaacacggcccccaggcccugagccgccucuccccgcagccaugcgcacgcugagcgaggacaccaucaggcucuuccugcagcagaucgcgggcgccaugcggcuucugcacagcaaaggcaucauccaccgcgaccugaaaccgcagaacauccugcuguccaaccccgccggccgccgcgccaaccccaacagcauccgcgucaagaucggucagcccgcgggcaggcaggcgggcccggcggggaggggcuccggggccggcgccgguccugacgcuucucucccgcagcugacuucggcuucgcgcgguaccuccagagcaacaugauggcggccacacucugcggcucccccauguacaugguguguuuaccuuggccgggcugugccgggugggcgccucucugggcuugcugguugguuggcuggcguguggugcgcucugcucugguuggcuguggccuggcgggcaccuucugugguuggcgugcgggggccucacacugacccgacuucuggucccgcaggcccccgaggucaucaugucccagcacuacgacgggaaggcggaccuguggagcaucggcaccaucgucuaccagugccugacggggaaggcgcccuuccagguaacugggcuuggcccugcuccccacgccgcaccgucagugcaaguguccgccagcugcggucagacgcccccugcgagcccugcccgcgccccacgagcuccccucggguccuggcuggcggggcgggcguccagggguccaguggggaaggggccucggugucccccagggagggcggcgccgccggcggugacugggagcugcccccggcaaggccucccucgccugucuggucgccugucuagucgccugucuggucgccugccuggucagaggugagggcagcgccggggccgagugggugagggcugggaggccgcguucugggggguggacaccccgagagaccgucggcgcccccuccccgcccccaugcucauaccuccagcagcaaacagccgcgcuagcacccgguuucccccgggcuucgcagcgucuggggcaggggccgacuggggacgaacgcaccgagaccccgugggcuggucccgcucggccgcagcccuggcagucaggcuguccccguccccgcaggccagcagcccccaggaccugcgccuguucuacgagaagaacaagacguugguccccacguaagcacccucccgccuucccuucccuucccccgcgggcuccggccccgcaggcccugcucacaccagccuccucuugccccagcaucccccgggagaccucggccccgcugcggcagcugcuccuggcccuacugcaacgcaaccacaaggaccgcauggacuucggugagcacccaccaggggcgcagcuggagucccccacccuccuuccuugcauuugcugaugugagcagggcccaccggcuucacacccagccccaugugcacacugcccuuuccacaagccaagcgcaggcaggggcuccaccuccgcccgggcaggugcccaacgcggcuggagcucaggccguggggaggcaggggccuggggucagagcugggguccuccugaggccucacuccuccuuccuccugcagaugaguuuuuucaucacccuuuccucgaugccagccccucggucaggaaaugugaguuucuguggguccuggggcuccgcaugggcccugcaugcaccccuuccuccccggguuugguuagggcacugaguguggggcagagggagcaggucuugagcugcggccagcucccagggagggcaggacacccggcuccuugcucugcugcagcggggaccccaaggccagggguucgcauggugcagcaggcuugggauggggaugggguguuggaggggcuggugcugcccugugacagucauaggguggcccaggagggagccucccuccuuccugcuggucgggguguagccggaaguggaggggauaugguugagcuuguccagucuguggguuggcucgagggugaggaggagacaggaggauggcccagacugaccuaugcauguuuaucucagccccacccgugccugugcccucguacccaagcucgggguccggcagcagcuccagcagcagcuccaccucccaccuggccuccccgccggugaguugccgccccaggggcuuggcagcuucucccuccacucagcagucaggggcuccagcccugggcccccgcggggacgugcugugacuucuguugucugugugagucacgaaagacauggaugaguucauucugucagauguugaagccccacaaacgggugacagccccucccaacacccacagcccucaggucccagaggccgauagggcggcuguuuggucugguccugucuuugguuuugugcugacguggacagaagcagcguguggccuuggcccacugacaccugcaccccuggccucccucgugucuuccauuggacucaaagcaugaguaggguugcagggugauggccccacaugaugauggcacuccuugugugacaugggaggggucugcagagcaccugagucggccaugaacccccgucccucuguccaucugacugggagccuggcucucaggcaugguguuguggcugguggugaugaguucaugucugggcucuccuggccuggcccccugcucugugaccagggaccgguccucugaccuugguugucugccuguaucauggccgaaagcucagauguggcgaggggagcguggcagcgcccugcuguagggagcuguggcauccgcagaccugcccuggggcacuuggggcuuuagccaccaccgcacggauggugugcccugggccuuagcauggugcuggccucagagcagggcccaccgggguggcagccucuccacuggacacgccuuccaugguaccucguucucuuggcuaugccgauggaaaagugaggugcagagggcagguggugaacaacuccccaaaacagggccucccagagcuucugggagcugagggcuucaacccacccaggcugcauggugagaguggcucgucggggggccugucccugcgaggucaaagcuggccuuugaguggagugcucuggaaguacagagaagagcggagcacaggaagaaagacgugcccagcccuucucagccccagcgccccgaucuuuacuggggcucugggccaucccaggagggggaauuugcuccccugaguguguaggucccugagaccugcucaccagccccuccguugacucucagucccugggcgagaugcagcagcugcagaagacccuggccuccccggcugacaccgcuggcuuccugcacagcucccgggacucugguggcagcaaggacucuuccugugacacagacgacuucgucaugguccccgcgcaguuuccaggucagggggcacgcugggcuuggaggugacgccucaggugcggcggggacagugcauugcauguguuggaugcacaguguguaacacauuuccacuuaugggcaguuaggaugggccccugggagccaccggcaucggcccagcuugguuggggaggccgugucuguuaaaaccacuccuggaaucaaagccggguccuccuaguggucaguaggaggucggaggccauaggccuggucuccuuagacagugcugcucuucggaugggugggggccgcucaccucaugccccucccccgccauguaccccuaccuuguuucucagcaacucuuguugccucuacacccugcagguggguuuauuccuuggcuuuuggggaaccccccgcuccauaauggccaggggcugcccacguguuuguugaaugaaggugccuaaacuuuuggagcaggccuggggucuguggcuccucugaaggcccugcacucugucccuggcugucccaaagcuccuggaggucuggguuggcacugguccccgugucugccagggacacaaugacucaugccgagcccuccgccucucccaucagcauggcuucugcggggguggugaggcccgagccaagccccagacagacccggggagggccuugguccuuugccagcugucagggcaacaggaagacggacaccagggguagggcagagccuccuugggggugggaaccuggguauuccuggaggggguugggcccagacuuagggcuguagaugccugaccucccccgcccauccuggaguuagcuaaaggcuggggggcagggccccaggggucucuggggcugaggagacaggaggcgcagaguccaaguggggauaagcgggggcagguagcgcucuggucucccggagcuggccuggggcuggcagggaggaugcagccuggacuguaccacccaggcucugccccccgcaaggccgcuguacgagcugaggccccugcaagguggagugugcguggggauccagcagagagccucgguggggugggguggcccugggcaggcggcaaggacuccaggcccagccuugucucccccugcaggugaccugguggcugaggcgcccagugccaaacccccgccagacagccugaugugcagugggugagcccccaucccuuaccucuguauuuuaggggagagaaacuguggccuuggaaguggcccguguuauuuacaaugagccgagaucgcgccacugcacuccagccugggugacagagcgagacucugucucaaaaaaaaaaaaaguaaaugccguuggcccgugguggcucacgccuguaaucccagcacuuugggaggccgaggcggauggaucacaaggucaggagauugagaccauccuggccaacauggugaaaccccgucucuacugacaaaaaaaagaaaugcaaaaaauuagccaggcgugguggcacaugccuguaaucccagcuacucgggaggcugaggcaggagaaucgcuugaacccaggaagcagagguugcagugagccgagauugcgccacugcacuccagccugggugacagagugagacugccccaaaaaaaacaaaaaaaugcccuuggccucccuucugccccacaggagcucacugguggccucugcgggcuuggagagccacggccggaccccaucuccauccccacccugcagcagcucccccagucccucaggguaagcagggccccaggcuggguggauggggcugugaacagucccccggcuggagguugggcuuccugugugucgcagccagcccaggccugcuguguccagaggccccugccuucuucucccaggccucgcaggauggggucugcugggucguccugcagaagggacuauagugggaggagcauugacaggaguaggugaaugaggaaaccaaccagggacgccagggccagcacagucgagccuguagggccaggaauggccagggccccggccaggguggccccccacuggcugggugcagacugggaguccagguggggugcaggugccacauuucugguguguguagaggcauggaagccggcucuuuucagaccuggcaugggucucaggguggccucugcccuaacuaggaagucugggccuaggcuuucuucuggugccccagcuccaugaccucagccucuugugaccccagugucugucaugauccugaccucucuccaccacagccgggcuggcccguucuccagcagcaggugcggcgccucuguccccaucccaguccccacgcaggugcagaacuaccagcgcauugagcgaaaccugcagucacccacccaguuccaaacaccucggugaguguggagcccccagguagccaggcguggcuggggccuuguguggcaggagcccuuccacggcucccauagagggacagggucgucauccaugugcaguugugcaggcugcgcacugcguaacucagcaccaccauuuacuuuguugaugucuuggguuucuagaguuauuuugacaguuuucugaucaguaaaaucucucuaguuuauaaaaucaauauugacuuuggccaguuuuaacagacagaaguaaauggugggaggaaaggguaccuuucuuuuaacucacagaaggcugugugggccagugggugucuggcaggggauggagacuuuagggugagggugccuuggguuggcaccccgggcaggaaagcuaaggggccaacuccucccacacacccacuguguggccgguuaccuggacagagugcauuagaggaugagccaucugucagcacuguagccacuuggcguggcaugggguccugggcugcuggggccuccccuccuaauaccugccuuguccccagguccucugccguccacaggucaggcagggcugcugaggccuccccuccuaauaucugccuugucuucagguccucugccauccgcaggucaggcagcaccagcccccugggcuuugcaagggccagccccucgcccccugcccacgcugagcauggaggcguccuggccaggaagaugucucuggguggaggccggcccuacacgccaucuccucaaggugcgccugcaggcuggggccugggaaggggcgucuguaggcagugggugaggaggcugucucugucccagcuggacccugacagaucucucuuuuccccaaguuggaaccaucccugagcggccaggcuggagcgggacgcccuccccacagggagcugagaugcgggguggcagguccccucguccaggugggugcaguccggaggggggagggggugcuaggcugaccucccucgcucacguugucauccuggucuaaagcccuugcucuuuccaagugaaaaggagugggaaggaagcugguggaacagaagccaacugccucuccaccuccuggcugugugggcuggggcaaguuucuuauccccucugugccagucuucugugcuggcugagggucagguuuaagaguggcgccucagcuacucgggaggcugaggcaggagaaccgcuugaaccugggaggcagagguugcagugagccgagaucauaccaccgcacuccagccugaaugacagggcgagaccccgucucaacaaaagaaaaagaguggggccuuggagugcgucuaccccaaggggcuccgugugguagcaguggggccuagggcugggccgccggaccggaaggucgugacgaggcgugucucucucuaggcuccucugcacccgagcacucuccccgcacuuccgggcugggcugccgccugcacagcgcccccaaccugucugacuugcacgucguccgccccaagcugcccaaaccccccacggacccccugggagcuguguucagcccaccacaggccagcccuccccagccgucccacggccugcaguccugccggaaccugcggggcucacccaagcugcccgacuuccugcagcgaaacccccugccccccauccugggcucccccaccaagguaaugggcacugccaugugugcaggggcacagagcccuggggaagaugugugggaauggccaguccugaacaaagaccgaggaaggcagcucuguaccuuuugacccccgccugggcucaugcucaggcugcucccacaugccugccaguuccugcggacucggccccuuccccaggcaccgggccccagggcugcagaccugcggggcagucuucaccccaucucuguccuccuaggcugugcccuccuuugacuucccgaagacccccagcucccagaaccugcuggcccuccuagcccggcagggcguggugaugacgcccccucgaaaccggacgcugcccgaccucucggaggugggacccuuccauggucagccguugggcccuggccugcggccaggcgaggaccccaagggccccuuuggccggugaguugaggggacaggccuuggacgggcuucugaggggcagccucuuuccccugcauuguucugcuggguacuucugggggguagaacaggaaaagcccagccuugcccuucugugggugcccaguguggcugggugccagagagccuggcccaccuguggcuggcccuagacccacagcagguccccguccugagccucgccaugcccgccuguaagcuggggugacaggagcgccugccucucgaggugggccaggagaccgugcaucaugugugucuggccugcagagggaccucucgagguccaguuaggguggggugggccgggcacccagcacagcccugcacacucccacaggucuuucagcaccagccgccucacugaccugcuccuuaaggcggcguuugggacacaagccccggacccgggcagcacggagagccugcaggagaagcccauggagaucgguguguggguggguggggcucggaggcugugggaugggggucggaggcugugggaugggggucggaggcugugggaugggggucggaggcugugggauggggcucgaggcugugggaugggggucggguggggcuuggaggcugugggauggggcucgaggcugugggacgggggucggguucggcucggaggcugugggacgggggucggguucggcucggaggcugugggacggggguuggggggagcucggaggccgugggaugggggucggguucggcucggaggcugugggaugggggucggcgggagucaggaugcuccugagcccuuccuugcucucccagcacccucagcuggcuuuggagggagccugcacccaggagcccgugcugggggcaccagcagcccuuccccgguggucuucaccgugggcucucccccgagcgggagcacgcccccccagggcccccgcaccaggauguucucaggugagggcuggcuaggcugaagcccugucccuuuuggggugguggcagcgcccuagcggacgggggcauccuuuaacucgggucacuggacuacagccccccagagcccaggggugccugaggaagcagcucaggccccugagaaaccccugcucugucuccccgucugcgaaauggacgugguucugguauccaccccucagaccaccccugccacucaaccugugagcgguaggcgcucguucccauuuauccccaaaacaugaggugagcagggacggugucuggaucauggccuccuugcccagcugccgugggcugugcuguguuggucaggaguugcccugaugagcacaggccgugcagacaggcgugccccucgguuccccagccagugguguguggggaugcucugggccuggggccuggcuggguccccacugcggguucugccuggggaggggugggcuugugggcgucugguccuggccaggggcugccaucgcuggggucaccugccagccccauagcgaggaugggggacugccuugcccuuugagguccuuuugggccuugggcccagcuguggggcacaguagcacaccaagccacgcaccuaccccauuccagacaguggcagcugcccuccucccaggcagaucugggcugggggucgggauacccagagggucccuuggugggcaccgcagcccuuggccugagguggggagcuggggacuuggggguuguggugaguggcaagagguugaggaguggcucuaggggccugcugugcuucuccuguuggagcauugggauauaacagguguaaaccgaggcagaggcacauugggcccuggaggugugggagucugugggggauggaugggggccacggugucugcugguccuggugugccccucaucgcccucucccugcagcgggccccacuggcucugccagcucuucugcccgccaccuggugccugggcccugcagcgaggccccagccccugagcucccugcuccaggacacggcugcagcuuugccgaccccauuacugcgaaccuggagggggcugugaccuucgaggcccccgaccucccugaggagacccucauggaggugagggcuggagugagcaaagguucccauucuggcuggagggugugugggguguguggggugucgggugugugggguauaggguguguggggugucggguguggggugucgggggugugggguguagugugugggguguagagugugugggguguggggugucggguguguggggugucggguguguggggugucgggugugugggguguagggugugggguguaggguguguggggugcaggguguguggggugcaggguguguggggugcaggguguggggugcaggguguguggggugucggguguguggggugcaggguguguggggugucggcugugugggguguacgguguguggggugcaggguguguggggugucgggcguggcacaucccagcugcccgggcugcagcaggggaggguacccugcccugccuccccaaggcgucaucggugagucugaagggagacaagccccuuccaagcccgggcagcacuugccgcccugacggccgcuuccugcagcaagagcacacggagauccugcguggccugcgcuucacgcugcuguucgugcagcacguccuggagaucgcagcccugaagggcagcgccagugaggcggcggggggcccugaguaccagcugcaggagagugugguggccgaccagaucagccugcugagccgagaaugggggugggugccgccagggcugggguggggcgggugguggccugggggccaggaccaaccggccuccucugaucugccugccgcccccagcuucgcggaacagcuggugcuguaccugaagguggccgagcuacuguccuccggccugcaaagugccaucgaccagauccgggccggcaagcucugccugucguccacugugaagcagggugagggcugcgaccgcucagcccacaugccggguuggggaggaagcccaccuugcaacugccugggugacaggguaacagggaggcugcuugaguaggccccugugcagaggugcagaggccccggggccuggcccagugugcagagcacagaggccauugggucggacagcacccuggagcccaguaugcagagcacagaggccguggggucggauggcacccgggacaaggugcggagccuggccacacccucaaggccacggggagccagggcuguggcagggagggagggacgugcucgcucagugcaccgggcagaucauggccacuccagcccugccccgugucugcugcacccugagcugaccacccucguccuuugcaguggugcgcaggcugaaugagcuguacaaggccagcgugguguccugccagggccugagccugcggcugcagcgcuucuuccuggacaagcagcggcuccuggaccgcauucacagcaucacugccgagaggcucaucuucagccacgcugugcagaugguacgggacagacagacaccaguggggcaggggccaggaacuuccaggcccgccgucuccacugggacgggaccuugaugcccacagcguggugagacuuuggggggugucacuucuggaggucuugaaaugacagcauuaugcacccccagccuccugcaggcgcucgcagcucggcugggugcauccuugauuguacgggugccguggcccaugugcauccugccucgccccgacucaguuuccccaauuguaaaaugagagacuuggucuucaggccucguagucaggugucagccuccagaagcagcaccuggucccggacaaccugccuggaaguguggugcacucaggugguaccacgggcaaagacucccugcuugggcucugaagagcucccucugccucugagguggugcccccuuuucguuuauuuuuuguuguuuuuuuuuaagagagggucuugcacuguugcccaggcugaaguguaguguagccgcuaacuccugggcugaaaugauccucuugccucagcuucccaagaugcuggguauuacaggcaaaaacucaugagugccugagucuccuuuuuuaagaaaauuuaagcauguaguaaaaauccagucugaacaaacaugggaaaagucagccucccuccugccccccuucccgcccaggcaggccaggcagcagcaguaaugacacugacugagcggcgggcacucuguuguccuggggccgggcugagagcgcuggccagggucaucugguuccaggcagugucuccccuuggcccugugaccauccccucugcacagcaggcugcaccagcacuuaugucuccacgucacugcccugagcgccuaucugccaccccugggccgcugccgugggugcagggcagcccuugcugggagggaguggggugagcuggcccuguccagccucuguccucgcccccaggugcagucggcugcccuggacgagauguuccagcaccgugagggcugcgucccacgcuaccacaaggcccugcugcuccuggaggggcugcagcacaugcucucggaccaggccgacaucgagaacgucaccaagugugagugcccggcugggcugggggcuggggacucugggcgucucccucacacuccccucucccuccacaggcaagcugugcauugagcggagacucucggcgcugcugacuggcaucugugccugaccuuucuggccuggcugggccccccguccugccgagcccugcagagugggcucugugugcuggcuggacuccucgggacaagcccauggcgcugaucgcuggugcugagcccugcccugggccccacggacagucagccugccggccucccugcagcucacggggcagaaccagcacaucuggagccacacagcuuggggggugucucccaucuuuuacagguggggaucacagaauuucugccccuccagcugccuggcucagcaggcgugggugccaccacccucuagccccagggcagccccggaggacaggcaagggccugagaccacugccgacucaaagccaaagcgagcuccugcuuagggaaggucagcaggcacugugcccaggaagagccugcggccucggcgucccccagucuccaggagccucucccuccgagauacccacccagcuuugucaaucacccaagcacuuuaugcauauagagacagaaccuggaccucaccagggacugcugggcagcgauuccuggcaguggccugguguuuguacauacacauaugcagacacaugccagggccccccaagcccgagcaccggaccacguugcugcccaggucuggaccucagcgggagaacuggcuccggggggaguggggcccugcgcuagaggcagaggcaguucuuuguucaagcguuccucuggggaccggcagcagaggcaccguguucucucagcccuggauacgucuuguaaucuuucacacuuuauuccuaaaacgugucuuauuuuuaugcagcucauuuuuucuuuaaaggagaaaacuuguagguguuuaagaauugguuuugggagggcgaggacugggccagguuagaggcagauggcacaggggcguguggcgggcgggugaggcugcuuugcacaccuguguugguggcuguccccugccgccccucccuguggcagcagcaggacaggugugugcccagcacccucccuaccugggccuggaagcagaugaggggaauacuucaugcaaagaaaaaaguaacaugugcaaaagcuccccguccagcuuugacagucaguuuugaugucagcuccucggcaggguaggccugaugacagcccugucccucccugccucugccuugcccaaggccacggagggcaucugcagagaggccugccuuccggauuccaggcgggcaugcccugcaaaccccgccugggccucccuuggucugcccagcccucgauuagcccugccugaaucaguagauacuugaacgaguccccagucugcgggaggcagugguggggccauggacccaugcgggggguuccagggucacacgccacauaacagacaaaaauacacacacguguguuuuucuuugcaauacuugaaauauugccacugugcuuggacuuagaagaagaaaauccccgugacuucuuccucaucaccuugauggcuuuauucucaccuuguggggcauguuuguauuuauugcuucauggccgacuggaauccugaguccugggaagcuggcacugcggggaucuugcccgguguccugguccucuugcuuccgucgcggccgcaugugcguguguccaagcagguccugggcgccucaacugcugccccugguugaauguucucuugauagugcuggacccuuugucuauuuuaaagcgaauuuugugugauuuccugcccuuugcguuauauuguauaauaccaacguaaggaaauaaaccuuuggaauuguugggcugguguca

SEQ ID NO: 191502 - RNA, 54092 nt, Homo sapiens
gcagguuuagcgccacucugcuggcugaggcugcggagagugugcggcuccaggugggcucacgcggugagucauauggggaacuucuguuggguguuuggugguucgaaucccaucuuaagcguuuugugcgaacggagucuccugagcuucgcuuugucuguaguuuugagcugaagggggagugugugggcgacucucuuccuuuucaguagaucauccucgaggugaaguucacuucccguauuacuugcaagcugaaacaggccugaacauacaggauaagaagaacagcguuguauucuucaauaucagagcgaagugacuucguaaaaauucuauagauguuagaaaucguugccauucuuuagguucaaucuauaaaauacuuauagagaagccagucuuagcuacugggcgcugcagggacuggaaacgcacugagcuguguaggaggauguucugcgugucccuaaauaagucccuaaguaaauguaugggauaggguggccagaaguggguaggagggcaucaguccuccuucggacuuagguuuucugcuugaaaaaaauauuguguuucacuugaaagaccucuggaauuuuuaaaaaaaauuauuuauuuuugauauaaaguauacauauaugauuaccaucuguaccuuuuuuuuuuuuuuuuuuuuuuuugagacggagucucucucuguugccaggcuggagugcaguggcgcgaucugggcucacugcaacuucugccuccuggguucaagcgauucuccugccucagccuccuaaguaucugggauuauagguacccgccaccaugcccggcuaguauuuuuaguagagacgagguuucaccauguuggccaggcugaucccgaacuccugaccucaggugauccaccugccuuggccucccaaagugcugggauuacaggugugagccaccgcgcccggccuauuuucaauuuuuugaggaaucacaauacucuucucuauaguggcuauacuaauuugcauucccaccagugguguaugugaacagugcaaggucagacauaaccagguccaugcacauuugugucuuuccacaagaucagacuuauugauguuuuauuuuaauuguaaaagccacgagcuauauggaguucccaaggaagcaauuuuccguaguacucccuguuuacuugguggucagagccaugggcacacaggcucaagccauuccacaagucagucaguauuguaaaccguacacaauaguauauuuauuuaauauguaaauguuauagauuaaaaaucuuacauuaaaguaacauuuaacauucggagaaaaggggauagggaaagugguuaucaaaccaguccaaggagagcaauguggacaaagagaguguuuuggcuuuaucuggggugucagugucuuguaaggaagaguuuuugaugcgggcagagccuuugauggcggauacuggguguuaaucaugagugacagcaagauggugucuguuaggacagccauuuugaccuaauaaaguccugcucuuaugaccaaagaauuuucuugugaggacuaauaacaaaagcguguacauauuuauauccuuaucugguuuaguacaguguuuuuuuugagacagagucucgcuuugucaccaggcuggagugcaguggugcgaucucggcucacugcaaccuccgacucccugguucaagcgauucgccugccucagccucccgaguagcugggacuacaggcacgcgccaccaugcccagcuaaguuucguauuuuuaguagaguugggguuucaccaugucgaccaggauggucuccaucuccugaccuugugauccgcccgccuuggccucccaaagugcugagauuacaggcgugagccacuguacauggccaguacagucuuuauuaauuagacaaacaucuggucccuguuggcauaaugccuuuuaaaauauaagauagagccuuuuucuaagauaaaauuacuuaugucaagagcacucuauacaguuccccuuucugcacauucuuuccagcaucuguuuugccuaucuuuuauacaaaccauuuuaacuugggugagaugguaucucauuguggguuuuuuuguuuguuuguuuguuugagacagagucuuacucugucgcccaggcuggaaugcaguggcgcgauuuuggcucacugccuccucugccucccggguucaagagauucuccugccucagccucccaaguagcugggauuauagacgccugccaccaugcccagcuaauuuucauauuuuuaguggagacagguuucaccauguuggccaggcuggucucaaacuccugaccccaagugaucugcccgccuccgccucccaaagugcugggauuacaggcaugagccacugcacccgggccucacuguaguuuugauuuauauuucuccagugaucagugauguugagcauuuuuuuaauauaccuguuggccauuuguaugucuucuuucgagaaaugucuuuucggaucuuuugcccauuucuuuuuuuugagacagaaucucacucugucaccuagccucgagugcaguggugcgaucucggcucacugcaaccuccgucuccgucuccugaguucaagugauucucgugucucagccuaccaaguagcugggauuacaggcacgggccaccaugcccagcuaauuuuuuguauuuuuaguagagaugugguuuugccauguugaccaggcuggucuugaacuccugaccucagaugauucacccaccuuggccucccaaagugcugggauuacagaugugaggcaccgugccuggcuugcccauuucuuaaauuggauuauuugucuuucugcaguugaguuucaucuccuuauauauucugguuauucaucccuugucagauggcuaguuuggaaauguuuuuucccauucuguggguugucucuucacuuuguugauuguuuccuuggcugugcagaagcuuuuuagcuugaugaaaucccaguugucuguuuuugcuuuaguugccugugcuuuugaggucuuacguaaaaacccugugcccaaaaaaccugugcccaagaugaguguccuggagcacuuccccaguguuuucuucuaguaguuuuauagguuuugggacuggauuucugucuacaguccuggaguuuugcugcccucacuuugguuuuucacucacuucucugcauggcuuuccaauagcaauagcucccagauagcaagcauggguggguggggggaguauuacaugcgucacuucacuuaauccucauggucugucuacuuauuuucagaugagaaaacagguuuagagaaguugugaucuaccuaaagucaugcacaguuucacucaagugucugacuccagauccgcuugccucuaaucucucauaguaacuuguugacacauuuucuccaguuguccugucuugcuuaaaaagcuguggggaagacucagccuggcucagguaguauuagaccagcagucccugguguggcauacucaguuuuggcauugccuuccugguauguuuuaaagaaaacucaucagaaccuuuguaucuuuuuuauuuuccuugagacagggucucgcucugucacccaggcuggagugcaggcucgaucacggcucacugcagccucaaccuccuggacucaagugauccucccaccucagcuucccaaguagcugggacuacaggugcacaccaccaugcccugcuaauuuuuuguauuuucuguagauacuggauuucaccauggugcccaggcuggucuugaauuccugggcucaagcaaucuaccugcguuggccucccaaagugcugggauuacagacaugaaccaccacaccuggcagaaccuuuguaucuugaaagcuguguaaauacaaucaguguggguaucuuagucccuccuuaucagcgguaguaguuucacuuaccaauggucagcugcgaucugaaacuauuaaguggaaaauucauaagaaauagucaauucauggcugggcaugguggcucaggccuguaauccuagcaguuugggaggcugagguggaccugaggaucaccugaggucugcaguuugagaccaggcuggccaauacggugaaaacccugucucuacuaaaaaaaauauacaaauuagccgggcaugguggugugcgccuguaaucccaacuacuuggaaggcugaagcaggagaauugcuugaacccaggagguggagguugcaaugagccaaaauugugccacugcacuccagccugggugacugagacuccguuucaaaaaaaaaaaaaaaaagaaauaaucaguucauaagucuuaaauuacaugguuuugcagugcuuguguucaugucacccuuauauuuaauaauggccccaaagcaaaagaugcuggcaauuuggauauuguaaagagaagcuguaaaguguuuccuuuuacugaaaaggugaaagaucucaauuuaauauggaaauaaaaaaauuuguaugcugaggcugcuaacgucuaugguaagaacuaaucuucuauuugugaaauugugaagaaggaaaaagaaaguugugcauaauuuauauaggguucuguacuaugcgagguuucaggcauccacuggggggucuuggaucuuaucccccucugaugguggggacuacuauaguguuguuuccuauguucuccuagaguaguagccugaguuuggggaggaagagaaugcccuccucucccucccuuuuuuuuguuaauccgauuaggucagcaguggauguuacuuugauuuuacuggugguucuguuaucagagucuugguuuguuuucuguucuuuggagauagggucucacucugccacccaggcugguauguaagugguaugaucauagcucacugcagccuucaacuccugggcucaagugauccucccaccucaccuuccugaguagcugagcccacagcugcaugccaucaugucuaauuuucuuauuuuuuguacggggggcggggggggucccacuauguuggccaggcugguauugaacucguggccucaagugguccucuugccuuggccucccaaagugcugggauuacagguaugagccacugcacccagccuguuaugacagucuaacugucuaucagguuaauucuaagacaaggguggaagccucuguuacggucuccaguuuauaaaagaaugguuccugcaagauuacaucaaggccggaaggccauuuaggaugcugaaaagauaagcccuaugguuauuuagcaucacaaagggauagguggaguuguuaagagcugucuuccuuuguguucugccucauuaagucacuggguccuuaggugucagggaauauagauugaacgaacagguguguuucacuuuaggagcaagccugggggaaaagggguaccagugacauuuuauguaaauggacccuuuggaguaaugcagcagguuauuguacaauuucuuuuugacuuuuauaucaagccaccugauuuuuugucuucuuuugcuuuccaaaguacacagaugcuccucaacuuucaauggcauuaugucuaaauaaaaccauucuaaguugaaaauauuguuaaauugaaauuacauuuaauacaccuaagauaccaaacgucauaguuuagccuagccuccuuuaaacaugcucagaacacuuaugucaggguacaguugggcaaaauuaucuaacacaaagauuauuguuauuauuuuuuguagagguggggucucaaacaccugcccucaagcaauccuccuaccuccaccacccgaaauauuggguuuacaguugugagucacugcaccuggccuauuuuauuuuauuuuaaaauuuuauuuauuuaauuaauuaauuuuuuugagacaggguuucacuccugucacccaggcuggagugcaguggcgcgaucucagcucagugcaaccucugccuccugggcucgagcaauucuccugcuucagccuccugaguagcuggaacuacaggcgccugccaccacacccggcuaauuuuuguauuuuuaguggacacgggguuugacuguguuggccaggcuggucuugaacuccugaucucaggugaucuaccugccuugaccccccagaguucugggauuauaggugugagccacugcaccuggccaccuggccuauuuuauaauaagguguuaaauaucucauguaauuacuugaauacuguacugaaggugaaaaccagaaugguuaugugaggacuuggagaaguaagugucuacugauugcuuucacagaaagucuaaacauuguuaaauagaagcauuguuaaauugaggacuguauauaugaguuuuuuuuuuugaaacggagucuugcacuguugcccaggcuggagugcaguggugcaaucuugguucacugcaaccucugccucccgggcucaagcgauucuccugccucagccucccgaguagcugagaauacaggugcccgccaccacgccuggcuaauuuuuuguauuuuuaguagagacggaguuucacuauguuggccaggcuggucuugaacuccugaccucaugaucugcccgucuuguccucccaaagugcgggacuacaggagugaacccccgcgccuggcccccuguauauaugaaauuuaaauguaguguugauuguaucaguacauuuuugguuucagucuuaauuuaaaagaauuggacaaauguaagcuuuuaugagccccccagcucaauuuuauugcuuuuuacuuauuuguaaccuucagauaauuuguuuuucccuguaguuuauggcugucagauaaaaaacugaucuggugacaaugaucuggugaaaagcucagcccagaagaacuauaggucugggcuguuaggacuuuuaauuuuuggagagcauguuugcccuguuuuuuuuuuuuucuuuucuuuugcuguuguaauaggcccaucauuuacuuuuuaauuuuaagucuugugccuugaaacucaccuuuguuguuggacacuuucuuuuugaggucgugaugucucgggagucggauguugaggcucagcagucucauggcagcagugccuguucacagccccauggcagcguuacccagucccaaggcuccuccucacagucccagggcauauccagcuccucuaccagcacgaugccaaacuccagccaguccucucacuccagcucugggacacugagcuccuuagagacaguguccacucaggaacucuauucuauuccugaggaccaagaaccugaggaccaagaaccugaggagccuaccccugcccccugggcucgauuaugggcccuucaggauggauuugccaaucuugguaagacccuuuguuguauaguaucacguuuuguucagaaaaacacuuacagaaaguuguauuaccagguggaagguucugauuggaguuguccagguuuuuggcacguugaacaaauaauugaacaucaugcaugaacaagcaaugaaagcauagauuuauugaaguggaaggcaauagaagcuaaaguacaugucacaggaugggagcaggccugagcaaguggcugcagagcccuuguagcaaagucuucugggguucaaguacccucuagaggucucccacuguuuacauccuauguaaaugaagugcuggcucacagcccauuagaggccaaagugaauuggagcucggccauuccaagacugguguggauugacgccuuaugcaaaugaagguccuagaauggacggaucauaggccagagugcaaauucuuccuuuuuuguuuaguuucaggaauuuuuuuuuuuuuuuuuuuggcaacggagucuugcucugucgcacagacaagugcagugacgccaucucggcucggcucacugcagccucugacuccuggguucaagcgauucuccugucucagauuccugaguagcugggauuacagacacacaccaccacaccuggcuaauuuuuguauuuuuaguagagacgggguuucaccacguuggccaggcuggucucgaacuccuggccucaagugauccuccugcuucggccucccaaaguguugggauuacaggcaugagcaaccgugcccaucuauuccaggaaguuugcgugaauuggccauagauucccugccuucagacccuauuuuccugccuuaguuaguugcagcagaaugcuugagccacucuuagaauaauucuggaguuugaaugugauaaaagguaaaaccaaagaggcaguauuggguguugcccuggcuguuaccugcuguggauucuguucauuuacucuuucaacaaauaauaauuggacauuuacaaugugcuguccauccaaagaucugaagguagcuuuggacccucuuccuagaaaaaugcagauucacucaaacuugcaaacauuauccccuaaucacaaaagcuucacuaguuaaccucugcugugguuugccacagcuucagagaaucagagcuguucagaauagagauggccauuuguugacuacuuguuacuuguuuuugucucaaaauagccaaccuugugauuuaaacauguugacccuuucugacaccuccugguuccaauaguaaguuuugcucugcauauguuuaaaauacacauguguguauuuuaacauugccaggcaugguggcucacgccuguaaucccagcacuuugggaggccaaagcgggaggaucacuugaggccaggaguucgaaaccagcuugggcaacauggcaaaacccugucucuccugaaaauacaaaaauuagccaggugugguggcgcaugucugcaaucccagcuacucaggaggaugagacaugagaauugcuugaaccugggaggcagagguugcaaugagccaggauugcaccacugcacuccggccaaaaaaaauaguguuuuuuuuccuuucgcuuacauugcaaugaccucuuuaauaaacaaauuugaacuuggcauuaacaggauagaauauguuaauauaaagaaaugaaggacugauguaucauuuuguguuuugucacucaccauccuuguuuuauuucaugucuaacuuugauaucuugaaaaaacuauaaaaaauggaggaauauaccugcauuccacauauacaacuuuaaauuuauaaguagacacucgaagcuauuuuuaacugauuuaaaauauauuuuucagaccgggcauuguggcucaugccuguaaucccagcacguugagagaccaaggcagguggaucaccugaggucaggaguuugaggccauccuggccaacauggggaaacccugucucuguuaaaaauacaaaaauuaggccaggcgugguggcucaugccuguaaucccagcacuuugggaggccgagaugggcggaucaccugagaucgggaguucgagaccagccugaccaacauggagaaacccugucucuacuaaaaauacaaaauuagcugggcaugguggcgggcuccuguaaucccagcuacucaggaggcugaggcaggagaaucgguugaaccugggaggcagagguugcagugaaccgagaucucgccauugcacuccagccugggcaacaagagcgaaacuccaucucaaaaaaaaaagaaaaaaaaauuugcggggcguuguggcaggcaucuguaaucccacccacacaggaggcugagacaggagaauugcuggaacuugggagguggagguugcagugagcugagauugcgcuacugcagucccgccugggugacagagcgagauuccgucuccaaaaaauaaacaaauaaauaaaauacaauauauuuuuucagauaggccuauagguuuagaugagugagaaauagaaauggugagaaagggcuaaaugggauacaucaccuuuaaaaguaagaaaacaaagaggcugggugcaggggcucucaacuguaaucccagcucuuagagcagcagaggugggaggauagcuugaacccaggaguuugagaccugcugggcaauauagcgagaccccauucuccacaaaaaggaaaaacaaaaaaagacaaguaaacaaagauccugauaggaugaccagcauaaaguaggugcugaauaaauagagacuguuuaucauuauuauuauuauuauuauuugagacggagucucacucugucacccaggcuggagugcagugguacgaucuuggcucacugcaaccucaaucuccuggguugaagccauucuccugccucagccaccugaguagcugggauuacaggugcccaccaccguggcuaaguucuguauuuuuuaguagggacggguugucaucauauuggccaggcugguuucaaacuccugaccucaggugaucugcccgccuuggccucccaaaguggugggauuacaggcgcgagccaccacgucuggccgaggcuguuuauuauuauuauuuguuaauuauuuauaccuauguuuucuuuuaaaauuuuacaguuuuaauuccuuuuuuuaaauuuuuguuuguuuguuuguuuguuuauuuugagacaggaucucacucugucauccaggcuggagugcaguggcacaaucucagcucacuucagccucugccucccaggcucaagcaauucucccacuucagccuccugaguagcugggaccacagaugugcaccaccacucccagcuaacuuuuuguauucuugguggagaugggguuucaucauguugcagucuggucucaaacuccugagcucaagcaauacauccaucuuggcuucccaaaguguuaggauuacaggcauaagccacagugccuggccuaguuuuagcucuuauguuuaauuaagguccuuuauucauuuuaaguuuuauuuauuuauuuauugagacggagccuugcucugucaccaggcuggauugcaaugucaugaucucggcucaccgcaaccuccuccucccgguuucaagcgauucuccugccucagccucccaaguagcugggauuacaugcuuaugccaccaugccuggcuaauuuuuguauuuuuaguagagaugggguuucaccauguuggccaggcuggucucgaacuccugcccucgggugauccacccgccucggccucccaaagugcugggauuacaggcaugagccaccguggcuggccuaacuuuuuuauuuuuauuuuuuguagagacagagucuggccauguuacccaaucugaucuugaacuccugcugucaucugauccuccugccucagccucccaaagugcugggauaagaggugugaggcaccauccccggccaguuugcagucuaaguaugauguuagcugugggucuuucccuuucccuuucucuuucccuuuuccuuuuccuuuccccuuuccccuuucuuuuuuccuuuccuuuccuuucccuucugcuuuccuuucccuuccgcuuuccuuuccuuucccuuccgcuuuccuuuccuccccuccccuccucuccucuccucuuuucuuuccucuucucucuccucuucucucuuccucucuccuuucuccucugauaucugaagacuaagcuguggauguuucauaaaaguucuuucuggggugggugcaguggcucaugccuguaauccaagcacuuugggaggcugaggugggcggaucacaaggucaggagaucgagaccauccuggccaacauggugaaaccccgucucuacuaaaaauacaaaaacaaaauuagccgggcgugguggcaggagccuguauuuccagcuaguuggugauagagugagacucugacucaaaagaaaaaaaaaaugcuuucuggcugguugcucugacucuuucacccuauaaucucagugcuuugggagccuauggcaggagaagugcuuaaggccacgaguuggagacugcagcaagcuaugauugcaggccacagagcaagacuuugccucuaaauuaaaaauaaauagauaauaaauaaaauaaaagcucuuuauuagguugaaggaguuuacuccuauuccuaguuuucugaguauuuuuuguuauaaaaggguguugcauuuugccaaaauuuuuuucugugucuauuuuccuauauucuauuguuaucguguauuauauuaauugguuuucagauguuaaaccaaccaagcuuuccuggguuaauucuuuuuuuuuuuuuuuuuuuuuuuuugagauggagucucgcugucgcccaggcuggagugcaguggcgugaucucggcucacugcagggucugcccccugggguucacgccauucucuugccucagccucccgaguagcugggacuacaggcgcccgccaccucgcccggcuaauuuuuuguauuuuuaguagagacgggguuucaccguguuagccaggauggucuccaucuccugaccucgugaucgcccgccucggccucccaaagugcugggaauacagaugugagccaccgcgccuggcguccuggguuaauucuuguuuggucauuuguaaucuuuuuuauguguugcuggauuuaguuugcuacuguuuuguugaggauuuuuauaucuauauucacaagggauauugguuugugguuuuacugugaugucucugucugguuuugguaugcuggccucauagaugaguugacaguguuccguuccgaauuucuucgaaaaguuugagaauaauugguauuaguucuuuacauauuugauagaauuuaaaaugaagccagccguguguuucuuuuuucuuuuuuuugagacagggucucacucuuacccacgcuggaguguuacccacuaucacguuucacugcaggcuugaccucccaggcucaacuccuaccucagccuccugaguagcugggaccucaggcaugugccaccauguguggcuaauuuuuuuauuuugauagagauggggugucccuauguugcucaagcuaaagugaggcaaucugggacugcacuuuucuuuguagggauauuuugauuacucauucagucuuuuguuuuguuuuguuuuuuuggagacagagucucucucucugucacccaggcuggagugcaguggcacaauauuggcucacugcagccucugccucacagguucaaacgauucuugugccucagccuccagaguagcugggacuacaggggcgcgccaccacaccuggcuaaauuuuuuuuuguuuuguuuuuaguagagacgggauuuugccauguugcacaggcuggucucaaucuccugaagucaagcaauccgccugccuuggccucccaaugugcuaggauuaucauucagucuuuucacuucuuauggguauauucagauuuucuguuucuucuuguguuaguuuugguaguuuguaucuuucuaggaguuuguccauuucaccuaugucaucuaauacugucacacaauuguucaauuauucuuuuuaaaucauuuuuauuucugucagaucaguaguaauuaucucucucauucuaauuuuaguaauuugagucuugucucuuuuuuucuuguucagucugucuaagguuugccaacuuguugaucuuuuuaacuaacuaaauuuggauuuguuaauuuucuuuuucuuucuagagauagggucucacucucacucuggagugaguggugcaaccacagcuuagugcagccucgaccuucaggcucaagugauccuccuuccuuggccucccaaaguacugggauuacaggugugagccaucgugcccagcccauauguaauuuugauagaucuugcuaaauuguccucccuagacaauuauagacaauguguguauaaauuauauucccaauggcaauguaugagaguacccgcuuuuucauaccucuugccagcacagggugauaugaaacuuuuggauuuuugccaaucuaauagguaaaacaugaaaucuuaauguguuuuugauuucugaauuuucuuauauuggguuagcuuggccaccuuucauauguuugagccagcuguauuucuguuucuuguaaauuaucuuuucauauccuuuaccuauuuuucuacuggacuguuuagcguuuucacugauuuauaggaaccuaacauuuauuagggaaauuauuccuuuuccugauaggaguugcuaguauuuucccuagucugccuugcaaugaacauuuaauuaccugccaugugcaauaucccaagugcuggaguuguacuguuaaacaagaggucuccagcugcccuccuggagguuauguucuaaugcagggagguggggagaaaauauacaaauaagcaagguaauuuccagccguggcccauacccaaaaagauauaaaacaggauaacauuaugauaacaggugaguaauguuuauauaacaagcugagcgggaggccgggugugguggcgcaugccuguuaucccagcacuuugggaggccgaggcgggcggaucacaaguucaggagaucgagaccauccugucuaacauggcgaaaccccgucucuacuaaaauuacaaaaaauuagcugggcaugguggcacgugccuguagucccagccacucgggaggcugaggcaggagaaucgcuugaaccugggagguggagguugcagugagccgagaucgcgccaccgcacuccagccugggcgacagagcgagacuccaucucaaagaaagaaagcugagugggagaugauaguagaguccuaaaggcagauaguguuguguagauaguaucuguuauacaaaaggcaagguggaaugagccauuuguguaguuggggaagaagugcuaagaccacaaggcagauugaacccagcauucuugggggcagugaaaggaggccaguggugcugggugucaugagcaaggggagagggguaugagguggggcuggaaugguggcagacgccagacccugagcaucuaguaggccaugaggaagagugcagauuuuaugcuaagugucauggaaaaccucaggaagguaauaagcaggaaauuacuguauugcaaguaauuuuccaagucauuaaaaauuacucgagaacuuuuaaugacuauuuguuauuucacgguuuuauauauauauguauguguauguguguguuuguguauauaaauacauauauuaauagauuauaauauauauuauauauuauuauauauuuagauauaauuacuauauuauaaauauauaauauauguuauauuguguauaaauauauaauuauauuuaagacaacuuauaaaauaaauuuauauaacauguauaauaaauacaaauuauauauauuauauauaauaaauauaaaauaaauauauaauauauauuaaauauuuguuuauuuauuuuuuugagacagggucuugcucuguugcccagguuggaguacaguggcaggaucacagcccauuguagcaucagcuuaucuugcucaagugauccuccuccuucagccuccugaguagcuggacuacaggcaugcaccaccacaucugguuaauuguuuuuuguuuuuuuucagacagagucuugcuuugucguccaggcuggagugcaguggcgcaaucuuggcucacugcauccuccaccucccagguucaagcaauucucugccucagcuucccgaguaacugggauuacaggcacccgccaccacgcccagcuaauuuuuguauuuuuuaguagagacaggguuucaccaucuuggccaggcuggucuugaacuccugaccucgugauccauucgucucagccucccaaagugcugggauuacaggcaugagccaccacaccuggccauuuuuuuuuuuuugaaacugggucucacucugucgcccaggcuagugugcaguggcgcagucucagcucacugcagccucgaccuccugggcucaagcgauccucccaccucagccuccugaguagcugagaccacagggacccaccaccacacccugcugauuuuuuauuuuuuguagagauaggguuucaccauguugcccagacuaauuuuuaaauucuugguagagaugggugcccccuauguugcccaggcuggucaugagcuccuggggucaagugauccuccugccuuagccuuccaaagggcugagauuacaggugugagccacugugccuggccaugugguuauagauaaacugccauuuguuaaacucauugguaauguuguuuuuucucuccuaauuuuuaaucuuguaaaaucuugauaagcagauugauaauucugauugccuucuuaggcuauuuuccuacaauuagcauuuaugagcaauuuuuaaacguuugauacaugaaauucaacagcccucugaugcaugcuuuuauauuacagaaugugugaaugacaacuacugguuugggagggacaaaagcugugaauauugcuuugaugaaccacugcugaaaagaacagauaaauaccgaacauacagcaagaaacacuuucggauuuucaggguagguaaugaauacccauguaucuaggagagcugguaauuuggucauuguuuuuagauauuuucccacuauaaaucucugcuauucaaagucugaaacaaaauguucucuauuuuaggaaguggguccuaaaaacucuuacauugcauacauagaagaucacaguggcaauggaaccuuuguaaauacagagcuuguagggaaaggaaaacgccguccuuugaauaacaauucugaaauugcacugucacuaagcagaaauaaagguaauauuauuaucuuaugguuacuggaauuuuuuuuuuccacucucucauaggaggaaaauuuguccuguccuuacagaauaugguuuaagugaguaaagaugaguaaguugcugggcgugguggcucacaccuguaaucccagcacuuugggaggcugaggcggauggaucaccugaggucaggaguucgagaccagccugacccacauggagaaacccugucucuacuaaaaauacaaaauaagccgggcaugguggugcaugccuguaaucccagcuauucgggaggcugaggcaggagaaucgcuugaacccgggaggcagagguugcagugagccaagaucgugccauugcacucuagccugggcaacaagagugaaacucugucucaaaacaaaaaaaaagaugaguaaguuagcacucaagauucaacuuugccguccuaguugcauuguaaaauuaugaaaaaguuccauccagacagauuuuuaagguuuuaagguuuaauugguuuuauguaaugccauauacuguuuuuuuuguuuuguuuuguuuuguuuuuuuuuagacggagucuugcacugucaccugggcuggagugcaguggugcaaucucggcucaccgcaaccucugccucccaguuucaagcgauucuccuugccucagccucccaaguagcugggauuacaggcuccugccaccacacccaucuaauuuuuuuguacuuuuaguagagacgggguuucacuguguuggccaggcuggucuugaacuccugaccucgugaucugccugcuucagccucccaaagugcugggauuacaggcgugagcccccgccuggcccauauacuguuaauugaauuaucauggugauuaaaauaaguuauaguucauugauugauucaguuuauaccacaucagucuuagauaucuaugaauuguuguuucaggccauuaauucauuuuuccuuccucuucaccucauucuuuccuuucuucauuuuuuccauucauuuuuuucuuucuuucuuuuucgagacauggucucacucugucucccaggcuggaguucaguggcacugcaaccucugccucccaggcucaagugauccucccaccuuagccuccugaguagcugugaccacagacacaugccaccacgccuggcuaauuuuuuguauuuuugguagagacgggguuuuaccauguuggccagacuggucuuagacuucugagcucaagcagucagucugccugccuuggccucccaaagugcugggauuacaggugggagccaccauguccagcccuauucauuuauuucuguauacauuuauugagcuccuuuuuuuuuuuuuucuuuuuuuuuccuugugacggagccuugcucugucgcccaggcuggagugcaguggcgcgaucucggcucacugcaagcuccgccucccggguucacgccauucuccugccucagccuccccaguagcugggacuacaggcgcccgccaccacgcccaccuaauuuuuuguauuuuuaguagagacgggguuucacuguuuuagccaggauggucucgaucuccugaccucgugauccacccgccucggccucccaaagugcugggauuacaggcgugagccaccgcgcccggccuauugagcucuuuuuauaugccagguacuaggcugugagugcuucuguaagaggcucacuuuagagcuucuaccuuuguaaauacuacaagguuaucgugcacaaguggagauguuuaucagccucaucagguagcauuuuauaagcauccauuucugaaacuaugaaaauaacaucuaaaaugaacaacuguuuuucuggguaauaucuagaaaggauaccugacaaaaacaaccaauagaguuaaaaguagcucagcgugauuagacaggaggaauacaauuuuucuuuaguuaaagaaaccauagacguucccaaacuuaucugagagucgaaugacuuggagggugucuaugugugugcgacacauuuugaaaauaaagguucauauaagcacucuucuccagauucugguagggauuuuaaaaaucaugccucuaggggcugcggcaugagucuguagucccugcuacucagaaaggugaggcuagaggaucccuugagcccaggauuuuaaggcuacagugagcuaugauugugccuguaaauagccacugcccuccagcucgggcaacauggugagaccccaucuaaccaaacaaaauaaagucaugccuaagggauuuucaugcaagucagucuucagucugguaucuuggaacuaugucuauguugggcauccuaaaguacauuuuaugauuaacuuaguuuucccuguuucuauuuugacuauuuuguuuucuuuucuuuucuuuucuuuuuuuuuuuuuuuuuuuugagacggagucuggcucuaucgcccaggcuggagugcaguggcaugaucucggcccacugcaagcuccgccuccuggguucacgccauucuccugccucagccucccaaguaguugggacuauaggcgcccgccacugcgcccggcuaauuuuuuguauuuuuaguagagacgggguuucaccguguuagccaggauggucuccaucuccugaccucgugauccuuccgccucggccuuccaaagugcugggauuacaggcgugagccaccgcgcccggcgaccauuuuguuuucuaucugacaguuauagucagggcagcugcuuuagguuuugcuguuuguggguaccuaggggaggaggcaacugggugcugaaauuuggucuguccucuccuugacaagcugugugccaccuucucauuggucuacucaaagggcacuuuucuuccucuuuuaaaaaaauuaaauaaacauuaaaaaauuuauuuaauagauaaauaaaaauuauaggcuggcgugguagcucaugccuguaaucucagcacuuugggaggccaagacaggaagauugcuugaguccaggaauucgagaccagcuugggcaacauagugagaccccaucucugccaaacauaaaaaaauuagcugggcaugcugcuguguuccuguagucccagcuacuugggagucugaggugggaggauugcuugagccugggaggucgaggcuacagugagccaugauugcaccacuguacucuucccugggcaagagaguaagaacgugucucaaaaaaauuauauguauuuaucauguacaacauguuuucaaauauguauacauuguagaaugacuaauuugagcuaacaugcauuaccucacauauuuaucuuuuuuuuuuuaauagagaaaauacuuaaaaucuacucucucagcugauuuucaaaaauacggcggggcgcgguggcucacgucuuuaaucccagcacuuugggaggccgaggcuggcagaucaccugaggucaggaguucgagaccagccuggucaacguggugaaacucugucucuauuaaaaauacaaaaauuagccgggcaugauggcaggcgccuguaaucccagcuacucaggggucugaggcaggagaauugcuugaauccaggagguggagguugcagugagccaagauugcaccauugcacucuagccugggguacaagagcgagacuucgucucaaaaaaaaaaaaaaaaaaaaaacccaaacaaacaacaaacaaaaaacaguacauuguuguuaacuacaaucaccauguuguacaauaaaucucuguuuucucuaauuugaacaaagaugucauauaggcuaaaggugacccuuauuaaaguaggucagacugguccucugcaggcugcauuuggccuauagauauuuuauuaggcauuuacugauacuuacagugguaaugugaacauccagaugucuuagagaaguuguaauauguggccacagugagucuauagucccacaaccggaggaucuguaggcacugaguagaggcugccuccuuuagaugggagguguguuuucucuccccacuucuccauggugucuuaaacucaacacagccugacccuguuacauuaccuuccugacuuguguggacaauggcguuugagcccuugaaguaaaccuugacaggagaaauacaucaugagagccaaucaaauuucuacauucucagaugccacuggaacauacagcguuaugaauagcuacaagcauagagggacacuugugccuggguggccagcaggugucugucaccagacaagugccugccucuuguguaccagccugaaugaaauauacucagguggcucagauuugugccagagacuggauccuuagguuauucuagggaggucaaaaccugucaccugagaucugagaaacucaagggucuuaacaaauuucaccuuucaagauggcauaggcaauugcaaauuuaucauugaugacuuuguagaauugaaauauuugauaauuuaucacaggcuuggcccacgugggugguuaaauuauuaaaucaucagcacuguccuggguuauagaauuuaaaaaguaguuguuuuacuuuuuuuuuuuuuggcugggcacauuggcuaacuccuguaaucccagcacuuugggaugccaagguggguggaucaccugaggucaggaguucgagaucagccuggccaacaugguaaaaucccgucucuacuaaaaauacaaaacuuagccgggcauggugcuguucgccuguaaucccagcuacucaggaggcugaggcacaaaaauugcuugaaccugggagguggagguugcagugagcugaggucaugccacugcacuccagccugggcaacagagugaaacucucucaaaaaaaaaaaaaaaaaauuacuuuuuuuaagauacagcccaaauaauggagaaaaaagggaauuuguuuagaaaauguuauuuaccuagcuuuacaaauauguugaauaugguuugcacuauaaaauacuuaauaccggauauauaaagguauaaauggcugagagaugauaauacccguauggugauacugauggccuaauuuucauugggauauuuacuugccuagaccauuuuuucuaggcucagacugauggauugcuuuuugauucugggccuguuguaaaucugcaugggcauuuuauauuaguguaauugauugauauucugaggucaaggaauauaaauaauguuguguuacggauuuuuugcacuaguuucagagugaugcuuauaguuccauugaagcaugaaauuugacuaucauuuauuucucaagggcuuuacaauauguauuagcccacuaauaccuauuauauuacauacauacuaauuuccuuaagguuacauguuaaauguaguuaaaaacaguucuuauauuccauaugaugaauaaauuuuagaaucagugaucgccucuugugaauaaauuaaugaaacccauuucuacucuuuucuuccuuaguuuuugucuuuuuugaucugacuguagaugaucagucaguuuauccuaaggcauuaagagaugaauacaucaugucaaaaacucuuggaagguaaauuauuuucuuauauaaaugcacuuaauuuuuucacuauacauuugugauuggugguuucucauuucugauuuuauaacacucauuauguauugauaacauuuguaugguaucuauuuguguauuauuuuuuauuuuuauuuuuguguguuauuucacacagucauuuuaauuuauuuuuauuuuauuucuuugugagacaggguguugcucuguuacccaggcuggaggguaguggcacgaucagagcucacuguggccuugaucucccaggucaagggagaucaggcaugcagcaccaugcacaacuaauguguguuuuuguuuuuuagaguugggguugcgcuguguugccagggcuggucuugaacuccugggcucaacccauccuccugccuuagccucccaaagugcugagauuaguagcgugagccaccaugcccagccaaauauuucuuuuuuuauuuccuguguguguguguguguguguguguguguguguguguguuagugucagagucuugcucuguugcacaggcuggagugcagugguacgaucuugacucacugcaaccuccacuuccagggcucaagugauccucccaccuuagccucccaaguagcugggacuaugggcuugaaccaccgugccuggcuaauuuuuguauuuuguguagagaugggguauuaccauguugcccaggcuggucuugaacuccuaagcucaagcaauccacccaucucggccucccaaagugcuaggauuacaggcaugagccacugugccuggccauguguauaguauuucauuguguauauauacaccacauuuacuuuguccguucauucauuuauggacacuuugguugcuucccuaucuuggcuauugugaauaaugcugaaaugaacaugggagugcagauaucucuucaacauacugauuuaaauuuuuuuuuggauauauauccagaagugggauugcuggaucauaugguaauuacaauuuuagcuuuuuggggaaccuuuauacuauuuuccaaaauggcuguacuaauuuacuuucccaccaacaguguaccaggguucucuuuucuucacauccucuccaacauuuguuauuauucaucuuuuugauaauagccauucuaacaggcuucaggugaugucauugugguuuuaauuugcauuuccuugauggcuagagauacugagcauuuuucauacaucaugauaggugcauuuuugauguguuugaggugaaauuaacucuuucgccucacgaauuuuauuggugauaacuuuuuuuucuuugagacggaguuucacucugucacucagacugaggugcaguggcgugaucuuggcccacugcaaccuccgccucccggguucaagcgauucuucugccucagccuccugaguagcugggacuacaggcuugcaccaucacagccggcuaauuuuuacuuuauuuuauuuuuuugagauggaguuuuguucuuguugcccaggcaaugguguggucucuuguugcccaggcaauggugugcaaugguguggucucagcucaaugcaaccucugccuccuggguucaagugauucuccugccucagccucccagguagcugggauuacaggugcccgccaccacacacccagcuaauuuuuuuguauuuuuaguagagaugagguuucaccauguuggccuggcuggucuugaacuccugaccucaggugaucugccugccucggccucccagagugcuggauuauaggcgugagccaccacucccggcccuaauuuuuauuuuuuuuuuuacuguagagaugagucuugcuguauugccuaggcuugucucgaacuccugggcucaaguuauccuccugccucagccucucaaaauguugggauuacaggugugaaccacugcauuuugccaagacauuuuuauauuaauucauuagguaaauuuacuacauguuaagaugaguuacauuuauuuuuuucuucuugagauggagucucgcucugucacccaggcuggagugcaguggcacgaucucagcucacuucaaccucugccucccggguucaagcaauucuucugacucagucacccaaguagcugggacuacaggccugugccaccacacccagcuaauuuuuuguauuuuuaauagagaugggguuuuacuguguuagccaggauggucucgaucuccugaccucaugauccgccugccucggucccccaaagugcugggauuauaggcaugagccaccgcgccuggccugaguaacauuuuuuauaaaaaauaauuauuaaaaagauuagugagaagagaggcacuguucaacauuuuugcaaaauuuuuuuaacaucuggcuuaguuagaagauggcuagauucuguaauuuguuucgucauucagucuguuauguugucacacgccacguagugucuggaaaucuccauacuuaugagcuaaugagaauggaaaacacaaauaaugucuuaguauuauucugagcauaguuguggcuuuguggaugcccugcaaggucuugggguccuuuuggggugauccaaucauacuuugagaaccauuucuuuaggaaaguaucaggauacuguuaccacauuacaaaauguucuucaucccccuuccugucucacaaaggucuuucuacugauauuuuuggaaacauggaaggaaaguacauaaaaggaaauaaucauccauauuccugcaacauaguuaagcacaguauccucuguauuauaugggagaaauuuuaguuuacugauacugaauucaguaacugauguguuuccauauuugcacugguugcuuggaaucuaaccgucaaacccuuucuuaagaaauguaugggcugggcacgguggcucacaccuguaauccuagcacuuugggaggcugaggcggguggaucaccugagguuggggguuugagaccagccuggccaacauggugaaacccugucucuacuaaaaauauaaaaauuagccagguguggugacgcaugccuguaaucccagcuacuugggaggcugaggcaggagaauagcuugaacccaggaggcggagguuguagugagcugagaucacgccacugcacuccacccuuggcaacagagugagacucugucucaaaaaaaaaaaaaaagagaaaaaagaaaaaagaaauguaugaggcuggguaugguggcucaugccuguaaccccagcacuuugggaagcuaaggcagguguaucacuugaguccaggaguucaagaccagccugggcagcugggcaauagagaaauccugucucuagaaaaaauagaaaaaguuagcugagcguugcggucugcaccuguagucccagcuacuuggaagguggaggugggaggauuaccugagcccaggagguggaggcugcagugagccaucaucaugccacugcauuccagccugggcgauagagugagacaaugucucgggaggaaaaaaaaaaaaaagaagaagaaauguauggaauucaauguuuuccuaagggaagauuuaauaugaauucucuaacuuguagcaaaugauagaaacucaacucaaaugagucagguaagagaaaaaauuuacuggcuuuuguaacugggaaauagccaggccgggcauaguggcuaacgccuguaauccggguacuuugggaggccgaggcugguggaucacuugaggucaggaguuugagaccagccgggcugacacaguaaaacccugucucuacuaaaaauauaaacauuaacugggugugguggcauaugucuguagucccagcuacuugggagguugaggcaagagaaucgauugaacccaggaggcggagguugcagugagccaagauggcaucacugcacuccagccugggugacagagcaagacccugucucaaaaaaauaaaauauuaaaauaaauaaauaaauaaauaaaaauaaaaauaagcaggcaaauccuuacuucaggcauggcuggaucuaggaggucauuaggcuuuacuucauggucuuugaguucugauggucugguugacugcgucuaagagcuccugcagugucaccagggcucuagcuccaucucuugauucagcuguuuguuggcuuccuauagaauuguucucucuaugugguaggaaaaauggcuaccaggggcugcagaaugauauuuucuuugucuagaaacuacaacagagagaagucugucucccaaugucagcauuugauuucaagggcaacucuggcuguagguaugaaugaaugacaggguguugcucugugucucaggcuggagugcgguggcaugaucauggcucacugcuccagcucaguuuugguuauguagcuauccuguguuucuaggaguagggguugugccauaguagacacccagcuagagcugcacggacuuggggaggaauucccaggcaaagggugacuguuuccaggagaagggaaauuggaaagugcuuugagcugauuuuaaaaagaauaguuacauggacccuuaccucauaccauacauaagaauuaauucaaaguggaaccaagaaugaaauauaagagguaaaacuauacaacucugggaggaaagcauagggacagcucuucaugaccuuguauuuggcagugguuucuuacauaagacaccaaaagcacagcaacaaaagaaaaaauagauaaauuagacuuaaucaaaauuaaaaacuuuugugccucaaaagauaccuaucaauaagugaaaacaaaaccaacagaaugauuaaauauuugcaagcccuauaucugauaagggcuuaugucuagaauagauaaagacaucuuagaacuguacaauaaaaaaacaaacaaccugccauuuaaaaaugggcaaaggcacugcacugcagccugggcgacagagugagauccugucucuaaaaacaaaacaaaacaaaugggcaaagggcuugaauagacauuucccucaagaacacauacaauggccaaaaagcacaucaaaagaugcugaauaucauuagucauuagggcaauacaaaucaaaaccacaaugagauaccacuucacaccuaccuacuaggcugaccauaauaaggaaacagaaacuaguaacuguuggugaggauguggagaaauuggaacccccaugcacugcuaacgggaauguaaaaugauguagccacuguggaaaauaguuuggugauuucuuaaaaagguaaacaucugagcucuauggggcauaaaaaacaacaacaacaaacaacaacagaaaaagguaaacauagaauuaucacgugacucagaaauucuccuucuagguauauaaauuccccaauuuaaaaaacaaguguccaggcugggcacgguggcucacgccucuaaucccagcacuuugggaggcugagguggguagauaaccugaggucaggaguucgagaccagccugcccaacauggugaaaccccgucucuacuaaaaauacaaaaauuaguugggcgagguggcacacaccuguaaucccagcuauucaggaggcugaggcacgagaauugcuugaagccaggaggcagagguuguagugagccgagauugugccacugcacuccagccugggugacagaucgagccuauaucucaaaaaaaaagcaaacaaguguucagacaaaaacuuguacauguggccgagugcgguggcucacgccuguaaucccagcacuuugggaggccgagaugggaggaucacgaggucaggagaucaagaccauccuggcuaacacagugaaaccccccucuacuaaaaauacaaaaagauuagccgggcgugguggcggguaccuguagucccagcuacucgggaggcugaggcagaauggcgugaacccgggaggcggagcuugcggugagccgagaucacgccacugcacuccagccugggcgacugagcgagacuccaucucaaaaaaaaaaaaaaagaaaacuuguacauaaauguucauagcagcuuuagucacaaugaagaaguauaauuuaucuauuguuuuucuuuuguugcuuaugcuuuuguugucauacugaagaaaccauuuacaaaagguggaaacaaaccaaauaaauguccgucggaaggugaauagauaaacugugauacuuccauauaauggaauauuauucagcuguaaaaaggaaugaaguaccacaaauguuauggcauuacgcuaagugaaagaauccagacacgaaaggcuacauauuguaugauuacaucaauaugaaauauucagaauaggcaaaucaauauuuagagaaaguagauuagugguugccaggggcugggggcugagugcuggggacaggguagagugaggagugacugcuuaauugcuuaacagguacaggguuuccauuugagcuaaugagaaaguucuggaauuagaugcugaugguuguagaacauuggcaaauguacuuaaugcuacugaauuguacacuuuaaaaugauuacagugguaaauuuuguguuauguauauuuaacacaauaaaaaagaugucuugguaagccccucaacucaccccuucaaaacccacaauaguuauaauagucuacuucauaauggguaauugaugcccuaguagccauuaucuugggcugacccaagcuuuggaggacagauccuacucaggauuaacuguguucuggguaauggcuuggagagcauuccuccuccaugaguaguaucccauuuaacugcaaaucucugugagagguugcugaaaguaggcugauuguguaauacguuugguuucuuagguaaucugauuugauuuagggugcaacuuaugucaucaacugcuuaugcacuuccuuugaagauggagaauaagaaggaaagaaauuuauccauuaaaguuauucauuugcagauucuguuuaccguuauuuguuuguuuugggcacuuauuuuugaccagggaggacuguuucuaguuaauguuuuucugaccucucggauacguaguuucucucucauuuuucucuuaguaucuuucugggaauuucacaauccagggcuacaguaagacccauguuuguauugcugggcucagaaauggaauuuggagcugacuuaguguuuuuggcuguuaagcccuugacauuuuacacuggugaaguuucacuguguccucugcaaacagggacaauggaaaggcuguuauauggaaugucuguaaauucuaauacuugaaguggacccaggagugguaggucucauaauuaaaaacauucagacaaucacuaucuuuguuuuucccucuaguggugccuguggagagguaaagcuggcuuucgagaggaaaacauguaagaaaguagccauaaagaucaucagcaaaaggaaguuugcuauugguucagcaagagaggcaguaaguaccaauaaaaggcugaucaccuuuuauuaacacgucuucauaacuucccaaaauaaucuuagauugaugauuuuuaaacucaggaauaacccccugcuuagauggaugaauuugugaguaucaaagaacauggaaaauuuuggggcaucuuugauuaaucuagaaacuuuuacuuauagauaauuugguuccaaaaguauuuaauuguacauaauaaugagcauagugggaaguuuuuuuuuuucuucuuccaaguucaaagucguuacaagauuguuuuuacaauaaaugacaggaaauuagagaaaaaaauucagccauaauccccacuguaaccccacagcuguuuucaguuuuccuuuuccuucuagauuuuguucagaugaaaucguguuuuuagaugguugaaaucaucuuguauauacaguuuuguauuuugcuuuuccacaaaugcauuauagcauagacuuuugccuaauacauccuuuuugaugacugaguuuucaugucaucaacuuuauuguaauuuacuuaaccauuucucuggcugaucauuuagguaauuucuuauucuuugcuguucuggguaauauggcagugaguaucccugguuuauggauuagccauagauuuuuaaaauuuuaauuaaaucauugaaauagccuuucuuuauagcagccauuuauuuuacuacucuuuuguaaucaacauuuacuguaugggagagauggccaaaugcauuggucuuuccacaugugacucaacaaaguaauguaaaacacagccucuaaucacauuuucccuaguggccagcuguuucuggcuauuauacuuucacauucuuuaaagaucaauuuuuuuucccccuagacaaugccauucucacauggcaagaggaauuuccuuuuuguguucacuuuguuauagaucuuuuccccuaugauucuaagauuuguuucccauuuuggggagaagaaaauaccaacuagauuguuaaaaacugggaguaaaauuuuacguuuugauuucauuauuugaaucagauuggaccuuugugaccauccuguuaucagaguauacccugacuugguaaugaguuuagcggcuuacaggaagaggcaggcucuuaaaauuaaacaucuggguuucuuagcugaaguucauuuuacauaaauauguaauucuaucuccucuuugcuuguggaggguguagcccaggaagcugaguuacuugauucauccuuuuggaauuguaacagaacaacuuuaguacccugaagccuccucuugucagagucucaguaaauaugcgaggcugcuguugaaguuggaaccuguaucugcucuauuagcagaaauuugacuucacauuuucuuuauauaguuuaauugaacaccuucuuguucauguuuuuuguuuaucauuuuaaugaauaaaaauaguuccauagcuaauaaguaggguuuacuaauuaaaaugaacacaguggaaacacacuuguuucugacuguggagacuagggcaaguggcuucuguuuucugagccuugguugccccaucuguaagauggggauucugaggcuuaugagacaugaucucuguaaauaaagagcuuggcacagggccuggccauuuauugagugcuuacuauuugccaagcauuuuacaaaguuauuuuaggugagguauuuaagucauugaccugggcuuugauuucuuuguauaaguagagcuggguuuggaacucaggcagccuugagucaacugaguuuaacuguaaauguuuuuuuaaauauuggcaauuauuauuacuaauaaacucuguuauucuguuuaucaaaggacccagcucucaauguugaaacagaaauagaaauuuugaaaaagcuaaaucauguaaguauuauuauaugacucauacuuagauuuaucuaucucaaaauaugagaagaguauaaagccuuucaguauaauaaagauaauauuggccaggugugguggcugaugccuguaacccuagcacuuugggaggccgaggugggugaaucaccugaggucaggaguuugagaccagccuggccaacauggugaaacccugucuacuaaaaauacaaaaauuuagcugggcaugguggcacaugccuguaaucccaacuacuugggaggcugaggcaggagaagugcuugaaccugggaggcagagauugcagugagccaagaucgcgccacugcacuccagccugggcgacagagugagacugucucagaaaaaaaaacaagaaaaauuaaaagaauaaauaaagcuaauauuaaccuggguucuuuaacuuauguguacauucacacacaugccuagcugucauuuagcugggaagaguuuuaccccaaaauguuacugagugaacaauaccguauaaagauuucaugauuaaauaaacaaaugauauuucuucugaguuaguucuugaccaaaacauauagcaauuauucuaucucauagacacaacugguuauauuagagaagacaguguuaauuuuaguaaauuugguuuaguuauaccugaaguuuuaccacuuuugaauaccuuuuauuuggaguaauccaaauaaauccaaggguauccauuaaguaugacaacauccuguccuuauaucugauuaaauggugucuguggccuaguucuuaucuuuuugugcaaugaugacuaugucucaaugaaaaaugugucucacuuuuaaaaagugagaagaaaaauuagagggugggcuuaaucuuaucuugcuuuuuuuuguuuuuuucccguuucuuccuuaauucauaagugcccaugaaggcauaagcucauuaggcaauggcauuaaacucaaggcaagaucucucuccuguccagcuaaugaugaucuuauucuggcauuuuuuuuguuuguuuuuuuuuuuuuuuuuuuuuugagacggaggcucgcucugucacccaggcuggaguacaguggcgcaaucucggcucacugcaagcuccaccucccggguucacgccauucuccugucucagccucccgaguagcugggcacaccaccacgcccggcuaauuuuuuguauuuuuaguagagaggggguuucaccauguuagccaggauggucucuaucuccugaccucgugauccccccaccucagccucccaaagugcugggauuacaggcgugagccaccgcgccuggccuuauucuggcuuuuaaccucgaaacagcaaaaagguuucuucucucuuuuucuaccucuccaaaucccucaaaaaagucaguagaaacugaggagcaauuacuguuguugacacaauacuucagcagguuccuuuagaacucugugaguggaccugaaaaccuaugagaaccugaguggcugaccuuccugcuuggcuuucuucuguuucuuuugcaaauuauucguccucucugaauuugccagguccuuuuuccaagagauuuggagucucucuuuaacacacacacacacacacacacacacacacacacacacauauuuuuagagacagucugucucuguuacccaggcuucaguguaguggcacaaucauagcucacugcagccucaaacuccugggaccaagcgauacuccugccucagccuccugaguagcugggacuauaggcaugugccacaccauacccugcugggagagaggagcccuccaauuuucuggggugggguugcaucagaccuacccuuaagauaaacacaaaugcggugggcgcgguggcucacgccuguaaucccagcacuuugggaagccggggcggguggaucaugaggucaggagaucaagaccauccuggcuaacacggugaaaucccgucucuacuaaaaauacaaaaaaaaauuagccgggcgugguggcgggugcguguagucccagcuacuggagaggcugaggcaggagaauggcgugaacccgggaggcggagcuugcagugagccgagauugugccacugcacuccagccugggcaacagagcgagacuccgucucacaaaaaaaaaaaaaaaaaaaaaagauaaacacaaaugcucagggaauuuucucugaugucagaugaucuucaaacauaacauuuguacaaauccgguguccagugcaauagagaagaauucaaaacccuaaaaaagauuucuagacauauuuauuugcauuuuacaagggcacaagaaacucuugggaauuaaacaugggcccaugagugcauuuugaugcuuggggacaauaaguagagucuaguggccaagagagccugaccuuuggagucagagauugaugugauuacuuuucgaacacuugucaugccaguugucuuguggaccccggcagugguaagcacagauauugcuguccuucccuucccucacuuuagugugacuuuaguguggaggcagaacuggguuccugucucaguacuaucaaagcagcugagaagucguuugagaaguucauuuuauuuauuggagcccccguuuccucagcuguacaaugaagacaauaagaauacuuaugucacaaggucagugugagaauuuaaugagacguacuccuaaagcuuucagugcagacaacacacuuggagagugacagagaucguuaauucccugaacugcuuucccaguaugaccuaaguggaagguguggguuaguagcuucugauuccugguagagagacccuuuuagcugugacagccccaggcagugacccuggagguagcggacacuagaggaaguaauucacacugguucugacuaucggacaccucuucaugcucuguuagcuccagaccccacccauuuucagauagguacuggcacugcccauuaugaagccaaccagaaccaagcaguucccuuuuuccuucucuccguuccuuuucuauaugugucuuuucuuuuuguucuccuuuauuuguuuauuuauuuauguaugagauggagucuccgucuguugcccaggcuggagugcaguggcaugaucucggcuuacugcaaccuccgccuccaggguucaagugauucugccucagccuccugacuagcugggauuacaggcgcccaccaccaggcucagcuaauuuuuguauuuuuaguagagaugggguuuugccauguuggccaggcuggucucgaacuccugaccucaggugaucugccugccuuggccucccaaagugcugggauuacagacgugagccacugcuccuggcuuuauucuccuuuaaaagguacuuuuuacagccgugcaugguggcucaugccuauaaucccagcacuuugggaagcugaggugggaggauugcuugagcccagaagguugagacugcagugagccaugaucaccccauugcacuucagccugggcagcagagugagacccugucucaaaaacaaaagcaaaacaaaacaaaaaacacacaaaaaaccugaccacaugacucgagcuaccuguuuauguuuuccccauccuacccagagguaaugccauuaccuugaaugcuguguguacugucccuuugugugugugugugugugugugugugugugugagcuggaguguugcucuguugccaggcuagagcacacuggugugaucucggcuuagugcaaccucucccucccggguucaggugguucuccugccucagccuccugagcagcugggacuacagguucgugcuaccacacucagcuaauucagauaauuuuuguauuuuuaguagagacaggguuucaccauguuggccaggguggucuugaucucuugaccuggugaucugcccgcuucagccucccaaagggcugggauuacaggcgugagccacugugccuggccugucccuugcuuuaguuuaguuuaguuuaguuuaguuuaguuuuuaguuuaguuuaguuuaguuuuuugagacggaguuucacucuuguugcccaggcuagagugccauggcgcgauuuaggcucacugcaaacucugccucccggguucaagcgauucccagguacaagcgauucuccugucucagccucccaaguagcucggauuacaggcaugcaccaccacgcccagcuaauuuuuuuguauuuaguagagacaggguuucaccauguuagucaggcuggucacgaacuccugaccucaggugauccacuugccuuggccuccuaaagugcugggauuacaggcaugugccacugcgcccggccccuugcuuuuuuaaagccacauauauguguaucccuaaauaauauaguuuuacugcuuguuucugaaucuuauaaaaaugauacagauugagugucccuuauccaaaacgccugggaccagagguuuuugggucuugaaucuuuuuggauuuuggaacauuugcauuguacuuccugguugaauauuccagauccaaaaaucugaaauccaaaaugcuccaaugaguauuuccuuugaguguugugucagcucucaaaaagauuuugggccgggugcaguggcucacaccuguaaucccaacacuuugggaggcugaggcggguggaucacgaggucaggaguucaagacuggcccagccaagauggugaaaccaagucucuacuaaaaauacaaaaauuagccgggugcaguggcaggcacucauaaucccaacuacucgggaggcugaggcaggagaauggcgugaacccgggaggcagagcuugcagugagccgagaucucgccaccgcacuccagccugggugacagcgcaagacuccgucucaaaaaaaaaaaaaaaaaagauuuggauuuugggaguauucagauuuuguauuuuuguaugugggaugcucaacuuguaucauacucuuugaagucuuuucugacuuggcuuuuucauucagcauuaugcuuccaagacccaucuauggugggaaaacugggcauucauucauugcuauauaacaauucauugugggaagguuccauuggaugaucuuaaucagagugaugagugaugaauaugaugaaauacacauuaugggaagaucaaucuggcaaguuuuaccacucuuuugaaucuaaaaccaaaaaaucugaugacucuuuucuuuuuaauucugauauaacuacaguccuccaaugugcugggguguaugucccugaugaauacucaccaaaucuuuuauuuacccacugagcuuaacugucuucugacuucuguaucguaaaaacaauaggugugcccaccgggcgugguggcucacugcuguaaucccaacacuuugggaggcugagguggguggaucacuugaggccaggaguucaagacgaaccuggccaacauggugaaacccucucucuacuaaaaauacaaaaauuagcugggugugguggugcacgccuguagucccagcuacucaggaggcugaggcaggagaauagcuugaacccgggaggcggagguugcagugagcugagaucaugccacugcacuuaagccugagcgacaaagugagacucugucucaaaaaaagaaaaugagacugucucaaaauaaaaaaaaaagaaagaaaaauuaaaaaaaaaauaggugugcuaaguaugaagucaugauauuguauaggcauuuuaaaaugugcaguauucucuuccuuacccucaguguucuccaugcacccugcauugaucaguggucaugaacuaucagccauaggugugugugugugugugugugugugugugugugugugugugucugucugucucucucucugcccccgacccaaguguguuuuagaguucuuauaaaauuagaauuuuccucuuccuuugaaaaaugguaggaucuuguuccaugggguccaauugccuggagguuccaguugcccagagcuuaaauaacccuuguuuggcagcauggcugggcuccuacuugacagcuuuuauucaugcuacuugucagucucccucaggguuccuuaggcuguccuugaguaccucugcucugggguagugaggaagaagacugggaagagaccuagccuucauucccagguagcauccuugcauaugaaauaugaacuagucucucaccaucauggugggguggaaaauuucuugcauguucucacugaggaguuggcuagauucugucugccuucuccccugauugaacuuccaagccucugaggcagggggccagaugccuguucuuggccucccugucccucugggcagauguucuaagcucuugugguuuuccucuugggaguuucucacuacuuucccuuuuuucucccccucuucuuagccuugcaucaucaagauuaaaaacuuuuuugaugcagaagauuauuauauuguuuuggaauuguaaguaguaaacuuuuuaaaaauuucuguuuccauucaaaugcuuuauaaagccaccaaagaaucuaauguaggcuugccuuucucauccuggggggccucaacguauguauguaguaguggggcccacaaagucuguguauaggggguuaauaucaacccaaaaaacccuccaauguuuccaaaaauaggugguaugggauuccagguccuggaucuaugaucaggacuugaacuccacucugcaguugacuagcugaccacccaugggucaguuuaacucacuuuucugagucucaucuucauaguguuaaauggggauuauaaugaacccccacaugcagaguccuuguaugaauuaaaugcuaugagggauggaaaucccccagcagagcaccuggcacauguguguacucaccauggggcaauauuguuauaauuggcucaccauaacuguggguuuuuacauccguguauucaaccaaccucagaucgaaaauacuuagaaaaauaaaauggaugguuguaucuguaccaaacaugaacaaacauuuuucuuguuauuauuuucuaaacaguacuguagaaccacuauuuacauaacauuuacauuguauuagguuuuguaaguauuuuagagauuauuuaaaguauccagggccaggugcaguggcuuacgccuguaaucccagcacuuugggaggccgagguggguggaucaccugaggucaggaguucgagaccagccuggccaacaugaugaaaccccaucucuacuaaaaauacaaaaauuagccgagugugguggcgcacaccuguuacuucagcuacucaggaggcugaagcaggagaauagcuugaacccgggaggcagagguugcagugagcugagauugugccacuguacuccagccugggccacagagugagacuccauaucaaaaaauuaaaaaaaaaaaaaaaaaaaggccgggcgcaguggcucacaucuguaaucccagcacuuagggaggccaaggcgggcggaucacaaggucaggagaucgaggccauccuggcuaacacggugaaacccugucucuacuaaaaauacaaaaaauuagcugggugugguggugggcuccuguagucccagcuacucgggaggcugaggcaggagaauggcgugaacccaggaggcggagcuugcaaugagcugagaucgcgccacugcauuccagccugggugacagagcgagacuccguuucaaaaaaaauuaaaaaaaaaaaaauagagaaagaaaguauacaggauacagccugggcaauauggugaaaccccaucuguacaaaacacacacacacacacacacacacacacacacacacagacacacacacacaaaauuagccgggcauaguggcacgugccuggaaucccugugauuuaggaggcugaggugggaggaucaccugagcuugggaagucaaggcuguaaugagcugagauugugccacugcacuccagccuggacaaugggagugagacucugccucaaaaaaaaaaaaaauaguauaugggaugauauacauagauuauaugcaaaucuuacgccauuuuauauaaagggcuugagcauaauggauuuuggucucugagagagcuccuggaaccaauuccccauggauacugagggacagcucuacucugaaauaucuaccuggguaggacuuucuaugcggguccuuucaauccaggaccagguugcaugguggcaccugaguaucuuucagugucuugguaguuuauuucaguggcgauaaugucuuguguuauuugguguaaucagaauaacuuccugucucauuucuggaagaugccugucuugauaucugcuccugcauaaauauuaaguguuucugggagcagcuauuguggcaggcacagaaugcuuugcuccugguuggcaaaucguaucuaugcagggugaucauuaagacuguauagacaacaggcugggugugguggcucacaccuguaaucccaggacuuugagaggcugaggugggcggaucccuugaggccaggaguucaagaccagccuggccaacauggcaaaaccccgucucuacuaaaaauacaaaaauuagccaggcaugguggcaugugcuuguagucccagcuccuuggguggcugaggcguggagaaucgcuugaaccugggaggcggagguuguagugagccgugauggacagagcaagacugucucaaaaaacauaagaaaaaagaaaaaagacuaugguaaaaacaccccugaucaccccugaucacagcacugggagagccuggagccccuuguggaucugcugcuaucaaauaggagauuguuaccugacugaauccaguuaacacaguuaauaaaagugauaauacagagccgggcacgguggcucacgccuguaaucccagcacuuugagaggccgaggggagcagaucaccugaggucaggaguucgagaccagccugaccaacauggagaaaccgcaucucuacuaaaaauacaaaauuagccgggcaugauggugaaugccuguaaucccagcuacuugggaggcugaggcaggagaaucgcuugaaccugggagguggagguugcggugagccaagauugcgccauugcauuccagccugggcaauaagagcgaaacucugucucaaaauaaauaaauaaauaaaggaauaaccuugccaagcaccugugccaggagcuuuuccuacaucagccaucucuuaauuuuuauaacaaccaucaagguagaugguaucauccccauuuuuuaagugguagaaacaagcugagagagguuaaauagcuuucccaaaguccaaaagcugggaaaugguagaguuaggguucagauccugguugucuguuuguaaaauucuguuugcucuucuacaucagucucagaaucaucuguggugugugauaaaaaugcaaacuccugacugggugcgguggcuuaugccuguaaucccagcacuuuugggagggcaaagugggcagaucacuugaggccaggaauuugagaccaaccuggccaacauggcaaaaccuugucucuacuaaaaaaaauacaacaauuagccgggcaugguggugcauaccuguaaucccagcuacuugggaggcuaaggcaugagaaucacuugaaccugggaagcggagguugcagugagccaagaucgcaccacugcacuccaaccugggugacagagcgaggcucugucucaaaaaaaaaaaaaaaaaagcaacuccugggccccacuuccaagcuacugaauuggauuuuuuaaaguuccccaggugccuccaaugcccaauccuuucaucucauuccuuaguuuccaacugggacaucugauugugaauaaaccuuauuaguuuuaaaaaugagagucaaaagugaauaaaaaugucaacuguuugcuugucuuaaugaauuuguuuuguuguuuuauugucuucuguccaagugcguuuucccccaggaaugaaccccuugccuugccuuuguguuucaggauggaagggggagagcuguuugacaaagugguggggaauaaacgccugaaagaagcuaccugcaagcucuauuuuuaccagaugcucuuggcugugcagguaaaagaagcccucaauucuuuugacagcugccuuucuuuuaguugaauuacucccugaauuaggcagaaaucgagggaccguggauuaaaacucagaagagaaucuguguguuugcuguucucuucuuggcaaaaauguccuacuccuuucacugagaugaaaaagcucucacuggcgaggcgcggugguucaugcccauaaucccagcauuuugggaggccaagcgggcggaucacgaggucaagagaucaaaaccauccugaccaacauagugaaaccccaucucuacuaaaaauacaaaaauuagcuggguguaguguugcgugccuguagucccagcuacucgggaggcugaggcaggagaaucacuugaacugggagguggagguugcagugugcugagaucaugccacugugcuccagccuggggacagagugagacuccaucucaaaaaaaaaaaaaaaaaaaaaagaaaaagcucucacuguguagcuuaagagaaaguaagaaagggaauuaaagaaauaaauagaccaggcauaguggcucacgccuguagucccagcacuuugagaggccaaggcaggaggaucacuugagcccaagaguuuaagaccagccugggcaauauaaugggacccccaucucuacaaaaaauaaaaauagccaggcaugguggcgggcaccuguggucuuagccacucuggaggcugaguugggaggacggcuugagccugggagguugaggcuacagugagccacagucaugccacugcgcuccagucuaggcaacagaaugaugcucugucuuuaaaaaaagagauaacauggcccuaugucgccuaucuuuagcuuggagguauuucuggaggggucuugaucauuaguucuuuaguucugcuugauccuuguagaagucucucuuaacucagagugggagcugggcagguuugagggcagagcugcaaguugugaugauugugacagauggguuggucccccauggcucagaacuagguguuucccuucaggugcagcauccuguucgcugcagugggcgggccggcagggaaugcacauagccaucucuauucaguagguguuagaugaaagaauagcugguggcacuugcuuugaggaacaucaccauuucccagaccaaaugugguuguggccauucccuuccagucucuucuugaaaacccacuccuugcaggaaaugcagugauugggagcaauccuuguacagagugaggaucgagagaaauuuuuuuaugauugaucuaccuagguuugcccucccuggagguuucaccagauccauuucccaguaaagauuuugcaaaaaauuuuuguucuaacccagagggacauccagagaagauugaagcccauaaacacaagccuuuuaaauuuauuuuuauuuguuuauuuuuuuugagaugaugucucacugugucgcccaggcuggaguccaauggcacgaucucggcucacuacaaccuccaccucggguucaagugauucuccugccucagccuacccaguagcugggauuacaggugccugccaccauguccagcuaauuuuuuuuuuuuuuuuuuuaguaaagauaggguuucaccauguuggccaggcuguucugaaacuccugaccucaaacuauccgccugccuugagcucccaaagugcuaggauuacaggcaugagccaccgugcccgcccacaagccuuuuuaaaaaaaaaauuuaauuuuaauuuuaauuuuugugggcacauaguagguguacauguuuaugggguacaacgcaagcccuuuuuaaugguagcugucaccuacucaguguauugcucccuuauugguuuauuccauuuauuuauauugaguaaccaagaauauuaacaugaauugaguacaguuuguggauaugugaaaauuuuguuuccuaaaaaaauauggccaggcaggguggcugaugccuguaaucccagcacuuugggaggcugaggugggaaggucacuuuagcccaagaguuccagaccagcuugggcaacauugugagaucccgucucuacaaaaaaauaaagaaguuagcugguugaaguggcaugcuuugugccuaugguccuagcuacucaugaggcugaggugggaggaucacuugagcugaggagguugaggcuguagugagcuaagauggugccacugcacuucagccugggggacagagugagaccuuguuucaagaaaaaaaaaaaagagaaaagaaaagaaaagaaauauggcauaguauguugguguuuguucauuuuuauaugcuauuucagacaauaguuuuuucaaagacaaagucuuugcauugaggaauagguuaacucacauaaacagauauauauuuguaucacauaaauagauauuuacaaauauauauuuguauagguucccuuuaaaaauauucucaggacugcaauaaccaaauauaucauuuugguggaauuuuuguguuuauuugguauguucucaaaacauuuucuguuacccauuugaauuuuuauugaaauugacaccuuacauuucugcugugugaagaguuguuuauuaucuuaaagugaaaugaaagguuaauuguucuaaguugcuuuuuucauuucccugcuuuuuaaagaucuucucaaacaaauuuguaaacuuuaccccaacaguuuucuaugauuuuggagaauaugguuguguguaucacggcuuacgguuucacccagcugugagauguguguguugguaacuuugauucuacuuaaguaucuacugcaugaaucugagggucaugccugccuuucuguguaguaccuucaugaaaacgguauuauacaccgugacuuaaagccagagaauguuuuacugucaucucaagaagaggacugucuuauaaagguaagaaauuggcauucuguauguggcuauuccuguagauucuuguucagaaacuuuuaauuccucaaauaaaaagugggagcguaaaaaggaugagaaucugacccuuucacuguuaccaauuauuuuagagaucaggugauacugcucuuauccagauucgaaugagcauuuauugagcucuguuguguacaagugaccuuugugcuuagagagagaggaggggucuaaauggacgagugggcuggguaugguggcucacaccuguaaucccagcacuuugggaggccgaggugggcagaucaccugaggucaggaguuugagaccaaccuggccaacauggcaaaaaauacaaaaauuuagcugggcaugguggugggugucuguaaucccagcuacuugggaggcugagacacgagaaucacuugaaccugggaggcagaaguugcagugagcugagaucgcaccacugcacuccagccugugcaaaagggccagacaucaucucagaauaggugaaugaaugaaugaguaaucacaugcgcugccuuucccuguuucucaagucuggcaucacuuuagaaucucuuguuaggauuuaugacacccaggcuuuaccucagaagcugagaguggcacucagguauaagcauguguuuccaagcuccccagguauuccauagcgcagccaaguuugagacacuggggucuaagaaccauguagaacuaauuagaauccugaagugucugugauaaagauaauaagcuuuuuguaagauuacagaggacauagguuaaguuggaaagccugaguguugagauuccuaggcucaggaauuuuaauuuaagcaaaauuaaauguccuaacuugcaaagacaugaaucuguaaauuccagauuaauggcaggugugaauuguacaauagaaacugaucuagccuacgugucuucuuggacuggcagacuauguuaaucuuuuuauuuuauggcaaguucaacauuauucccuuuuguacugaauuuuagauuacugauuuugggcacuccaagauuuugggagagaccucucucaugagaaccuuauguggaacccccaccuacuuggcgccugaaguucuuguuucuguugggacugcuggguauaaccgugcuguggacugcuggaguuuaggaguuauucuuuuuaucugguaagaaauauuuucauugcugcacagacugguaggaggugauuagaugaagucacaaaugugucuugcucuguuguccaggcuggcaugcaguggcuugaucuuggcuaacuguagccucugccuccugggucaagugauccucccaccucagccucccgaguagcugggacuacagaugcacaccaccaugcccagcuaauuuuucuauuuuuuguagugaugggguuuugccauguugcccaggcuggucucgaacuccugggcucaagugauccuccugccucggccucccaaagugcugggauuacaagccuaaggcauugugcccagccuagcucacuuuuugaccauugauuuaaagaaaaaucugacuuuucauuaugcugaaaaagaaaucuuuauaucugaaugccacugagaaugccacuugauuucuuuuccuuucucucucuaccaauauuaagccuuaguggguauccaccuuucucugagcauaggacucaagugucacugaaggaucagaucaccaguggaaaauacaacuucauuccugaagucugggcagaagucucagagaaagguaugaauaugaaaggguuaagaauuugugguaugcuaaaauguguaugugcuguggugggaguuucuucccaaauuccaugguguuuucuccugucaauucuguucuuauuuucuauuguuaguuucacaccauuugagaggcacuggaaauuauuaagagcaugcacucagguccugggucugcuacuacuuagcuguguggccuuaggcaaguuauuuaaccuccaucuccaauuucuuucuguguaaagggacccucaauaaacccuaccuuaaaagguuuuugugaggguuaaguaucauguacacaagugccugguaccuauuuuagugagcaaaauaaaugcacuuguaacuuuuuaguuacaagguuuccuuugaguaagcaagcauguaaaaacuagaugucauuaguuaccuuguauuuuauaauuuauccuggcaacuuuaguucccugaagagaaaguagaaaauuaaaugucaaauaacauaacauaggugauuguguuaaaugucagaauauuuaaggaauaauaauguuguaauauacaggccagcgugcauuuguugcuugcuggaguagccaaguuuuauuucugacaagucugcaguuccagggagccucucccucgcugaguaacugucaccuauccaucuguagaugucagagagaguuugcugugcaucccaaguaucuuagaauuggguagaaguuuagcuuuaauuaguccgaccuugagucuagcaacaagagagggaacaggcagugaagaggucgugacugacgucccagcagcaggagacagggagugucauuaucauuccuggucuucucacaguacucugaauacagagagugaggaagauuagggggcccugucugcugacuccgugaugaucucagacccucucugcucuuucugaaugguggccuguuaauucuggcauacucuuacugauaauauauuuauccuuuucacugugauuugcccaauuguugcuuuagcucuggaccuugucaagaaguuguugguaguggauccaaaggcacguuuuacgacagaagaagccuuaagacacccguggcuucaggugggugugggacagugccugcuagcauaaaauacaugggaagcccugcugccugagagacaugagacagaggacagaaacauguuuacuuuguugaguguuuaaucuaauuguuuuagauguaugggggguaucuuggaggauggguuacaaccuguuuuauuuuuuuuuuugagacagguucuuguucugucacccuggcuggagugcaguggcacgaucucagcucacugcaaccucuggcccccggguucaagugauucuccugccucagccucccaaguagcugggauuacaggugcaugcugccaugcccagcuacuuuuuguauuuuuuguagagaugggguuucgccgugcuggccaggcuacaaccuuuuugauauuacucauggcuguuggauguacacgcucacuuuauguccuguucugguuccacuuggcugccccgagucuccuguuuggccuguguucuuuugagugcuuguucuggcucuacccccagccauguccacugcucuucauagguggggugcauuccagccaucuucaaccuuaaaucagggaagugggggagggggaggaggacagccucccuggggagaauccagcuauuucucaagcccaagugacuggguauaaagggucccacugcuuguucauucaggugaguaaauguguccuuaaugaaggcugucaccugcacuuuucaucuguauuaccgcugugcuccugcuagggguuggggcugccauuuuuaaaugcugaccucaucuggaacugccaagaguuggaaguauguuguggcuuugcuggguuaaucuuuaguuuuagaauuagccacggcauugggcagguuuuucugauagaugucuggucuucuguaaugagcaguuccauucagcacagacaugccccuuucuaugaauuuuuuuuugguuuguguauuagucuguucucacacugcuauaaagaacugcccaagacuggguaauuuacaaagaaaagagguuuaacugacucacagcugcacauggcuggggaggccucaggaaacuuauaaucaugguggaaggggaagaaggcaugucuuaauggcagcaggugagagagcuugugaaggaagugaagggcgaagauccucuuaugaaacugucagaucuggugagaacucacucacuaucacgagaauagccugggggaaacugcccccaugagccaaucaccucucaacaggucccuuucucaacaccuggggauuacaauuugagaugagauuuggguagggacacaaagccaaacuguaucaauccguuuucuguggagaugggggacagaacugguagcuugagcuagaggcuguuacuugagcuaaaugcuguuucucuggggauuacugguccaggaacuccuugggcaguccagccuccgacccguacuucugggacucugggaagacugucccuguucucuguuccaauccucuacaccuaacaguuuugcucaggccagcucagguugagaacaacaaaaacuuaaaacaaacaaacaaacaaacaaaaaaagacauauauguguuuggauguugcccuggaaacuacagucuccccagaagaaaucugucagaugauuuagcauuuaauagaccacacagauuugaaacagugggacccuggaggaaagggguuuggaaacaaagggugccuuugcauguggggauuuuaauuuugaugaaaaagagaaacaugucuuuuggcucuuuucauguguccuaauagggaaacucuugggucuaaauguagagguacaggagcuguguucaucucuaacaaaaaauagagcuggccaguugagccugggaacaggguuugcaucugccugaaauuuaugagcaagcauagccuaucuuucuuguacuuuuuugugucaaagaaaacuuauuaacaaccaaggagaaggugaaguucaacucuguugcaggaucucccuggaauacucuuuuagccaccuuuuguuuuugcagugaaaggaggaaugagcauugaaugaagacaaggaugaagacugaccaucuaaaacaucuguuagugauaguuuggguuuuauuuugggaaaauucaguguuuuugaaaaaaccaaaugguuuugugggucugucgcugaacugaguguugggaauguggauucuggucucuguuuugucauuaacagagugcccaguuuugggagcaucccuuacaucuacucucugccucauauuuacugccugaaauagaggauuucuucuguuuacuuucaagggauauuacaauuuaauuuuuauuuuauuuacuguuggagacaaggucuucuucuguugccuaaacuggagugcacuggugcaauuauagcucacugcagccuugaucuccuggccuuaagggauccucccgccucagccucacaaagugcuuggauaauaggcacgagccacuguuccuggcuaauuuaauauuuuggaauaauuguagacaucaugaagaaaaucaauguuuauuuauuuauuuccuuuuuugagauggagucuugcuuuugucuaccaggcuggagugcaauggugugaucucagcucacugcaaccucuaccucuggguucaagugauucuccugcaucagccucccaaguggcugggauuacaggugccugccaccaucccagcucauuuuuguauuuuuaguagagaugggguuucaccauguuggucagacuggucucgaacuccugaccucagguuaucuacccaccuuggccucccaaagugcugggauuccaggcaugagccacugugccugaccugauuacuuguuuuaaauacaggccugauuaggcuugugaccacucuguuuggcuucacugaagggcugccaagagauggacuuuugagagugacacugcaagauaauugagauccuaaguaaggccgugagagggugcggaguagaauccagaugagcuugcugcugucaaauggcaauggggagcuacacugagaaacucaaaacagagugaccucaagugaucugcccugccuuggccucccaaagugcugggauuacaggcgugagccacugugccugguccuucuuuccuucuuucuuucuuccuccuuccuucccccuccccucuccuccauuccuuuccccucccuucuuucguccccccuccccuuuuuccuuccuugcuucuuuccuuucuuccuuccucagggucuugcucucucaccuaggcuggagugcaguggcaugaucacugcaccaugacuuucaggcucaagugauccuccugccccagccucccaaguagcugagacuacaggugcaugccaccaugucuggcuaauuuaaauuuuuuuuuuuuuuuuuuuggagacaguguuguacucuuuugcccaggcuggagugcaguggugugauccuggcuuacugcaaccuccgccucuugaguucaagcgauucuccugccucagccuccugaguagcugggauuacaggcgugcacuaccaugcccugcuuauuuuguauuuuuaguagagaagggguuucaccauguuagccaggcugaucucaaacuuccgaccucaggcgauucgccugccuuggccucccaaagugcugggauuacaggcgugagccuccgugccuggccuaauuuuuaauuuuuuuuguagugacgaagucccacuauguugcccaggcuggucucaaauuccuggccucaagcaauucucccaccuuggccucccaaagugcugggauuauaggcaugagccaccaugcccaaccuaguguuguaaaauuuccauauccaucaaauugccaaaugguggaggacuuuacuguauccucucccuuuccccacugugguaugcuuggcucagugggaggaggggcuggaguugggugggaaaguacaugaggcacuggaaucagauaacucugggucuguauucugcacaugccaccugugaguggcugagcugggcuucuggccagcacucaaaggccacauuccuaguuauggauguuccuuucaccuugcugaagauggggagagcugcaccagaccaccucucaggguuuccuaaugcaaauccucgaacccugcagaagugagcauccagagaggugggagcuacucgcauacacacugucugugcccuccucaucuccugcuccugcagcaugaaaccccucaccucccgcuccugcagcagaaacaaaauacuugguucuguuuauugucucccuuucucauuagaccugagcucugggauacugugggcuuaaguacuucugaaaauuuguauggcaucugcugggugaauuuuccuagggugcugggcugguuguuaggacagucugggugacuggccucauucauggcaggggcagcagguggagagugguccgggaaggauuugaggagcugcacggagucaggcccagccucuggccuccugauugccaccuuucucaggaucuuggauacuaauuaagaaacucuugacugcuggaggcugugauugacccacugagagcuuuuaggcauguggaugugagucagccaggauugauggagcauugacugcuaauuagacuccucugggaagguagaggcgggcaacacauaaugccuucgcugugggagcuucaucaaggggaugauucuuggacggacauuuuuccucccucuuuccacaggggcaugcuagcccugucauucuaggaguuuauuauccuucagacacagcuacuuauguuuuuaauucccucacaggaugaagacaugaagagaaaguuucaagaucuucugucugaggaaaaugaauccacagcucuaccccagguucuagcccagguauucguauuccugaugaucacuaaauguagucugggcuuaaggagcugauaagcaaagaugaugaaauucaagauuuuccugaguagcaauugcuuaacauuguuucaguuauaauguaguagaaacucuguuuuaacuugauucgcuccagcacccuuagauuuaaaaaugcaggauauguuuaauaucuaacacauaauagaccgauaagcacagcuagggauugucauccaaaaggucaccugcaaggcaauuucgaaagacucuauuagaggcucaaauauaaauuuguugaacaaauuaaaauuugggucaguaguugauuccuugauuacaauuuuauucuuuaaaguucuuugugaguauaaguuaauuccaguccugcuuuuuuguuguuguuguuguuguugaaugguagcuguccuuuuucccacuguuuccuccccccaauuuuuuuuuucuugagacagagucuugguuugucacucaggccggagugcaguggugcaaucucagcucacugcaaccucugccuccuggguucaagcaguucuccugccucagucucccgaguaucugggauuacagguguccgccacugugcccagcuaauuuuugaauuuuuaggugagaugggguuuugccauguuggucaggcuugucucgaacuuuugaccugaagcgaccugcccaccucggcuuuccaaagugcugggauuacagcugugagucaccgcacccagccuuccucccaauuuuauauaugggaaaacaacuaaggcacaaagguugucuucccgcaaaagaccaagacuuggggcuucaacugagagguauuauaguccuuuuaaacuugauauuuagaagaggacgaucaagaggaaguugguuaugcuacuugcuuucaguauacaucguucagaggucagaagccauaagggagagaaauaucuauuagauaagcaugucugaguugggggcuguggugaggacucaguugucaaugaugacaaccaguaauuuuugguucuagaauuucacaucaaaugcccccacuuuacuggaagcauauugaggaacuuugauaaucuuaaagaagccagugauuuucuuuugaacauuucuccauuuuccuuuauuuucagccuucuacuagucgaaagcggccccgugaaggggaagccgagggugccgagaccacaaagcgcccagcugugugugcugcuguguugugaacuccgugguuugaacacgaaagaaauguaccuucuuucacucugucaucuuucuuuucuuugagucuguuuuuuuauaguuuguauuuuaauuaugggaauaauugcuuuuucacagucacugauguacaauuaaaaaccugauggaaccugg

SEQ ID NO: 191503 - RNA, 35452 nt, Homo sapiens
ugcggccgcagguuccgcugucucgggaaccgucguaucccucgguccggcggcggcggcggcgguagcggaggagacgguuucaggccuccggugcggcugcaaugcugagcucccgggccgaggcggcgaugaccgcggccgacagggccauccagcgcuuccugcggaccggggcggccgucaggugagauuuuggggggcggggcugccgaagaggccgggaccaggguccccagcuugggcccgugacggcuuuuucaugcccuaguuggggucuccagggcccgcgcgggcauucuggaagguucugcguccuuuaggguuggaggccugggcccguaggugggaggacugacgggcuccaguccuucggcaacaccaauucugucugcacuccccaggucugucagucccucccccuccugucauuguucccaggacacccggggcacuccagucuugucaaggccccuaauucugucagugcccucaguccuuucagugccuccuaggccugccaagaccccucaauccuucuaguauacccccaguccuucugggucccccaaucauaucaguuucuggacugccaggguuccccaaccuuggcacgguucuucuaguccuauaagugccccgggccugcgagccccgcguuuuguuaguaccgcccccuauuccuguuagcccgcccucuagucuaauauggaucgccacuucugucugggucccugauguuguuagugugaguaaaggcccuuguuuugcaagggucucuaaauuggucagggccccuuuaaccuguuaagguugcuugguccuguuaaagcccuccguucuuguuaggacuccucgauugccuggguccccaauccugucagggcccccauuucccucuuauucacccucccaagggcuccaggcuucagaacugaguacccccucccccacugcugaccccaaaugacugagaccuguugcucaggucggcuuccucuggaacuggagcagguuuaaagagcuuauuaucccagggcugaaaguccucgauacuuauccuguccagugcccccauuccguagauaggaaguguggccccauagcugaccucauagcagaguugggaggagaagccagaucuuuucauccgcaggccccaccacucuccucgugaugucauuuugcagaggaauggaguuuccaaagucgccacuugucccuggguauuuuuuccuuaugcugccaaagucauggacaaguccucucucccauccccuugacacucuucccuucaguuuccaucuugaacuucgugguuuuaagcacagaccuggggagacagacaggcaugauucagagccauguuccuucacucacugugaccaaguugggcucuuaguuucuucugcuauaaaaaugaaagugauaguagaaccugcaucugugggguuguuuuaaaaaugagguaagauugucacagggccuggcagagaguauguacccuuaaauauuaguguuugauuaggggauuuuaaagcacugguaaagcaccuuagcacuuccaugacaguccuuuauaaucuuuccaggcacuuuugugaacucacguaucguguaaaagcacagugauguauuaagaaacuucaagaauaccuuucaccagcugggcaugguggcucacaccuguaaucccagcucuuuggaaggcugaggcagguggauuucuugagcucaggaguucgagaccagccugggcaauguagugagacccugucucuacaaaaaaauuuaaaaauuaccugggcauguggugugcagcuguggucccagcuacuugggaggcugaggcaggaggaucaccugagcccggaaggugaagauuguguugagcugagauggcaccacugcacuccagccugggcacuagagcaacuagagcaagacacugucucaaaaaaaaauaaaaauaaaaauaagaaaaaaagaaagaauagcuuucaugaaugauccugagauuguaaugcuuaauuuguagcagcuaacauuuauuaaguucuuacuauguacuguaugcauucacacuuauuuaauccucacaacagcccuaugagguaggucuuauggauuguccccauuguacagaugaggaaacugaggcuuagaaggugaagugaugccaaaugaaauagcaaagccaggauugaaccagaauaagguaaucccacuuucuuaaccaaguuuggugcauauucuguugacucugucuuggaaaacaaauauuuaucugaaauucagcuaucagcuaugauacuaagaaaugcugauuauuauaaaacagggucaauauuaccaccagugacucuucaccaaguuaauguuuacugaacugaaaucaaaacaauauucacaugauccaaauacugggauaauaauguauuacacacacacacacacaaacacguauguaugcauguguaacauauaugcagauacacauuacauagcuauauacacauagaugguuugucuuauuuuguagaaauauauaacuuuguauaaaaacaauguuuuaaauuguuggggaaauuucuuaauauguagcaaaagcauaaccagcguucaagucaagccugaaguuaggaaaucuuuaauuuuauaaauauucagcucuuuuauaccauuguaugugugccccuucccugucuaauauucuaaaagagaaauucauuucuguauauuuucuccaguauucagucauucaauaaauauuuuauauauauauacacacacacauauauauacauauauauauauauauauauauuuuuuuuuuuuuuuuuuuugaggcagagucucgcucagucacccaggcuggagugcaguggcgcaaucugggcucacuguaaccuccgccucuuggacucaagccauucugccucggccuccagaguagcugggauuacaggcaccugccaccacacccagcuaauuuuuguauuuuuaguagagacaggguuucaccguguuggccaggcuggucucccacugaccucaggugauccgcccaccucggccucccaaagugcugggauuacaggcaugagccaucacaccuggccucaauaaauauuauugagaaccuacuaugugcuaaguaugaucuagacacuugagcucauuaguggguaaaacaaagcacaugccaguugagggagacagacaacaaacccagugcauuaaaaaaaaaaaaaagaaaagaaaaaaaacauagcgaauagguuaauuuuauguuagaaggugguuaaguucuaugguaaaaagaaaaaguagaaacaugucaaggggacaaggacaggucccacugauauguucagguaggccucuugagaagcgaagggagguaaaggagugagccaagcagugaucugggggaagagcauucugagcagagggaacagcagugcaaacgccuugaggucagagcauuggcugguaacguuccauguggaaguggagugagaggcagaaaaggaaaauaacuucaguuuuuccucagagugagaaguagccuuuggaaugugaugauuugacuuaguuuuuguuguuguuguuguuguuguuguuguuuuuuaugagacugagucuuucucugucaccugggcuggagugcaauggcacgaucucagcucugugcaaacucugccucccagauucaagugauucuccugccucagccucccgaguagcugggauuacaggugcacaucaccacggccagcuaauuuuuguguuuuuaguagagacaggguuuccacauguugcccaggcugaucucaaacucugggguucaaaggauccuccugccuugacuucccaaagugcugggauuacagggaugagccaccgugcccagcugacuuagauuuuaaauccuaaugucuaaacauccugauuuucaagauguaauccuaugacuauauguuacuuuaacuugcaauuagguauuugguggguuauuuugacaaaauguuauucugucuauaucuguauauuugccuuuuguguuugugugagggaagacaguaaacuuguuuucuuuuuuagauauaaagucaugaagaacuggggaguuauagguggaauugcugcugcucuugcagcaggaauauauguuauuuggggucccauuacagaaagaaagaagcguagaaaagguaagaaugagaacacugcaucauggucuguagacuugacccagaucccuguuaucugaaaacaguacaaagaagguggggagguuggucauauuuguucucuguaucuuuaaaauuaggauuucagguuuucaaacaguacuuuuaccguuagucauuauuuuauaccauguaguaaaaagauuucuauuucagccccucuccagacuggaguuggaggcaugcuuuguaaugaaaaaugucaagcggcauaauugucuaagaaguguucucauuaguacggcaauuguaguuuucagugguacagacugaccaauuacaucauacauuuguguucucucagacuagcuugcuaguaacugguaaaaauuucaaguuagugccuucauuacuaaaaaauuauuuucuuuuuuuuuuuaaugcucccuuuugaaaguguggcucuauguaacauugauuaaaauucagcaaagaaagaaagaagaauguggugaaauuugaucauuguuaaaucuggggacaguuauaauugagguuuauuuuacauucucccuccuuuuuuugugucuuugagaacuuugauaauaaaaaguuuuuuuaaaagauugcuagcagaagagagaaguauauuagauuucauugaucucugcagaaagacugaucagaauugguauaguggugucuuucccagugauuguuaagauaagaacagaaucauuguccuggggaaguaacaacagaacaauuguuuucuucuguucugagaaacauugcuuucugauuaaagaagaaagagagcauguaggggagaaugaggaagagaaaaagacaggagaugguuacuaaguguuuuuguacauuuaggaagaaccaagcugugcuggauaccaugauagguuucaaaaauaacacacaaaggggaccuguccuucugugcuuacagucugcggagcaguacuagaaccaagccuuggcacagauagaaggccuggccccagaucucuguggauaaggaucuucuuggaucgggauuccaaauuuaaggccacagcgcaggaacucugggucccacaugggagagaaauugaucaaaugugauauacuguucucuucuucccccugcuuuuuuuuuagggcuugugccuggccuuguuaauuuagggaacaccugcuucaugaacucccugcuacaaggccugucugccuguccugcuuucaucagguggcuggaagaguucaccucccaguacuccagggaucagaaggagccccccucacaccaguauuuauccuuaacacucuugcaccuucugaaagguaucuagaugggaauuucaagggaauuauguaccuuuucaaagaaguccagaugacagagacucuuauaacaaagaguuaauaccuuauuguaggaaaagaucauacagaucauuaugaauaaacaacaccaagagcccaauagauacaaacaaguauuuuuuaaaaaucaaagauggaggccgggugcaguggcucaugccuguaaucccaguacuuuaggaggccaaggcagguggaucacgaggucaggaguucgaaaccagccugaccaacauggagaaacuccaucucuacuaaaaacacaaaaaauauuaucugggcaugguggcacaugccuguaaucccagcuacucaggaggcugaggcagaagaaucgcuugaacccgggaggcggagguugcggugagcugagaucgcaccauugcaguccagccugagcaacaagagcgaaacuccgucucaaaaaaaaaaaaaaaucaaagauggaaccauuuauuuuuuaaauugucaaguuaauaacagcuuuuuaaggaaggaaagaaauccacugccacauaaacaguuucaucguaagaaguauucugguuucaaaaacauuaaaguaaaaaaaaaauguccguuagccuagaaaauaagguaauucacaaaagaaguaauacaaauugcuaacaaacucaaauguucgacucgaccaucaucaaagaaguauaaacaaaauaaaaaugcuguuuuuugccugucagcaaagauuaaaaaacaaauuugcagcccuguccagcuguuggacaauacauccauacaccgcugagagggguguaacuuagugccacuuuucuggaaagcaguuuggaacuacacaauaauagcuugcgaaauacucaguacuguuugacccaguaauuccaugucugggaguccgccuuaugaaaaugguuagaaacguagauugugacuuaacuagccugaaaaauggagucuaaaagcaaacaaguuuaggaauggcugaaugguagcccccaacuuggagagucacaauauacacuggcuugguaaagguuuuaagaaauaaccuacccaacuuuuuuuuguuuuuguuuuuugagacagagucucaccuuuuuuucccagccuggagugcagugguacaaucucagcucacugcaaccuucaccucucagguucaagugauucuugugccucagccuccugaguagcugggaugacaggucugugccaccacacccagcuaauuuuuugcauuuuuaguugagacagggucuuacuauguuggccaggcuagucucaaacuccuggccucaagugguaugccugccucagccucccaaagugcuggaauuacaggcaugagccacuacgccuggccccaacuucauuuuuauuuuuauuuuauuuuauuuuugagacagagucuuguucuguugcccaggcuggagugcaguagcacgaucucagcucacugcaaccuccgccucccggguucaagcgauucuucugcuucagccucccuaguaucugggauuacagcugcaugccaccacgcccggcuaauguuuguauuuuuaguagagacaguguucgccauguuagccagacaugucucgaacuccugaccucaacugaucugccugccucagcucaaagugcugggauuacaggcgugagccacugcaccuagcccaacuucauuuuuaaaccaacuuuuugacuguagaacuguuuuuuuucuucauaaaaucugcugacauuccauggguauuauacagagugcaauguaugcacaaagaucuccaacaccuaauuauaauggcaaaaggaaagaauguagauaucaaacagaaucauuaagcaaucaccuguggccauacuacccugaacuuaccugaucucaucagaccucggaagcuaagccggguagugguuggcuagcacuuagaugggaaaaugauaaaguaaucgauggcauacagccauuaagaaucacuuuuaugaaauuuuuuuuuaauuugggugagggcauaggcuguaauauuaaauuuaaagagcagcguacaaaauauaauuugacuucaucaagguaggaacuuccacagauaaagacuggacugaaaaaugcugaaauguuagcaguggccauuuugguauugugcagucauugguaauuuuaaaaucauuuuuggaaaaaaacuauacuucaacuuuuaacaauaagcauauauugcucucacuguaaggagaaaauuggauuuaaaaaacauucagcuaaaucgugcuucacugagguauuuucccaugugagcucugcuugacacagaaaucuuuaugaagcaaguguacuuuucuguggaagaggugacuugggaauaauuucuuuuacuauccuguuuuuuuagcccauuccugguuuagaaaaaaaaaaugugcaacucgcugccagcguucaucuaauuuuacguaaacaugcucuuugaggccgaagcaaaucugacugauuuuaaaugcgaaaauagaaaaacuguucuuggaguucuuuccuuuuuuuuugagaugagucucgucuugucacucaggcuggaaugcaguggcgggaucucggcucacugcaaccucugccucccagguucaagcaauucuccugccucagccucccgaguagcugggauuacaggcaugccccaccacgccuggcuaguuuuuguauuuuuaguagagacaggguuucaccaggcugcucucgaacuccugaccucaaguggugcaccugccuuggccucccaaaguguugggauuacaggcgugagcuaccaugcuuggccuuuuuaauuuuuuuaaaaaaauagagauggggucuugcuauguugaccaggcuggucucaaauuccugaccucaagugauccucccaucuuggucucccaaagugcugggauuacagaggugagccacugcacccagccauguucaugggaguuauuucuaaauagaacuugucucuaauccuaauguaacagaaauguauaugauguuacauuaggauuaaagacaggaguauucuuggggcaaaugggaaauggguuaaaaacaccacuccaaagauuuugugaaagcugaaauguccacaugaguuauccuaacccugaccucagcacugcccuuauccuucacaugggacccagugcugggagccagagccauccuugggcugcugucccaggaugucugcucauuucucugcuucugcuuuccaaugucucuaacuuugguuuaaaaaaaaaaaaaaaaauuuuuuuuuuuuuuuagacaggguucuucugucugucgcccaggcuggagugcaguggcacaaccucagcucacugcagcaucugccucccaggcccaaaacaauccuccauuuccauuucccagguagcugggacuacaggcacaugccaccaggccuggcuaauuuuuuguauuuugaguagagacaggguuuugacuuguugcccaggcuggucucgaacuccuaagcucaagcaaucugccugccuuggccucccagagugcugggauugcggacaugagccaccaugccuggccuauaaauaauuuuuuaauuauacaaguaaugcaugaaucaguucucuuuguaaaagauuaaagcauuacagagaaggccaaaguccccuuuaucaauacucaacccugcuccccuccaccuuucccaaaaggaagcuauaggugaauccuuccagacccuuuucugugcauuugaauacauuucuaugcauccauagaaauuauauauuguagguuuuuuuguuuucuguuuuguuuuuguuuuguuuuuuggagacagggucucacccaagcugaagugcaguggugcagucucggcucacugcaccucagccuccugugcucaagcuauccucccaccccagcuucccaaguagcugggacuacaggugcgugcugccacaccuggcuaauuuuuguauuuuuaguagagaugggguuucacacuguugccuaggcuggucuugaacuccugggcucaggugauccacccgccucagccucccguagugcugggauuacaggcaugaaccaccacaccuggccuguauauuguuuuguucuguuggugauuuacauggccaaauauaauacauuagagaagcguccauuuuaguacauguagcucuaccuccuucacuuuuuuuuuuuuuuuuuuuuuuuugagacggagucucgcucugucgcccaggcuggagugcgguggcaugaucucggcucacugcaagcuccaccuccuggguucaagcuagucuccugccucagccccccgaguagcugggauuauaggcgccaugccuggcuaauauuuuuguauuuuuaguagagacgggguuucaccguguuagccaggauggucucaaucuccugaccucgugauccgcccgccuuggccucccaaagugcugggauuacaggcuugagccaccgcgcccagccuuuuuuuucuuuuuugaguguauuggucuuauaguuugucuucugugaauugcuaguuuauauccuuugccuacuuuuuaaauuguggcaaaauauccauaacauaaaauuuaccauuuucagcauauaguugaguagauuaaguacagccacacuguugugcagcagucacggccaucccucucuagaacucuucaucaucccguacugaaacuguacccaugaaacaguaacucccacucuccccucccccuagcccuugguaaccacugcccuacuuucucucucuuugaauuugacucagaccucauuaagucaugaguuuccucauauuuauaagauguaccucauuaagcggacucauauaauauucacccuuuuguaacuggcuuauuucacuuaaugucuucaggguucauccauguuauaccauguaucagaauuucauucauuuuuaaggcugaauaauauucuuucuauuuuuuuuuuuaagacaaagucucauucugucacccaggcuggagcgcaguggugcgaucuuagcucacugccacuuccgccuuccagauucaagugauucuccugccucagccuuccgaguagcugggaugacaggcgugcaccaccacaccuggcuaauuuuuuguauuuuuaguagagacgggguuuuaccacauuggccaggcuaaucuugaacuccugacuucaagugaucugcccaccucagccucccaaaguucugggauuacaggcgugagccaccacgccaggccuaggcugaauaauauucuguugcauguauaugcagcauuuuguuugucccucugucagucaguggacauuuggcuuauuuucauucuuuggcuaucaugaauaauguugcugugaacauuaguguccaaauucccugcuuucaguuauuuucuguaaacacucagaaguagaauugcuggaucaaaugguaauucuguuuaauuuuuugaggagcugcugugcuguuuuccacagauggugcacgauuuuauaauuccaccagcaauacauaaaaguuccaguuucuccucaccaacagauauuauuuucuguuuuuauugauaguagccauccuaaugguaugguaauugcuuuaauuugcauuucccuaaugauaaguuauauugagcaucuuuucauuugcuuauuggccauuuugucuaucuuuuugggagaaaugucuguucaaguccuuugcccauuuuugaauuggguuucuuuuuuuuuuuuuuuuuugagaagucagucuguugccaggcuggauugcaguggcgccaucucagcucacugcgaccuccgccuccugaguucuaagcgauucuccugccucagccuccugaguagcugggacuacaggugcaugccaccacacccagcuaauuuuuguauuuuuaguagagacaggguuucaccauguuggccaggauggucucgaucucuugaccuugugaucugccugugucaggcccccaaagugcugggauuacaggcaugagccaccacgcucagcauuguuugguuuuuuguuguugaguuuuagaaguucugaguucauauauucuggguauuaaucccuuaucagaugugauuugcaaaccuuggucacuuuuauuuucuucuuugggacagagucuuguucuguugcccagacuggagugcagugaugcaaucucagcucacugcaaucucugccuccaggguucaagugauccuccugccacagcuucccaaguauuuaggacaacaggugugcacccaucacccccggcuaauuuuuggguguuugcuguugcuguuuuuaauagaguugaugguucaccauguuggccaggcuggucuugaacuccugaccugaagugauuaaccaccucggccucccagagugcugggauuacaggcguagaccacugcaccuggccucauucacuuuuacagcugcauaguuuccauaaugucaagacaccccaguuuauucaggcauuugcuuccagcuccuugucaagauaagcaggcuacagugaacauccuuauacauaucccuuuaugcaccuaagcaugcauuucucuaggaaaaaaauugcuggauugagaaaguaaaauugcuggauuguacaauaugaaaauguuaguagauauugccaaauugccccauaguauuuuagacaaaguuggguuaaaggaggcauuaaaauuuuccuuugggggguaguugguggggggagcuaacagaagggcugcccgagggguaugggagaaagaugugguucauuucccaacccugcucccuuuguccugggagggaaagggcuagccccaggguauauacacacugaugcagaagccuggacuuuauuauuauuuuuuuaagugaaagcaaguuuauuaagaaaguaaaggaauaaaagaauggcuacuucauaggcagagcagcccagaagucugggcuuuaaaggaaucuuucaagcccauugacggcaagucagaaagaagaaacaggcuggccuacuguaucuugggagucacugaacuuccagaaacugcacugagaggcaggcuucuguauuuuuuucucucacacucuagcaguacuggucuaguguaacaugcugggaaggaggguggccaagaucaggagucugcaccugauggcucaugggccaaauccagcccaccaccuguuuuugucaauaaaguuuuauuggaacacagucauguccauuuguuuagguacugccuaugucagccucaaauaaucaaagaguucgagauccagcuaaaaggguuuauugaagcacaaagugugaaggcggcugucuggggacacacaaaucccaggaaauggugaucagugcucccaguguggggaaaaguggggaucauuuauaugacaaaaacggagguacugaacagaauuauaacauuuuccauacaauggcuaacauacagauguaagauuugauuggcuacuauggauuacacucuuaggggguugccuaccauucuguuguaaagagguaauaaucacaaggaucucuaucuccaguccauucagccuagguuugagggaagaacagggagucugguuaacguguaacaucucaacacaaaggucaggaagcaguggccaugcgccagagaagaaaagcagcuguguuacaugacuguuuccagcacuuuuucccuuggcauaaugcauuuagaagguccugaaauguuauuuucuuuuuacaucuauggcugcuuuugugcugcaguggcagaguugaguaguugcaacagagaccaugugguccacaaagccuaagauguggccaggcacaggggcucacaccuguaaucccagcacguugggaggccaaggugggcagaucacuucaccccagaaauucaagaccagccugggcaacauggugaaacucugucacuacaaaaaauacaaaaauuagcugagcacaaggacaugugccuguagucccagcugcucaggaggccaagaugggaggauugcuugggcccaggaggucaaggcugcagugagccaagaucaugccacugcacccuagccugacagaaugagacccugucucaaaaaaaaaaaaaaaaaaagcaagccuaagauguuuauuuucuggacuuuuacagaaaaagugccaauccuuggucuagaaguaauuauaauauaaauaagcccaucaaacuuuuauuaggccugauucuaccugugauugaaaaguaaaccacucgggugggugcaguggcuugcaccuguaaucccagcacuuugagagguugaggugggcgaucaugagguuaggaguucgagaccagcguggccaacaugggggaacccccaucucuacuaaaaauacaaaaauuagucgggcaugguagcgcaugccuuguaaucccagcuacucgggaggcugaggcaggagaaucgcuugaacccaggaggcggagguugcagugagcugagaucacgccauugcacuccacccugggcgacagagcacgacucuguuucaaaaaaaaagaaaaguacacuacucaaaagacccuuuaggcugcugcauauagcuugaugcuuugccuugaaaaucagaaacucaaauacaaacaaauacaagcaaaggccuugggaaacagcccuguggagaggaguguagcaccaaauaugggguuggacuggaugaauguuaaagggcccucccaaccugaaaguugugaguuaaaaucauuuugcucaauaagaaccuugcaacaaauuuauauugaugaugauaguuugaagauacaggaaucgguuacuucauuuaaaugcugcagccucaugaaaaauuacauucauucaguaaacauaaaugccuaauagaguacuaagcauuggguaaagcuacaaagaaugaugaaaaauaccuaauucuaagguuaauccuacaguccuuaauuuuuuuuuuuuuuuuuuuuuuuugagauggagcgucacucugucacccaggcuggagugcaguggcacgaugucugcucacugcaagcuccgccucccggguucaugccauucuccugccucagccucccgaguaccugggacuacaggcacccaccaccacgcccggcuaauuuuuuuuuuuuauuuuuaguggagacggaguuucaccauguuagccaggaugaucuggaucuccugaccuuguaaucugcccacuucggccucccaaaauucugggauuacaggcaugagccaccacacccagccugcggucuuuaauuuuuaauuaacuuugauauguuauacugugcaaguuuucugguuaguuguuaugcugaugaauuuaauaauugucuuaccuuuuuuguuuccagccuuguccugccaagaaguuacugaugaugaggucuuagaugcaagcugcuuguuggaugucuuaagaauguacagauggcagaucucaucauuugaagaacaggugaguacaacauuugaacagguuuagcuuggagaauccuuuccccuagugacuuggggccugaccuuaaaauugccuggccccaguguacauuucugugacauuuuagacaacuuuaguguucugggaccagaguaccaacuuuguuccugcucucaugaucagaggggagauacagcuguuuuucacucaguggauggaagguuagcaggaugggacauaaacacacaguugccaaagagcaaaaucuuuuuaguucuugagugacuuggcacuccaauaagugauagggacaccuggguucuuuagaaagaggcaggugacuuuaccuuggaggcccagagguuuagguaagauuuuucuggaccacacccucauuuuuuaaaaaaucaaucuucggagcuuugcuuaaaguagcccgaaaccucaagcagaugucauaugcaauuucaaggccguauucagucacucccaccucccuuuuccacaacuacagcuuugcugccuuuuuuggaacuuggccacccuccuccccgccagaccgcuguuaccaacagcaagucugaagcagaggccaagagaaugaaguucuagagaugaaaaaaucuagcccccagugacauacaggugcauccuccacagccacacuuccaagauggccuuguccagcuucguguaggcguugucugccgccacuauccagagaaaugggaggcggcaucuuggaccucccaaaacuguggggccgacgugaggggcaucgagagacuuuuggaaagggagcuggggaggcuuucuagcaccccuuauuuuuaaagguguucucuuguuuuugcuuuauucugaagccacaggucacuuuuuagacaugguggugguaucuauacuuucuuaaaauguaucucaguuaauccaauuguauguugcaacguuuuucuauuuagaaaauacuuuuaaaauccuccucugguaacuggaauuauuuaucuacauuuuacauuucccuaaacugagagaauaacuuggagauuuagucaccaaggacaucagauaacuuuuuuaagguccgacuucuccaucaaggacucacuuaggucccagucacuccuuggaaguauuuccaacaucuucagcccacagcagucacugagcccacaucgugcuguagucugcaggaaaaagaggugaacacgucuguccgguggccuuuuucucuuugaagguacccagagcgucuagcaugggccuugcccacaucuuuauuaucagcgauccagucaaucaggagcagauuuucccugauugucaacccauuuucuuugucuaaagcuagagcuucagaggaugcauugggccaaaggcuugcuuugugcaaauuaccugauuuuauuaucacaauaaccauguaaggaauuacuguuguccccauuuuacagauggaaaaacacugaggcucagagaaguggaaugauuugcccagaaucaugcagcuauuuaaggggcagagccaggauuuaagacagucuagugcuacagugcacauucaagcucccccuccucugcagugcugucccuuuccuuaaggccuaguuguuacauggcugacccacgguuuagguuauagauccaccuccauccuuucucggaucugcuucaagccugggcccagaugccuggugugugagggcuccuugagccucccaggaagugcugauucuccuccagguucccugcuuccuguucaucuguacagggcugcaccucuggugugccguuggcuaauagcuaggcugccacaccuccccuggauugugagucccucaggggcuagagccuugccuuauuuaucuuugaaucucuacuuccacucuacagcugcaguuuuauagcccaggagggaauucauuuauauaggcaacaaguauuuauugaaugccugccugggguggggacugucgagggcaauggagucguagcagcagacaugacuugcaggaguuuccugcucucuuagagcugguauuccagugggggaugaggauagcaggcaggggucggugcagacaguaagcaggggauuucaggauaugcuaacaagaaacuagcugguguaacauggcauggauagggagggcagaggaggaggagccaagcuacagggggagacugcuccagguagggaggcuccucucaggaggugagguuucagcggagaccggaaguauaaaagagagugaaguguguggacaccuggguacagagcauuccagacagaugaagaagcuaggguauaagucuggagaugguuauaaagcugccaccuguggagaauggcagggaggccagggcggggagggcgguggaggagaggggcuggcgaaguuggcagggagcagauugugcagggacuaggaggcugcgggcggcaucagcuucuauuguguuugcagcggggagccacuagaggacuuugaacuggggacugguuugaucugacuuguuagaaaaggaaggcuggaggggcaagaaugcaagccgagaggaaaggugggaggccgcugcaguuaucuggccgagaugguguggcucagacuggggucgaagcaggguagcugagaguccucaggaauuuagggcguauuuuggaggaggguccuuuuuucaggacugcugcugaauuggcugaggguggguuagaguucagagggguggaggcagcuuuggauaauugguuggggaguaugcccuguggaggagcucuuuuggcagagaccugaaggauaggagguagccgugcgaaggucugagcacagcccgaaaugggaauaagcuggauauguucaaggaacagcaaagaggccaggggccgggacauugugaauguugggggcuuuguaggccagauaagaaugguagguuuuacucuaguaguggaagccauuggaaagcuaaaagcagaagaguaaagcuaucugccuuuuaaaguauugcucugguggcagugugaggggacaccaaaggagaagcagagggccuguguugugaccccguuacucccggaagagugagggguggcuuggguuuuuggggagagagccauuugaguugauccuucaagaguagucccaugccauuggauccagcaaccccgcugcuggguacaaaccaaaagaauucaaagcagggacucaguaggguauuuguauacucagguuaauagcagcauguucgcaauagccaagggguagaagcaacccaaguguucaucggcugauaaauagguaaacaaaacuuucauacaauggaauauuauucagccuuaaaaaggaaggaaauucugcaguaugcuacaacauaggugaagcuugaagacguuaugccgaggaaaauaagccagucacaaagaccaacacuguaugauuccacuugugugagguucccagaguaaucagauuccuagagagauaaagaauggugggugccagggguuggggaaggggaaaugggaaaucaguguuuaacagauauggaguuucagcuggggaagaugagaaaguucugaagauggauggcagugaugauuguacaacaacaugaauguacuuaaugccacagaaucauucauguuaagaugauaaauguuaugauauguguauuuuaccacaauuaacaaaaaacauaaucuuuugaaaucggaguggaggucaaggcugucucagugaaacagaauggucucauagacugcuggcgugaaggcagccaccuggcuuucucuccugcucucugcuccuggaccucuugcuugagggucuucacucgugacaguguccaggacauaacuguuuucuuuaaugagcugggccuugagaagguagaaagcaaauucuacccacauucacuguagggugucugcccgagguggguaguucugaucuugcucuugccucuuccaaccucucuaaagaaugcuuugcccuaugacaggaugcucacgaauuauuccaugucauuaccucgucauuggaagaugagcgagaccgccagccucgggucacacauuuguuugaugugcauucccuggagguaaaccauuaauauuuccaacacguucugugcagcuugugcauauuuaauaaguauaggggaggcaaguguaaucuuuguacaacuuuaaaaguaagauucaguaaaaaucaguggugggaaugaggccaggggagggucuuaaaacuacaugcuuugcaguuggugaucugauuagggaugucaaggcucuuucaaaugauucauugcugcaauuuguguuggcuuugagaauaaagaauguguuauuuuuuccuguuuaauacaggggaacaggggccauaggaaugcuaagugagcccucauuucccuguaacaguauaaauaucggaggaguugacaaaaguuaaccaguaaggaugaaaauauucuggagagaagaaauauguuucuauugcauuugaugaaagaauauucauaguauccagccagauaggcuaauugaggcuaccuuuagaaaccugagcuuuguuaaaaguugauuuuuagugguguaaucaacguagaaacuuguaagguuuagggguggggugaggguggugaaagggauuauaguaagguuuucagucuguuuuuuuuuuuucuccccuacagcagcagucagaaauaacucccaaacaaauuaccugccgcacaagagguagcuguuuuccauugaaauauaacacauaagauguggacuuuuaagauaugauaauaauuugcuuguuuuaaaaagauuuuuuucuggugacauacaggccagcuugaagugugaugugcuugcaaaggaacuuguauuuuggaaauagcuuuaaauagauucucuugguguucccuugcaccccagcccagcugacuuuucuugaaacuggcuuauuuguacuucaaacaagggcuuucuuuuuaccuuuuugaauugauccugggaagaacauaaugagcugaaucugucguguccucagcauuuccagugcugccaaauucuauugcauauuaccacagucauccuuaggaggaaauuguuguuuucuuaagacuuaaaaaauaagauuagcauauuaauuccucuguguaguaauaggaacaaauauuuuuugagcccaugcuguuugccaggcauugcauuaucucauuuaagccucauaacaacucuacaaaguugaugauacuggaguuaaugggauaauaacuaucccaauuuuccgcacacugaggcuuguagagauuaaaggcauucccaggucagguagugaauaagaagcacagccagagcugaucccugggcugcacaacuccagagcccagguuucucacuuauguucuuuccauuaaaccccauucuagccaaagaaaggccuaguuauucagaacuugcuuauucuguuuauuucagaagauuuuaucucgcuuuauggaauguucacuugugguauccuucuuuugacaucucaaacauuuuaagcauauguuuguaaaaagacauuauucaacacaaauuccuuuuuaaaauguggcucuacccauuauacagaaaccguauauaaagauagaucuguguaaauucuccuaugaaggaaugggaugucuuuuggauggaagucaaugaggaaagcuauuucaauguacuuuucaagaauauuuuuucuuaagagguaguuucuaccacaugcuagaaaggaagaugaauguugagcuuggugccaaagggcuaaaagugacauaucaaaaaacuuuuugcauuccagggucaccucacccuacauccaaucacuggaagucucaacauccuuuucauggaagacucacuaguaauauggucugcaaacacugugaacaccagguaaauacaauaccaacacuugauauuuccgggagagguuuuccaaaaguuaggauucuugaaaggaccuagagagugggcugacaucggucacugguguuagagacuaccuggccucugcacacuaguggacugacuaccccacuuuggucagugucagcaugucauuugaggucagauggcaucuucugcaccaaggacaacagacccacuguggauuggcaggcucuugaguccagugguugagucuaugcucaugguggacacaguagauucuagggcugguuuuuuccccuuuacuuuugagguuuuaaaauaauauuuuauuauggaaaauuuccaacaucauacaaaaagagagaauuguacaacugucaccccaauccauuuuauuuuauuuuauuuuuucacagccauuacugacuccgggaucagucaacuuuauaacauuuucauugcccccuaaagaaacuccauacucauuagcaaccucuccccauccuuuccaucacccuacccuugucaaccaugaaucuaccucugucucuauggauuugcauauucuggaugcuucauauaaauggaaucauguaauguguggcuuuuugugucuggcuucuuucauuuagcauaauauuuccacguuucuuccauauuuuggcaugaaucaguacuuuguuccuuuuauuaccaaauaauauugcauuacauggaucuacaacauuuuuauccauucaucaguugaugggcauuuggauuguuaacacuuuuuggccauuaugaauaauguugcugugaacauuuacauacaaguuuuuguguggacauauauuuucacuucaguuggguauauaccucagaguagaauugcuagcuuauaugguaacucuuuuguuuaaccuuuuaaggaacugccagacuguuuuccaaaguggcuaugccauuuuucauucccaccggcaguguaugagggguuccaauuucuucacagccucacccacauuuugaugucagcccacucucuagguccugucuaacauugagguucuagccauccuacugagugcaaaguaguaucucacuguggcuuuuucccccaguuuuauugagaucuaaucgacaauaaaaauuguauauauuuaggguguacaaagugaagauuugauguaugacugugugugugugugugcacgugcaccugugcucauauguggugagaacacucucuuaguauauuucaagaauacaauacaguauuauuaacuguagucaccaugcuguacguuaacucuccagaacuuauucgucuuauaacugaagguuugcaucuuugagcaacaucuccccaccuccccagccccuggcagccagcauguacucugcuucugugaguuugacuuuucuagauuccauauagguaugagaucaggugguguuuaucuuucuauaucuggcuuauuucacauagcagauguccuccagguucauccauguugucacagaugguaggacuuccuuuuugauggcugaauaauauuccauuauauguguauaccacauuuucucauucaucugucuguggacauuccauaucuuggcuauugugaauaaugcuacaaugaagauuguuuugcagauguaucuuugagauacugauuucauuuccucuggauauauaccuaggaguggcauugcuaguucauauaauaguucuauucuuaacuuuuugaggaaccuucauacuguuuuccauuuacauucccaccaacaguaugcaagaguugccuucucuccacacccucggcaacacuuguuacgugcugucuuuuuuuuucagacagagucucgcucugcugcacccaaacuagagugcaguggugccaucuuggcucacugcaaccuccgucucuuggguucaagcaauucucccaccacagucucccaaguagcugggauuacaggcacccgccaacacacccagcuaaucuuuuguauuuuuaguagagaucggguuucaccauauuggccaggcuggucuugaacucccaaccucaagugauccgccugucucggccucccaaagugcugggauuaaggcaugagccacugugccugaccacaugcugucauuuugguaauagccauccuaacaggugugcggugauagcucuuuaugguuuuauuugcauuucccugaugauuagugauauugagugccuuuucauauacccacuggccauuuguaugucuuuuuuuugcaaagugucuguucagcuccuuugcccauuuuuuaaucauguuacuuuuucuuuuuuuuuuuuuuuuugcuguugguccauaugaguuccuuauaaacacucuuuuaguguauuucaaguauucaauuuuggauauuaaccucuuaucagauauaugguuugcuaauauuuucuuucauuccauauguugccuuuucauuuuguugauuguuucauuugcugugucauugcgguucugagugacauuaccuugaagacuaauauguugaauggucuuuuuaaaaauaagguucauauauuaaaagauauguaagauauguuaaggaacuguaaucuauaaguugacuauucaucucuuuuuuccgugcauuauuuugauacuauuguaaguggaauuuaaaaaaauuuauuuucaaauuguuugccacuaguauauagacauacagcuguuuauauauugaccuuauaucuugagauuuuuguaaacauucauuuauuacuucuagaagcuguagaaguuuuguuauguauuccuuagcauucucuguguaugcaaacagucauguugcuuaugaauagaaauaguuuuaguucuuccuuuccaacccaaucuuuauuccuuuuuuuuuuuuuucuuugccuuauuauccuggcuaagacuuaugguacaaaguuaaauaagagugaugauggcagacaucuuugcuuuguuucaaaucuucugaagcaaguauuugguguuuuauaauuaaguaugauauuagcuuuagguuuuaguauaccucuuuaucauacugacaaacuucccuucuguuccuaguuugcugagaauuuuuguaaugaauagugauuggauuuugucaguuuuuucugcauccauugaaaugaucauauuuuagucuuauucuguugacuuggugaauuacagugauugauuuuuucuuuuuuuuuuuuuuuuugagacggagucuugcucugucgcccaggcuggagugcaguggcgugaucucggcucacugcaagcuccaccucccagguucacgccauucuccugccucagccucccgaguagcugggacuacaggcgcccgccaccacgcccggcuaauuuuuuguauuuuuuaguagagacaggguuucaccguguuagccaggauggucucgaucuccugaccucgugauccgccugccucagccucucaaagugcugggauuacaggcaugagccacugugcccagccagugauugauuuuucuaauguuaaaccaaccuuucugggauaaaccccacuugaucaugaugcuuuauuguuuuuauauauuauugaauuugauuugcuaauauuuccuaaaggauauuaguaucuguguuuaugaggaauauuguucuuacacuuuucuucucuugugaugucuuugucaggcuuuguuauaaggauuauacuagccucauaaaauaggcuggaaaauguuccuuccucuguuuacugaaagauuuuguuuaauauugguauuauuucuugcuuguuugcuaaaauuugucuuuucuuuagcucuauuucugcuaauuuuuuuuaaacuuuguuauuggauacaagcauauguauuaugaugaguuaacucaucuugucaugauaaauugucccucuucaucucugcuaagacuccuugacuugaagucuauuugaaugauucauuuuuaaucuagcuaauguuuauuuggucauuucuuucugucauuuucggccuuuguauuuaaagugugacuuuguggacagcauauaaugggucuugcuuuuuuaacuagcuugacaaucuuuuaguuggaaugcuuaguccauuuacauuuaauguaaguauugaugugauuagauuuaggucugccauuuuaccauuuguuuucuguuugucuuacauauuuucuuguuccucuguucccccuucacuggcuucuuucagguuaauggaauacuuuuuaguauuccauuuuaauaccuuuguuggccuuuuagcuuuacucuuguguguuuguguuggggggggagggugugugugagagauuacguuaugcaguuuuaccuuaucacauucuauuuagaguuaauauuauacuucauguaaaauccuggaauauuacaaaaguauaguucuguuaccccagccuuugugcuauuauacauacauuauaaaccucacaauacugugucauaguuuuugcuuuaaagaguuauauguguuucauuucauuuccuuuggauauauaccuggaagugguauugcuaguucauacaguaguucuguucuuaacuuuuugaggaaccuccuccguacaauuuuccauaauagcugcaccagccaggugcuguggcucacgucuguaaucccagcacuuuggaaggcugagacgaguggaucacgaggucaggaguucaagaccagcauggccaacauggugaaaccccgucucuacuaaaauuacaaaaauuagcugggccugguggcgggcgucuguaaucccagcuacucgggaggcugaggcaggagaauggcuugaacccaggaggccgauguuguggugagccgagaucacgccacugcacuucagucugggcgacagagugagacugagucucaaaaaaaaaaaaaaauagcugcaccaguuuacauucccaccaguaguaugcaagaguugccuucucuuaagaggcugaggcaggagaauugcuugaaccugggaggcagagguugcagugagccgagaucacaccacugcaugccagccugggcgacaaagcgagacuccaucucaaaaaaaaaaaaaagaguugccuucucuucuacuaauuaauuaauagaaaaauauguuuaccauuuuucuuguucucagucuuucuuguagaucaaaauccauuugauguuuuuucccuuuuggccuaaaaacuuccuuuuaacauuuguuauagguguacugcugacagauacacuuagauuucauguauaugaaaauguuuuugucuugccuucauuuuugaagaauacuacugcuggauauagaacuuuggguugacaguguugccgugguuuugcuuugguuuauuuuaaauucaucacuuuaaggacauuguucuauugucuucuggccuccauuuucucaguuagugucauuuauaucauucuugucuauguaaauugucauuuguuuuucuucugcuuacacugcuuacaaaauuuucucuuuauuuuuguucaugcugcgcauagaugugguuuucuuaguauuuaucuuauuuaucuuguuugggguuugcugaguuucuuaaauuuguacuuuuuuuaaccaaguuugaaaauucuuggcuguuauuuuuucaacaaagauuuuaugcccauuuuucacuuguuauuuuacuuaauguuggcccacaggucacugaggucuuguucaauuuucuucaaucuuucuucuguguguucuuuaaauuagaucauuucuauugacuuaucuucacguucacugauucuuuuuucucuuuuuuucuuuucuuuuucuuuuuuuuuuucuuuuuuuuuuuuuuuuuuuuuuuuuuuugugacaggggucuuagcucugucaccgaggcuggauugcaauaaugugaucauagcucacugcagccucaaccucccaggcucaaguuauccucccaccuuagcccccugagcagcugggacuacaggugugugccaccacacccagcuaauuuuuuuuuauuuuuuguagagacagggucucacuguguugcucagguugguccugaacuccugggcucaagugauccuuacacuucagccucccaaaguguugggauuacaggugugagccaccauaccuggccugauucuuuuuucaucuccaaucucuguuugccuaugcaacaaauuuuucaucguaaucacuguuguuuuuaguuauagaauuuccauugccuucuuuuuaauaguuuccauuguucugagauucucaauuuguucauucacugucacuguauauuuuccuuuacauccuugagcauauuuaugauacaucugugagguccucgugugcugacuucuuuguauuuuauguuugguaauuuuuuauuguaugcuuaacaucauaauagagacauagagaguagggauucuguuacauaucuaugaagaaaaauuaauuuucuucuggccugcaguuaaccuggcugggcucaaacucaacucugucuccccuacauugggcagcaaaaucucugcucaguuuuuuuagcuuccagcugcuacuuuuugccaggcucccuggaguuucccccugugcacgugugguucagggaucagcccuggaauugaacagaguuuagguauaaacuuuggggcucauccccucugugucuccuuucuuccuggcauuuccccuggucucuccaccagcccugauucuugaacucugucgucugaccacucaauccuguaggaugcugcuuuucgccacccagcaccacaucaaccaggaaaaaaagccacaaacacacaaaucucgcccacagaguucuguuuuuccaacaguugacuucuuuuccauuucugccugcuuuugguagcucuccguucauucaaacgguuuuguuuuguugcaaacuuuacaauuguuaucucaaggagggccaaucuacccaagcaccucugccaucaccaaaagcaggaacucucucacccuacuucaucgucuccuuuuuugcaaugaauaaucuaacaugaacaucuuuccacaugaucauauguucuucuacauuuuguuuaacauaguguuucauucuguggacaugccauauaauuuauuaaaccauuugcuagaacuuccaacuacagucaugugcuauauaaugauguuuuggucaaugacaaaccacauauaugaugguggucccguaagauuauaauacuuuauugguacgguaccuuuucuguuuuuagauacacaaguacugcccacuguguuacaguugcuuacagcauucaguacgguaacauguuauacagguugguagccuaggaguaguagcuagacaguauagccuagguguguaguaggcugcaccaucuagguucuuguaagcgcgcucugcgauguuuacacaaugaugacaucaccuaaggaugcauuucucagacuguauccccauuguuaagugaugcugacuguauucaaauuuuugcuauuacaaauaauguugaugaauauucuuguaguuaugcccaugguuauuuccuuaaaaaucccaaaauuauugcugggucagauauuuaaucuuucaguuguuccaagcgauucuuuaguauuauuguaccucuuauguguacaagguuguuuuaauauguuuuaauagaauuuuauucuaaguacauuauauuuuacuguguuaauguugggcaucucaauauuaaacuguuucauagucacauaucuugcaucuuuaaaacuuugaacuaagccuaaaucguuucuggauuuucugcaauauuucuuucagaguccuguucgauuugauaccuuugauagccuuucacuaaguauuccagccgccacauggguauguacugauuuaugguuuauuuggagucuguuucagaaacauuucaaucugaaagggcuuugaggcauuuuauguggcucaggcacuauguguaauucagauacaugguugguugaacccucucuuaacuuucauaugguggcaugauuaugggagagaggaaaaugaaucguuuuucuuuugcuccagaaauuuuggcuuuuugaauacacacgcacgcaugcgcgcacacacacacacacacacacacacacacacacacacacagacauuaaccucagauugaaagauaccuaaaacagcguggaaguccacaaguucgugcaguuacauccucaugcucuagaaucuguccguaguagcagucuagggugcuuugagccccauguuuguccaggaaacauccaguugugacuauaaaacuuuauugccugcauacaucaaaauaaagcucuggucuucacacugccaucugcuaacaguuucaguauagcuguccuuugaauuguaguaauuuucuucuucucaugcuguagggucacccauugacccuggaccacugccuucaccacuucaucucaucagaaucagugcgggauguugugugugacaacuguacaaagguaugcauugaaccccaaaugucaucgccagcuggccugugugugcugauguagcgccucucacaccagugacccugagcucuucugacuguauccagugggucuuuucagccacuucuacuucucccuaauuugguuuggacauuggcagcucauggaccaaaucucuuucccagaugaguuuuguuucaugcacaguguuuaaagaauaaacugucacgcugagaugagaaaugcccucuccaguuugcugcaguugccuccaaucccauuuguuuuacacccuuccuuuuaaccugugcuaccugccugacuccccuaaguaacuugaguuuuccccucugacucaagaggaacuguauggaacagaauuuuugaagacagagaacaauuaauagaugacaugccagugucagagcaucaguguucgcucuucacauucucuucccuccacuguuucuguuauuuaaugacuaagagggaucagggaaaacaauucacaaauaacugggcagcuggguucauuucagcagguagcagucaagugccaauugugugccgcuauaacaccacuguggucugcagcacuccaaagcuguccuauuuuaggcauugcugcagagaaauguuccuuuuauuucagauugaagccaagggaacguugaacggggaaaagguggaacaccagaggaccacuuuuguuaaacaguuaaaacuagggaaggugagcccacacuacacacccuguuggcuuuguuuugaggacuccguguauccugccccugaaacaacucgguucucccgauuucucuuccacccgcagcucccucagugucucugcauccaccuacagcggcugagcugguccagccacggcacgccucugaagcggcaugagcacgugcaguucaaugaguuccugaugauggacauuuacaaguaccaccuccuuggacauaaaccuagucaacacaacccuaaacugaacaagaacccagggccuacacuggagcugcaggaugggccgggagcccccacaccaggugugugcgcgcgaggagccgaugcagcaggaauuuucagcacagagaaaagcaguuuggcaucaccaccuucugggucccuuaugacaggagcacaaggcuuguacaauggugcuuaaacucuugagaacagcaggauuggggguggaagagggaagauuucuuagaagagguuaaaauuauguagcagugagauguaucguuuuugaaaccauauuacagaugaaaaaguacagagagaaacgcuuaaaauugcagcuuugccuucuaauuuuuccgcuaaaugauauaaucauuggcucacaucauuccagugaauuucuuuuuucggucaugucauuuccugucaguagaggaaauguagggaggacauguccuggcuaaagaucacugagccucuucuggggguugaaaugccuucuguacugaauuauguaucugauuccauuacugcccucagcugaggucucauuuaagccggguagcuauuaucgccggucuuacugauaagaacauggaggcuccacgggguugaaugauugguccaagggcaaacaccacacaggagaacuggcccuagaaugccauguugggccauuuucuaaaggugucucaugugacacacugaguucuuuagaguuagacaugaggaaaacccacucacuugaagggcucacagccugaacucaccaccugucugcugcccccaguuaggucaggauugucucacaccccauacuuuccuauuuagggucccuuacuccuuuuguucuuuuuaugaccacaguugcauggcccgacaccucaucaugucagggagauuguguuuuccucuuucucaucaagucacuagauuaacaucgaaaagagaugagguaggggacagacucugguucaguccuuggcccugguuuuaaaucaaagaccucugcaccccagcuuccccaucuccugggcuggggugcagguuuacuaauguugagagcaugcuggcugugguuaaagaugccagcaguagggccacucgugguggcucacaccugcaaucccagcacuuugggagauugaggugggaggauugccugaacccagauguuugaggcugcagugagcugugaucacaccacugugcuccagccugggcaacagagcaagauccugucuaaaacacacacaaaaaaugucaucaggaaacuacuugguacauaacagcccccaaaaaugacacuugaaaggaaaagacauguaaauauggccuuaauuauguugucuacccauaaacauguaugaaugcuauuacacguugguauuccuuagaagcugacagaauuaaagcaaauagaaugcuuagaucagugguucucaacuuggaggaguuuugccucccaagggacauugggcagugucugguaacauuuuugguuaucacuacugggggaggggugcuacuggugucuaguggguagaggccagggaugcuguucaacauccucuaaugcacaggacagcccccgcaacaaagaaugauccagccaaaaccaucauggugcugcuguugagaaaccuugguuuaggucaaaagccaguaaauuagcuacugauuaacuuugauacauggcauuagcaaacagggcuaggaagcucaaagaucccaggcuagccguaaagcuggagcuagauacacuuuuccuauuugggauuaagacagauuaucccuauuugagauuaaggauaaagggcagauuauuuuaugaaucuauauaauaccaaaugaaauagauuuuuuucuuuguagcauuauggggaguuaacuuucaagguaaucaaaaccagguuuuguuuacagagccacugcuaauuuucauugacucgggccuuuuucucuugcaguucugaaucagccaggggcccccaaaacacagauuuuuaugaauggcgccugcuccccaucuuuauugccaacgcugucagcgccgaugcccuucccucucccaguuguucccgacuacaggugagccacccuuuacaagccccaucuuagagcuaccacugcucuuagcuucuaaaauuagcuuuucacagaaaugaauuaaggaaaauauagauguuuauuuuucauuuuaaggugaaguuucacgauuacacauuccuauuuauuuuuguccaaaauggaaauaacuuuuaaauuaaaaauuuuuaaaguacauaaaauuuacauaugcauauguauguguguauauauguguguauguauaaaauauaaagaaaauuuaaaauuucuugggauaccaucuagagauagccaauuaaacacuuagggucaugcacucuauaaaguuguacaucacacauacauauaguguacauaaacacauacacucauugauacaaacauccacauauacacaauauacauauacucauagaauguacaucuugccaugccaguaaauacagaucuguauuuuaauaguuguguagcauuuggugguauggacuuaccauuguauucauccccuauuuaacauuagcauucuuuuguuuuugccuauaaagucuuuuuguuaaaauuguaaaccccugacauguguucguaucauucagcuccuccacauaccucuuccggcugauggcaguugucguccaccauggagacaugcacucuggacacuuugucacuuaccgacgguccccaccuucugccaggaacccucucucaacuagcaaucaguggcugugggucuccgaugacacuguccgcaaggccagccugcaggagguccuguccuccagcgccuaccugcuguucuacgagcgcguccuuuccaggaugcagcaccagagccaggagugcaagucugaagaaugacugugcccuccugcaaggcuagagcugauggcacugucugcacuguccaggaaaaaaguaaaacuguacuguugcgugugcaagcggccccacuagagccuuccagccuucugguguguucuaagagcaggcuccaccugggagccagccccaguucacaccaaaccaggcucccugaacaguccuguucauguguguaggugguucuguuguguuaagaaagcauucauuauguccggagugucuuuuuacucaucugauacagguaauuaaaagaacucagauucuugaagccaccguuuucauauuguaauguuagguguucucagaggggagguaccuuugucuaaucaacguuuccacuuagaucuuuuauuuuuaauaagcaggcccauaaaaauuguugacaagaauuaaugaaauuauuaaaggcaacaauuuagaagaaaaagugccuuucacuuucgauugcuuuuguagcacguccauugugaaauauuccuuccaggcuacucaaaggauagcaagagaacagguaaaugaugccuaaagaacaccuuccuuuuucuaugccuuuucuaaucuuucaauucuuucuauggaguaaaggcucaucugccaaaucugcccccuggggaaacucuuucacuacuuugucaguuauaagugaagagcuuacuuguugcuuuuaucuuuuguauauuggacugagauguaauuacacuguauuauaaaacucugugaauagccagaacugagcuggaucuuugcaacaccugauuccucugcucuguggaaaacuuuuucuuacacaaggauccacuguggacgguuacuuucaucuguuuauuuauugcccaugcagagcucuuaagguuuacaggugggagcuuggggcuguauaaaaaaauaaucccugcccugaguugacaccuggcuuaggaaggaagggcugacuauggggcugcagucucucugaaccucaguuuccucauuugugaagugaaggguuagauuugaugaccaccaaaguucagcccuuuucacgaaaaggagaaagcagcuuuugacuuuuuaaaaaacauauaacuacagcuggcaucuaguauugucauguugcucuagguccauauucugaauuuauucauuuccaauagccuaauacaaaaaguauauauugagcacuuucuucccuuuucagguaagucucugaaugcagcccagggccaaaggaauuuugaugacacaguaguaccuauguuuuaagcuauauuuuuaauuuagaaaaauggauaccaaauucaaaccgacucaucagagguaagauuuggaaucagaccuuuccaaaaggucaucugagguaaggcuaagaccgcacuuccucugcugggggugagcuggcagacacaccaaacagugccuuggcagcagcucacagugcaggaagcccaggugaucacucuucugcugggcccaggcugcacccugaggacucaguaacucacucucaacagaauauucugugcaggcucuccaggcucugggcgucagggugcaaggggcagcuugaacuguacgguccguccugcacucacccgaugcagaccuugacuuugauguugaaaugaacacacuuguuuuacccaagucugguggaacaaaugcccaaucaugugaccuuaaaguguacugcaaagcuguagcuuuaaguaauugcuguucugccacugcuuacucugaaaucuaccaucaaagaaagauagagaaaaggggcugagccuuggaauauaugguuauaagcagaucuuucuuuggucagagaccaggguuugagccaaggcuguaaaugugaacaauagcugugcaaagccuuuuaaccugacuucuucauuuuguaaauuauuaugcauuaaguagcagcccaauaaucugauuucuaguuuuauuuucaaaguaaguagcuucuuuugggaaaaaccuaaguuaaacuaguaguuuugccauaauaacugcugauuuauguauuugcuaaagguacuuuuguaucugcuguguauuauagcaauaaaauaaucauuuuguuagaaaaaaauca

SEQ ID NO: 191504 - RNA, 5301 nt, Homo sapiens
cgauucgcuggggcgcgucuuucccaccacgaggccaccagggugacugcgggauuccgaucugcgccggagcugcgaugcuagagcacucuugccacccccaccccacggacguguugcagugauaucagaauuuugcgugcgguuuacccguguuuaaccucuuugcgucucgcuucugaaucguauccacuugagcaucacuagacugaucuauuuuaacacugguggggggcagcgaggucaguuauggguccuuccuccuuaaagggguggacaguugacuuugggcaaaccucuucgccucugugggcaacaguuuccccuucugcaaaaugaggguuuggauuguaguuucuaaguuuagcuguggcgugcgaauucccaggagguaguucuuuaaaaauucaggugcucaggcguggagugcagaccucuggguuuuugcaagcuagccagcugauucugaugcacagguggacgugggagacccuggaucagauugucccuagggucccuuccggcuuuaacaucuucuguuuccuuucuaggacaugguuuuaaacuuuaaaaugaaaaugugaaacuaggaauguugcugugagaccccuuggacaaacagauuuuugcacuggggauagaacuugagcaauuucugucuuggccucgccacugacgucccuucuuuccuguggggacaggauggacagauuccuggugaaaggggcucaagggggccuuuugaggaagcaggaggagcaagagccaacuggagaagagccagcuguguugggaggagacaaagaaagcacaaggaagaggcccaggagagaggccccagggaauggaggccacucagcaggcccuagcuggcggcacauucgggcugagggccuggacugcaguuacacaguccuguuuggcaaagcugaggcagaugagauuuuccaagaguuggagaaagaaguagaauauuuuacagguaagcagaggggugugugugugugugugugugcauugagggcuuguuuggugcaauuaaugaucguauguuuggagaaaucugaacucaggauccauuauuuacugauggguucacuaauggauucauccaauauucucugagcaccucugggcuaagccccuuaggugcuugggacauaaacuugaaagaaacuggauugccugucuacuaggagcugacagaugacucgagugaaucucuccuuggcuacugaugaguaucuucugggaaaguuuacaaaacaaaguaaaaaaacgugcuggguucuacugcagagcacuucaaucagaaucgcuccgagugcaggcugaccacuuguuuguuuaaaaagcuuccaggugauucucaugggcagucaggguuugagaaucacuggucucauaggagagauggcaaauaaccagguaauuucuccacaccagugguucucagcaucaccugguggacuugcuguuggcaggacuuggauugcuggacccuaccccugugguuuaguuuaguuucuaaggagaguccaggugcugcuggucuggggagcacauguugagaaccacaccucuauccuguaaugaggacacaaggaucuggcagagaggcauagaaaagcccacaggaagcuaggcgugguggcucgcgccuguaaucccagcacuuugggagcccgagacgggcgaaucacuugaggucaggaguucgagaccagcuuggccaauauggugaaacccuaucucuacuaaaauacaacaacaacaacaaaaaaugagcugugcguaguggugcaugccuguagucccagcuacuugagaggcugaggcaggacaaucacuugaaaccgggaggcagagguugcagugagccgagaucgcaccacugcacuccagccugggcaacagagugagacugugucucaaaacaaaacaaaacaaaaaacgaaagcccacaggccaggcacggugguacacaccuguaaucccagcuacucuggaggcugaggcaggaggaucacuugaggccaggaguucaaguccagccugggcaacauagugagacccccucgucacuuuauucuuuuaugcuuugagacagggucucgcucugucaccuaggcuggagggcaggggcacgaucuuggcucacugcagccucguccgccugggcucaagugauucucccaccucagcauccuaaguaacugggaccacagauguacaccaccaagccuggauaauuuuuaaauuaucuguaggucucacuguguuacccaggcuguuaauugaacuccuggccuugagugauccucgccuuggccucccaaagugcugggauugcaagcaugagccagcgcgccuggcucaccaucucuuuaaaaaaagaaaugcccacaagagaccccagcagugugagccccaucuuucauggggucacaugcccuuagucccuacaguugacaagcuauccuagccuguaaacuaacuuuaucguguuccaauuucagccucuuuauucugcccuuacuguaguuaaggcaguuaaguuacaguguucacuaaaaaaauggcccaggaccauguuucucuccuuguagaacaagagucacuguucuuacaugaacauuuggggcaguuggcuuggugcaguggugcacaccuauaaucccagacuuugggagacugaggugggcggaccacuugagcccaggaguucaagaccagucuaggcaacaugauaaaacccugugucuuacaaaaaaauacaaaaaaaguuagccgggcaugguggcaugccccuguggucccagcuacucaggaggcugaggcaggagggcugcuggagcccuggagguggagguugcagugagcuuacaaaaaaguuagccaggcaugguggcacgccccuguggucccagcuauucaggaggcugaugcgggaggauugcuggagcacgggagguggagguugaagugcgcugagauugugcuacuguacuccagccugggugacacagggagacccugucucaaagaaaacaaaacaaaaagaaaauuuggggcaagccaaaaugaugauugaagagggguuuaaauugcauggaaugacggggaaauguuauuccuuacuucccuuucaaucuugaauacccagggagcauguauguggggcacuggauuucuggugauggcagugcggguuggggggggcaucuggauuucuagaugggggucagguagaaaggaacugccauguuuccucugcacaggagcacuggccagaguccagguauucgggaaguggcacagugugcccaggaagcaggcaacguauggcgacgcugggcugaccuacacauuuucaggccucacgcugucuccaaagcccuggaucccaguucuagagcgcauccgggaucacgucucuggggugacuggacagaccuucaacuuugugcucaucaacaggugacacccuguuuaguggacucaauguuacaagucuucugucuccuccaaaaggaaguguuuaggguuccacccuauuugguucauugguacaaaucauuucuuaguacacuggggcucuaagaguggaauagcgccagcacucggucuuccuggauccuggagcucaucccggaguaggaagugagaggugauuaacuccugaacaaacagcugaaugagauaauuucuucuucucuuuuucuuucuuuuuuuuuuuugagacaggguuuuucuauguugcccaggcuuggucucaaacugcuaggcucaagcgauccucccaccucagccucccaaagugcugggauuacaggcgugaacgacuaugccugacccuagacgauuucagacagugauaaccaucuugcaaaaaauuaaacaggccgauuugacugagaauggcugagagguuugcgauuagggcaagguuucucaacggcagcacugcagacauuuugggcccagucauucguuguuguuggggcugaccugugccuugcaggauguugagcagaucccuggccuccauccacuagauugcaaguagugucccccaccccccaauaccuguccccuggggcagaaucacccugguggagaacccuggguggguuuaagggaaggucacuucagauggggugguuagaggagggcugaggcagugcguuugagcugauaacuaaauggagagugccagccacagacaucuggagggagagcagagggacucuggagugucugugaagcaaaaaugcugcaggauggccggaaagcagugaaugagggaaagaaggggauggcaugagcucagcagugggcaggggccgggcuaugcagaguauggccuuugagugcagggcaaaaucaugugauaaagguuuacauagacuggccaggggaacuacaguaagacgugauuuuggcuuugggugucuucaguuuuaaagcacaugaacuggccggacguggugacucaugccuguaaucccaacacuuugggaggccaaggagagugaauugcuugagcccgaguuugagaccagccuggguaacauggugaaacuguuucugcaaaagaaaagaaauuagcuaggugggguggugcauaccuauagucccagcuacuugggaggcugaagugggagaaucacuugagcccaggaggccgaggcugcagugagcuaugauugugccacugcacuucagccugggugacagagcgagacccucucaaaaauaauaauaaauaagucacaugaacaaauacgucaacagaccucuucagcguuggcuuaucuuagagcccacuguggaccucaagcccucgcagaaacaacggcagguacagccaugcagagugcuguuucacacugugaggaaaacgagggcuggcggugcuggugaguuucaggagaggguuguuuuuaugcacuguguuuguuuucucauugcagguauaaagauggcugugaccacaucggggagcaccgagaugaugaaagagaacuggccccugggagccccauugccucugucuccuucggugccugcagagacuuugucuuccggcauaaggauucccgugggaaaagccccuccaggaggguggcgguggucaggcugccgcuggcccacgggagcuuacuaaugaugaaccacccgaccaacacgcacugguaccacagucuucccgugagaaagaagguucuggcuccacgggugaaucugacuuuucguaaaauuuugcuuacuaaaaaauaaaaacauuuuuaacaguuu

SEQ ID NO: 191505 - RNA, 128829 nt, Homo sapiens
auuuucugaauggucuugcuucuuugucuaucuugucugauuuucuccugucugaccuuuuccugguuaaaaaucugggggaaaaugacggacuccaagccgaucaccaagaguaaaucagaagcaaaccucaucccgagccaggagcccuuuccagccucugauaacucaggggagacaccgcagagaaauggggagggccacacucugcccaagacacccagccaggccgagccagccucccacaaaggccccaaagaugccggucggcggagaaacucccuaccacccucccaccagaagcccccaagaaacccccuuucuuccagugacgcagcacccuccccagagcuucaagccaacgggacugggacacaaggucuggaggccacagauaccaauggccuguccuccucagccaggccccagggccagcaagcuggcucccccuccaaagaagacaagaagcaggcaaacaucaagaggcagcugaugaccaacuucauccugggcucuuuugaugacuacuccuccgacgaggacucuguugcuggcucaucucgugagucuacccggaagggcagccgggccagcuugggggcccugucccuggaggcuuaucugaccacaggugaagcugagacccgcguccccacuaugagguaaugugcauuuucuccuuguaacugaggagugcagaguucaggugggguccacacccuucccaaccugugcccaccuugaucaagcuguuugcugaugccaaagcuucaaggguggcuaugcacaaaaggagaagacacgagccuucucagaaguuuccuuccuuccuuccuuccuuccuuccuuccuuccuuccauccuuccuuccuucuuuccuuccuuccuuccuuccuuccuuccuuccuuccuuccuuccuuccuuccuuccuuccuuccuuccuuccuuccuucccuccuuucaaaaucauuccuugaggcugggcacaguggcucaugccuguaaucccagcacuuugggaggccaaggcaggcagaucacuugaggucgggaguuuaagacuagccuggccaacauggugaaacuccguuucuacuaaaaauacaaaaauucaccaggcaugcaggcgugugccuguaaucccagcugcuuggaaggcugaggcgggagaaucucuugaacccaggaaguggagguugcagugagcugagaucacgucacugcacuccagccugggugacagggcgagaccuugucucaaaaaaggaaaaaaggaaagaaaucauuccuugugcaucuacugcaugcacagggcucgaugccaugaaacugacuuucuagaagaccucagccuaguuggggaagaugaccuuguguuuaguuauaauuuaagcugaaugagccaaggcuggcaagagccacaagugaugaugguagucuagagggaggggcaguucucucugccuccugaagagacauugauucauucauucuuuuuuuuuuuuuuuuuuuuuuuugagacagggucuuacucugucacucuguuagcugaguguacugguaggaucauagcucacuacaaccucaaacucccgggcucaagcaauccucccaccucagugcacuccuggguagcugggacuacaggugugcaccaccacaccuagcuaauuuuuaaauuuuuuauagaaaugggaaucucaccauauugcccaggcuggucuccaacuccuggacucaagcgauccucggucucccaaagugcugggauuacaggcaugagccaccacacccagcccauucauucauucauucauucagcagguaacugacaacugaaaaaccagccuucccccagugaugccugaaaagcagaaacucaaacacucuaaaggucuccaucaauuugauuguuggaaaugaaugccuguagguucauaacaggugggacuaucccagcggcugcagucaguggcuuuguuguugauguuguuguuauccaccuucuccucugccauccccaaauuacaaauggaauacagcacuuccagguagaaaauuugggaaauauaggagaacagagagaagaaaagagccaccaaccaaaacuucaccagccagagggaaaccucuguucucauuguucuacuucuuccuucuaguguguuuuucuccucuggagugaaguuuuacuggcuauucuuuuaagcaucuccuguacucucucccaaauuagaaaaaucuagagguggucuuccauacauguccauguuagcagugagcuugguuuuaacccugguagcuggaaguagaagacagagaaaaaggaggaggaaaguauuccauauacugaaacuuuucaggggaagaguguuugaguuucuagaaggguuaagggaagagaaagucucagaaucuaguacaaagagcacagucuguggagucagcuggagugggguucagucuuuggcucugccacccccuacugugugaccuugggcaugacccuucaccucuccaggccccaguaccucuguaaaauguggaagggauuaaaugggauaauguaggcaggcaugguggcucacaccuguaauuccagcacuuugggaggaugaggcaggaggaucgcuugaggccaggaguucaagaccagccugggcaauauagugagaccucaucucuaaaaaaaaaauuaagaauuugccagacauuguggugcauaccuauaguucuagcuacuugagaggcugaagcaggagggucacuugagcccagaaguuugugguuauagugagcuauaauugugccacugcacuccagccugggcaacagagcaagacucugucucaaaauaaaaaaacaaaaaagaauguaucaaaccaacaaacuuauaacaugauuauuauuauuacuauuuccugagucuuggaugccaaaauagucgugaagauuaaaugaacuaauauuucucagguacuuggcaagagaauaaagcauccauauuugguagauaauaaauagaaaggggggcaagucucccaccuuuccacccacugucuuccugccaccauuuugaggggucuuuacugguuugagcuuaaaccaagguuuuucugagcugguacauuuauaaaggcgaaaacuaucucucucuuucucuuucuuucuucuuuuuuuauuuuuuuggacagagucucacucugucacccaggcuggagugcaguggcaugaucuuggcucacagcaaccucugccucccggguucaagcaauucuccugcuucagccucccaaguagcuggaauuaugggcgugugccaccacaccuggcuaauuuuuguauuuuuaguagagacgggguuucaccauguuggccagucuggucuugaacuccugaccucaagugauccacccgccuuggccucccaaagugcuggaauuacaggcaugagccaucacgucuagccuacuuaacuaucuuucauagggaaaaugaaaccaaaauguugagugaauuuccugcccucgugucuucauggcauagaaaccuaacauuguagaucaaucuuuuauccuuacuuugucccagcaaacagcuggcaggagggacagagggaucuuggaaaggcagugaauguggagcugaaugacauuguaggauugugggcgauucaaaggcuaugauauggugaacgaaggagugaugugcugcaugaacuugggugagucccuuccccucucugagucuccaauuuaucaucuuuagaaugaggaggcugaggcugggccugauggcucauaccuguaauuccagcacuuuggguggccgagguggguggauugcuugagcucaggaguucaagaccagccugggcaacauggcaaaaccucaucucuacaaaaaaauauaaaaauuagccaguuguggugguaugcaccuauagucccagcuacuagggaggcugaggugggagaaucacuuaagcccaggaggcagagguugcagugagcugagauugccccacugcaucccagccugggugacacaggcagacccugucucaaaaaaaaaaaaaaaaaaaaaaugaaugaggaggcugcaccagacuccugagaugugaccuguggcccuaaagcucacugacauacaguuaguuauuuuguccccgguaugugugcauuuucagaguugagaauuuagaauuuuagcacccaggggcaaugcgggugguucugcuggcaccuccugagacacuggcacuuccucaaggaacauucccagccccagaaucaggggcuucugacagagaagacucaugugugcuuguuguuucuaaugaacuguagugagaaucccacaucaaagaaucuucagggagucaagccuuagacaugugugcuggugccugcugccucugguguuugacuggaugaaaaaauuauguccaaaccugguguuccagccuguuggaaacaacgcauaucaaaaugaggcugagguccagcauggugacucacgcguuuggggagacugaggugggaggaucccuugagcccagaaguuugagagcagccugggcaacauaaugagacccugucucuacaaaaaauaaaaauaaaaaauaaaaugaggccagguaagguggcucacaccuguaauccuaguacuuugggaggcugagguggguggauugccugagcucaggaguucaagaccagccugggcaacauggugaaaccccaucucuauuaaacuacaaaaaauuagccaggcaugguggugcacgccuguagucccagcuacucaggaggcugaagugggagaaucgccugaacucaggagguggagguugcagugagcugagaucacgccacuacacuccagcaugggcaacagagugagacucugucucaauaaauaaauaaauaaauaaaaugaggcugagcauuuuauuaucuuguagagcuuuuggcuuuggauuuuggcaucuuugggauccgugguagccugguguuugcugguuacccauugacucuuuugcacacauacaggcaggguaguaauaccucuucccugguguucacaggucaacacccaagcaguuuuggguguaggccauggaagguggugucaaaagacaaaaucacagcaaauuugauuuaaaacucgaauuggcuuuuauuuacaauucuaggaucaugcagcaccucauucuguaaaauagaaugggucuuccgaagagcugagcagagaggagcuuggcuuuauaggcagaacagggcugaagaaagcagaaacaagggacaaaggggagcuucauaguuucuuucuuuuucuuuuucuuucuuucuuucuuuuuuuuuuuuuuuuuugagacagagucuugcucugucacccaggcuggaggcuggagugcaauggcacaaucucggcucacugcaaccucugccucccggguucaagugauucuucugcuucagccuccugaguaucugggacuacaggcacaugccaccaugccuggcuaauuuuuuauauuuuuaguagagaugggguuucaccauauuagcuaggcuggucuccaucuccugacgucgugauccaccugucuaggccucccaaagugcugggauuacaggcgugagccacugcgcccggcccgcuucauaguuucaaaaugacuuucccuucaggguuaaaacaaaugcaacuuucuuaucauguuggcucagguacacuggaccccuucugauugguugcuauuguuuuuuggaaaacuggucaguuucaaaguucagacugauugcgaggcaguuggccaggagugauccgucguuuugguuuggucuguaggggcuaagcacaggagcucagcucaaaaucauggccucccauauauuaaaauuuuguuuuaauuuuuuagauuugggggguacaaguucaguuuugucacuuggauauaauucccaguggugaagccugggcuuuuacgagccauugcuugcauaguguacauuguaucuauuagguaauuugucauuccuuaccccuucccaccaugccaccuuuccaaaucuccaguaucuauuauucuacucuuuagguccauguguacacuuuauuuagcuccacuuauaagugagaacaagcauaaauuauauuuaaggguggugcaugcaggccagccagccaguugccuguaaccagcuggagcacugaggaaaggaagccugacccaaaaaggcaaauacagugagcaagaaucccuguuagcugaauccaggaacuccuucugaaaaaaaauauuauuuuucuugaggccaggcacggcaggucaugccuguaaucccagcacuuugggaggccgaggggggcggaucacaaggucaggaguuugagaccagccuggccaacacggcaaaaccccaucucuacuaaaaaaaaaaaaaaauagaaaaauuagcugggcgugguggcaggugccuguaaucccagcucuucaggaggcugaguuaggagaaucacuugaaccugggaggcagagguugcagugagccaagaccacgccacugcacuccagccugggcaacagagugagacucugacucgaaaaaaaaauuauuauuauuuuuucuugauaaguugcuaaauaaucuguauccucuggcaaaucuucuaaccguuugagguccuguuucugcaaaauggaagcaggggcuagagguuuaagcuaguccuuccagacaggauccaacccuugccccauuuccaagacaaacaacuaaggccugggagaagaggccagggguauuuauuugaggguucugacucacguggaagccacagugaagaagugacuuguauuuguggaucugcuucugcucucugcaguuuccuugggcagucacuucacugcugcucugcccuggaaggccacuuccuacauucaccucuuccugccaggccaguagcugggagacuggcaaggcaaggauggaaaaugcuuguguuaagucugugauuugggaggaagcucuuucugaagcagucuucaaggggcugucuccuuccugcagugcccagagcaucccagaguucucacaacuguguuccuguuuugggaguucgcacuggguucccucugaacugaaacacucucuuucucccaaccccugaacccagaccucccaccagggccagcuucacaggcaugcccugugcuucaagggaccccgugcuuguuuugacgcuuuguugucgccgucuugagauucuuuuuuauuuuguuuuuugagacaugaucuugcucugauacccaggcuggagugcaguagcauggucauggcucacugcagcuuugacuuccugggcucaagugauccucccgucucagccuccugacuagcugggacuacaggcacgugccaccacagcuggcuaauuuuuuuauuuuugguaaagaugagguuuugccauuuugcucaggcuggucggaaucucaugagcucaagcaaucugcccaccucggccucccaaaguacugggauuacaggaauaagccacugcacccagccccaaauucacaauaauuuuucaacaaggggcucuguguuuucauuuugcacuggguccugcaaauucuguagccgguccugccucuacugcuagcucuuugcccaucagagucacuuccucaaagggccuucccugucccuuucucacauuuaaaaaaucuaccccccaauuaccuucaguaucuuuaucaaucacucugauuaguugucuuugcaacauuuaauuauuucuugagauuaugucuguuuuuguuuguuuguuuguuuguuuguuuugacacaguuucacucugucacccaggcuggagugcuguggugugaucucagcucacugcaaccccacaggcucaagaaauccucccacaucagccuccugagaagcugggacuacaggcaugcaucaccaugucuggcuacuuuuuuuuuuuuuuuuuuuuuuuuaguauuuuuaguagacacuggguuucaccauguuggcuaggcuggucuugaacuccugaguucaagcaauccacccaccucggccucccaaagugcugggauuacaggugugaaccuccacaaccggcuccuaaaagauuacgucuuuuauuuuuuuaugaucuacuugguuauuaccugucucccuacacuggaagcaaguuccgugaagccagggccauaguuauaguggucucuguuuuuccccacugccuaggcuggugcuggcucaugguaggcuuugaauaucugcuaaauacaugaaugaaaugagcugcaacaagcuugccaaagacagaauucugcauuacgggggaauguaaaacaugugaugaaugagugugggaauggaugaacgaauggaugaaugaauggaugaaugaaugaauggauuaauuaauuaauuaacaggugaauaggcauuuuauaguuguugcucuuuagcagcaguaaauuuuuguuuucauaaaauucuuucuccuuguaucuugugacuuuggagacuaguucuggggugaaacuccaauuuuaaauuuuucuucugucuuugauaggaucaugcaaacucagccuuucucuccuuucucccagcuggcaagggcuggcugagaauaugaauccaacaaccucguuaagcucucuccucccaucuccuccccuuuggguugaucucagggcagggauuagaacuuggccuuuccuuggacuuggaaacagucccugagguuuggaaaucccaugcaacacuuagaaacagagcuaaugagaacauuacaugauguggcaaaaucacugcuuacaugcucugaaaugagcacgguuacaagaaccuccuguucugugugaucccauuuuguuggacaaacagcaugugguuaguagugcauagugggccuaugaugagacacucagguucaaagcuaccucuuccuagcuuguaccccgacuuaguaugacccuguggggugcgcauguggacugaauggaaugggacagguucaggauugcugagauugcagcuggaauccugaaacuuaaagcuaugaaauugaaguucauaaauuaguggugaacucauuuggcagcaaaaccuguccugaauugaugugagguuauguauaguaauuauuuauccuauucugcugcugaaauauuaauaugauaauguggaacagaaaguuuuaccuuccuaaaaacaauaauuuccaaguuccaaaacauaucaggcccugggaauuucagauaagggauuauggacuauauauaacaugcuuagaauaguuccuggcauauaguaagcacaaaaaaugcuucugcuuaguaaaugugccuaauaaauguguguguguguaugcguauguguuuguaugugugugucuuagagggacuguaaagagugucuccaaauaguaaauaaucauuuuaugugguaugauuaugagugauuuaaauuuucuucugcauuuucuaacuuucugcucuaaaugucauuuuauaaugcauuuuaacaauguauaauaauaaaacaguauaaaaauauugggagaaagaguaaaccaaucaucucacuuccuagauaggaagcugaagcccagagacauuccaggccucucagcaagguaaucagaggcccagagcaccauuugaacccagacccucguuagauguggaugugaaaucagucaacgaacugcuaguauuagugucacugccuaaccuucccccagcggguaagaggcuuggacuccaggacgggcaccuccguccuccuccuaacuuguucuuucuauuagugggaaggguugggagauuaggguaguuuauggauaaccuuuaagucguaugagcuugaggacaucaucuaccuucucaggggccagacuggacacucugagguucuuuguggcucuaacaguugguggcuuuguuccuuuauauguggaggaauggacagcagggagggggcugggagauagagaaggagaguagcuggaaaauggcagaaaaguuuguuaauuuacaggcaggcugaagcgggaggaucguuugagcccaggaguuugaggcugcagugagcuaugauugugccaguguaccccagccugagcaacagagcaagacccuaucucucuuaaggaaauuguuaauuuagaaccauuuucucccugguaaaugaccacagauagucuggguucuaggcaagagagaggacacacuaagggaugaaaugguagguggggaagucaagguuugucccauccauucguuggcccaggagcaguuauugcaaccccucugggugccaggcagucaguuggcacuacagaugcaaagauggugagauacagccucuguccuuagggagaccagggcaaggggucugagagcccacaggccagggcauuccccaucauuuuuacagagagagcuguggaauaguuaagagcacaacacgcugguggcugaggcugggggcuggugugcuggcuucuccaccuagccaucaugugacuuggggccaaguucugugauuuucugugccucaguuuccucugaaaugaagucaucguguuaccucccucacaggguugggaucaggcuucauugaguugcuguaaguacagcacucgaagcagcacccauggugcgaucauggucauuagauccagugcacggcauaagagcccaggacccacaaucaggucuggauucagaccucuccuguuaccugucugagcugcaauuuccugcucuguugaggcaggauaauacuagugccuacuuuaggagauuguugagaucgagugggagcaagugcuggggguggacggcccagaggugguucaguagccauuaguugggugggcuucuuccaaaguucuugccugugcgcaugguuauucccaagcccuggccgggcuuacaucuuaaagguguagcaaccuguguccacggaggaggaagaggauugaaaaggcaggugaagugucccgauaaaaggauaaaguccaaaacagcagaugggugcugaaguguuccuucccgccaccauuuacgaccauguugggaucacugagguaagaacaguuuagcaaggcagaccuuggaucccaggaaggcaaaugaggcucuguggggucuggacauacagagggggcccugcaggcaaagguaggugaaggaauaccaggaaagggagcugacaccagggaccuggcaucgcccccacuuucccagauagcagacugggugggcuugcagugcagccucccagcugcuuguucgucaucccagcccacaucucuuaucggcuccaagcaaggaacaggucaggaaacuaaauugucuaugcauauuuuuaugcgccccugagugaaaugccaaggaucuuccuguaauguuuaauuuauucauuuauugacuuaggaaggggcugggagaaacucucuuuucaagucucuuuagcuccuaaaauguuuacuuuuucuuuuucuuuuucuuuuuuucuuuucuuuucuuuuuucuuucuuuuuuuuuuuuuugagacggagucucgcucuguagcucaggcuggagugcaguggcacaauuucagcucacugcaaccucuaccgcccgggucccgguucaagcaauucuccugccucagccucccgaguagcugggauuacaggcaugcaccaccaugcccagcuaauuuuuguauuuuuaauagagacaggguuucaccauguuguccaggcuggucuugaacuccugaccucaugaucugcccuccuuggccucccaaagugcugggauuacaggugugagccacugcgcccggccuccuaaaauguuuucuaggagcuugggggaaagaggaucccugucuuugaguuguucuuguauuaaguuaauacaagguacagagcaacuaaccauucauacauuccccucccccuuaagcaucauugcccuauuuuagaaaaauuauucacuucugcucuauacuuaauguaacacagucccccccaccccauauauugaaagagauuauuucauuuugcuuuucugcaaaaaugaaggcaaauuguauguggauaauuuuauaguugaggaaguggagagacgggauuuacuuaaggucauccgugaggggaaggguaaguucaagcccauggauggcacagucuuucuaccacgcugcuggccacaugcaugcggauuuucuuguugauuuuguguguguauuguucauugaccuggguuuucccucugcaauaccaguaaguaaaauugagcuucuaguaagucugagaggaagggcuuaaugcaugagacagcaacuaccaccaugcuugaacuguuucaucaaaaagcacaacaauggauguuuguauaaaggugguguugugcuuggagguggauauuagguuggugcaaaaguaaucgugguuuuugcaaucccuuuuaauggcagaaacugcaauuaguuuugcaccgacugaauauuauucauuucuuuccgucuucuauucccuaauaaugcaauuagagaaaaaugcaaggucaugaucacugugaugaaaugaugagcccacccaucuaaaugaaaucccuuauuugagacccugggucauagugagaugugugaggcugucuuucaggcuguauuagcagagaagugagaauaucuauacaguguuuaaguaguguugggguuuuugcaauagagaauaaaaaucuagagcaauacaaguaugcuggcaagcaguucucuucugcaugauccuaacugacuuugguaggguugggguauuuugaaauaucuucauuucuugauuuucauugcuuucccuauuuugaggugguuacauuuacacuggggauauuugggggaugaauacuuguugguuuugguuugaaucucuaaaaaucaggauacaguggguuacuuuuuuggaggaggugaagacaaggcugugaacaccuucccagaaacuugaagaacugagaauuuuguuuaucuguuuuuuuucuuaaaccuguuguugaaauguuauuuaauauauggucagggcauagcuauccacugcugucaggcauggcugcuuaaacaggggcccaggguguuuauguuguggccaaguacuuggcacccccgggaaguguggcccugccugugccuuuucuuucuuucuuucuuuuuuuuuuuuuuuuuuuuuuuuugagaaagggucuugcucuauuccccaggcuggaguguagcgagaucauggcucacugcagccucagcuaccugggcucagguaaucuucccgccucagccuccugaguagcuggaauuacagguaugcaccaccacgcuggcuaauuuucauauuuuuaguagagaugggguuucacuauguuggucagguuggucuugaacugcuggccucaagugaucugccugccucggccucccaaagugcugggauuacaggugugagccacugcacguggccuuccugugaagugaauuuuuaauuguauuuuaaaauuuguuuucauguuuuuguuuguuuugagacagagucuugcaauguugcccaggcuggaaugcaguggccugaucucggcucacuuaaaccucugccucguggguucaagugauucuccugccucagccucuggaguagcugggacuucaggccaccccgccaccacacccagcuaauuuuuguaguuuuaguagagacgaaauuucaccauguuggccaggcuggucuugaacuccugaccucaagugaucugcccaccucggccccccaaagugcugggauuacaggcaugagccaccaugccuggccuguuuucaugauucugauacauuauauuuuuacacauuuauaggauacauguaaaauuuuguuacaugcauagaaugcauaaugauuguagggaccaagggaauaucuucugcuuugcccucugaaguuucgcugaaaaauuaacuuguaaaaaggcagauuaguuggagaaaagacacacaaauuuaauuaauguguacacugggagaaccgcagagugauuacccagaagggaauuuacuggccagcauuuacauuauuuuugguugguuuguuggcuaugaaaguaggcuaccuuuauuauuacugcgaugacuucuagguaguguuuugguucuuugcauuuauuacauuacuugaagaagcauucauucauuuauuuuugauuuuuugagauggagucucacucugucacucaggcuggaaugcaguaccgccaucugggcucacuucaaccuccgccucucggguuuuagugauucucucuccucagucucucgaguagcugggacuacaggugugcaccaccaugcccggcuaauuuuuguauuauuaguagagacagggugucaccauguuggccaggccggccucaaacuccugaccucaagcgccugccucagccucccaaagugcugguauuacaggcaugagcuaccaggcccggccucauucguuuauucuaacuggaaucgguuugucugaguucaagacccugggcucuggcacuucagauaacaugcaucucugggccccaguuuccuuaucuguauuauagggauaaaaacaauaagauugccacgaggauuaagugacacagaggaacaaaggagcacuuaguaaauguuagucuuaccagaaguuuauuucggaucaccgggcugcugggguccucccuguccuggaggcacucgcuucaguagcggacccagguggugcaaagugcgugcuagaagcacacugggugauugcgcagccaccugucccagggaguggaggugaaaagaugagagaaaccaggacuuugggaaauaaaagucgacuugacaacagggacuuuuaacgggcacaguggcgaccucugacucacauuuuaaauuucccauauuuuccaccgcuucccuaucguguguguauucaagcauaucaauugcugccaauauguaggggugucccauauuggggagcaaagcagaagagaggcuuuaaaaauauauaucuccgcagcucauuucggcugccgaagcucagcggcgggucggagguaggccggcccgggggcggggcuccguccggaaggcggggcccuccuggggcggggucggugugggggcggggccuggguggggccuaggcgggcgcgauggcccgggacucuggcgcgcagggugcauuucgggauggagcaagcgcagcgcgaaguugggcgcccgccggcugcagcagaaccccgcccgcggcgcucuaggacugcaucucggccuccgggucgcgaccuggcuguccugcugggucccgggccucgggucggcuucaggcgguuaaggggugcaugcucugcaccccugcgggagcccggugggauuggccugcgggguggucaacaugaguccugccaagugcaagaucuguuucccugaucgcgaaguaaaguaaguaagccugcaauuguaaugaccaugaucuuuuacaaacuuacgcagucuuccuuccccuugaagucaagcuguguguccucuuagcaccgcccccuuuacccccacccccauccaaagaaacacgggcuugaguuggcugcuggggagaugaugcccgccuuggaaacucuagcuggccuuggcgggaggggaggaaggaggcuggacguugggggugacguugcuuggaggaggucgcuucggagcacacaggugccuaaagaucagcccuugcgcaggggcacgccuuccccgcuuucucuccuucgccuccagaagcugaugguuguggaaggcaggucucuuuugaagcugaagccugggcaaaucgacgugaacuugagcaggcucucauugagggucauuuucugagcagaugagcguaggcaucucagugccugagugcuuuguagcucuaccuacuugguuuuguuucuuuccuuuuuuguccucauuuuauugcacuuaaaaagaauuaccaaauugauggugugucuguuguugacaauucagaaaauuauagauaagcaaaaaagaggaacaaaaaucacccauaauuccaccccugugauguuuguuaacaguuguauauucuucagcuuuuuuuuuuuuccggugcagauauguuuuaauuuauaaacuugaaucaugcagaacguucuguaacucacuuuuucauucaacauuaaguauuuuucuaccacugggcuuggcaaacuaugacccacugccuguuuugggauggccugcaagcagagaaugguuuuuucauguuuaagugauugaaaaaaaaaucaaaagaagauuguuuugugacacgugaaaauuacaugaaauucaaauuucagugucuacgaaaaaaguuuuauuggacugcagccugcucaucgauuuaugauuuaugccuaguucauggcugcuuuugugccucacuggaggauuugaguggugggacagagacugaccagaucuaaaguacuuacugccugacccuugacagacaauguuugccaaucccugccuacaacaugcuuuuacuggauucauaguguuccuuuaaaugggugcaccuuaaaauguaugaauaauccucgccaggcaggguggugcaagccuguagucccaaauacucaggaggcugaggagggaggaugcuuuugcccaggaguuggaggcugcagugugcuaugaucguuccugugaacagccacugcacucuagccugggcaacauagcaagaccccaucucugaaaaaaaaugugcccaggugugguggcucaugccuguaauccuagcgcuuugggaggccaaggcaggagaacugcuugaacucgggaguucgagaccagcuugggcaacauagugagacccccaucucuacuuaaaaaaaaauuagcugaggauggugaugcaugccuggaguuucagcuacuggaaagacuaagggaagaggauugcuugagccugggagaucgaggcuguagugagcaaugguugugcuauugcacuccagccugggcaacagagcaagacccugucucuuaaaaaaaaaguauaaguaauccccuauaaguagcggauauucaggcuguuucucucuguuuuuuuuuuuuuuuuugggggggggcuauuaucaacagcacagugaggaauaccccuguagcugaaucucugccuccauccuuuauuuucuuaggauauguuuaccugguccauaaacauucaugcacaccucccaugcauaaggccugcaacugguagcaggaagggucgcaaaaaugguuggaaaccgugaccuccgcccuccaggaacuucgguuccauuguggaaggcagaugucuucucaguaacuccaauucgaggcugaugggugcaacaguaauagccacuaccacucauggggugcuuucaguaugccaggccaagugcuuuguagguguggucucaugccaucuucaaaauaccacugugggggcacuaaguggagaguguuguacccauuucacaaaccacuuuaauggaaaaaaagaaaaaccucacacaaauuuggaauugucccagcaaguccaggacguggggucccccuauuuauaauaauauggacauacuuuguugggggacuacauuguuccucucuuagcuuagaguggcuaaaaagauggauuuggacgaucuaacuuugccaccaagcugugugaucuucuggagcagguaccaucaagccuuggaaccucaguuuccacaucuguccaagggacuagcccucauaggccuuucuagaguuguuauuauuauuauuauuauuauuauuacagacagggucuugcucuguugcccagacaguggcaugaucauggcucauuacagccucagccuccgggcucaagcaguccucucaccucagccuuccaaguagugggaccacaggcaugcgccaccacacccagcuaauuuuuguauuuuuuagagagacaggguuucaccauguuucccaggcuggucuugaacucuugagcuaagcaauccucacaacucagcuucccaaagugcugggauuacaggcaugagccaccaugcccggcucuuucuugguccguugagacucuguguggaagucgcuggucuugaguacugcccugggucagcacaaacauugaugaaaacuaauaaguaaagacagaguucgguuaugaaagagcccucuggaguugggaggcauuugggaucuugugcugaaggcucgggccaucuaagaagccagaacuccugagaaggugaggucgcaaaugaugacugauuuuucauggcaugagaacggggucacaguucagagaguagagaaaugauuguggaucagagugcagaagggcuugaaauaaaguuggggaugaggaggcagaaguuguuuuuuaaugagucccauuucacugccaugcaauucugcucugaaaggccagcugccugcaugcaaauauuggcuguagaccuaucagggguuuucacucuuggcuacacauuagaauuuccugguggggagauuuuugaaaaaucuggaugccggggaccccaccucuacccccuagacaugcugaugggaccccgacaucagaaucuuauaaaguuuuucaugucaggguugaaaacucgugccuagcuuggggucagcagacugcuauuauaaacggccagacaguaaauauuuuuggcuuuguggccauguggucucuguuguaacuacucaacucugcuguuuccugcaccagaagccauaguuauguaauugaacaggccuggcuguguuucaaucagacauuauuuauagauggggaaauucaaaguucauauaauuuuuaugugucacaaaacaggauucuuuugauuuuuuuuuuuuuuucgaugacuuaaaaauguuggcugggcaugguggcuuaugucuauagucccagcacuuuagaagaccaagacaggaggguugcuugaggaguuugagaccagucugggcaacaugaugaaaccccgucucuacaaaaauaaaccaauuaguugggcaugguggugcacaccugcagucccagcuacucaggaggcugaggugggaggaucacuugagcccaggaguuugaggcugcagugaacuauuuuugcaccacugcacuguaguccuggcaacagagggagacccugucucuauaaaaaacaaauaaggcugggugcgguggcucacacuuguggucccagcacuuugggaggccaaggugggcagaucgcccugaggucaggaguucaagaccagccuggccaacaugguaaaacccugucucuaauaaaaauacaaaaauuagcagagcgugguagcacacaucuguagucccagcuacucgggaggcugaggcaggagaaucacuugaaccugagagguggagguagcagugagcugagaucacaccgcugcacuccagccugggcgacagagcaagacucccuuucgaaacaaacgaaacaaaacaaaaaacaaucuaaaaaguuaaaaccgcucuuagccugugggagauacaaaaacagguggccgaguggauuugacccauggguccuaguuugcccacucaccccuggccuagccaagguagucaucccaggggguacugauggggcagguggcuugagaaauuuccaaggguccauuucuggagagcgugguuuugugcuguuugaacgauaucaaccuuuacugggcuacacaguguucuuucuugcuuucuuguuuggaaguaguuguaauuacagaauugccuggcucagaaucagcucuuagcagugcggguagccguuaccaucucuauuuuauagaagaaaagagagggaagaaauugaaggucugauuaaugccggggcccuagccuaauggcccagccugggcuccuguaaugcuauccugcagacguacaugguagcuaaaguguugcaagcuguuuacuuuggcuagguccagggauaaacuguuaauuccaucaugugaggaaacugaggcagggaguauugaaguaacuuucccaggauuacacagguuauaagcgguagauucuggcuucaaagccuaggaggauggccgcagucuaccagaguuucuaaacugcggcucuguugacacuuggggcuguccaguucuuuguggggcuguccugugcauugcaggguguugagcagcaucccuggucuccacccacuagaugccaguagcgcaucccccaaguugugacaaucaaagaugucuccagguauugcuccccggggagcaaaauuucccccaguuaagcacucagggcugggcgcgguggcucaccccuguaaucccagcacuuugggaggccaaggugggcagaucaccugaggucaggaguucgagaccagccuggccaacauagugaaaccccauuucuacuaaaaauacaaaaauuagccaggcaugguggcaggcaccuauagucccagcuacucgggaggcugagacaggagaaucgcuugaaucugggaggcagagguugcagugagccgagauggugccacuucacuccagccugggugacagagcuagacucugucucaaaaaaaaaaaaaaaaccaaccaaccaaacaaaaaaccucagcauuauacauguuugucucuuauuugagaggaauauaagaggccauauguguaaugcauguuuuaaaaguccaguuaauagaggggcuuccauuuaucucagauugucuuucugccuagaaguuagauucugaggucagcuagaguuggauuugaaacggggcucugccacuugccagcugugaaacuggagguaaaugguccucucugaaccucgguuuccucaucgugaaccuggagaugacagacuccuccauacagggcuguggagauucacugagaggcccccugugcccaguccauagugggcagccgagaauguuuauuuccuccauuccugauacuauucugccuggucuugugcuccggcagcugacugcauuugguguuuggcugacaccucugcuguugauuguaccugaagucauuuccaaagucaccuugaaacauuucagcucucacccuugccgugcuguauaaggacagggcuucucacuggacaauggcacuuaggaugauccuccuucaguggaagcaaaugcuggccgaaggucagcucucuagagccaauguugguuggcuuccagcuuuaucaaaaagaauuaaaauagccacuugccuggagauugggccugaaacaaggccaguccggcagcuuuguguguucgcuugccuagccugcgguaaugggcuuguggccugccugauggaggggcucugucaccaguuucgaaaucaacaugguggccaagaaugguuuuuuugcccccuaggccacaaaugaaguuuuucuuuguugugcuuuaggucaaauugcuagaguuuuaauguuuguguguguagaaaugggaugucucagacuuucugaagcugaaccaucaagccagccagucagggaaggucguggacagaaugaggggugcggcugugugugggaaugucgauuaguacaaccucuguggaaaacaguuuggagaguucucaaggaacuaaaauagaucugccagucucuccagcaaucccacuacuggguauguacacaaaggaaaagaaaucacucagucagauucgcuuuucauugggaggaucuuaacaugauugguugaaaacaauaaauaaaauuagcaaggaguccaguuguggggucucacgccuguaaucccagcacuuugggaggcugaggcaggcagaucacuugaggucaggaguucaagaccacucuggccaacguguaaaaccccgucucuacuaaaaauacaaaauuuagccggacaugguggcgggcaccuguaacccuaguugcucgggaggcugagggaggaaaauugcuugaaccugggagguggagguugcagagagccgagauuaugccacugcucuccagccugggcgacagagugagacgcagucucagaaaaauaaaauaaaauaaaauaaagaaauaauuauaucaaaagacaccuguacuuguauaguuaucacagcacuauucacaguagcaaagauauggaaucaaccuaaguguccaccaacagaugacuagauacagaaaauuugguguauauauauauauaauuuuuuauggcucaguaguauucuuuuguguguaugugugugugugguguguguguguguguauaccuacauguauacauggguguuccucuuacaaaauuaauagcuuuuuucuuauugaaaauaacacaucauugcagaacauuuuuuaaaauauagcaaagagauaacggcucuuaauacuuuagcauuuuuuucccccagaucaggggucugucuacaaaugaugucccuuggguugcaucuaccuuuuuuuguaaauaaaugaaguucucuuuuuuuuuuuuuuuagguagaguuucacucuguugcccaggcuggagugcaguggugugaucucagcucacugcaaccucugccucccggguucaagugauuuuugugccucagccuccccaguagcugagacuacaggcgugcgccaccaugcccagcuacuuuuuguguuuuuuuaguugggaugggguuucaucauguuggccaggcuggucucaaacucuugcccucaaguuaucugcccaucuucgccucccaaagugcugggauuacaggcgugagccaccgugcccagcguagcauuaaccuuuuagaagcuagaaagcagaugaaugaguggucacuggcuuaaggcugaguccuaauggagcagugaggaaaguuggggaccccuggccaucuguaccacagaacccccaaaaggcauagugucuggcagcaagggaugccccuggagcugagggguaaggaggguaccaaaaugagaaggacaggguggaagacucccagguccccuccccugucuccugcggcaggggcuguccacuucgaccccaacagaaggcagcaguucaaagguacauauagagggucuugggagaggggaucgacaggcacaguugagggcauggggccuguaucccaaauaggaagauaagggucugaauaggugcugaauucuuagaacuuccccguuccccccggggcuccaggcugaccuuuacuguccaggcagaagacuggaaaacuucucccuggggaaucuggccagcgagagagaaagacacaaagauacugacucaggggauccccaacgcacuccuaccucacccuacauugagcucagggucaaccagguccaccacagucucagaaauucuguucucacucauagucacaagguuggaaccaaggcuucccugacauuuggguucaguuucuuuuucuuuuucuuuuuugagauggaguuuugcucuuguugcccaggcuggaguguaauggcacaaucucagcucacugcaaccuccgccucucagguucaagcgauucuccugccucagccucccauguaggggggauuacaggugcacgccaccaagcccggcuaauuuuuuguauuuuuaguagagaugggguuucaccauguuguccaugcugcucucaaacuccugaacucaggugauucaccugccucggccucccauagugcugggauuacaggcgugagccacugcacccggcccugagguccaguuucucauauguaagucaagguccaaaccaguagacacaggaagcuuggaagaaacagaaaccacgcuggagaagagaaguuuaaaaagcucucauuaauaucaucguugaggucagacaggauguugcacucauaggaagaggaugcuauaacaaagggaacauuuguaggccaaaaacaggcucguagacaucaaaaacaugauagcagaaaugaagaacuccacugaauguuuagaagaugaggcugagaaaaaucaaccagcaaguagaagaagagagagaauaggagaggggaaaaaugcauaaaccaguaggccaguguaggaauuucaacauccagauaauaggacuucgggaaaaaauagagaaaaaaagaggcaaggacaucaucaaggaaguauuuguuucuuguuguuguuguuguuguuugagauggagucucacucuauugcccaggcuggagcgcaguggcacaaucuuggcucacuacaacauccgccuccuggguucaagugauucuccugcuucagccucucaaguagcugggauuacagaugcacaccaccaugcccggcuaauuuuuguauuuuuaguagagacgggguuucaccauguuggccaagcuggucucuaacuccugaccuuaagugaucuucccacuucagcuuccaaaagugcugggaucacaggcguaagccaccauguucagcccaucaaggaaguauuugaagacaaauucccaggauggaaguuuccagauugagagggccugagagaugugcagccucauugguggaagcagacacauacuugagcucaucacugugaaaucauagaguucuggggacagagggacgcuccuauaagcaucuggauaugaaaaaacaggucaccuacaaaggaucaaggaucagaauuacucuuguucuagcagccuuggaagccacaacacaauggcacaaggcuucuaaaacuugaagaagguuuuccuuccugaaauuucuuuuuguuugagauagagucucacucugucgcccaggcuggaguccaguggcgcgaucucggcuuacugcaaccuccauucucuggguucaagcaauucuccugccucagucucccaaguagcugggauuacaggugcacaacucugugucuggauaacuucuguauuuuuaguagagaugggguucaccauauuggccgggcuggucucaaacuccugaccucaagugaucuacccaccucagccucccaaagugcuaggauuacaggcaugagccaccaugccuggcccuuccuagcauuucacacacagccaagugguaagguugaaugugagggcaggagaaaggcugaagugcaauggugcaauccuagcucacugcagccuugacuuccugggcucaagugauccuucuaccuuagccuccugaguagcuaggacuacaggcaggugccaccaugccuagcuaauuuaaauuuuuuuuuuuuuuuuuugagauggagucugacccuguugcccagucuggagugcaguggugcaaucucggcucacugcaaccuccaccuccuggguucaagcaauucucccuccucggcuuuccaaggugcugggauuacaggugugagccaccacgccuggcccugaauagccuuucuuagaaagcuacuugaggaugucuuccacugaaaccagaggguaaaccaaggaagagcaacacacaggagacaggaaacaggagauucaacauagacugaaagggagucuccagggugauggugauaaggaagcccagucaggaauagggcagggaaauugagggcaucauugucaugcgccuugccauucuaccaucuucuuaaguggaugaaacuacuggaggauaugccccagcaaaacaagggagucuaccaagaaagacgagccacccauucccccaaauuaggaauccaaccccaaggaaaggcaaagggaauucuagggaugucagcaaagggaagccccaaaacaauggugauguaggggccuagaggacagccaguaccuacggaaggagaacagaggccuucaggagagaugucaccaguggaaaaaaacagaacugaucaauuauuuauuauuauuauuuuuaaugagauggggucuugcuacauugcccaggcuggucucgaacuccuggucucaagcaguccuccugccuuggccucccgaagugcugggauuacagguaugagccacugcauguggccugaucaauuaucuuauguguacugggaaucuauuaggaggaguggggugauuuagcaacagguacaaggaacacuaaguaaaggaaaaaaaucauuaacuccaggaaaaggcaaaaagaaaggaacuaaaaucugguacacugcagcucucauaugugaauaaugaucacaaacuucauaugugaauaaugaucacaaacaaguaaaacauugaauacccaguuugcuaaauuacaguagacuucuaugguauugaccagcugguggaggggagccgaugggguggccuugugagauaacuaaauucacaucucucaggaugggaaggccauagaugcugucucacauggaugacucacaagauugcauacacuuguuguuuaggacuauggagauguguaauugcuagaaaaaaucagcaucaguuuccucugguguggagggacagagcaggaaaccuguuuuguuguuaaacauuuaaaaaauuguuuucaguuuucuaaagaaauuuugugggcugggcgugguggcucaugccuguauuuuggaaggccgaggugggaggaucacuugaagccaggaguucaagaccagccugggcaacaaagugagaccccugucucuacaaaaaagaaaacuuaaaaacuucugaaauacaaauguagaaaaguacaugaaagauauuaauaccauguaacaagucggaacgauuagaauguguggacuucuucccugaucauaaaacucucacccuuguuauaaguuuuuuaguauuauucagguuccuaaacaaugggcauguaaaguaaaaauuaacuuaggauuaaaaaucuaaacauccaccuugggacagguagaagaaacugcuccuucuaguucaugugcugguaccuuagcuggccucuuaaggugcuuucaguuggguacagugguucacgccuguaaucccaaugcuuugaaaggcuuugacgucacuugacaucaagaguuuggacgagccugggcaacauagugagaccccaucucuacaaaaauguuuaaaagucggcugggcuugguagugcccucuguggucccagcuacccaaggaggucgaggcugcagcgagccacgauugcaccacugcauacuagccuaggugacagaaugagaucccgucucaaaaaaaaaaaaaaaaaaaaaaaaaaaaccgaaggugcuuccugcccuugagccuccuuguaaauugcuucaggggcucuggagagcaagugcaaagcaggggggcucuggugcaguuuggcuccucugcuccacuggcuuuacaggugccgagcucugagucccaggcuucuucccucaugcacgucugucccucauucuuauucugcaggccgagcaugucgggacuccaccuggugaagaggggacgggaacacaagaagcuggaccugcacagagacuuuaccguggcuucucccgcugaguuugucacacgcuuugggggggaucgggucaucgagaagguacagaugggucucggcacucugggugggguccgauuggggugcaggggccccuccucucagcuggaggugggagauucggguucaggcucauucugccugcugcagagagggggugagggccacgcuccucugaguuuuaauaguuuaacccucaaauagaaauaauagugaagccucuuucaaagggcuauugugaggaugaaaugaaauaagacagguaaaacacauuguacuguaaaacacucaaaaaguguuaagggugaucacaaugacaccaaaggaauaaaaaaaaaaucauucacugggcucggcacaguggcucaugccuguaaucccagcacuuugggagggugaggugggcagaucauuugggcccagccuggguuuguguucaaguucaagaccagcauggacgacaugacaaaauccugucucugcaaaaaaauuaaaaaauuagcaggauguggugguguacaccuguagucccagcuacucgggaggcugaggugggaggaucacuugaagcuggaaggucgaagcugcagugagcugugauugcaccacuguacuccagccugggugacagagcaagacucugucucaaaaaaaaaaauauauguauguguauauauauauauauauauauauauauauauauuucagacaaacagccauccauccauccauccauuugaugauccauucauguggauggcagacuuugagcuccugcucugugcuggggugugugccauggaaauacauagaaauaccaagaggaaugaugugcugcgggggcugcaggaggcucugcagcugugagguggacucgggguagcacguggcccccagcgcagguagaugugcaucuacagcuccuuccuugucuucccaugcaggugcuuauugccaacaacgggauugccgccgugaagugcaugcgcuccauccgcaggugggccuaugagauguuccgcaacgagcgggccauccgguuuguugugauggugacccccgaggaccuuaaggccaacgcagguaccugggccuugacccucuccucccaucacgcuccauccuugccugcccucgccuccuuccccugugccuaggcaaguccauccuggacucccgauggucaggaccucucaugagucuguauuuauuuguccuuccuucuuuauuuaauuaaaaugucugcugacaucaagaacaacucaugugccuuacaaaaaugcagaugguuaacaugcagagaggaaauucgaucuuugagaaaugucuguguucuagcagauugggggcuguuucuccugcagguguauguaauuguauuucaaucauuuguucauucuuccguucauuugccuaaguuuauuauaaugaaucauucuauaaacaacuguuggaugauuuacuuuuuuccugaacagucuuauccuuuuauaggcccuacuccccacagcagccaaagugaccuuuuaaaagcauaacuucuucugcuguauuuucugaagguuguuaaaaacaaaaaccucagccagagcgcuggcucaccccuguaaucccagcacuuugggaggcuaaggugggaggauugcuugagcccuugaguuugagagcagccuggguaacauaauaagacccugucucuacaaaaaauaaaaauaaaaaaauuaacuggguauaguggcacgcaccuguagucucagcuacucaggaagcugaggugggaggaucgcuucagcccagggggucuaggcugcagugagcugugauuacaccgcugcauuccagccugggaaacagacugagacucugucucaaauaaaacaacauaaaccuaaaagcauaacucagguccgagcacaguggcucacgccuguaaucccagcacuuugggaggccaagaugggcgaaucacuugaggccaggaguuuugagaucagccugcccaaugugguggaaccccaucucuacuaaaaauaccucccaaaaauuugccgggcaugguggcaggugccuguagucccagcucuucaggaggcugaggcaggagaauugcuugaauccaggaggcggagguugcaguaggcugagaucacuccacugcacugcggccugggcgacagagugagacugucucaaaaaaaaaaaaaaaaaagcaaaacaaaaaccaacauaagucaggucuucaggucuuuuugugcuucuccuuaaaaugcaucagaggcugugugcuguucccaauauuagcaaccucagcaccauccccuaagccuuccugccccaagcucuucacagacauggccucauuuguuacuuacagcucuguuuuacagauggcacagucgaggcacagggaugugaauuuaucacuuguccagggucacacaaccaucaugugaugcgggugggaugggaacccuggucuggguucagagcaucauccaguggguccucccaucuugguuagucuaaaauucaaaauugucacccaggccuauuaaguccccuccuggcuccaucuugaaccucuugcccuccaucagccggguaccagucacccugaccucugguagcuccugggccuguugcagagucuuggcaccugcuggaaccucuauugaaggugcuucucccagagcccuuugugcaguggacucccuccccacccagccuguaggucucaacaugaucaucgcaucucucucagagaaccucauuuauuuucuucccagcacugaccggagucuguaguuauuguguuuauuuucuuguuuaucuucuccaacauaaaagaaaaacuggacaaggaccaggaagccugucuggccgcucacuucaucaucucuggaaucuccccguuggccgacacuucuguguuugauaaacauaggaggcaggcaggccggaaggagcagcugcucugggauuucuuucuguguuugcauauaaagugccacauuguucaauuucaggaucuuagcaauucuauaguacagaugucccaaccccuguguuuggauugagucuaacuuuuccuaguccaaaacacugcucaguggcuguucucugacuuuggccucauugauguguggguuuuuguuuguuuguuuguuguugcuuuuuuucugagauggagucuugcucuaccucccggguucaagcaauucuugugccucagccucccaaguagcugggacuucaggcauguaccaccacgacuggcuaauuuuuguauuuuuaguggagauggaguuucaccauguuggccaggcuagucuugaacuccugacuucaggugaucugcccgccucagccucccaaagugcugggauuacaggugucagccaccgcgcccagccagcguguguuuuuuuaaggacauauuccuagacauggaacuucuggcuuaaagagcaugaguauuuuaaaaucaaaacauugcguuauguucagccuuaaaaaggaaggaaaucccgucauauguuacaacacagaugaaccuugaggacguuaugcuggucacaaaaagugaaauaagccagucacaaaaagacaaauacugcaugauuccauguagaagggguaacuagaguagugcaauucauagagagagagaagaucguugguugccaaggacaugagggagggagagaaagggaguuguucaugaguauagagcuucagauucauaaaaugaaaaaguuguggacaucuguuucacaauauaaauauacuucacuauugaacuguacacucaaaaaugguuaagaugguaaauuuuguguguguuuuuuuuuuuaccauaauuuaaaacucuguauuguauuuuuguuuguuuguuuguuuuuugagacagggccuugcucugucacccaggcuggagcgcagugacaugaucacgacucauuguagccucgaccuucuaggcucaagugauccuccugccuuggccucccaaguagcugggacuauaggcaugcaccaccauuccuggcuacuuuuuuuggauuuuuuuuuuuuuuuuuuuuuguggagacaaagucucuguguguugcccaaacuggucuugaauucuuggccucaagugauccuccugccucugccucccaaagugcugggaugucaggcgugcaccaccgugcccagcccuauuauauuauuuaaugguaaaacaauauuaagauaaacuuuaaauaggacuuuuuuuaaaaacccaccucuaaucccagucuguugacagauuacuuccuucuuccuucguuccuuuccaggccuuccaggccuuguccagaaacauaucuguaucacauaauuaaaaucauauuucauuuucuuuacauuuucuuucuuuuuuuuuuuuauuagacagagucucguucugucacccaggcuggagugcaguggugugaucucagcucacugcuaccuccgccuccuggguucaagcgauucuccuaccucagccuccugaguaccuuggauuacaggugcccaccaccacgccuggcuaauuuuuguauuuuuaguagagacagaauuucaccauguugcccaggccgguuucgaacuccuggccucaggccaucugccugccucggccucccaaagugcugggauuacaggcgugagccaccacgccuggccuucucuuuacauuuucauacauguuuguccauuguuaccauagaaaucugcaugguucugcuuuccauggcuguacauagucacaucuuguaauguucugccauugaugucagucugucagcaguuccuuccuucucccucccauuuaauuucagaguacaucaagauggcggaucauuacguccccgucccaggagggcccaauaacaacaacuaugccaacguggagcugauuguggacauugccaagagaauccccgugcagguagauggacuggggugcccaaguguggccccugagugugggaugaugccccuagguucuaguucaauuccacaguucacaagggguggaggguccagaucccacaaggcuccaaauuccugggcugauguaacacagaaaagaguguucaagugaggcgaagcacauucuguuuuuaaaaaaaaauuuuauagacaggaucucgccauguuggccaggcuggucucgaacuccugggcucaagugauccuccugccuuggccucccaaacugcugggguuauaggcgugaguuacugcaccuggcugggaggcauauucuugaaggaagauuguugcucaccccuuucuguguuugcaggcggugugggcuggcuggggccaugcuucagaaaacccuaaacuuccggagcugcugugcaagaauggaguugcuuucuuagguagaguguguccccaucagauacaugggaauugggguauugcugggacacucugcugggucugacccucuuucuccuccuguccuguaaagcggagguccguuugauuucccaccucacacuucugucgugaggagugagugagucccaggguggaagggcacauagcuaaucugccaacucauggaauuaggagcugcccgcuuuucaaaggaagacacacaggcagccaacaagcauaugaaaaaaagcucaacaucacugaucauuagagaaaggcaagucaaaaccagagugagauaccauuucuugacagauucugagauuguggagaaaagggaacgcuuaugcacuguuggugggaguguaaacuaguucacccauuguggaaaacagugaggcaauuccucaaagagccaaaaauagaacuaccguuuaacccagcaauccuguuacuggguauauacccagaggaauuuaaaaucauucgaccauaaagacgcaugaacacgaauguuuauugcagcacuauucacaguagcaaaggcauggagucaaccuaaaugcccaucaauaacagauuggauaaagaaaaugugguacauauacaccauggaauacuaugcagccaucaaaaauacugagauuaugucuuuugugggaacauggauggagcuggaggccguuauccuuagcaaacuaacacaggaacagaaaaccaaauauuaaauguucucacuuauaagugggagcuaaaugaugagaacauauggacacaaagagggaacagcagacacuacuugagggugaaaggcgagaggagggagaaaagcagaaaaaauaacuauuggauacuaggcuugguaccugggugaugaaauaaucuguaccacaaaccccugugacauaaguuuaccuauauaacaaauuugcacauguaauuauguccauguccuuguguaguuuaggggaaucauuuacuaucauguaauaaaucccugcuucuccuuaccggugggucugaaaacagucuugcccaaaugugaagcaacucagugcggaucaauacaugauauucaccugagguacagccgggagucccaugcccauugacguuuucuuugucuguggacucugaguacaugugggcaucuguccugucugacaguuacccaggacucucauuaucagucuuaauuccucuggagguugaugauccagcccacuggacaaacuacagcucauaggccaaauccagccuauggcuugccuuuguaaauaaaguuuuauuaaaacauggucgugcuuauucguuuauguauugccuauggcugcuuucacccaacacuggcaaaguugagucauugugacagagaccugcaggcucgcacaacugaaaguauuucccaucuggcucuuuauagaaagaguuugcuaaccuaugguccagcucuuugagcuccuagcuuaccucuuugaucuagcuuucugccuucccuccaaagugaauuuuguauaugccacuguagccuagguuguaacucacaacagguuuacaauccacauacguugaaaguugacugaugcaauagcagacuaacagauuauuuuucuucccugacaugagguuaagcuccuugagagcugggaccagagaauuuucucugucaucugcuccuuaccuggccccaccaccgugcacucggucggccuucagccucgagggucuugugacugaccggauucugcuucccuucuuguccccgauuccucaggcccucccagugaggccaugugggccuuaggagauaagaucgccuccaccguugucgcccagacgcuacaggucccaacccugcccuggaguggaagcgguaagggaccccgagcuucccucugggggagcuucucagcccagucuugauaaugugaacggucagggugacagaaguaugcuuguaacaauucuuuccauuacaaauguuacuuacuuuuauuuuuuagucauuagcaaaauauuuuaaaauuuuaaauuaguaaacaagugguauaauuuauuguaggcaauuuagaaaauacaagaaguacaaaaaagaaauggaaaucauucauaauccuaugacccaguguugaacauuuauuacauuguagguaucuaccuuuccaaccuuuuucuggccauauucuuugggaaaaaaaaaaaaaaaagacagaucuuggccaguggcucaugucuguaacccaaccccccaacccagugcuuucagaggcugagggaggaggaucacuugaagccaggaguucaagaccagccugggcaacauagcaagaccccaucuccagaaaaaguaaaaaaaaaaaaaauuaacugguuaugguggugcauaccuguagucccaacuacugaggaggcugaggcaggaggguggcuugagccuaggaggucgagguuacagugaacuaugguggcaccacugcacuccagccugggugaugagacccugucuuuaaaaggaaacaacaacccaucuuacauuuccuaguuugugacuuuuuuuuuccucacuaaugaauaucuuucuauguaaaaaauacacuuuacaccauuuaagaugccugcauaggauuauaucuuauggauguaucauaauuuacuuaacaguccucaugguuaaacaauuuagguuguuuccaauuuauuuuuucuaauuuaaaaaauauucaaaggaauggagcuuugauaaucuuacagcuaaauuuaugugugcauuuuaauaauuuucuuaggauaaauuccuaacaguggaguuucuaggacaaauuaaaaaauaaauaggaccgucucaaaaguuuccuauuaaauuuguuuuuuuuuccccccccaaaaguugaauuuuaaauuugggauggaaaauuugcuuucauuuguuaaaucuuugcaugguguugggaaauaauuauucacauauaaaugacuccauaagguagaauugggauuuuuuuuuggauuuagauuaauaugguuguuguuggucgacucagucugaguuucuuuccuuuuuuguuguuuuguuuucgagacagggucucacucugucacccaggccaaacuguaguggcaugaucauagcucacagcagucuugaccuccugagcucaagugauccuccuguaucagccucccgaguagcugggacuacaggcccaugccaccaugccuggcuaauuauaaaauuuuuuuuguaaagacaaggucucacuauguugccaggguuggucuuaaaguccuggguucaagcgauuccccccaccucagccucccaaagugcugggauuauaagcaugagccaccacgccuggcaguuaguuucuuaagcuugauuucucauucaagguuggguuaguucuugaggaaaugaaaagccauugugagaagcugaagggagugucuguauuccgcugguccagaagcccaggucuagcacuaugucagcagggagaggcgcugugguuucuggguuguguguguuucuccuggauuugggaggaaucagguuucuuugugacucuccaggccugacaguggaguggacagaagaugaucugcagcagggaaaaagaaucagugucccagaagauguuuaugacaaggguugcgugaaagacguagaugagggcuuggagguaaaugcagagccugugggggccaggggagccagaaccgaacugccucuguccugguagcaguuggcaacuggcuaaccucuaaagaggucuguuuguccuuugcacccaggcagcagaaagaauugguuuuccauugaugaucaaagcuucugaagguggcggagggaagggaauccggaaggcugagagugcggaggacuucccgauccuuuucagacaagugagcaguucuugcugugucuuuucgcaucugucuuugggaauuguuugugggcugccagauuauuucucuuagcauuauucugugacagucaagaagacauuuguaggagcuggauguaucguuguaucguauuuugcaacaaacgcguacauuuuuacucagaaaagcccaugguuuugugucgaucuugacagaaucuuuuagguaguucaagucuauaaaucaguguaucuagaaaugauuucagagauacaggaucaaaauagcuguuugugacuauauuggccuauagaggaaugggauauuuuauaaauauuaguacucuuguuauuucuaauguuucuagauggucuauuuuauuuuauuuuugagacagaguucacucugucacccaggcuggagugcaguggcacaaucucagcucacugcaaccucugccuuccagguucaaacaauucuagugccucagccuccugaguagcugggauuacaggcgugugccaccacacgcagcucauuuuugucuuuuuaguagagacagaguuucaccauguuggcugggcuggucucaaacucuuggccuugagugauccacccgcccuggccucccaaagugcugggauuacaggugugauccgcugcgcccugccugaucaauuuuaacuguaggaacgaauugcacauuuacuuacugguagcuaguuuuccucuuuuaaaaccuuauguccguuaucagcaauguuuagaaaacauuuauacugacaaucuucccauucuuaaagcuauuuuaauauuucuagcuuuucuucuagaccuucuucauauguauauuuuaaagagcuguauucagucuacacgaaauuuugcucugcauuuaacacauuccaaauuguagaucaugaauauuauuauguuauuccugccuuggcaauuauuuugaugauuacucaauauuuuauguguggcaauagccuuauuuaugaaaccuuuccuuuuuuguuaaauguuuagcuuauuucuacuuuguuauuaugaauaauaauaccacaguauaaugugauauuuaguacuauaaauaacacuuagcucuuuuuucuucuuaauuauuuucuuggauaaagacuuggggagaaagacuuaguuaaauagcacacacuuuacaugcacuuugaaacacauaucaguacauugcuuucuaggaguuuuacuaauuauaccacucuugguauaauaugugaauguuguauaaagcagcaguuucacuaccauuguaucgcuguugggguguacaaguguuuuggggauuuggguggggggaagaauugauauuaaaagggaaguugcagcagcaguacagaaaguucacaucuauccuucgcccgguuucacucguuaacauuuuucauauaacuuugcaacuaagagauuaacaugggcacuuuucuguuugguaaacuccagacuagauugaauuucaucuguuuuugcaccaaugucccuuuccuguugcaggauucaguccuggauuccauauugcauuaggggucauacagauuuuaaagcuuuuuugcuuuuuaaaaaauagacuuuauuuauuagagcaguuuuagggucacagcaaaauggagcggaaagaauagagaguucccacauaccccaggcccucaugugcacacagaugcccaagcuuuuuuauuuuacuuauaugagugcacuaugaauauguucuuaauguagagagucagucaagucagccauguguuaagaauaaaaaaggaaaaacccuuuuccccauuaccuuccaacucuccuuucucagauguaaccacuauuagcagcugccgaugguggggggcucuuuucagcacugucacuguauauacuuuuacauagacauucauacaguuguuucauuauuuuuugcaugacuucauccuauacauuauugcaaauuuguuaaacuuaauuugucuuagaaaucauugcacgugaauacuuuucacauugucuuuaagaaucucuagaagacaugccuauaaaacaaugccuuucagcucuuaacaggaugaaguaaguuuguccuuagauuccacccgggagagcuagcugagaaagugcaguaaguggaagaaaaagacaaccacagauuaguguguuuuggucccauuuucauucaaagaaacuuucucuguauguguugcuauaugcauagaagaaagccaguuuggacaccaaacucuuuaacagugcaauaucuuuaggggaugugacugugggagauuuuaccauuucacagaguuugacuuaaaaaagagaauauguugcagguagugacuauugggcuggcggugcagcugguaaaggaauuuaccaagacagcuguagguaaagaaaggcagauuuauuggaggaaguaugaaaauauguugcaagauugcaacaggcagcacagcagagaaggaucugucugcaaagaggcaagggcuggugggagguuuuauaggguggugcuggaggaggggcugugaggucauuacguccugggguuguuugugauuagccaucucucgagcaguuguucauuguucuuccccaccuggggccgucccccaccuggggccccuuucuccucguuacuguggagucgggacuccacagaauauuaugucugugagacaacaaaaguaaaagaucagcagaguccuggaugaguacccuaaacacaucacugcguuuguuuuauguucucuccugagaacuuccagaagcuuccagagcugguuuccccaugaagaucaggcugcucugcuucccccgacagguacagagugagaucccaggcucgcccaucuuucucaugaagcuggcccagcacgcccgucaccuggaaguucagauccucgcugaccaguaugggaaugcugugucucuguuuggucgcgacugcuccauccagcggcggcaucagaagaucguugaggaagcaccggccaccaucgccccgcuggccauauucgaguucauggagcagguacacuucucagagcccagggggcagcuucagagagagccgucucagcucagagucaggaagaacuuucuacggucaguguggcugaaugguggcaugggugccuaacaagagggaugagggcccauuccagaggugauuucagcaucacacagguuuauuggauuagccggucugugaacuccccaaauauuucuuuucuuuuuugagacagagucucacuguguugcccacgcuggagugcaguggugcgaugauaguucacagcagccuguaacuccugggcucaagugauccucccaccucagccucccaaguagcugggacuacaggaaccugucaccaugucuggcuaauuuuaaaaaaaaauuuuuguagagacagagucuugcuauguugcccaggcuggccuugaacuucuggccucaagugauccucccgccuuggccuccuuaagcgcuagggugauaggcaugagccaccacaccuggccagucccaaaauauuucacauguagcaggugcucagucugcauuuggugaaggaacugauagucaccauuuacaguucccugaaaagaccucuggaacccccuuggccucuuucuguuucuucacagugugccauccgccuggccaagaccgugggcuaugugagugcagggacaguggaauaccucuauagucaggauggcagcuuccacuucuuggagcugaauccucgcuugcagguggaacaucccugcacagaaaugauugcugauguuaaucugccggccgcccagcuacaggugagaaaaugggcuuggggcccugggacuucucugcccugggucagggguccaugugcugcucccauuaguccaucccgcccaucucuuggccgacugucccaggggaaugacuggccaaagagcacuuugagaaaucuguaaaagcuauaguucucccugggaaaauaucuuuuauacaauuucaggacauucauagaccuagagaaauguuucuuaaccuuguuaucauuaucacucccugcaaggauccuuuggacacauuuuauauccuaaucccugucuugugaaauuuuaauaucacaaauauaccacauaccuguuuggauauuguagauauaucugugcuuuauucaugaaaagagugagauuuucuucacucccaagaacaaauauuugucucuucagaggcaauaucaucccuguuaagaauaugugauccagaguuguaaccucuuggguuaaagggaacucuaaauuuuuuuuuuauuuuuaauuuugauggguauauaguaagucuguauauuuauagggugcaagagauuuuuguuuuuguuuuuguuuuuuugagacggagucuugcucuguugcccaggcuggagugcaguggcgcgaucucggcucacugcagccuccgccucccaggcauacaauguguaauaaucacaucaggguaaauggguauccaucccccuccagcguuuauccuuucuuuguguuaugguguuaugaauauuccaauuauacucuuuuaguuaauuuuaaaauguacaauaaauuauuguugacuguagucacccuguuguacuauaucaaauagcaggccguauucauucucuuaaucacuacauuuuugcgcccauuaaucauccucgcuuuccaugccccuaccucuuccuuuccagccucugguaaccaucauucuacucucugugucugugaguuccauuguuuuaauuuuuagcucccacaaaugagugagaacaugcaaaguuuguuuuucucugccugguuuauuucauuuaacauaauguucuccaguuccauccacguuguugcaaaucauggucucauucuuuuuuaugucugaauaguacuccauuguguguauguaccacauuuucuuuuuccuuuuucuuuucuuuuuuuuuuuuuuuugagaugcagucucgcucuguugcccaggcuggaguguaguggugcaaucucggcucacugcaaccuccaccucuuggguucaagcaauuauccugccucagccucccuaguaguugggauuacaggugcacacuacuaugcccagcuaauuuuugcauuuuuaguagagaugggguuucaccauauuggccaggcuggucucaaacuccugaccucagaugaucugcccaccucaacuucccaaagugcuaggauuacaggcaugagccacugcaccuggccuguaccacauuuucuuuauccaaucaucuguugauggacauuuagguugauuccaaaucuuggcuauugugaauagugcuacaauaaacaugggaguacagauacucuucgauauacugauuuccuuucuuuugaguauauauuuagcaguaggauugcuagauugguaguucuacuuuuaguuuuuuaaggaaccuccauauuguccuccauagugguuguacuaauuuucaguccuaccaacaguguaugaggggucccuuuucuccacguccuugcuagcacuucuuuuucuguuuucuuuuuccuuuccuuuuuuuuuuuuuuuuuuuuuugagagugagucuugcucuguugcccaggcuggaguacaguggugcgaucuuggcucacagcaaccucugccucacgguucgaacaauucuccugccucagccuccugaguagcugggacuacaggcgugugccacgacgcccagcuaauuuuuuguguauuuaguagagaugggguuucaccguguuagccaggauagucuugaucuccugaccucgugaucuacccaccucagccucccaaagugcugggauuacaagcuugagccaccgcgcccagcugcuaguauuucuuauugccugucuuuuggauaaaagccauuuuaacuggagugagacaaugucucauugugguuuugauuugcauuucucugaugaucagagauguugggugccuuuuccuaugccuguuugccauucguaugucuucuuuugggaaaugucuauucagaucuuuugucuguuuuuaauuggauucaugagacuuuuuuccuacucaguuguuuuagcuucuuuuuuguuuuugagccagggccuugcucuguugcccaggcaggaaugcaguggcaugaucauggcucacugcagucuugaccuccugggcucaagcgauucucccacaucaaccuccugaguagcugagacuacaagugugcaacaccaugcccagcuaacuuuuuaaaauuuuuuguacagauaaggucucacuauguugucuaggcuggucucaaacucuuggguucaagcagcccucccaccucagccucccaaagagcugguguuacaggcaugagucaccaugcucauccuugagcuucuuauguauucugguuauuaaucccucgucagguggcuaguuuacaaauguuuucucccaugcuguggauugucucuucccuuuguugauuguuuccuuugcugugcagaaguuucuuaacuugaugugaucccauuuguccuuuuuuugcuuuaguugucugugccuuugggguauuacucaauaaauuuuugcccagacugauguuccugagaguucccccaauguuuucuucuaguaguuucauaauuucaggucuuagauuuaagucuuuagucuauuuugauuugaagaauuugauucuucauuuaugauucugcauauggauauccaguuuucccagcaccauuuaucgaagagacuuuuuccccauugcauguucuucgcaagucugucaaaaaucaguucacuguagauguauggauuuguuucuggauucucuauucugucccauugaucuauguguuuguuuuuaugucaguaccacccuguuuugguuacuguagcucuguaauauaacucauagucagguaauucaauuccuccaguguuuguucuuuuuuuucaggaugguauuggcuauucugggucuuuuguguuuccauauaaacuuuaggauuuuuuuuucuauuucugugaagaaugucauugguauuuugguagggauugcacugaaucuauagauugcuuuggguaauauagccauuuuaacaauacugauucuuccaaaccaugaacauggaauaucuuuccauuuuuguguguccucuucaauuucucacaucaguguuuuaugcuuuuuauuauagagaccuuucacuucuuugguuaaguuuauuccagggauuuuauuuuguuuguagcuaucauaaauggaauuacuuucuugauuuuuuuuuccagaccauucgcucuuggcauauagaaaugcuacugauuuuuauauguugauuuuguauccuguagauuuacugaauuugucaauucgaauuguuuuuuugguggauucuuuagguuuauccaauuuuaagauuauaucaucuguaaacaaggauaauuggacuucuuccuuuccaauuuggauguccuuuauuucuucucuaaauuguuuucauuguuuucuuccuuccuuccuucuuucuucccauaauggggucucauuacguugcccaggcuggucucccucccuuccucuuuuucuuccuucagcagaauuuuuuaaaaaguuuucuuuauuuuuuuuucaguuugaaagauuucaaaaaaguugcaagaaugauacaauuaauacccauacgcccugcauauagauccaucaguugccacauuugcuuugucucucuucugucuguuuguauaauuuuagggggcucaaucuuuuuuuuuuuucuuugagauggagucucgcccuuucacccaggcuggagugcaguggugcgaucuuggcucacugcaaccuccaccucccagguucaagcgauucuccugccucagccucccgaguagcugggauuauaggugccugccaccacacccagcuaauuuuuauauuuuuaguagagacggggcuucaccauguuggccaggcuggucucgaacuccugaccucaacugaucagcccaccucggccucccaaaaugcugggauuacagguaugcaccacugugcccggccgugggcucaaucuuuugagcaaugguuugagugaaccuucguaacauauggccucugaauacuucauucuaaaggccuccuacaacaagagcauuccgguccaaugcccuagugcaauuaugacacuugagaaauagagcauugauaccacaucuauaucuaauauauaccauucacauuaaauauuuucccuguuguuccaauaaugucuuuuuguagcuguuuuuugucucuuaaauccaggauccaacccaacccagggugacacauuccauuuuauuuucaugugucuuuaaucucuuuaaucugaaagcauuucguagucuuuuuucauccuugacauuggcauuaaaauuuuuuuuuuuuuuuuuggugauggagucucgcucugucacucaggcuggaaugcaguggugcaaucacgacucacuacagauucaaccucccaggcucaagugauccucccaccucagccuccugaguagcugggaccacaggugcaagucaccaugccuggcuaauguuuuuuuaauuuuuucuguagagaucgggucucauuauguugcccaggcuggucuccaacuccuaggcucaagcgaucugccugcuucagccucccaaaguucugggauuacaggcauggacacuggcauuuuugaggagcucaggcagaaugucccucauuggauuucucugauuguuucuuccugguucgauuccugcuacacauuuuggcagaauacuacacagguguuguguccuuaauacaucucaucaugaagccuguuaaaucugaucauuugguuaagcugguuccauaauugucuacuuuuuacccauucuucauguccaguuuccccuucgggugcccuuuacaaaaacuuccuuuaacucugcagccaacaugguugcuucucaccuucccuagcucuaaaagucuagugcuuuuacuugaugcauguauuuucuuguugugugauguuguuucauaaauauuuuuccuuuucccaacuguacuauuugcuccacugugaaaaguucaugucuuauggcuuuuucuuucuuuggcucucuggccacaguagagcaccauguugucuauagaguagugucuguauauccuaaaucauugacugaaccuccguugcaucuaccacugugccugguguuuuggggccguguucugguaggacugacagucuguggguuggaucucuugauuuuagaucgccaugggcgugccacugcaccggcugaaggauauccggcuucuguauggagagucaccauggggagugacucccauuucuuuugaaacccccucaaacccuccccucgcccgaggccacgucauugccgccagaaucaccagcgaaaacccagacgaggcaaguuaugggggccccuguguuuccaccaucucagaucucccagcaugugggggacccuggauguuagccugggaagagacacccacaagcuauccaggcaucucaguuuacaaauggggaaacugaggcaugggaagggacaucccaugguuuauuugauuauuggauuuauuggauuuuuauuuuuauuuauuuuuauuuuuuugagauggagucucacccugucacccaggcuggaguguaguggcgcaaucuuggcucacuacaaccucugccucccagguucaagcgauucuccugccucagucucccaaguaguugggauuacaggcgcccgccaccacgccuggcuaauuuuuguauuuuuaguagagacgggguuucaccauauuggccaggcuggucuggaacuccugaccuugagugauccacccgccucggccucccaaaguguugggauuacaggcaugagccaccacaccuggcuggauuuacuggauuuuuggauuauugccaggcucugggccgagccuucccaugucucacugcucacuuauaggacacuacugcugcuggacaucgucaccccacauuacaggcaaagagccugggguaacuugcuuccugucucccaccugggaccugcugagacccaucaguggacuccaaaagccaugccuaucuuugggacaagcagccagguuuagaacccuaguccuuggauuucuggccccgugugcuuuuugcuacaguaugaagucuggcucauuguagagagucccuuugugacuuggccuuacuugggucuuaaaaaacaaaccaacuggcaucccuuacaguuuacaugcauaccgaccguugauugucacaggacucaucaaucuacuacaacuuaauugcuuaauuauuacccucaggaaacuggggguaagagaggguacaccuccaccccuuuuaauuaaauaauuuuaagcuaggguagcuguauucauuuaggguucuuggcugugaaccaaacaccaacucugguggacaagcaaaaggggaauuuuuuggagggaugauggcucguucccagguuccuaggaggauggaggaccagguaugguaacagcccaggcacuugggucgcuccaucucucacuucuacauaccucuccccaaauccuucaucccuuaguucaggagcccuaaucccagugagaggugccauguccacccacucuuaccaaaauuguacuuagagggagacgggccguucucccagagggaaucagguguguguuggcagcagccuggccgauggggugaggaaaagggggauggagggagggagggaggaagggguaggaaaggaaggagggaagaggggagugaggaaggacgaagggagagagggaaggagggagggaaggaggaaggaaggagagaagaaaggaaggaaauaccaacgaaauggccucuucccuagcagcaagggcccugcccaggaugcccuggauuucuucaccugcagagguuuucauuauccagaauuggaaaucuaaccugucuucacuucuauuuaaacuuuuuauuuucgaaaugucaagcauauaaagucagaaugucccuucacucagcuccaucaaucaucaauguucgcccauuuaacaccugcacuaccaucucugucccaacucgcuuauuuuauuuauuuauuuauuuauuuauuuauuuauuuauuuauuuauuugagacagguucuugcucugucacccaggcgggagugcaguggcguagucaugccucacugcagccuaaucuccugggcucaagagauccuucugccucagccccacaaguagcugggacuacaggugugugccaccacaccuggcuaauauuuuaauuuuuuguagagauggggucuccugauguuacucuggcugguuuugaacuccugggcucaagugauccuccuaccucugccucccaaagugcugggauuacagacaugagccacugcgacugaaccaacuucguuauuuuuuuacaguuaaaaaaaauaagaauuauaggcauugaggagcucauauggguacacccaugaauagauacauccauaccuguaacaagcgauaucaguguucuauugacuacccuaagcuuuuggucagcguagggguucuuggguuuucccaggacugaauucugaugaaaauauaucuggaguaaugauuucuuccauuuugcauuuucuguccggacuccaggguuuuaagccgagcuccgggacuguccaggaacugaauuuccggagcagcaagaacgugugggguuacuucagcguggccgcuacuggaggccugcacgaguuugcggauucccaauuugggcacugcuucuccuggggagagaaccgggaagaggccauuucgucaguaucuccuuccuuccuuccuuccuuccuuccuuccuuccuuccuuccuuccuuccuuccuuccuucccucucucccuucuuccccucuuccuucccucuuucuccucccuuccuuucuucuucccucccucucagccuuucuccuuuuuuccuuccuucccuuccauugccuuccugccuuccuuucuuccuuccuuccuccccucuucugcccuccccuccccuuccaucccuuccccucccuuccuuccucccguccuuccuccuccccuucccuucuuuccucccuuccucccuccuuccuucuuuuccugacuucucugcuuuccucccccucccuuucuuccuccuucuuuccuuccuuccuucuuucccucccuucccacuuccuccuuuucccaauuccuuccuuuaagaaaugaaacgguccccuggggcuucagauacaguagcauuucaggagaccaagaaaaguaaaucacaggguaggccccauuuaaaauacccugugcuugaaguucaagaucaaagccugcccuuuuuuuccuuuauugaagauccacaaaguaaaauaagugcaccaaggucauuuggucuugagcuuauaagaguucuagcuugaaggagaucuaaagauuguucuaggagauacccaaaguguaaaaggugcuaaguaccauagcugaagaaagggggagggaaacuccuuuacauuuaaaccuuaucaguaguucccuaauggguuguauuucacaccgaagacuaaauuuuaaggaguguguccugcugugaaccacccaccacucugaggccugugacagcagccccauguccccagcucagccaaguccucccauacuugugauaguuucugcagagcugagaagcccacauugacagagggacccccaaauucugacacaccaucuccgacacuucuccuggcuugacauggguguggaaagguauaaaacuaguuuacuuuguaauuaaauguuuuuguguggguaacugcccuucggagugaaaaaaucccaaaggccuuagcauuaaaaucugacguggggcacuuagccacgaauuaaauugaguugggcaguuuugaugaucagguuuucuuugccagcuuagaauaauuaauuuuaaucaugcuuagugaaaaaucaagauccuugaaguuuauggaagauugcagcaaaaagggcuuacuuaauaggaguaggcggaagacaggucagccagcccagaccccuccgagugaagugaccuguggcuugucacaugcuacgaguggaccaaccgcaacuucaacagaacucacaggcagaaauuccagcuuuucuuauugcuguuagugagaguccaguagggggaucaacuguccucguuuuccuggcaccgguuucucagguugaaggacuucucagugcuaaaauggggaccaccccaaggaaacugggacaagucacucacccgugagaccagcggguuaacucucauacccagcuuccagacccacagcugacuuuucauggccuauggauacccuuguaugaccuuacugggucuucauuuucucacccccaaaauggggucaucaguguccuuccccguuaccugcugacagcacacaggaugcugcaagacaugaaagcuuacucggccaggcacaguggcucaugccuguaaucccagcacuuugggaggccaaggcgggcagaucacuugaagccaggaguucaagaccagccuggccaacaugacgaaaccccgugucuacuaaaaauacugaaauuagccgggcauccugguggccaucuguaaucccagcuacucgggaggcugaggcaggagaauugcuugaaccugggagauggagguugcagugagcugagaucgugccauuucacuccagccugggcaacaagagugaagcuccgucucaaaaaaacaaaaaaaagaaaaaaagaaagcuuucucucccagaagaagagguguucagauaccugcccacacucaccaugaauucauagggcucagcuucccgaguagcugggacuauaggcgcgucccaccacgcccggcuaguuuuguauuuuuaguagagacgggauuucuccauguuggucaggcuggucucgaacuccugaccucaagugauccacccgccuuggccucacaaaguguugggauuacaggcgugagccacugcaccuggccugagguuuagcuauuugaacuggugcucuuggagauuuggagucuguguguuggggagaggcagccauggggcccaccaggccccugagccgggugacagugccguccaucugcaggugcaccccacacacaccaggcagagcagcuguguggaaggugagaggguggcaccagcucuggggacaggagauuugaauaggucaagggagagacagaggcggugaccgauuuucccuuuguuuuuuuuucuucuuuuaagagauagcgucucacuguguugcccaggcuggagugcaauggugugaucauagcucacugcagccucaaacuccugggcucaagcgauccucccccuuuagccuccugaguagcugggacuacagucacauaccaucacgcuuggcugauuuuaaaauuuuuguagagauggcgucucauuauguugcccaggcuggucuugaacucaugccucaagcaauccucccgccucagacucccaaagcagugggauuacaggcaugaaccaccaugccuggcugguucuuucucuacuaaucauuaacuauuauagucaauaauuauaacaauaauaacuaaucacguucauuguaguuaacauuuauugaucagugaccaugugcauuacauggauugucucauuucaauucucgaacacccucaugaagucagggcuauuuccccauuuuccauaugaggaaacugaggcccagaguucucaagucacuuggccaagauuagccaggcaguaaacccuggcgcugauucaaugcacuggcugugucagucagagcccucucuuaacucuucuuuuuuuuuuuuuuuggagacagagucuugcucugucgcccagccuggagugcaguggugugaucucagcucccugcaaccucugccucccagauucaagugauucuccugccucagccuccugaguagcugagauuacaggcguccuccaccaugcugagcuaaguuuuguauuuuugguagagaugggguuucgccauguuggccaggcuggucuugaacuccugaccucaaguaauacaccuaccucagccucccaaagugcugggauuacaggcgugagccaccacacccggccacuccugugcuuuuccaguucucugaaucacaucauugcagcaacucuguugauguaugcaugaauuuggaaaaugauccaugugccuuucccuucaaggaacauggugguggcuuugaaggaacuguccauccgaggcgacuuuaggacuaccguggaauaccucauuaaccuccuggagaccgagagcuuccagaacaacgacaucgacaccgggugguuggacuaccucauugcugagaaagugcagguagggagugagcugccugugucuccccucuggauggccgagaccucggcuuccugaggauacugaagugcauuuucuccuaggcggagaaaccggauaucaugcuuggggugguaugcggggccuugaacguggccgaugcgauguucagaacgugcaugacagauuucuuacacucccuggaaagguaggggcuguggcaguucccuucugcuuuugugauauguguuagcggcuuaggaggcugaaucugucuccuuuauuuguguggccaguuagucaccaggcaauuggugagucucuccuccggucuugccucugggaaauuccucuacagaucaaccuaggcuacccuugaagaggcuguggguuagggaaugggauucucgaggccaggguggcagucagugaacaggcuguuguguacggauccaugcugacuuguguaagguacaucauaauagucaggaguucugaguucaaggagguggauuugggaagcaaagcggcuuaaaggucaucucuacaagcgggugcauucccagacccucaccagaaucagagggucaucaugaaauggaccagaauggaaagcaaccaggcgaucucuguuaggauaggccgggguuucucagccucagcaccauuaacauuuugugcuggaugcuuuuuuuuuguuugggaaccugucccgugcaucauaggauguuagcagcauuccuggccucuacccacuaaaugccaggagcagcccuucccucugagucaugacaaucaaauauaucuccagacauugcccaaugucccaggguuaggaguagaauaaucacccccaguugagaacugcugcaagaggcaaaggaacuaucaaaaagaaaauaaaaggauaaacuuuuuuuuuuuugagacagagucuugcucugucauccaggcuaucacccaggcuagagugcagugguaugaucacagcucacugcagccuggacuuccugggcuccagugaucugcccaccucagccucccaaguaguugggaccaccggugcaugccaucaugccuggccaauuuuuuuaacuuuuugcauagauggggucucacuauguugccccccaggcuggucucaaacucauggccucaagcaauccuccugccucaacucugaaagugcugagauuauaggcgugagccacugugccugguaagaaauguuuuuaguguuugguuaugcuuuugaacgguaguagaaucacagucccugcucugguuucuuucauaagccgaaggcaggaucccauaugugaaauuuuuccaagagaccguuauggauuuugcuccugaaaagccuuuguaagauuucaaaucccucagcaagugcugauuccuuaaguucuaagcaauaucaggcugcucagggugauucagguucugugcgugacuuuuaaucagauuuagccuuuuuuuuuuuuuuuuuugagacauagucucgcucugucacacaggcuggagugcaauggugugaucucagcucacugcaaccuccgccuccugcauucaagcaauucuugugccucagccucccgaguagcugggaugacagcugcaugccaccacgcccggcuaauuuuuguauuuuuaguagagaugggguuuugccauguuggccaggcuggucucgaacucuuggccucaagugaugugccugccucagccucccaaggugcagggauuacaggcgugagccauugcgcccagcccaggcuuagcauuuuuagugcagucagguuugcugaugcagagaguugcguaauuuuuuuaaaugcaagggauggcuguggaguucucagucccucccaaggcugaccacaacccugucuuuucuuucaggggccagguccucccagcggauucacuacugaaccucguagauguggaauuaauuuacggagguguuaaguacauucucaagguaaaugcccccgugccucuccgaugucuccaacacucugcaagcuucagggaguuucuuucuuccaugaaccaucccuggaguggauuugcucaugcuuggguuugagcucuuguguuccucgggaauccccauguaguccgugaccuugacaccuaaacacuuuggcuuuuagaacauguagggcugugcauucugcagagggcacaauggagcguggauaaguuuccuguagcugcgguaacaagguaccacaaacugguuuaaaccaacaaaaauuuauugugucccaguucuggaagccaagucuaaaaucgagguguuggcgggccguggucucucugaaggcgcuggggcaggaucuguuccgagccuccccagcuucuggugcugcuggcagucccuggugauuuuuggcuuguggaugccuugccccagucucugucucuguuuuuuuuuuuuguuguuguuguuguuguuuuuucaaacggagccucacucugucacccaggcuggagugcaguggcucaaccuuggcucacugcaaccuccaucucccagguucaagcaauucuucugucucagccuccugaguagccgagauuauaggcauaugccaccaugccuggcuaauuuuuguauuuuuaguagaaaugggauuucaccauguugccuaggcuggucuugaacuccugagcucaagugaucugcccugccuuggccucccaaagugcugggauuacaggcaugagccaccccccaaccucugccucugugugugcauguguguguguguguguguguguguguguguguguguuuacauuggccucccaaagugcugggauuacagucaugagccacccccuggccucugccucuguguguguguguguguguguguguguguguguguguguucacauuaucuuccaugacugugucuuugugucucuucucuuguaagaacaccagucacauuggauuuagcguccacccuaauccaguaugauuucaucuuaauuacaucugcagagaccucauuccaaauaaggucacauuccaagguuccaggaaggccaugaauuuuggaggauauuauucaaccccuauagaaugugagcugggccuuugcugagacagaauagugggcccgggucuguuuccaggggcucugaggcugguuuuguucucugucucugcaccacguguagauuacuggcaucuucccugguuuacuacuggagucccuggggcuuauuccgguugcucuccucugucagaagugccuaguugcccuuugugggccauccaaggucaauucaacagugucagaaaugucucugagaugcacagguagggggugaggcuugguguccuagccaugguguucugggcccaggguccuuguuggggugagccggcuguggcaucagugccccggguuccaaugcaauggcaggaggcuguguccccuguaagcccaggccugcccaguacuucccagccucacauugucaggagggaaaagaggacagaguuugagucugcuuaugagacagaauuuuuguuuucuuuaauuaguacuuucuauuuaauauugaugagcaugaguagaacucacaacuuuggagauuugggggcuuuaguucaacuaaaccugugugucauugaucaggguaugcuuucacaaucauccuccuuugccccuaaugccucuuggcuaccuuuggggaccuagcugcccccaacuugauuuuaaaugucacauaugcacaauguagaaaauuucaaaauuucaagcgagcauaaaaaaucaggaaaacaaauccaucaugugcuaaugccuagagguaauccugguaaacauuuuagcaaaucuuuguuauauauuuuuuuccuuuugcauuaauuuuacaaaguugagaucauggugcaaaugcaguuuuacagcuuugauaugaucauggcauaaaguuuuccauguuauuaacaaguuuuuuuuuuaacacgagucuaaacucaugucuguggcacugucucccugaacuuuuaauagugaugggaacauucccuaucuucuguguccaagaugcugcccuuauguggugacugagagcuugaaaguggccagugugacugaggaacugaauuuuacauuuuauuucauuuugaucaguuuaaauagcugugugugguuaggggucaccguaucagacagggcagaucuaaaguguuccauugcaagguuguuggcuugcuaauuuuguucuaauuuuuguuguuauuacaaauaaugcugcaauacacauuccucuauuucuugcugccuugugucauaaacugugaauuuuauagguugaaggcccuuuaggguguguguuuucugagagaaaacugaacugaaguaccagauggggcaggcgcucuuccuggagggagauguagugcuggggccagggcuuggcugugucucucucacgugucccaaagcucuugugugcuccugggcagagcugggucugggaagcagagcccuaguccauguccaggugucuuaguccauuugggcuacugucguaaaauaccaaagacugaguggcuucuaaaccacacacugaauuucucacaauucucuaggcugggaaggucaauaucaagauacuggcagauuugguaucuacugaggacccaccuuucguuucauagaugcuguccuuucgcuauguccuuagaugucagaaaugggccacagagcucuacaggggaucuuuuauaagggcacuaaucucuuuuacaagggccccaccuucaugaucucaucaccucccaaaggcuccaccuccuaaagccaucacauuagggguugggauuucaacuuaugaauuuugcggggacacaaacguuuaguccauugcaccuggcugcugguggagucuccagggcugccucacacagagugagagcuggagacaggaaucagaagggagucucuagccccagaggacaugcaguugccaacacggcuugacagggacuauauaagcggccauuagccuacccacagggcagguguggcucgcuacuccaggccucccccagccccaucagcagcugcucccuuggcaggaauugugagggcuggguccgagagacggggguguucaucuuggcccucugugguggacaaccagcucuuguuuguuguuagcggggcccagcagugcucugggagcacauccugaacccaggcggugacaaggggcuuguccccacagguggcccggcagucucugaccauguucguucucaucaugaauggcugccacaucgagauugaugcccaccggcugaaugauggggggcuccugcucuccuacaaugggaacagcuacaccaccuacaugaaggaagagguugacaggugcgugggggugcgagucccacugugggcugggcaugcacagcucucuguccuaggcauggaaaacacagcacuggccugugugcagguccaagggucuuagagaaggugccuuucugguaaauucugggggugugcagagaaguuaaucucuugguuggaauucugugcaacuggcagauauuuaggggaggauccuaggaggcccuuuucuaguaaccugguugguggggauucagagcugaacgggacaugacucccagcucuguggccugcgaggugugugaccaggugccugcugccugugcaucugggcucuggcauccacccaguuagugcggcagugaccuacuaagcuccuccguaccaggcgcugugcuggguguugggauagcauucugggugugacucguggagcuuccagcccauucgggaagaugacacacugaacaaacagauaguggcaggaaagggugucguguaccugacggguaacacacaagaugcccuggaagcucuuagcacaggggcuugugagauagugagauaggccccaaagaugccccgccuccagugugucugaucaccccgagaucacgcaaugaaacagaccccagccaaggugaugaaaggggaggggaugucugaaaagcuccaguuagagaguggagacucucuucucaauccucaauguuuuggaagaaggaagacuagguuuaugccagaguaauauuuuguuaucuccuuuuuuuucuuuuugagagagggucucgcucugucacccaggcaggagugcaguggcaccaucaugacucacugcagccucaacuucccugggcuccgagaugauccccccaccucagucccccaaguugcugggacuacgggcaugugccaccacgccuggcuaauuuuuguauuuuuuguagagacgggguuuugccauguugcucaggcuggucuugaacuucuggacucaagcaguuggccagccuuggccucccaaagugcugggauugcagucaugagccacugcacccugccuguuaucucuuuuuuaacccacguucuaucugccaagaauguucaggauuacuauagguucuacucuccccaguucaaagguuaagacuuugaaucaguaaauauuuguugaaucauauccacugauugauuuuucugugucaggcccuguuggaaguaugucaguaaaaggaaccagcuuucagccaaaaaagggucacauccuuuuuauuauuuuauuuuauuuuaaagacugguucuuacucuguugcccagccugggcaagagugagacccugaucgcuugaguccagaaguuugagaccagucugggcaacauggcaaaaccccaucucuauaaaauacaaugauuagccaagugugguggcgugugccuguagucccagcaauuuaggggguugugaugggaggaucaccugaccccagggaggucaaggcuucagugaaccaugauugugccacugcacuccagccugggugacagaguaauuauagcucacaauagccucaaacuccugggcucaaaggauucuccugccucagccuccugaguagcugggacuacuggcauaugcuaccacgcccagcuauuuuuuuuuuuuuauuuuuuguagaggcagggucucacuguguugcccaagcuugucuugaacuccuggccucaagccauccucccaccucggccucccaaagaaagcaucacagccuuggccaggcacaguggcucacgucuguaaucccagcacuuugggaggcugaggcgggcggaucaugaggucaggagaucgagaccauccuggcuaacauggugaaaccccaucuuuacuaaaaauacaaaaaaaaauuagcuggaugugguggugggcgccuguagucccagcuaugcgggaggcugaggcaggagaauggcgugaacccgggaggcggagcuugcagugagccgagaucgcgccacugcacuccagccugggcaacagagcgagacuccgucucaaaaaaaaaaauaaaauaagaaagcaucacagccuuuuuguucacccaccucacucucagugucucugagauaacuaucaacugccacccuuugggaauguagaggguacacucccccuuuaggaaggggaaaugguauugaaagccggacuagggcuugcugaguugguaguccucaucagucucccuacccgacuccuccucucucccaguuaccgaauuaccaucggcaauaagacguguguguuugagaaggagaacgauccuacaguccugagaucccccucggcugggaagcugacacaguacacaguggaggaugggggccacguugaggcugggagcagcuacgcugagauggaggugacugcagagccggccguggggaauccugaacccucaaacucccacucuucuggcuuugucccaugucugaacaaacaggccuaccucuccccuugaccacugucugcaaauuucuaagggaaucagucuguggauuucagccaaauccccugaaguauucaaagaaaaaaacuucaggcugggcguggugguucacgccuguaaucccagcacuuugggaggcugaggcgggcggaucacgaggucaggagaucaagaccauccuggcuaacauggugaaaccccgucucuacuaaaaauacaaaaaauuagccgggcaugguggcaggcgccuguagucccagcuaugcaggaggcugaggcaggaggauggcgugaaggcaggaggauggcgugaacccaggaggcggagcuugcagugagcugagauggcgccacugcacuccagccugagcgacagagaaagacuccgucucaaaaaaaaaaaaaaaaaacuucaaaaaaugcacaucuccccaggaaugaguaagaagguuaaugacagagaaacuggguacagagaauauggaaacucucuguacuauuuacauaacuguucuauaaacuguuguguaaaucaguuuccuugauuucuuuauuuuuuuuuugagacaagucucagucugucacccgggcuggaguguaguggcgugaucuugucucacugcaaacuccgccucccaggcucaagugauccucccaccucagccuuccaaguaguugggauuacaggcacgcaccaacaugccuggcuuaauuuuuuguauuuuugguagugacaggguuucgucaugcugcucaagcuggucaaauaccugagcucaggugauccaccugcuuuggccucugaaagugcugggauugcaggcaugagccacugcacacagccaagaauugauugauaauaacaauuauugucaaucaaugauuaaauauuaaauauugaccccagcaauaauugaaagguguuaagccaacacuugcaaagccauaaccauguggcaggugcuguucuaagcauuuuacugaucuuuauuuuuuaaccuucccagcaaauauaugagaugggcacaaaugugauccccauuuuauaaaaaagcugggcccaggcaggcuaagaaacucacuggaggucacacaaagccaggauucaaacccggaaaauaacaacaauaauagcaaugaaaauacaucaauaauaguagcuacugcauauugaccugcugcauggcaggaucugcaucucauucaauccucguaagagcccuaagaggugaaacugucauuauuccucauuuuacacuuggggaaacugaggcucaaggaggggagccacuucugaagaucacagagguauuggugggggcaguuccugggauucuaguccaggccuggcugacuugggugcccaagcugugaacugccaagcaagagagauagcacaguccuggcucugcggccgccaccauggugacaaagcucaugccacgcacguauccagacauucgggaaaauuaaaagggcugaugagcagauucuucauuucacagaguguucccugaggguuuucuaagugccuuuaauaaaacaaacuguucacaaaauguuugauuuaugcaguacguuuuaggaacguguauaugaaccacucuauguaauaugauuuaacaguauuucuaagagaagacucccccuuuggaaauaaacaucaguuuccauaucuguaaaaugggcaucauaaacaccuccuuggcuggcuuugcagauugaauggcacuugccuggcacuuagcaggcuuccaguaaaggucacuuuuccuuguaccuucugccugaacacuacccagggagucauucuggcgcgucccuggguagugucccggcgcgucccugcuccggcaucacuaguucuggguggcucugggugucaaucccggugggcucuguacuauuucuucuuuuuacgaaauaggugaugaagaugaucaugacccugaacguucaggaaagaggccgggugaaguacaucaagcguccaggugccgugcuggaagcaggcugcgugguggccaggcuggagcucgaugacccuucuaaaguccacccgguauguggcuccacggcccaagugcucuggcuggugcaggugcacucgugaccuccacugguucagugagacagguggacucaaggcugguagcgcuucuccugccuccaccugcagacagagcucgucgcagcagccaccgugauggugcagaaacacaaggaagccgcgcccugcuuuacucagaucccucucuguggcucuccauccugcuuagagcaaaacccaauuucugccagugaccugcaagaccccaaaugagcuagcuguucccugcuuucuucucugccuuucuccucugucccucuccccaucacuuacuugaauacacuggaccccucccuccuggcggcuguccucucugcugugaaggaccuaccccagacuuugcagggaucacucucaacuccugggagcuuugauuccaaugucuuccccucaaugagggcauucuugaccauugaccaccuuuucuuuuuaauagacuuaauuuuuaguauaguuuuagauguacagaacaguuauguaaguagugcagaguucccauauucucuguggccaguuucccugucauucauuuaauuaucauucaauuaauuguuaguauuauuauuauuauucauuuuuuuuugagacagacucucgcucugucgcccaggcuggagugcaguggcgugaucucgacucacugcaaccucugccucccugguucaagugauucuucugccucagccuccugaguagcuggggauuauagguguguaccaccauaccagcuaauuuuuguauuuuuaguagagacaggguuucaccauguuggccaugcuggucuugaacuccugaccucaggugauccacccuccucagccucccaaagugaugggauuacaggugugagccacugcaccuggccucaauuaauuacuauuguuaucaauuuacuguuauuaauuuaacuauuauugcacgagcaugguccauuugucauauuuaaugaaccaauaucgauauauuagguauuauuguuuaagaauaauaauuaacuuuaaaauuuaacuauuauugcaauaauaugguccauuugucacauuuaaugaaccaauauugguacauuauuguucacucagauuucuuuaguucauuuuuuaaaaauugugguuaaauacacauaacaaaauuuaccaucuuagccauuuuuaaauguucucuugagcaguauuaaauccauucacauuguugcacagccaucaccaucauccaucuccagcacuugcaaaacugaaacuugacacucguuaaaugguaacuccugagucccuccucccuccagccccuggcaaccauuguucugcuuucugucuaucaauucaacuccucuaggugccucauauagguggaaucuauauaguaucuggccuuuugugacuagcuuauuucauuuagcguaacgucuccaaguuucauccaucugauagcauguggcagaauuucccuguuuuuuaaggcugcauaauauucccuuguaggggugaaucacauuuuguuuauccacccauccacugauggacacuuggauuguuucuaccuguuggcuacugugaauaaggcagcuaugaacaugaguguacgauuuucuuaguuuuuaccuauuguccaggaucccauccagguuagcacauugcauauaguugucaggucucuuucaaccgcccuuuaaaaaauugugcucaccuccacccacgugcaaacacacaccguaccucacaaagaugaucucacugauugucuuguugcuuuauuauuuggccuccaggagacuggaaacaccgugagaacagggccuuuuggcuuucuugcucgcugcuggggccccagugccaaaaacagggccuaguacaucagaggugcucuguaaauauugguuguuggaugaacguguagcaggcaggugccgggggcgucccccuguccucaggaccaccagggggugcaccagagugucugucaugugacccugagcucaggcucuugggggcaccuccaauuuagauuccucuuaauuugucaagcugugucauuaccgaugagucccugaggucaaggacuacuuucgauguccacuguugugauccuggggcuuagcacagugcucggagcauagugggugcucagaaauaacaagucuugaugaaugaaugaauguuuacacccuccuaagcaagacucuaaaauaauuaguacaucuguccaguaaaaaaaaaauuuaaaaauaucacauggucucuuuucuccagaguauucuauuaauuguauuuguuuucuuuuuuaaaaaaauuauaauuauuauggguacauaauagguguacauguuuauggggguacaugugaucuuuugguauaggcauaccgucuaauaaucaaaucagggugauugggguaucuauuaccucaagcauuuuucauuucuuugcgcuaggaacauuccaguucuacucuuuugguuaguuuaaaauguacagucgauuuuaauugacuguagagucacccuguugugcuaucaauacuauaucuuuuuuuuuuuuuuuuuuuugagauggaguuuugcucuugucgcccaggcuggagugcaguggcgugaucucagcucacugcaaccucuaccuccaggguucaagcaauucucgugccucagccuccugaguagcugggacuuaaggcaccugccacuaugcccagcuaauuuuuguauuuuuaguagagaugggguuucaccauguuggccaggcugaucucgaacuccugaccucaggugauccgcccaccucagccucccaaagugcugggauuacaggugugagccaccauguccagccucaauacuagaucuuauucauucuaucuaacuggauuuuuguacccguuaaccauccccacucccaccagccccacuacccuucccagacccuggcagccaucacucuacauucuauuuccaugaguuuauuuguuuuaauuuucagcucccacauaugagugagaacaugcuaaauuugucuuucugcccagcuuauuucacuuaauguaauauccuccaguuccauccauguugcugcacaugacuguuguuacaauucuuuucauuagucucuuucucucuuuuuuugagacagagucucacucugucacccaggcuggugugcaguggcacaaucucagcucacugcaaccuccacuuccuggguucaagcaauucuccugccucagacucccggguagcaaguaccugggaccacagguuugugcgaccaugccugacuaauuuuuguauuuuuaguagugaugggguuucacuagguuggccaggcugaucuugaccuccuggccucaagcgauccguccaccuuggccucccaaaaugcugggauuacaagggugagccacugugccuggcaucacuagucucuuuagggaguucccaaagcuaggaauagacugggccuuuuuggaucagugggcaggucuggguaccugcacugugauuccuuucagcacacauuuccugugcuggguuaaugaggcagggccugcccacccauucccugcagccucacauaaaugcuugugagacagacugggagaucgaguaacuucacuuggugaguguaguuagaagaccgcccuuggcccugggcuguggggacccacauggagaagcuaugaucagauuguguaggggaaaacccucaagucagcuuuuuuuuuuuuugagacagaauuucacuccauuacccaggcuggagugcaauggcacaaucuuggcucacugcaaccucugccucccagguucaacugauucuccugccucagccucuggaguagcucggauuacaggcacgcgccaccaugacuggcuaauuuuuguguguauuuuuaguagagaugggguuucaccauguuggccaggcuggucucgaacucuugaccucaguucauccucccaccucggacucccaaagugcugggauuauggucaugagccaccgugcccggccaagucaucucuuaaaaggggagaaaagccugcagggcuagggguggggauggguguggguggagggguagagggugggcaggaaacggaguguucucugcugggagaacagcaccccagcacugugcgucaugcacaguagguauuuguagaaugaaugaguagacgaaugagcacauuuagucuguguugcccucuagggagcuuuuuauuuuuccauguguuuaccuaagacugaauuuuuaugauuuacaaaaaucagaugcauuuguaugagauguucauaaauuuucauccuacugugagguguuuaacuuugggauucaauagagaaugaaaauaaauacagaacaugagauuuguugauuauaaagcaaaacaacaacaacaacaaacagaucggccgggcgcaguggcucaccccuguaaucccagcacuuugggaggccaaggcgggcagaucaugaggucaagagaucaagaccauccuggccaacauggugaaaaccugucuauacuaaaaauacaaaaauuagcugggcgugguggccugcgccuguagucccagcuacucgggagacugaggcaggagaauugcuugaacccgggaggcagagguugcagugagccgaggucaugccacugcaguccagccuggggacaaugcgagugucucaaaaaaaaaaaaaaaacagaucucaccgccaccccacaaaacugucuggggugugaaacuguguacugggccauuugcaaaaggaaugguuuggaaaacccacauuggggugugaguuuggccguuuuaacuuuccaguucauugucuuugauuuuuuccucagaccucauccucacuugauuacggaagccggcagaucuguccugccucccguucugcccggucccauuuggaauucccagaguuuuccugaccugucguucuuguggugucucaucaggcugaaccguucacaggagaacucccugcccagcagacacugcccauccucggagagaaacugcaccaggucuuccacagcguccuggaaaaccucaccaacgucaugaguggcuuuugucugccagagcccguuuuuagcauaaagguaaagucaccuaugagcgcaggcguguagaccagugcggagggucagaagaucuaccccgugacagcagaggucauuauugaguaagaaaugagaaaauggucgguccucuguuguuuuuauuuuauuuauuuuauuuuuucagacaaggucucacucugucacccagacucacugcagccucgaccuccugggcucaagagauccuaccaccucagccucccacguagcugggacuauaggugcaccccaccacgcccggcuaauuuuuuguauuuuuguagagauggcauuuugccauguuccccacgcuggucuugaacucuugggcucaagugauccauccgccugggccucccaaagugcugggauuacaggccugagccaccgcacccagccccucgguuguguuuaugaaggaccuguccucagggaauuccucaauucaauuguaaacauuggccugacuuuuucuccuugaucguaaacugggcuuguagcaguucagcucaagacugagaauacuccaguaggacauuaaggaaggagucagugggggucacccugcuuaaggagaugacagacaaggcacuuuguuugaaacacaccucuguucgucauucacccuugcugggucucaucugcucacucaguagagaaacaagaaguucucugauuugcagaccuccuugaaagacccaugaugcucauagcagugacuaagcaucacacugugugcuguaccggguccgucucaggagagcaaaucaugauggugaugacgauaauaaccgccaacccuuagcaaguauguaccaugugucaccccccuuuguuuuugagagggagccuugcucugucacccacaccaaagugugguggcacgaucuugucucacuguaaccucugccucccagguucaagcgauucuccugccucagccucccgaguagcugggauuacaggcgugugccaccauacccagcuaauuuuuguauuuuuuaguagagacgggguucuaccguguuggccaggcuggucuugaacuccugaccucaggugauccacccaccuuggccucccaaaguacugggauuacaggcgugagccaccgugcccgcugugucaccuucuaacuacuuaaaaguucaaucauuucauccucccagcaaccgauaagguaggaacucuuauuuccacuuacaguugaggcaacugagggacacagagacuaagagacuugcugugcuucauacaugaggaggcaaagaugagaucugaaccauggccaucaggauucugacucugugcucuucgcccccacguuaugcugccugaugauuauuaccaccauugcaacauuuuuuuuuuuuuuuuggagacagggucuugcucugucucccaggcuggaguacagugggggaaacacugcucacuacaaccucgaccucuggguucaagcaaucaucccacuucagccuuccaaguagcugggguuacaggugccugccaccacacccagcuaauuuuuuguagagacggggucucgccauguugcccaggcuggucucgaacuucugggcucaagugauccucccgccuuggccucccaaaguguucagauuacaggcaucagccaccgcaccccacaauaauugcaacuuuuauuaguuggggcacuucgcaguuuaugcaucaguucacuuugaaaccucacaaccacacuaggauguuggccccacuaucaucgucauccaaagaccaucagcauuggcuacugagacaccccggaaacagcauagggcagcaguucagagucucaggagcugaauagccuggguuugcuucuuacuagcugagugacuuugguuaacuuaacuaaccucucuguguuucaguugccucaauugcaaaauggacaaaaucauuagacuuccuuuauaugguugcuuuuagggaucaaaugauaacaugaaaagaaaguuccuagaacacugucuggcacuaagcaaguauccuauaaacaucagcucaucaugugaccuuauguuugaucccccacaccaugcuggcuuucugaugcacagagagggggagucagggucuuccuauguagggaaacugaguauuccccuguggucagggggccauuccacucuggacugccccagaggcugcugggucuggaucuucagccacuugagugcauggggucaggauggguugagcuguguugggugcccuguuuggggcgguggugcccaugcccaugcagggcugggggcugaugcugugguccccgcuucagcugaaggagugggugcagaagcucaugaugacccuccggcacccgucacugccgcugcuggagcugcaggagaucaugaccagcguggcaggccgcauccccgccccuguggagaagucuguccgcagggugauggcccaguaugccagcaacaucaccucggugcugugccaguuccccagccagcaggugcgugcuccccugcccagccccaccccaccaggauggucacacugggccggcucccggucuggcucgauaucuggccucugaucaaguugaacuccuugagacccacuuauagccuaacauaucaggggccgaggguuuccuuuugagccuugucugcagaauccuaucauuuacucaaagcaacaguuguuugaaugaacaucaguauuccuuaggccucauugccuaaaacccaagauucugaauaggagugagcaguuguugcagauggagugagcauuucccaaaaaauaaacuggcugacaucauuagaggaaacugcaaguuuuuuuauuuuuguuuuuucacugguuugcagcuuugauuuucugccccuggauuuuguaggugaucaucugggagcuccauguauguguguguguguguguaucuguguguauauauauauacacacacauauauaugcauauauauacacauacacacacguguguauauauguauauacacacauacacacacguguguauauauguauauacacacauacacacacguguguauauauguguauacacacauacacacacguguguguauauauguguauacacacauacacacacguguguguauauauguguauauguguauauauacacacguguguauauauguguauauguguauauauacacacacguguguauauauguguauauauguauauauacacacauguguguguauauguauauauacacguacauguauguguguauauauguauauauacacacguguguauauguauauauguauauauacacacguguguauauguauauauguauauauacacacauguguguauauguauauauguauauauacacacauguguguauauguacauauacacacacauaucuguguguauauguauauauacacacacauaucuguguauauauguauauacacgcacacacauaucuguguauauauguauauacacgcacacacauguguauauauguauauacacgcacacacauguguauauauguauauacacgcacauacauguguauauauguauauauacgcacauacauguguauauguguauauauacauguauguguauauacgcacauacauguguauauguguauauauacgugcauguauauauacauauauacauguauguguguauauacauauaaacauauauauguauauauauaauauuuuuuaagaauuauacugaggucgggugcauuggcucacgccuguaaucccagcacguugggaggccagggcagguggaucacuugaggucaggaguucgagaccagccuggucaacauggugaaaccccaucuauacuaaaaaaaaaaaauuagcugggcgugguguugcacaccugcaaucccaacuacucaggaggcugaggcaggagaauugcuugaacccaggagguggagguugcagugagccgagaucgcaccacugugcuccagaaaaaaaaaaaagaauguacugagaugucuuaucauaaucauaguugcauuugugaacauguuaaaaaaaaaaaaagaauggaagccauuccagggaaguaagaaauaucucuguuauuuacacaucggccucgcguuguucauuuuguugugguuguugguuuuguggggcauuugaaaggcauuugcacugggaagagccccucugccuguuugccuuccugcccucuggugggaggguuccccaccaucaucauccacccacccacaaauuggugauuugggaaaccagaggacaguguaguucaggccauucucggagguuaggaguucuauggguuggaauguuguucagccaaagaaagaaagaauacugauucaugcucccacguggaugaaccuauugugcuaagggaaauaagccaggcacaaaagaccacauauuaugugauuccucuuuuuuuuuuuuuuuuuuuuuugagaccucccgaauaguugggauuacagguguacaccaccauucccagcuauuuuuuuguauuuuuuuagugaagauggguuuucaccauguuggccaggcuggucuugaacuccugaccucaggugaucugccugccucggccucccagagugcugggauuacaggcaugagccauggugcccagcccugugugauuccaauuuuaugaaauguccagaauaggcacguucaugaagaaggaaguagauuaguggccgccaggggcugcagugcagggaaaauggagagugagcgcuaaugacuacaagguuucuuuuuagagugacgaaaaugcuuuaaaauuagaugguggugauaguugcacaacuuuaugaauacacuaccaaccacugaauguacacuuuaaagggagaugguggaauaugaugguguguaaguuauaucugaacuaaaaaauaacaaaagccaaacucuagaggauccuaacugaaaaaguacacacuuggaacuuucaggaauuugucauugauccagguuuuuuuuucuuuaaaaauauuuuugaugccaaaggcaauacaccgauaacauuauguguaaugauaaagacaggacccuuccccaugagcacccugguuuuugcuagagugggacauucccaucuccuuguuccccaucccauugauaugugcggaaugguauaaggcgaaugugugcacuccuccaugugaucgcuggcauuuugagcgcuugaauuccucaccguugaggggaugaacagggguguuucaggguagcuggaaggcuuugggccuggaauuuucaaucuucaaaugagucucggaugggaccucccugggaggcugugguggguccuuuaggucagcaguucccaaccuuuuuagcaccagggaccgguuuuguggaagauaguuuuuccacggaccggggagggggaugguuucgggaugauucaagcacguuacauuuauggugcacuuuauuucuauuaugauuacauuguaauauauaaugaaauaauuauacaacucaccauaauguagaaucugugagagccccaggcuuguuuuccugcaccuagaaggucccaucugggggugaugggagacagcgacagaucaucaggccuuagauuaucguaacgagcaugcaaccuaggucccucgcaugcacgguucacagcaggguuugcgcuccugugagaaucuaaugcucccgcugaucugacaggagguggagcucagaugguaaugugagcaauggggaggggcuguaaauacagaugaagcuucgcucccucacccacugcuuaccucccacuguucagccaguuccuaacaggccacggaccagugcucguuuggguacugguuuggggacccuuucuuuaggggacugcugugugucaucugaaucaucagcagucagaccugucuuguuuucccauccagauagccaccauccuggacugccaugcagccacccugcagcggaaggcugaucgagaggucuucuucaucaacacccagagcaucgugcaguugguccagaggugaauccugggucuccccguaggaugugguugucaccugaaucgucgcaugcauugcaccaggguggugcucuggggcugucuucagggcaggcuugaacugagagaaaguguguuauaguccugcagugccauuacuaacagcagaacccugggugagguacuuuacuucuguaaaucucuguuuguaaaucucagcucacugcaaccuccgccucccagguucaagcaauucuccugccucagccucccgaauagcugggauuacgggcaugugccaccaugccuggcuaauucuuguacuuuuaguagagacgguguuucaccauguuggccaggcuggucucgaacuccugaccucaagugauccauucuccucgaccucccaaagugcugggauuacaggccugagccaccaugucuggccuauaaauguauuaaguuuugugaagugcugacaaauaguaaauacuugauagauacauuagauugagacaaugggaugaaauagcuuuauguaugauaaaacacugcaaaaauuguuauuguggcuuuugggacaauugcaaaggaaaguggaugaauaauuguauuucaucucaaguaguuauuuauuguacagggguuucccgcugcaggacuauucugaugacaaaaggauuuucuuuguuuuuuugagauggaguuucgcucugucggccaggcuggaguguaaugguucgaucuuggcucacugcaagcuccgccucccggguucacgccauucuucugcugccucagccucccgaguagcuggaacuacgggcgcccaacaccacgcccggcuaauuuuuuuguguguuuuuagcagagauggaguuucaucauguuagccaggauggucucaaucuccugaccucgugaucccccugccucggccucccaaagugcugggauuacaggugugagccacugcacccggcugacaaaaggauuuucugccacuuuucaugaaaaauccaccuagcaagaaggcuuuccuuaugaagacaaucagggccaggcgcuguggcuuaugccuguaaucccagaauuuugggaggccaaggcaagaggaucacuugaggccaggaguuggagaccagccugggugauguagcgagacccugucucuacaaaaaaaaaagaaaaaaaaaaugagucggggauggugguguguaccuauaggcccagcuacucaggaggcugaggugagaggacugcuugagcccaggaguucgagguuauagugagcugugaucgcgccauugcacuccagccuggggacagagcaagaccuugucuuuuaugaaaaagaaaaaaggaaucaaagcauucuuggauuugaaccaguaaauuccaggcauguuucccaugugccagaaacucacagguacaaagaaugugagauuguagaaaacuggccuccuuuucaaggagcuccucagcuguuagggagagagauuuuaguguggauuccccacaaacugcaaguuucacagccaagggcuaggaagggaguccuccuaaaacacauagacugcuaaccuuaagcccauccuuuaagcuucagagaaacaucuaggaaaaaugaaccauuaauaaauuaacugaauuuucuagcaaguuuucugugcugaccauaaauauuaaagcccuguccuguauuguguaaguauguuuuaaaaucacauuuguaucagagucuuuuagcaucuuggucuguuuuguugugauuuggugaugcugccaugaagcgucuacuuccccacaacucaguggcgcaucuccugagaaacuugacuccuguguucagauuuuuggaagaacauccagguuaaaacuuuguuuuaaaagaagcggcuaggugcgauggcucacaccuauaaucccagcacuuugggaggccaaggcggauggauugcuugagcucagagguucgagaccagccugggcaauauggugaaacccugucuacaaaauauacaaaaauuagccaggcuuggugguggccaccuguggucccagcuacuccagaggcugaggugagaggauugcuugagcccgggaggcagagauuacagugagcugugauugcaccacugcacuccagccuggguggcagaacaaaaccucgucucaaaaaaaagaaaaaaaaaaagggagaagcaaaauuuacauggggaucuuuugguaaauguuuuuccaguuugucuuuuuaaaauggucucuauaccuuggguaaguaauugaaaaauuuuguuuuuaacaguuaaagcuugcuaaaauuggcuaccccuguucaguauccgaaaucuaugaaguuuuuuuuuuuucuuaacucuguggccagaaaggcgcccucccaaguauaaggcuugggaucuaccuacuccaguuuugccuccaguuugaugugggacuuugggcagggcaguguucuuuuuggccugcagaugaaucaacuccauauccuuugaaggccucaggauuagagggugccucuagauacuuuaaaaaaauuuuuggcugggcgcgguggcucaugccuguaaucccagcacuuugggaggccaagacagccggaucaugaggucaggagaucgagaccauccuggcuaacacggugaaaccccgucucuacuaaaaauacaaaaaaauuagccgagcguggguggcaggcgccuguagucccagcuacucgggaggcugaggcaggagaauggcgugaacccgggagguggagcuugcagugagccgagaaucgugccaccgcacuccagccuggccgacugagcgagacucuguuucaaaaaaaaaaauguauuuuuaaauuaacuaauuaauuaauuuuuauuuauuuauuuugagacaagcugucacccaggcuggagugcagcagugcaaucauagcucacaacagccuugaccuccugggcucaagcgauccuaucaccucagccuccuauguagcuaggaccacagucaugcgcuaccacucccggcuaauuuuuuugauuuuuuuguaaagacaaggucucaccuuguugcccaggcugcucuugaacuucugagcucaaaugauacucacgccucagccucccaaagugcugggauuauuggugugagccaccaugccuggccuuaauuuuuuuguuuuguuuuguagauauggggucuuggcuauauugcccaggcuugaacuccugggcuccagugauccucccaccucaguguccuuucuaaaauccuuucucucucucucuuuuuuuuuuuuuuuuuuuugagacggagucuugcucugucgcccaggcuggagugcaguggugcgaucucggcucacugcaaccuccucuucccggauucaagcuauucucaugccucagccuccugaguagcugggacuaccggcgcgugccaccaugcccagcuaguuuuuguauuuuuaguagagacaggguuucaccauuuuggccaggcuggucucgaucucuugaccucgugaucugccugccucggccucccaaagugcugggauuacaggcaugagccaccaugcccagccaauccuuucucuuuuuaaaaaucauaaaaaaaaauacuaaauauucagguacucaaggaagggugugagcauuaagagcagccuucccuucuccccagauaccgcagcgggauccgcggcuauaugaaaacagugguguuggaucuccugagaagauacuugcguguugagcaccauuuucagcaaggcaagagaugcugaugccaacaccagugggaugguggggggcgugaggagccugagcuuuaccucugugugguguuuugucucccccagcccacuacgacaagugugugauaaaccucagggagcaguucaagccagacaugucccaggugcuggacugcaucuucucccacgcacagguggccaagaagaaccagcuggugaucauguugaucguaagcaggaagagggccuguuacuagacugggggugggucaggaguccacaaacguuuucuuaaaagggccagaaaguggcugggugcgguggcucaugccuguaaucccaucacuuugggaggcugaggcgggcagaucacuugagguuaggaguuugagaccagccuggcuaacauagugaaaccucgucuccacuaaaaauacaaaaauuagcuggccaugguggugcauaccuguaaucccagcuacuugggaggcugaagcagaaggaucgcuugaacccugaaggcagagguugcagugagccgagauugugccauugcacuccagccugggcaacagggugagauucugucucaaaaaauaaauaaaagaaaaaguaagccagcaaguaaauuuuuuagacuuugcagguugguguggucucugucgugaccacucaacacugccuuuguacaauguaagggaaugggcauggcuguguucccauaaaacuuuguugggagcccgaggugggaggaucacuugagccuaggaguucaaguccagccuaggcaacauugcaagacuccauuucuuagaaaaaaaauuaaaacugggcacuguggcucacaucuguaaucccagcacuuuggguggcugaggcaggagaaucacucgaggccaggaguuugagacgagccugggcaacauagggagacccccaucucuacaaaaaguacaaaaauuagccaggugugguggugugcaccuguagucccagcuacucagggggcugaggcaggaggauugcuugagccugggauguugaggcugcaguaagcugugaucacaccacuacacuccagccugggugacagaaugagauccugucucaaaaaacaacaaaaaaaaucccaacuuuguauacaaaaacaggcaaugagucggguuuguuggcacugggaagaucaugacuaaugcaaagcaccuaguuugugccagguacuccugaagugcuuuccaaauaaauaguugcucauuuaauucacgcagcaguccuagaaaguggguacugcugucacagcucuuuggcagagcacagagagguuaagccacuugcccaagggcacccagcuccuaaauguagagccaggauuugaaccaauagucugacuccagacucaugaacuauuagccgcaggauauuggauuuugaguccuguguguggagaagaagaaauauggagucucuguucuuguuucucuuuccacucgaugauagcagucuuuuguuuuuugucuguuuuuucuuuugagacagggucucgcucuguugcccaggcuggagugcaguggugccaucauggcucacuguagccucuauccccugggcuuaagccauccucccaccucagccucccaaguagcugggauuacagacucacaccaccacgcccagcuaguuuguuuguuuguuuguuuguuuguuuguuuguuuuguagagaugaggucucacuauguuucccagucuugucucgaacucccgcgcucaagcaauccuccugccuuggccucccaaagugcugggauuacaggcauaagccacugcgccuggccgauaauagcagucuuuuauaacuaaaaauauuuuucuuugauaugucccuugcaacugacuuggaaaauguaggaucagcagaguaagagcaacuuggacuuggcuuauaguagaaagggguuuggcaauuuuuuuuuuuuuuuuuuugagauggagucuugcucugucgcccaggcuggggugcaauggcauaaucuuggcucacugcaaccuccgccucccggguucuaucuaucuucuaucuaucuuuuuuuuuuuuuuugaggcagagucucacucuaucccccaggcuggagugcaguggcacgaucucuguucacugcaaccuccaccuccaggguucaagcaauucuccugucucagccucguuuagcugggauuacaggcaugcgccaccacgcccggcuaauuuuuguguuuuuaguagagacgugguuucaccauguuagccaggcuggucuugaauuccugaccucaggugauccaccagccucggccucccaaagugcugggauuauagacaugagccaccacgcccggccuggcaacuuuuuuuuguaaagggcuccagauaguaaagauuuuaggcuugaggacguccacccccuauugccacuacucagcucugugagcucugccacuguagccugaaaacuagacaauagguacaugaaugaggguggcuauguuccaauaaaacuuuauuuacaaaaacagucaguaggcagaguuuggccacgaucucagagaauaguuaauacccuguccccuguccaaguugcauuaauaaauauugggauuuuugguaaagaaucauuuaaaaaucucacgcagcagcuuuuaauccuggcuguacauuagaaucaccuaggggguggggagacuuaaaaaauacaauugcccaugccccacccuuggucaauuuaaucagaguuucuagggguagggcccaggcauuagugcuuuuugaaaguuucccugugggaaaccuaaaugugcacuguauauuagauaauauuauugguuuaauguucaguuucuuugguguuuuaaugguucuguaguagguggaagggagauaugugcgaaaauaguguaaaggauuguggugucugcaacugacuuucagaaaaagagagaguguguauguguaugcgcacguacguucuuauuagagaaaaaucaaauaugauaauguggcaaaaguuuuaacaauuagugaaucuaggugauuacuauggguuuuuaacauacugaucuucaauucuucuguaguuuugaaguuuguaaaaauuaauugggagagaggacucuccaagugauugcaacacgcagccaggacugggaauuuaugcccaaggagauauccacucuuuggggggaguucuauuacuaaaauaauauaauguuuuucaaaauacauucuuuggauggaguuuccuggaguuugaguguuugucaagcaaaauaugccuguaaucuauuacagucagcuugccauucaaaggcagugggucuguggguuauuuugcuguucguucuucugugcacauauugacucucuucugggcaugaagucaugaaauaucauguacaccagaggacagccaagggaagauggguggagcagcccccaguucuugggaauugggacauuuuccuggaccuccuuggugauagaggcuaaaaauguugaaccaauuacagucucgggauaaaugugagauucauuauucuucugacuuucuuggucccauuuguuagaaaauagugaguucucugcaccugaugguauuugguaccugagagguuuugaacaaagacuugugaauugaaugauuauuucgaaaugaauuuuuuugaggcuuuuaaagggaccuaguuucugacaccaguucacuggucaugggacuucguuagugacaaaacgaagcaaacaaaacaugauucugagaacuaaaauauacaagaugagacugcuucacaaaguuaacaagaaagaaaaaugguguuguuguuguuguuguuguuguuuguuuguuuucgagacagagucuugcucugucacccagguuggagugcaguggcgcaaucucggcucacuacaaccucugccuccuggguucaagugauucuccugccucagccucccgaguagcugggacuacaggcacguaccaccacaccugacuaauuuuuuuguaguuuuaguaggaaacaggguuuugccauguuggccaggcuggucuugaacucuuggccucagaugauuuguccgccuuggccucccaaagugcagggauuacaggccugagccaccaugcccugccuagaaaaauguuuuuguuauuauuauuauuaucuuuuguauguagaaggcaaugguuagauuuuuuaacauucacacuuagauguguggggggaaauuuaaaaaauguucacacaaacucuugaguuuuucaccucuuagaaaagcaccagucuagcugcuggccagcaccugugcugucuggccugggagccacaugccuaggggauugguggggaguuaugccaccaccguuuaauaauagaaagcaaaucagagaagggagaggagauuuagaacacuuuccuaccacauuucuucagcauugauguuccugugucuuuguguaugaaauaucaauauguugaaguuuuuucugaugauaaaaucagucucgguucauuauaauaggaaaaugcagaaacacauguagaaaaaaaugccccacagcucuaccaucuggugaccucuugaagaccagucuuaguggaugcccgggguggggaaugggggcauauugcucaggagcucugauauuuagcauucauugcuccaucuucagugggugguuagggagcaccugcgcugagcuguucccaagccccauaugcacuuagggcauaagaggagaugcgaacaccggcugcacccaggccuggucuccagcagaaaggcccuucuuucagaagcagagaggagggaugcaacacagacacauugucccucccucuccugcaagauucaaccccacgucccucuccucugaaaccgugagcgccuuaagucaggcagcaauguguaggggaaggagcgggaggcuuugggggcagaauagugcuguguucgaaucuggcucugucuugcacauguuugcuggcuuuggggugaggcauauugccucuuugagccucaguguuccuaucuguaaaaugggaaucaaaauaaguaacucuucgugggggugggagaauuuggggaguuguauauaaagggucuagcuguuuacuagccaccuggcacauaguaugugccugauaaucacugaccuuuuuuuuuuuuuuugggggggagacagagucuggcucuguugcccaggcuggaguacaguggugcgaucucagcucacugcaaccuccaccucccaagggaugaucaaaucauccucccaccucagccuucugaguagcugggacuacaggcaugugccaccaugcccggcuaauuuuucuauuuuuuuuuuuguagagacaagguuuugcgcuguugcccaggcuggucucaaacuccugagcucaagcgauccuccugccucagccacccaaagugcugggauuauaggugugagccaccaugccuggccuaaucacuggcuauuaauaguaacguaggcagggacuuaguuguauuuguuuguucuuaccaggcauuuagggcauguugugggguggaugaauggguggccgagugagugagugagugagugaaugaaugacugacuggggugggugcacaguagaaaguggugaggguuugcauaacaggcugugcugggccuguuuggagaguggagcagccgccuggcuuuugcggcaggugcuccccaagucgagaugagugcugcauguuucccugggcuggagaaaagccauuuggcuucuuuuucuguccccuaaggaugagcuguguggcccagacccuucccugucggacgagcugaucuccauccucaacgagcucacucagcugagcaaaagcgagcacugcaaaguggcccucagagcccggcagguagggucucagggugcgguccccacgaugugcguuuccccccacccuccuauguguccccuaccgugcucagcccucaccaugcacagucccaccgugcugccggcccgugcccgagccucugccuucugcccugggagguuggcucacgccagcgcccccaucccucccccugcagauccugauugccucccaccuccccuccuacgagcugcggcauaaccagguggaguccauuuuccugucugccauugacauguacggccaccaguucugccccgagaaccucaaggugagcccgucuccuuccuuucaccaucugcagagcacacacuguggcccaggugggggccucuggggaaacggcuccuccugcccuccaggugcucaguggggugcagggcacagccacagaugcagacaguucagcccaauguggccagggcugcccgaggggucaccuggggagacucuaggagaggugggcauggagcccaguccuccaggaaggacagugugacagcagugggggcucaccuggugcaguuuacaaaccucagccauauggagcauaucuggaagcugugagcccuccuguggcugagucgcggccucaucuucccuauuccuggacucuggcucauuuacauguucucagguacccccucagugccugaugggagaccugucccaggugccgucaucccggaguucuucaccagcucuccuaugauuaaauaggggaggagcccagcgcgcugcagggcacugaucgcuuuuaguggucaaagcaugacuucugccugcucccaccgcccccacucaucagacuggugauuaaaaaacuuacucacuggcugggcacgguggcucaugccuguaaucccagcacucgggaggccaagacuggaggaucacuuaagcccaggaauuugaggccagccugggcaacaugugagacccugucucuacaaaaaauagacacacaaaaaaaagagccacgauguuggcgcacgcuguagucccagcugcucaagagguugagguggggagaucgcuucagccugggaguuugaggcugcggugagcuaugaucacaccacugcacuccaguuuaucucaaauaaaaacaaagaaaaaccugaaacuuguucacauuuacuuuuccuuguuuccccuuuucauuucccuuagaaauuaauacuuucggaaacaaccaucuucgacguccugccuacuuucuucuaucacgcaaacaaagucgugugcauggcguccuuggagguaagcaggagaggcccagagaacagcacugaccaugccaguucuaguguucacugccgcuaccaugcaccugacccuaggccacaugccuuggugaaugugauccuauccuuuucucuucaagguagcuauguuaauagucccaucuuacagaggaaggaacugaggcucagagaggucaagugacuuaugcaacgucacacagcuagaaaguggcagaaccagguuuugcauuauugggucugccucauuccagauuccaugcuaguuaccacugcugucucaugucauuccagccucuuccaggcagggcacauuaaauacuaaucccugagagccaagucugaggcaccucaucuaaacuuucugacucacgugcauuaaauaccuuugaaagacuuuucugcuuggaacugccagagcuagaggagcccaggugacaacuuaaggugacccccugccccccgagugaugagguagaagggcguggccaguagcaaaacccagauuagagccaggugaucccagguggucuugcucccgggagcaagaauucaggucuucuugaauucaggaaccaagaaguguuguguugguuccaggaaaucagaguuuuaaaucugcucuuuuauuauuauuauuauuauuauuuugagacucgcuugugccuaggguggagugcaguggcacuaucucggcucacugcagccucugccuccuggguucaaaugauucuccuuccucagccuccccaguagcugggccuacaggcgcccaccaccacaccuggcuaauuuuuguauuguuaguagagacaggguuucaccauguuggccaggcuggucuggaacuccugaccucaagugaucugccugccucagccucccaauaaaucugcugcccuuuuagaaucuuuuuaagaaaauauguuuuuaacacggcccucuuacccgggucugcuuugcuggcaguaguuuuuccaauauucuuuaucuucugagcucagagucucaguccccuguugcccccacuuucucuucugcauccuugggagccugugagucacacagugagaagguuuacugggucuucuggagaccaucuugggcuuguuagcauauuacagccacagggucuccugggccugcaacuuuuauuccucuauggguuucaccucuggaagaaucuuucucaggccucacucuuuguuucuaacagggagaccuaauacaccucuucuguaguuacuuuaaacacaauuuuuguuuuguuagagacaggucuugccguguugaccaggcuggacuugaacugcuacgcucaagcgauccuccugccucacccuccccaguagcuuggacuacaggugcaugccaccaugcuugacuuacaguuacuuuuuaaagugcuaaaugcuguuugugucaauuagagauuuuucuaggaugcuuuuggguuuuuuuauuuguuuuguuuuuccaccacgcccagcuaauuuuuguauauuuaguagagaugggguuuugccaugucauccaggcuggccuggaauuccugggcucacgcgauccaccugccuuggcuccccagagugcugggauuacaggcgugugccaccaugccugaccccauucuugacagggaauggugggaaccuuccccaaauucaaguuccccagugcuggccaagggcaagucuuuuaauggaaagcaauuaugucugcuaauugcuguauuagcuccugcugcccaguucccgcauuuccuguucaguugaaaagcuuccaguguuuaaacuccagaacugcauuguccacuauggcagccaccagccacgugugguuagugagcacuugaacugcauccagucuaaaucgagcugugcucuaaguggaaaauacacacuccauuccaaagauguaguacuguauggagaaaagaauguaaaccaucucaauaauuucuuauauugauuacauguugaaaugauaauauuugcauauguggggugaaauaaaauauauuauuaaaauuauuuuuuaucuuuuuucuaagugguuacuagaaaauuuaaaauuauaggccaggugagguggcucaugccuguaaucccagcucuuuaggaggcugaggugggagaaucacugaacucaggaguugcagaccagccugggcaacauaggaagauccuuucuuuacuaaauauaaaaaacaaaaaaaauuagccaggugugguggugccuguagucccagcuacuugggaggcugaagugggaggauccuuugagcucaggaguucaaggcugcaguggguuaugaucucaccacuguacuccagccugggugauggagugagacccugucucaaaaguaaauaaauaaaauaaaguuacauacacagcuuguguuauauuucuguuggacagcacugcucuaaagcaggguuugauaaacuauagaccauggaccauauuuggcccaccaccuguuucuguaaaguuuuaucagaacgcggccagguacgguggcucaugccuguaaucccagcacuuugggaggccaaggcgggcggaucaccugaggucgggaguuugagaccagacugaccaacauggagaaaccccgucucuacuaaaaauacaaaauuagccaggcaugguggugcaugccuguaaucccagcuacucaggaggcugaggcaggagaaucgcuugaaccugggaggaggagguuguggugagcugagaucaugccauugcacuccagccugggcaacaagaacaaaacuccaucucaaaaaaaaaaaaaaaaaaaagaagaaugcagccacacccauucauuuacauguuguccacagcuacguccgugcuaacagcagaauugaguaguugcagccaagaugauaugucccacaaagccuaaaauauuuacuaccuaucucuuacagaaguuuaucaaccccugcucuagaguuuagaguggauuuuguguaacuaguaacacucugaaauaugagcaaauuugcucuuaacugcugcuuagaaaucuuuuuuuuuuuuuaauugaggaaggauuuuucucuguugcccaggcugaagugcaguggugcuaucauagcucauugcagccucaacauccugugcucaagcaauccucccaccucagccucccgaguagcugggacuacaggcgccugccaccaugccuggcuaguuuuuguauuuuuaguagacauggggauuugccauguugcccagacuggucucgaacuccuggguucgagugaccuaccugcccuggccuuccaaaaugcuggauugcaggccugagccacugcacccggccugcuuacagauagauauuuuagaggucauuucugguaccuguuccccgugagugcccucagcuuuugagcacacucugcaguggccccugagagaauguccguguguuucugccuugucagguuuacgugcggaggggcuacaucgccuaugaguuaaacagccugcagcaccggcagcucccggacggcaccugcgugguagaauuccaguucaugcugccguccucccacccaaaccgguauggagugggacacacccagggacggccuguguuucuguucuuccugaccucugucguccugucucuggaaggaccuggcaaguguguuugggcacgcugcuggggagacaucagcgauaagcacuuccccugugggagcucccugcagcgccauuuucuccccucuaacauggugauaaugcagagcccaccuccuacaccugcacuguucaguacaguagccaugugugccuauuuacauuaaaaugaaugcacaugggccaggcgcgguggcucaugccuguaaucccagcacuuuggggggccgaggcgggcagaucacuugaggucaggaguuccagaccagccuggccaacauggugaaaccccaucucuacuaaaaauacaaaaauuagccgggcgugguggcacaugccuguaaucccagcuacuggggaggcugaggcaggaggaucacuugaacccgggaggcagagugagucagugagcugagauugccccacugcacuccagccugggcgaagaagcgagacuccgucucaaaaaaaaaaaaaaaaagaggccaaacacaguaguggcucacaccuguaaucucagcacuuugggaggcugagguggguggaucacaaggucagggguucgagaccagccuggccaacauggugaaacccuaucucuacuaaaaaaaauacaaaaauuagccuggcaugguggugugcacugguaaucccagguacccgggaggcugagggagaacugcucgaacccgggaggcagagguugcagugagcugagauugcaccacuacacgccagccugggugacagagcaagaguccaucucaaaaaaaaaaaagagaaaaaacaaagaaugcaaaugagccagccaugguggcccacaccuguaauccuagcacuucggagggcugaagggggcagaucaggaacuugaggccuggaguuugacaccagcccggccaacuuggugaaaccccaucucuacuaaaaauauaaaaauuugccaggcgugguggcacaccccuguaaucccagguuacucgggaggcugagggaugagaaucucuuaaaccugggaggcagagguugcagugagccaagauugugccacugcacuccagccugggugacagagcgaaacucugucucaaaaaaaaaaaaaaaaaaaauucagcuucucagucauacuggguggcucauggcugccauauuauuugacaguggaguucuagaacauucugucaugguagaaaguucuaguagacaaugccacccaagccauugggaagagucaugagauaaggcacauguagcauuuuagacagugccuggcacaaaggaaguuguugacuguaagugaucccggagaugaucaugacuaacgcuguuauuaccaucuaguggcaugccauuggccugggcacucugcucagugcucccacacucuuuuauuuauuuauuuuuuuugagauggagucucgcucuguugcccaggcuggagugccaguggcacaaucucagcucccagauucaagcgauucuccugccucagccucccgaguagcugggacuacaggcgcacaccaccaugcucggcuaauuuuuauauuuuuaguagagaugggguuucaucaugucagccaggcugaucuugaaugccugaccucagaugauccacccgccuuggccucccaaagugcugggauuacaggcgugagccaccgugcccagcccacacucuuauuuuauucagcucuuauccucuaucggccaaaaauguguucucauccucguuuuacagaugggagcccugggcccucaccugaccuaggcugagcugcuugugcacguggagugggaauuugagcccaggccacacucucaccuccaaguccuuuccacagcauucaggggcccucugagccaggugugagggcaccuguccugucuguguccacuguagucugcuguccaagagcuguaguucaguagauacccucaguguucucaccugagaauaucuuuuuuugauuuuuuugagauggagucucacucugucacccaggcuggagugcaacggcgcgaucucagcucacugcagccuccgccuccuggguucaagcgauucuccugccucagccuccugaguagcugggaccacagucaugcaccaccaagccccacuacuuuuuuuuguaauuuuaguagagaugggguuucacugcauugaccagguuggucuggaacuccuaaccucaaaugaucuguccaccucagccucccaaagugaugggaugacaggcgccaccaugccuggcucaccuaaaaauaucugaugugucugaguuccucacucacagucuuuuuuucaguccaucuuguuucaggacccaaaguauuaauaccauuuaggucagguagagugggauaccuucucuuaaaguaauuaugucuccuugggauucgaaguguucucucucacgcucccucaccccucugguuuuaguucuuaugggggugcccaaggccuuaccuacggcggcauugaugucauugugauuugggaguucgguugaucagaucuguacaggcaauaggguucaugcuuuggugaagcggggauuuuucuggccucuuaggauuuuuaaaauaacuuucuuuuccuguugguuuuaagaagaaagaugcugcuauguuuuggaugaagaaaagggggcuuccccacgaggcacugccuuuccuaguuauuuguuuuuacccuucuuauuuccaaaaauaggauugugacauuuuaccccauugagagaaaggggacugacugcuugcagccuggggucauucuggggauuuggagagcaguggugguguaagauauuuuguagcugucuacuccugagaaggacucuuuugauuuuuuuguuugguuguuuagagacagagucuaguucugucacccaggcuagagugcaguggugugaucauagcucacuacagccuugaacuccugggcucaugugauccucccaccucagcucccuguguagcugggaccacaggcuugcgccaccacaccuggcuaauucuuuaaaaauauuuuuuugcagagaugggggucucacuauguggcccagguuggucuugaacuccuggguucaagugauccuccugccucggccucccaaagugcugauauuauaggcgcgagccccugugccuggccuucucuuuugaucuuauugucccagcaagucagcccuguuaggaagggaagggcggcucuccugagggcugugggucaugccuugugagcuacacguauauccagguuauugguugugauuuucaguaugggcacaggguccuuuuuugacccagagagacauugaggacccugggggauuccuggccaucuaagauucucaugauugcucucagugccagaaauguacucugggccugugaagagaccuugccugcggcugcccccaccaaccagcccuuuaaugccucuguaaagggccaugaggaauaaagucuauccccaagauggccuggcuuggcccucaacacuuguguguguagagccaggcacauggugcuuuaggucaccgagacccaagggaaggucagaugagaaguuggcagggcuuugugccagcugcagccuggaccuggaccucugugcugggugggaacuggcuacaucccccugcgauggggcugcuguccuagcucugcccacuguugcccugcaggaaacugaccaucacaaccagacuucuccaugauuuuuuccagcagaagcaggaaaucuauuuuuuuuuaaccugaaguccuuccauuuuucaauggggacagguaauucauguuaaaugaauacaugaacacauguuaauucauguauguuauuaaaaugcugcauggaccaaagucauucugugaguggcauucagccacacugccacugcaaguuugugaccccuggauugagcugucggggagcagaggggccaugaucgugauuucagagcacccaacaggaaugcacacaccugugucaggguccccaaaagcacccccagguucgaucaucgccuaggagaacucacaggucucgggacauagucaugcuuauagcucugacuuauuagggggcaaggauacaaagcaguuagccaaggcagaaggcaucagggugaaguccagaggaaagcaggugugcugccaggguccucucccaguggauucacgcagggugcacuucauucccccagcaaggaguugugacaacacaagugaaggguugucuuccagccccgcaccagggauugguggcuggucacaucacccucugcucugcaucgaaaucucaggcuugcagaagaaagcagguguucagcauaaaccacacuguuugugcaaacaguugaggcacagugagccccccuugucaccuucagggaacgauaggaaccuuccccaaguccaaguucccagaggccagccaagggcuguccuugcaagcaagcaggucuccuuucucagaagagcaguguggggccugcugugcugacuuccugcacaccauuucauuaccccucccguaucugauuccaaggcccaauucuaacaaccucagguggcccauugagauuugcugcuggugagcagccaguucugggagcaucguugucuaaacuccagaaggcugcugacuuugucccaagggcaaguuugauggagggauuacagggagcagaggacuggaguguccgucaggaccaagccugacugccucaccagcugccuggggcugguggauuucuccaggagaaauugaugcugggaguguuucuucucuguggucaaguucagcacuuggggcuccccucgggacuguguugagacuggacucucaugcaugaaucauugauuccuacacuuguugagcucuuacucuucaccagguccugagggaucagaugagacccuccucaggccccggccccagccauugucucauccccugcccauuuuaagcccccauuuggaagagcucuaaaucugguccagcucacugaagcuucaggaguaggagcagcucguagaguugggucugcaagcagcugccucauccccgacuugccaucaccuuacaggaugaccgugcccaucagcaucaccaacccugaccugcugaggcacagcacagagcucuucauggacagcggcuucuccccacugugccagcgcaugggagccaugguagccuucaggagauucgaggacuucaccagguacccagcauggcccggucuccaacacccugagcaugggggcugggcagacuucccuugaauccccccccaauucacuggacagauggggugggagagacccagacacguggcacagcaugucaauaacaacagaauaauaauagcauuguagccaagaguaugagccuacaugucagcuugccuggcacagcacaucaauaacaacagaauaauaagagcaucguagccaagagugugagccugcgugucagcuugccugguuugaauucuggcuaugugcuuucuaacuaagagacugagcaaaauauuuuuaccucuccauaccuucguuuucuuaucuguaaaaugggaauaauaaaggacucacuucauaggugcgccaugagaauuaaaugagauaacauaugugaaauaacauauuuaaaguauaauuaguaugcagauaauauagugacuaaauguuagcucucaauaguuacuguuauagucuuuuuucagccuuucacuguguguucugcuuugugcuuggaguaucuuguggaauuuucacaacagccucaugaggcauagggauuacucuuauuaccuuucuuugacucggggugaggugagguuucuaggaucucccagccaguaaaaaugggagccaagaguugaucucaagcccagcugaugccugaaagcgcuggaauccuucccuguauuccugaucacagaucacuuagguucauucuucccuuuugggaaggaccccaucacgggugcucuggacaaaguagacagggaaccuccugagcucuguagaguuggauaagaucaaaggguguuggcugggaaauugggagggucuggcguucccugcugccuggcuuggaagcuugaccucauccccaugggucagcagccccucagcccucccucucuacccgcacccccagaaauuuugaugaagucaucucuugcuucgccaacgugcccaaagacaccccccucuucagcgaggcccgcaccucccuauacuccgaggaugacugcaagguaagcgucuaagcccagggagcaaccuggggagcaggugggccguggcccccaggcuuuccagcccuaccccuugcuucucccucucagagccucagagaagagcccauccacauucugaauguguccauccagugugcagaccaccuggaggaugaggcacuggugccgauuuuacggacauucguacaguccaagguacucugggcgugccucugguuuugguggggguucuuggagaaggaggaggggcugggcucgucgaggcggcccuuggggaggcaggcgugcugaguacuucagagccacagaccuggcuucccacucuagcucugcucgccucauagcuggcgaccuugggcagauguggcugaacguggggucagcauuucucucgcucacgguguugcaaugauucaaugacaaaguauauacacggcuuagccagucccagguacggagggcacacccaauaaauaguuuggagauuuucugggaguguuuuuguuggaauaauccagaaacuggcaguuuuaaaauggcuacuuacauugaugaccaagugugccaauaacagcagguugcucuguaagccugugaugccauuguauuucagccugggggacagagcgagacccugucucaaaaaaaauuauauauauuuacaguauacaaugugauauuuuuuaauuaucuuuuuaauaacagcuuuauugagacaucauugacauacuacacaauucacccauuuaaagugugcaguuuugcagccauaaaaaagaaugagaucauguccuuugcggggacauggaugaagcuggaagccaucauccucagcaaacuaacacaagaacagaaaaccaaacaccgcaugugcucacucauaagugggagcugaacauugagaacacaugggcagagggaggguaacaacgcacaccggggccugucggggggugggggccgaggggagggaacuuagaggacaggucgguaggugcagcaaaccaccauggcacauauauaccuguguaacaagccugcacguucugcacauguauccuguuuuuuuuuuuagaagaaauaagaaaaaaaguguacaauuuaauauauuuuuaguauauucaccagguuguacaaccaucaccagaaucaauuuuaggacauucucaucacuccauagaaaaacccuguaccuguuagcagucacuccccucuguccccaacccaaaaacccucuccccaccacagcccuaggcaaccacuaaucuacuuucucucuauauagauuugccuauucuggacguuucauauaaauggaaucagaucacaggaggucucuuaugauugacaucuuccacuuagcauaauguuuacagguucauccgugugguaacaugcagcaauacuucaguuccuuuuacggccaaauaauauuccauugugucuuugguuuuuaaugcagaaaaauauccuuguggauuauggacuccgacgaaucacauucuugauugcccaagagguuaguucacaguucaucucuaugagucuuucccauucuccaagccuuggugugugccauuuauuugauauuuauuuuguagauuugggugaaagagaucauuagaaaggagaaggauuuccaaaugauucauucuagaagugaauguaaucguuuacaaucacuaaauaaggauguacauauuucagugcgucuugcuugauuuaauugucuuguguguggauuucuuuuugcagaaagaauuucccaaguuuuucacauucagagcaagagaugagguauggccaaaaguaaugauguuuucucuucucuagcaucuuguuuuauuuuuuaagagaugggauggggccgggugugguggcucaagcccguaauccuagcacuuugggaggcugaggcaggagguuugcuugagcucaggaguucuagaccagccuggguuauauagugagacccugucucuacaaaaaaauuaaaaaaucagccuggcauugugaugcaagccuguggucccagcuacuugggaggcugaggugggaggauugcuugaaccugggaaauagagguuucagugagccaaggugauuccacugcacucuagccugggugacagagugagacucugucucaaaaaaaaggaaaaaaaagagauggggucucacuauguugcccaggcuggacucgaacuuauggcucaagcgauucucuugcuucagccucccgaauagcugggacuauaggcacaugccaccgugccucccagcucccuggcaucuuugauauucaugaagaauauagucugcaguccuuaaggcauccccauauucaagaauguagcaacuuuuguguagacugcagucuuccucugggauuguauuuccauugagagcccucuguucccugcauggcacucagaccugagaaucuugcccuuucagccucacuacagguuucugucuugcuugaauaauuuucaguacuugcugauguacucaguaagacauuuuuuccaaacuguuuuucuuaugcucgucuagaacagugguuggcaaacucacuugcagaccagcugccuguuuuuacgaauaaaguuuuauuggaacacagccacacccguuggauuccacauugucuacucuggcuuucacucuaacaguagcagaauugaguaguugugacagagcccguaugauccaucagccuaaaacauuuacucucuggccauuuaagaaaacguuuaccgaucccuguuguagaacagguagguuuauucccagcacugauucaagaccccaccaaauucagcauuuugcauuuuaauuuauccaaagcuuuauuuuucuagcuaagacacauccuuuucuuaaugucuucauuuuuuuuuucaguuuaguuuccaguacugucaguugcuuucuuuucggggaccaauuuccaccaagaaaccagggguuaguggcuucaugagaauugccacaggcugugacagauggagaacagccuggucacgcuggcaggugauagggacuagcuagguucccccaggagccagcgcugcacccagcacaacaggcuugcaaugcccauagcucuccucagaucuuagcaaaaccccaaauaucuggagcccuggggguagcuuacaauuagggaacaucaugaaugcugcauuccugagugccaaacccauggacaccaggggucugcagaguaggguguggaccaagcagggacgcagcuccaacgucacgcuguguguguaugugucugucuucucucucugguccgccuacaguuugcagaagaucgcauuuaccgucacuuggaaccugcccuggccuuccagcuggaacuuaaccggaugcguaacuucgaucugaccgccgugcccugugccaaccacaagaugcaccuuuaccugggugcugccaaggugaaggaagguguggaagugacggaccauagguucuucauccgcgccaucaucaggcacucugaccugaucacaaagguaagaugucgcagagcauuucuuccucucucagaaccuggcccucccuuccuuacauuccugcucugugcuggguccugggcugcaugcuggggauggagaguacaccaacacccaggguccugcccuugcuaugcuccaguccagggcaggaggcggacagcaaaguggccugugaucacguccaggcugguggcacuuggaucuguuucuuguauuaugugggucucugcgcaugagaagaaaauuuccaggauagaaaaauacugguuuguucagggaauuucuuaauauuugcugacugagugaucguuuuccauuguuucuugcauuuagaaaaguaauccauggccgggugcagugacccaugccuguaaucccaguacuuugggaggcugaggugggcggaucacuugaggucagggguucaaaaccagccuggccaacauggugaaacccugugucuacuaaaaauacaaaaauuaccugggcgugguggcguacaccuguaauuccagcuacucaggaggccgaggcaugagaaucgcuugaaccugagaggcggagguugcagugagcugagauggagcccuuguacuucagccugggggauagagugagacccuaucacaaaaaaaaaaaaaaaagaaaaaaagaaacagaaguaauccaugauuauauugugaaaauuuuaaauaagacugaaaacgauuuuuaagaaccuagcgcaaggaccgagaauccugucacugaggggccagcuuaguuguugacuguuucuagacacaauuccgucccugaaaccuagaguuguaggcauaaguugcagauaagagcugagaguggacagaucauuugaauauauuauucuuuaauuggucagucacuuguggaccucuuucauuguuaauaaagagugguccaccacauauuauuuccuugcauggauguaccguguauaauuuuuuuuuuuuuuuuacuaauccccuauugauggaaacauauauauauuauuauauauauaauuauauauaauaauauauauaauauauuauauaauauaacauauaauauacauaauauaauauauaauauguuauauaacauuauauauacauaauauaauacauauuauauguauuuauauaaauauauauuuauauaaauguauauauaauuauuauauauauauauuuuuuuggagauggaguuuugcucuuguugcccaggcuggagugcaauggcacaaucucaguucacugcaaccuccgcacccccggguucaaacaauucuccugccucagccuucugaguagcuaggacuacaggcacaccccaccaugcccagcuaauuuuguauuuuuaguagagaugggguuucuccauguuggucaggcuggucugaaacugccgaccucaggugaucugcccacuucggccucccaaagugcugggauuacaggcgugagccaccacgccuggcccuauugauggauauuaagcuaacugcaguuuuuuugcuaccugucagcuagauguuuuauuuuuauuuugauacagagauuugcucuugucacccaggcuggagugcaguggcgugaucuuggcucacuaccaccucugccucccggguucaagcgauucuccugcgucagcuuccuaaguagcugggauuauaggcgcccaccaccaugcccagcuaauuuuuguauuuuuaguagagacggaguuucaccauguuggccaggcuggucucgaacuccugacaacugauccacccaucucggccucccaaagugcugggauuauaggcgugagccacugugccuggccaagccguuuuaauagguuuuauuauuguugagguauggugaggccaacagauaaggagacaacugccaucaaaaagacaguuuauuacucauaguucccaagaagaagggguuuucccugccauggggccacauggggaggcucugggguuggucaggcagcagagggacagaggggaagacauggaagacguggacgagagccuugauugugguuuccuggagaagaaaaaagugaggcugaguaaacagguuuaggauuggcugugaaucaucucagcagacccuggcauauagaagcugucucugguucucaggaaucuggcccugggugauuagagcaggugguuuguguccccagguaugauccagggucagcaaggccccaggugucaaagugucagaaugcagaaaauaggacacaugucaauacacucaacagcuuugcagucccuucgccucugagaggcagggcucugcuguucuugccuggcacacuuuuuggaggaggggaauguuuuccuccugucucugccucuuuggggcugaguuuccagccagcugggaguaggccugcaccccuggccugagcagcugccccucccacucuuuggcaggaagccuccuucgaauaccugcagaacgagggugagcggcugcuccuggaggccauggacgagcuggagguggcguucaauaacaccagcgugcgcaccgacugcaaccacaucuuccucaacuucgugcccacugucaucauggaccccuucaaggucucgccuuugcaggggggcucucaccgggcucuggguucacccucugagccaugcugcuuugggguauugucucuugccacucaagaccuggguuccaggaugaaaccaugcguaucugagccucaguugcugcgggaggagagcaaaccuucugccauucaauucuagagcuauguuuuagccaugcccugcacgggaaugcuuuacuuuaaggaugacaagcaugcucaaaaugucuuucaaaacaaaauuuuguccuuucccugguuccaggcugcgcuggggacugcauguggguggggagagacgugagaccgugaggucuguggcugaauguucccugucagguggcucuucacgagcagacagacuuuuaugguggugauucuggaaugaaagaagccccacuuguaaucccaguacuuugggaggcugagguggguagauugcuugagcccaggaauuugagacaagccugggcaacauggagagacccuaucucuacuaaaaauuuuaaaaauuaaaaaauaaaauauuaagauuauuaaucaaauuaauauuaauaucgauauauuaauauuauuaaaauauauaaauguauuuuauuuuauuauuuaauaauauauauuauuaaaaauaauuaauacaauaguauuauuaaaaagagaaguccugauacauccguuugguaucugggggauucaggggacccauguggaggcucuggccucacuaguucagguaguuccagaaggaagcagugcaauggcuugagucaaaggcauguaaagauaguauaacauagcaguacuaguucagucacuuaucagccucaguuuccuuaucugucagugagggauuagaaaagcucgccucucuugaguacuuacgaaggcaaaaugagguagaguuuuaaaugcuuagcaagagccguugcuuguuauuaguuaauacuuuuuguuggauacacacuaugucccaggcguuuuugcagucaguauaucucauccucuuauuaguaucagugcuauugcaaauguccuugggaugucuuggcccugaaacuggaauugcuguguuuuggggcagaucgaggaguccgugcgcuacaugguuaugcgcuacggcagccggcuguggaaacuccgugugcuacaggcugaggucaagaucaacauccgccagaccaccaccggcagugccguucccauccgccuguucaucaccaaugagucgggcuacuaccuggacaucagccucuacaaagaagugacugacuccagaucuggaaauguaaggcuggcccgcgccgugggggucuaagucaaagcagaagcaggcugcuugggccaucaauuuguagauuaagauggcauuuggaggcggucuugccuugcucucccaugucauucuggguugggguagcccccucugaguguuauguuaaauguguuagccuuugaaucuugguuuuucacucaccuaaaaaggagagugaaucuccaaguuuaauccauucuguggccauguuggauuuuugauagagacaaggugucaccauauuggccaggcuggucucgaauuccugacuucaagugaucugcccgccucgaccuccaaagugcugggauuauaggcgugagccaccacgccuggccauauggccauauuugggauaaguugugcacuacugugguugacuguaaugcaguccucagauugguucacuuagggaaauacuuucccaaccauguucuaggacagacuuuuguaaagugaauuaaauguucuuuugacugccauuuaaauuccuauguguguacauaaaaauauacauauauauacacgccauuuuuuaaagagauauugccuagacugggccugaacuccuggguucaagcaaucuucuggccucagccucccaaguagcugggacuacaggcacaugccauugugccuggucuaugcacuuuuuauuuuggaguaauugaagacugaagacucucaagcaguugcaaaauuaguacagaagaaaaaaaauagugcagaggauuuucacccaguuucccccaaugguaauguugauugaacuucaccauugcacaucauuaaaacaggaaauugacauuggcacaggacuguucgcaccaacacugaccacguucggauuucaccagcguuuccaugcaugccuguuguugggagugugugaugccuugaucacuguauuuuuggaacugcauuccacagccccuguugucccuucuuguucuggcccuccacaguggugaagaagggaguuuuacguagcccaggcacucacuuugucaugccaugugacaugcuuugcuucccccaccugcauuuucauugaggacugggcagaaauaaauugggggagaugugugauucucucucacucucuguuuucccuccuuucugguccagaucauguuucacuccuucggcaacaagcaagggccccagcacgggaugcugaucaauacucccuacgucaccaaggaucugcuccaggccaagcgauuccaggcccagacccugggaaccaccuacaucuaugacuucccggaaauguucaggcaggcaaguccggcggcucagacgcgguacccccuggguccucccagcagacuccaccagaaccaaagcccauccuuaauucuccuucuaaagaccuagucuaaaggacaaggucuugccaggugcgguggcucacgccuauaaucccagcacuucgggaggccgaggagggaggauugcuugagcccaggaguugaagaaccccaucucuacaaaauauacaaaaauuaaccgggcgugguggcgcaugccuguagucccagcuacuugaaggcugaggcaggaaggaucaccugagccugggaggucgaggcugcagugagccaugaugucaccacugcacuccaggcugggugaccgagugagaccccgucuucaaaaaaaaagaacaaggucugcauugaagaaaaagaaaugaauguguugagaacgacuucauaguauuuuucuccaaauaagacuaauuuaucccaaugauaaaagucauaggauauagaaacuucagaaaauaaaggagguuggaacaaagaaaaaauaauuccuagucccacacucugaugacaaauugcuuaacauuuugauguguuuccuucuggucuuuuuaauggucauuuauuaaguaccugcuacuuaccaggcaccauucgaagucuagacagcugugggaaagaggagggggucacugccuugaguaauuuuuagucuacucuuaaaaaauaauguuuuggguugggcacaguggcucacgccuguaaucccagcacuuugggaggcugaggcagguggaucauuugaggucaggaguuuaagaccagccuggccaacauggugaaaccccaucucuacuaaaaauacgaaaauuaaccaggcguaguggcaggcaccuguagucccagcuacucgggaggcugaggcaggagaauugcuugaacccgggagguggaggcugcagugagcugagauggccccacugcacucuagcccuggugacagagcgagacucugucucaaaaacaaaaacaaaaacaaaaaaauaauguuuuauuauguuuuucugaugauuaaaguauacauaggaaacuauggaaagguaagaauaaggaaguaaaauucuauucauauguaauuuucccaccaucaaugccugaaagaacauuugggugcauuuucuucaaguauuuuuuaugccuuuauauguuuaugcccuaggggcuuuaaaggagccugaaccacugacauuggugaugugaaugucucuucauuuuccaggauugcuuuggaaugacauuauauauauauauauauauuuauuuauuuauuuauuauacuuuaaguucuaggguacaugugcacaaugugcagguuuguuacauauguauacaugugccauguugguaugggaucuaauuaaacuaaagagcuucugcacagcaaaagaaacuaccauuagagugaacaggcagccuacagaaugggagaaaauuuuugcaaucuacucaucugacaaagggcuaauauccagaaucuacaaagaacgcaaacaaauuuacaagaaaaacaacaaccccaucaacaagugaaugacguucaugaaaccaaggucaaggaccuuccaguguaggcaggaagcaucuguuccuaccucugccuaugccucaugcauagaggauaugaaagaguaggaaaagcugcucuuuagaguaacucgggccucagcucgaaugcuggaucuguccccuugcuuccugcugucccuagccaaguuccuucaccucucugggccucaguuuccucuucuguaaaauaagaauaauaacaguaccuaccaaaaguuguuggaaaaguguauguauucagugggcgcuuaauaaguggaaacuuaugauuaagaaugucauugucuguauccuuuugccuuugaccucaagagcuauaagggaagaaacaugacugaaccagaagcaaauccaucgucucuuuuuuagauaaauccauugucucuuuuuuacaggcaugagccaccaugccuggcuaauuuuuuuauuuauaguggagacaggguuucacuauguuggccaggcuggucucaaacucccggccucaggugaucugccugccucagccucccgaaguguuuggauuacaggcaugagccaccacacccagcugucugucugucugucugccucuauaucuauaucuaugucuauaucuaucuauuuaucuaucuaucuaucgagagaauggaaaacugaacagcagaccagagcuaaauuuaucaauauggauaaaucucucaaacaaagaggaguagaaaaaguaauuugcugccgggcgugguggcucacgccuguaaucccagcacuuugggaggcuaugguggguggaucaccugaggucaggaauuugagacuagccugaccaacauggagaaacccugucucuacuaaaaauacaaaauuagccaggugugguggugccucaacccgggagguugaggcaggagaaucacugaauccgggaggcagagguugcggugagcugagauugcgccauugcacuccagccugggcaacaagagaaaaaaaaaauagaaaaaguaauuugcggaaggauguguacagugugguacucuuuauuuaaaguuugcagugcaaaacgauauuguauguuuccaauguaugcauacaggauaaaggaaaaugaaaaaaaaagcaugcauaggacuggguaggcacugaauucaagggaauggucaccuguggguuggaguugggaggaagaaugagcuggggcuucaaucgcaucuuucuucuuucuuucaaaaacuuuaaacaacuauggaaaaaucaagauuugacagagccacuggaugggugcucauauuuaaauaugcuuuaaauauuucaugauucaaaaagagagagugaacuacagaauucacccuggaaucaugacagaucaucucugucugggaaagauaguucuucccuacugaugacuucaaguuuuuucucuuuccucuucucuccccaggcucucuuuaaacuguggggcuccccagacaaguaucccaaagacauccugacauacacugaauuaguguuggacucucagggccagcugguggagaugaaccgacuuccugguggaaaugagguaauagcucagcggagccuaaccccuggcuggagucacccccuuaaaaauauuuuugggccaggugcaguagcucacaccuguaaucccagugcuuugggaggccaagguggguggaucacuugaggucagaaguucaagaccagccugggcuacauggugagaaccugucucuacauaaaauuuuaaaauuagcugugugugguggugugcuccuauagucccagcuacucgagagacugaggcaggagugauugcuuaagcccagaaaguugaggcugcaaugagcugugauugcaccacugcacucuggccugcgcaacagagcaagacccuguaucuaaaaaaaauaauaauaacuaaaauaaaauaaaaaguuuucccccaaagaaacaaacucauuuuccuugugcauucauccccuugccaggugggcaugguggccuucaaaaugagguuuaagacccaggaguacccggaaggacgggaugugaucgucaucggcaaugacaucaccuuucgcauuggauccuuuggcccuggagaggaccuucuguaccugcgggcauccgagauggcccgggcagagggcauucccaaaauuuacguggcagccaacaguggcgcccguauuggcauggcagaggagaucaaacacauguuccacguggcuuggguggacccagaagacccccacaaaguacgucgugaaacuggcggggcagggugauucugcucagcuacuacuguauuuucagugggagugcuagcaccugcaagaggugaaaaaaaucucacuuauguauaaagcacagauguacauguaguguauaaacaggcauacaguguaucagugauacuaacauuucacuguggcgggggggauggugaugagaaaaaaaagaucuaaaaaggcuccuuaacggggauaaugaaaaaagucuauaaacccugagcugauauacacugagcgcuccugaaugcagugugcacugagaaugcagaggugauugugucaacucccuggccucauagcguucuuagaauuauggcucacaccugucaucccagcaacucaggaggcuugggugggaggauagcuugaagccaggaauucaugaccaagcuagguaaccuaggcagcauagccagacuucgucucuacuaaugaaaaaacuaggugagcaugauggugccugccuguagucagccucagcuacuugggaaguugaagugggaggaucacuuggagcccaggaguucaaggcugcagugagccaugaucaucauaccacugcacuccagacugggcaacugagugagaccccccaucucaaaaaaaaagaaaaaucuuuggggaguuguauagauaccagcuugccauaaaaggcaagaugaaugagggaagcgcacgcauucugugaugugaaaugacaggggacagucauccuuuccauucagagcaugcauucucgggggcgauauugcccacuacccccaagaagacagaaaaauaauuuuugggguggcaauaaaauaguuuuuaacauauauacauauacagaguauguaaauagugguuaaacaguguaucuugaaaauuaaaauuucauguuggggugcuggcaauaagaaauaaaaaugagauaguccuuagaggagagcuuagcucaaagcagaacuucaguuuauggcuguuauuaauacgguauuuacaugagauguguuaaugugucauugacauguuacuaacauguuauuaacauccaucccuacgauguucacauuaagaaaaaaaaaacaguggcuuucagugcagggaacuggauucguagccucacuaaaguauuuuuuaagggauuuaaauaccuguaccugacuccccaagacuacaccagaaucagcucccugaacuccguccacuguaaacacaucgaggaaggaggagaguccagguaaauaacuuaucagguagcuccuuaauuuugcucaugguuaauuucagcugucuucuuuccucggggcuuguggcgauauuuuccagugggguggugguguuuguaugaugggaaccaaugccuguugggggcacugaugccuuaaacauuuguuaaacucuccaaggugaguccauccuugucauucuaaaaugagugacuccuuucacaaaaaauagcacgucauguagggagaaugagauuggauucucgugaaucuccuaggagccgcaggcucacauuuugugaccaaacugaugcagcggugacuuggcaaacugggaagguauggguggggcagagagaggucuguucuucgagagcauucaaaggcuacuaucuuuuccaggacaaguuauguuuuucucagugggauuaacugacucaggauuuccuagacuggguuuuuugcaauguuagugacaagcuggggggaaauuccauagucagaugaguuugggaaacacuggguuaaaugagaucucauaaacaucuuuauugcagaccuucuuaguaccuguagcaugcuguauuagucagcguucuccagagggacaggacuaguaggauauauguauauaugaaagggacuuuauuaaggagaauugacucacaugaucauaaggugaagucccaugauaggcugucugcaagcugaggagcaaggaagccaguaguggcucggucugagucuaaaagccucaaaaguagggaagccaauagugcagccuucaguggccaaaggccugagggccccuggcaaaccacuggcgugaguccaagaguccaaaggccgaagaaccuggagucugauguuugagggcaggaagcuuccagcaugugagaaagaugaaagccagaagacucagcaaggcagcuuacuccaccuucuuucaccugcuuuuucuagccgcgcuggcagcuggaugacuggauggugcgcacccacauugaggaugggucuuccucucccaguccacugacucaaauguuaaucuccucuagcaacacccucaaagacacacccagaaacaguacuuugcauccuaaaguugacacuuaauauuaaccaucacacaugcuaaagugcauugugaaucucuaacagaggcuggcgggacaguguuucucauuauguggcccuggaauuuuugauugauugauugugaauggguuuccucuguguacccccaucucucuguagaccguuggaggaauaugggccgagggugauauuucacugagacagccccugaacaggcagauaucuuugguuguauaaaccaaaaaguaucugagacaggucucaaucaauugagaaguuuauuuugccaagguuagggacacauccagaagcaaagaacacggaaucauagaaaccgucuguggcguguaccuuucuucaaagaugauuuggagggcuucaguauuuaaaggagaaaagcaggcuggaggggaaagagggaaguucugguaaucacauguugcaggagaaaaggcgcaggcaggggaagucaguuauguauucuuccugcgcucaguaagucagcacuuucuauaagauaagguggacauagaggaacuaccuguggagauauuucagcuuuuaucuguaucuaucugcuuacuaaagaaacaaaaggaaaggcagcuugcacaacucagcuucagcuuaaauuguuccuuuuggcauugugaaucgugguccuaguuuuuauuuuccuuucacagaugggagcagugugaugauuuauuuauuuauuugagacagaaucccgcucugucacccaggcuggagugcagugguguaaucuuggcucacugcaaccuccacuucccagguucaagcgauucuucugccucagcuucccaaguagcugggauuacaggcgugcaccaccacgcccagcuaacuuuuguauuuuuaguagagaugggguuucgccauauuggccaggcuggucucaaacuccugaccucaaguaaucugcccgccucguccucccaaacugcugggauuacagagcagggugaugauuguugaugcugcacuugcccuuuuagaaaucuuagcacucauuuugaggguucuagaugccaauuucauuuugccucuggaugcuuugucugcuuccaaucucucaccuugcugcccagucagucccuucuugggaaaugcauccaccuuggauuuuuuggggcuagagcccagccuuuaaccugugcuugcuuuugaagauacaugaucacggauaucaucgggaaggaugauggcuugggcguggagaaucugaggggcucaggcaugauugcuggggaguccucucuggcuuacgaagagaucgucaccauuagcuuggugagucuucuucuauuuucucuuacuuuucaacuuuccauuauagaaacuuuaaaauugucacaaaauuagagagaaucaauaauaagccccaugugcccgucacauaccuccuacaguuaccacaugccagcccacugauauuuccucaaucucacccccauccccugcaccuguuuuagaguauuuuaaagccagcccccaucaugucuuuucauccauaaauacguaaggguagaucuuuaacagauaaugacucucacccucuucccccgguuuuuaaaaacauaacugaaauacuaauauuacacccaacagaaucagcaauaucauugaaacccagugugguuuaacaguuaucucaaaauacccuuuucuagugguuuguuugaaucaggguccaaucucaucuuauuuucaagguacugaauguuuagaagaacuuuucucugacuuuaacuggcauauaaggaguaguccccaucccauccccauggccuuuccaaaaauguuuucuguuucuaguaguaguacuacuguaguaguaguaguaguacuaguaguaauucuaguacuagcaguggugguaguagugguggugguaguaguaguagugguaguaguguuugugguggugaaucuguaugggucuaaggcagagugagagaccgaggcaagucucucagcaggagugaaaguuuauuaaaaaguuuuaaagcaagaaugaaaugaaguacacuuggaagagggccaaacaaggcaaccugagagauccaagugccucauccaacccuuuugagguuuuaugcauuggcaugauuccaggguuuguguuucuucuccccugauucuucccuuggggugggcugucugcaugcacguggucugccagcacuuaggaggggccgcaugaacaguguguuuacugaaguugugugcaugcucacuugaggcuuuccuccuuuaccagucgaguguuccuagaagaagggcacgguaccagauaaacucugccaucuuaccucuuagcaugcaugcuugagcccacccacccagcuccugagaucuuauggggaagcugcuuaucacuagcuucagguguuuucuaucuaucaggagauugccuuucccuggagccagcugugaccaauauuaauuuuagagagacacuuuagcaacugccuaacuaucaccugaugguugccuuccucuccugcccugcucaugucugcuuaacuaccuacucuaacagcagcagcagcaggaauaauaguacucuuuaaugauaaacugccuuggaaggccuuauuuguacaugcaauguugaaucuucaguuuccaaguggaaaauguuggucauaagcaucuuccuugggcuuguuuucuagauuauauguauagucuuuuuauuuugaagucaucuaggacccaccguaaguuauaagauacuacagagaauuuccaaguacccuucacccagcuuccccuaugguacuuacauaaccguaguacauuaucgaaaccaggaaacugacauuggcacaauauuguuaacucaguacagaccuuauuuugaauuucaccaguuuuuacaugcacuccuagguguccuuuugguuguuaagaggcugcaauggcccaugaaugcccaggcucagaagagcugcacacaagccucuuaaaaucugaaacauucacugucugcugcuugucuuuacagcaaucuuuguuaaccauguuauuuccagauaggaauccaagcucaauaaaguggccugaagaauaggcuuuugccucuacugugguuuggcuccaaaucggguugccauuggucaaaacauaacuuccauuuggucccagcagguuccuggacucuucccugcuguggggggugggucccucgccacucuccagaauucagaggggguccucucuccacaggugaccugccgagccauugggauuggggccuacuuggugaggcugggccagcgagugauccagguggagaauucccacaucauccucacaggagcaagugcucucaacaaggugaccaaaaaggggccugugcagaguggauccuugggggccaggagucauuuuaacauucccauuggucucuggugggggauuuuucucaauaugaagccaguuucauuccuacugauacaagagcucuuuuuuuccaauuugcagcuaucuggguccuuaugagaaaaaaaaaauuaguuuuaggcaauucuggucgaucuaacucccuguauuacugacauuuuaaaacaaauuauugaagugccauuacacauugcagaaaauuagaaaaggaaccccccaaaaaaguaauuuugcagcuucuaucauucugguauaguucccucucaucuucugucuuuaugugguuaauuuauagugaauaugcaguuuuguauucuacuuuuuucacuguauuaaaacauuuuccuuguugaaaagucucuauacuuaaugucugcucaaaucucagccaaagucucaaagccugguucuugaaccaacagcaucagcaucagaugggaacuugucagaaaugcacauccucaagcccugcugcagaccugcugaaucagaaacacuagcuaggguuuugcuuuugagauggucaagguagaagucagcugcaucaccaguucucaaauuggccugcauauuggaauuaucuagaaacuaaaaaacaaacaaaacacaaaaacuaauuccucgaagauucugauauaauuggucuggauguagccugagcaucaggauuugugaaaucuccugggugauucuaauguguagccaggauugagaagcacugagaugauuuccaaacaggugguagagcccugcaccgugcaggacauugcuaaccauguugugucaaagcagguccugggaagagaggucuacacauccaacaaccagcuggguggcguucagaucaugcauuacaauggugucucccacaucaccgugccagaugacuuugaggggguuuauaccauccuggaguggcuguccuauaugccaaaggugcaguacucccccugcagcuuagaaccuggaagacucuuauuaagcucauuggcuaauucugucccugucaccuccuggguggugugggaggcugaggagcaggaagcacugcacauguggcugggguugauuuuucuuacuccuucuuccuucucugaugcccagcccuguacuagguguccuuugcucuuuugguggcacuaaugccauuguaaggaugcuaucuguuaauccuuuagaaagagguaguauugccucuugacaagaggcagcauuggacaauacugagucuuuaagcuuuacagucaggcuggauuugauuccugccuuccuccucgguagcuguaagacacugggagagucccuaaguuuuucugagccuguuuccucaucugugaaaugagaauaauaauagcaccuaacucaugguguuaucaugaugauuaagugaagugauauuuaaagcacaacguuugguagguccucaccaaaguaagaaggggacaaucgugggcacaguucuugguuaacuguaacauuccuuacaaaugagugagguugucauucuucauuauaaccauuucugagagguuggguuuacagaguucaggucauuccagaucuucugccaagaaccccaagucacaaaugucaguuuguauucccaagugccccuuuuccccaucugcaugccaucuguuaccauucucugcaaccaaucucuuuuucuuucuuuuaagauguuuuuccuccuaucugaccauauauagcaguagcaacccuuuccugcguuucuguaacuucccagcaucagugacaccaucugaaccgggaagcacacucaggaguucauaaacuagauuucagaagaauccaugggauggccaguccuuaucuggcauuuuccaaucagagcaguggcuucaggagcccuagggaggggauauugcugcauaaccaggcauaaucauagucagaggagcaaagugcugaucagagguauuauugacaagcaccacagacuaagucagagacuuggcuuucuuuuuuaggauaaucacagcccugucccuaucaucacacccacugaccccauugacagagaaauugaauuccucccauccagagcucccuacgacccccgguggaugcuugcaggaaggccucacccaaguaaguucuaaaguauuuugccuaggaccuggucucggguuucuuucuagggcuugagacaaaggagcacuuugucucaagcgcuugagacaaaggcuugauauucguucucauaucccagagagguauaccugaaaucaaaugcagggaaaguagagaaauggagauuuuacucuaggcuuuuccugagccauugaccaagaagggguggaaacagccuccaguuucuggagcuaauagauggagguggggugcaauggugguccuggucucccuccccugaugcuccaugcuccguggucucuaacugccccacugucucaucaguagaaaauucagugcugaaacaucagaguuucaaagagaagacugcaucuuucucuuucuuucucucuuacaaaggaacucugugaguuuacacaggauaggcaaucuggucuccucuucuuuuuuuuuuuuugagacaguguugcucugucgcccaggcuggagugcaguggcgcgaucuuggcuuacugcaaucucuaccuccuggguucaagugauucuccugacucagucuaccgaguagcugggauuacaggugccugccaccacacccagcuaauuuuuguauuuuuaguagaggcggaguuucaccauguuggccaggcuggucuugaacacaugaccucaagugaucugccugccucagccucccaaagugcuggaauuacagacaugagccaccaugccuggccaauuuuaccucuucuauaccuacacacacacacacacacacacgcacguggacacgugaacacacaugcacaugcacacacauuuuugcacacacacauucucucucugaaagggaugaguuucucucuuggagguauauuauuucagucugagcaaccagaacacaacaggaaaguugagcugcucccgucacuauaucccaaaucuagaauuucacaugcugcuaccuuuagacuuggcugcuccuuggcugugcaaugcaggagaggugacccucgggagugugcuagacuccagccagugcaaggaguccuguggcuuccuucucuugcuuuucauuucucuugggcuuucuggccuguaaacacugagggggcugcuuaucucaauuaaaaaauguucggcuucucacugucaggccaguccucggcagaugcugaagcugugcuguugcaugccugggugccgggccucccaugccugagaugccucuuacucuggcugcccccuccuggucagagccacagccauuuacgcuguugcauggauuuaagucaucauuucuuccccaccaauggcugucauugacaucaucauauucucucucugucucucugggaaauugaaacuuuuuucccaauuaagugguuaugaagcugcagccagcagcuagcaggugagggaugaguuuuucgggaaagguggucccuuccuaaaaucccaccuucuggaggugucuguccacucucugcaucuuaggaagagaaggcagagaccaugauuagaaucuauguguuuggaguuggcuggcuguugaugguagucacauauuccauacagacugaauucuugacuugguauauuuauugcagcccuguuugucuuuugaggcauuuugggaaggagggaagggguugggcugugugguuuuagguagaaagggguaucugggcuaugagguuaaagccaggcuguccuuagggagcuuuugcacagccaggaguguccugggggcccccagccaccuggcccuccagccugggcuucugcccuucuguccacagcucugaagggaacguggcagagcggauucuuugaccacggcaguuucaaggaaaucauggcacccugggcgcagaccguggugacaggacgagcaagguaaucaugaagacgggagcaggcugcccaugucugacucaccaggcauuggggccccgaggugugaggccagggaccuccaggggcaauuuucuucuuggccucaggauuuucuaaaagaaaaaaccaauuuggggaaugauuucugcagugucugugugugcccuuagaagguaucucagccagccuccuccugaggccugggacccuguagucaguccccaggccacaagggcuaacaaccccuuugggcaucagaagguggccuugggugcucuccccagaaaacuucacagacacuggcacucugaauuccaucuuaggagagccauggacaggagcccuguuguaugccacuguuggugggaggcugcaaugcuugcaugcuuuccaagcugggcagcucacccuucagccuuguagcuuucaucucuuuggacagcuccaccugccugaaaguuccuccuuauaaugagccccgagcucccuccucaucauuuaccacucauuccugguacgaugucgcagcuauaaguccaggcucugcauuagaccugaggccaagccccaucuccaucacucacccucucugguccuucacaucuguaaaauagggauaauaauucuaccccaaaggauuauugugaugauuagaugcaauaacaugugugaaauauuuaaaaucgacauacuccauaagugggaauggcugcuaucauuuacaucuucggcaauaaauacuaaagugcagccagggccgggcguggcagcucacaccuguaaucccagcacguugggaggccaaggcggguggaucaccugcagucaggaguucgagaccagccuggccaacauggcgaaaccccgucucuacugaaaauacaaaaauuagcugggcgugguggcaggcaccuguaaucccagcuacucggggggcugaagcagcagaauugcuugaacccagaagguggauguugcagugagccgagauugcgccauugcacuccagccugggugacagagcgagacuccaucuucaaaauaaauaaaauaaaauaaauuauauuuuuaaaagcaaaaaauaaaaaaaaaaaaauccacuccuucuuccaugugaaaacacuuugauuugaagacugcucucccccaccccugcaucauaggguaaacgagaaccauguagugaugcacaguucaguagcaaguaacugaugucauggcauccccugagcugagucucuguccaguucaauaucccucagcccuuuccaagugcaacuugaugucuagaccaguguaguagcugcuggcuacaugugaugcuuuaguuucauuauuauuauuauuauuuugagacaaggucuugcucugucacccaggcuggagugcagaggcaugaucgcuguucacugcagccuugaccuccugggcucaagcaauccucccaccucagccucccaaguagcugggacuagaggugugcgccaccacaccuagccaguuuuuuuauuuuuugcagauacagggucucacuaugcuguccaggcuggucucaaacuccuggacucaagcaauccuccugcuucagacucucaaagugcugggauuacaggcauaagccaccaugcccggcuccuucaguuuaaauugaacuaagucaaagugacagaggaugaccuguuccauuccucacacuugccacguuccacgugcagcccacagcuccuguauuggacagugcagauggagaacguggcccucgucacagaaaguucuagugguucaugcugcuccaggcccuauaccaucccagcccuccucugaugguucuugccucaaaaagggcaccaauaggucugcuaccuuucgaggcucuuaccauuugggggcuuuuucuuugccuuccaauaaaauaauccgccagauuaaaaagagcauucuccuccacgugcccucacccccacacccagagguccccaaaugcaccuggggugcugcccagggccuggcucacuggugcucauuuuccaggcuuggggggauucccgugggagugauugcuguggagacacggacuguggagguggcagucccugcagacccugccaaccuggauucugaggccaaggugagggggccgggagcuguggcugcugguuuagccagcgguacugucgagaguggguccugggcgugggggucccaucccugcccugccaacuuagguggagaagcaggggacccagugcagucccuggcccuggggggcucagugccuguuucucugacacuuucucuauggguugcauaaauggcugcaccaucuugcuucuuccucagcagaugauaaaggucccuagaaaccccucccaccuccugcccugccucuguugcuguuucugcgcuaggccagggcacagacugagaagagcucaggagucaagagggcuggguuccagggccggcuuuaccccaacucagugugaccuugacgagcuuggcaccccucggagccuguaaaggagggcaacgggaaccuugcugggcugcaaugggagggucagccugguccugagcggaggagauggggcuuccauccuucugagcccuggcucuggugcuggggccagcacagaucagaucgccugccauccagagcgagguucuggcagccgucccucuguccuggguugugguugugcagagacaucugauccccgcagcucuguguuccagauaauucagcaggcaggacaggugugguucccagacucagccuacaaaaccgcccaggccgucaaggacuucaaccgggagaaguugccccugaugaucuuugccaacuggaggggguucuccgguggcaugaaagguaagccccucccugccuauguuaccccaaagccuuggggucagcacccaggacagcacccucuggguggugaugcuaauguccuagucugugcccaucaucaucuuagcugugucucccaacaacccugaggagaaaauauuguucaggugccccacuaccccguuuuaaagaugaggaacugcugggcacaguggcagacaccuguaaucccggugcuuugggaggccaaggcagaaagaucauuugaggccaggaguuugagaccagccuggggcaguauagcaagacccugucucuacaaaaaaacaaaauaaauguuuaaaaaauuagcugggcaugguggcacaugccuauugucccagcuauuugggaggcugaggugggaggauugcuugagcccaggagguugaggcuguacuccagccugggcaacggagugagacccccaucucaaaaaaaaaaacaaaaaaacaaaaaaaaaacaaugaggaacugaggguuggaggcaaagugucacuuucuagaggucacaccaugaggugcaggucagggaggggcagccccaggagcugccgggugaccugggcaggcaccuccccauuuggcaaggugaggaggauguuuguccacccuucccucugcagaaagcugcucugagccucaugugaccuuacaauugugugagggcuuuuuaagccaccaagcauguuuugggagagaguggcuguuggaucacugggguguugaggacagagcuggaugggaggcagacagaccugcugugaguccuuguuaacugggugacaucacugagccucaguuucccuccuuuguaaaaggggguuaagaacaggaccaaccucagagggccgagguaagagucugaugagcuaauugcugacaugcagugugauugucagugcuguuauuauugcauucuuguuuucauguagggugccuggggaccuggagagaugugucuugguggaagauaagggccauguugcccaugcacauuggggaaggaucagugugacuguuagugaggguuuucuuugcuggaaaugguggggcagggcagggacagucaugggugagggcauuucaauuccaguuggaaagaauccuagagauugguuuuucccugugccuucacagaugaggccacugaggcccacacugggugaaugaccuguucgaggucacacagccacuuagagagugaucaguacucucaaaucccagcccagugcucuccaagccucucagcugggcucacucucccaggacccccaggacaacuagggcaguggguuucauguguggaugagugagggcccugaacugggaggcugcuuugcuuuucagacauguaugaccaggugcugaaguuuggagccuacaucguggacggccuuagacaauacaaacagcccauccugaucuauaucccgcccuaugcggagcuccggggaggcuccuggguggucauagaugccaccaucaacccgcugugcauagaaauguaugcagacaaagagagcagguggguguguugcccuuagccuggcuuagccuuuucuuguucucccagccuugagagcccaugaccuugggagaucauggagggaugcaguggcuggaaccuguaagugguggagaaauguugucucuucuuucaugguuuccacuuccccuucccaaggaaguuugcaaucaaaaaauaaaaaggaaagaccaaaagcacuugaacuuccuggcagccaggaugaaaagggaaauaugaugagccauuuaucucucauuagacucugagcuaugaguuccuauaggaaauguuuuauucaguuuuauaucccagggucuagcacagugccuuacucuccugguagguggucagaaaauacuggcuaaacaaaugacugaaugaauacuugcaugagaggauaccgguucuucgcgggagagguaaccuccuuggcacuuuccuuaggaggaauuuauuccagagauucuuacagaaaggaugaugacaauaauguucacagcacagugacugaugacuuugaagugaaaacuacaugcuacacaggaugucaaggccucaagagucauucuacuccaaauauaggcacggcauuccuguguucacucccucauucauuugcuaauucaaugaauauccauugauuaccucacuguaugccagccauucugguagacauuaugauaugguggcaaaugggccaagcuuguccugcauucagggcacuuagacccuuguuagggacugcugaggucaguccuccaggaagacucaggauacugagcagcacuugaauggagucauugcuaacuuuucaugcuggccaccaggaagcucagagcuacugauagcauucuucagggcuucuaagcugucaaaagcaaaagggggcagggggagaauaagggguaaauaaaaauguuggaaaugaggccaggcgugguggcucacgccuguaaucccagcauuuugggaggcuaaggggggcagaucacuugaggccaggaguucaagaccagccuggccaacacagugaaaccccgucucuacuaaaaauacaaaaauuagcugggcauggugguacacgccuguaauccaagcugcucggggggcugaggcaggagaaucacuugaacccgggaggcagagauuguagugaaccgagauagugccacugcacuccagccugggugacagagugagacccugucuaaaaaaaaaacaaaaaaaaaaaaaaagaaagaaaagaaaauguauguuggaaaugggaggacagcucacacaagacuacacugggcucucaaggugcuuuugugagauuuaaagcgaucagaaacagugccccuccucuaggagggcagaaauuagcaaaguuagagaggacuguggcuggagagcaggaggguuaugcugccauggaaaaagucguacacucuuagaccugaaaggggcccuccagaguucagaaagcauuauuuuaaacaguuggcucagucuuuccaucuguggguaaagauacagaggcccagagagggaaagugacuugucuaagggcacacagcauguguggggguaaaagagcugaggacugacacccagaucuucuggcucucuucccuccagcuccccccacauccauuagcccuugcuugcugggcaaugccucauauacccccaucccugccucuucucuuuuaaggggugguguucuggaaccagaggggacaguggagauuaaguuccgaaagaaagaucugauaaaguccaugagaaggaucgauccagcuuacaagaagcucauggaacagcuagguaagggggucccaaaggcuucaccucucagaggucaagagaggcccagcuggcccacugcuggggguuucuaggauguuaaaaauaaaaugaaaaaauaccaaaauacagcuauaauaacugugagauuuuuaaagauauucacauuugucuguuuguuuuguuuuguuuuuuugaggucuggcucuauugccuaggcuggagugcagggugcaaucucagcucacugcaaccucugccucccaggcauaagccauccucccaucucagccugaguagcugggacuacaaguacgcaacaccaugccuagcuaauuuuuguauuuuuguagaugugggguuucgccauguugcccaggcuguucucaaacuccugggcucaagcaauccaccuaccucagccucccaaaaugcugggguuacaggcaugagcuaccaugauuggaggacauucacauuucuaaaucaaccuuuuuaacauuauauauauauauauauauauauauauauauauugccaucgugaauuuauuucucagcauacacaaaagauagcaauugaaguauuuggggcugauggggauuaucagaauuuugguggcaaaauguuccuuuagaauucccaaucagagauaagauauuuuacuaauuuuguuugaaugacagcuuuguuuuacuugucaucuuuagauguaauuaucuuuauuuauuuauuuguuuauuuuugagacagagucuugcucuguugcccaggcuggggugcaguggcgcaaucucagcucacugcaaccucugccucccagguucaagcgauucucaugccucagccucucaaguagcaggaauuacaggugugugccaccacaccuggcuaauuuuuguguuuuuaguagagacaggguuucaccauguuggccaggcuggucuugaacuccuggccucaagugauuugccugcgucagccucccaaagugcugggauuacaggcgugagccacuaagucuggccacaagaugauauuuaaauauccauuuuaagugucagugucuuuauaacugugcuauucacaagauuuuuuacagugugugcguguaauuucuuuggcugguaucaggguaaugcugaucucauagaaugaguugaaguguucgcuccuauuuucugaguuuuugcagaauuggcauuauuucuuuauguuuuugauagagguuuuuaccuauaaauucaacuucuuuguuauauauaggacuauuuguguuaucuguuuccuccuaggugagcuuuggugguuuguguguuucaaggaauuugucuauuucaucuuaaguugucaauuuggcauagaguugcuuauaauauucccuuaucauauuuuacaauguguacuaaaaaucauugauauaguauccuacaagcacgaugggucugauggaaggggaaaauguagaguugcauguugaaugcugucuugcaauugugagugcauuucugagacuguacuagcuauuugaucugagacaaagggggccaucaagaugggccuggggugggggccaggccaguggacucugggggaccuagggggcugagggcagccuguguagcagcagggguaauaucagaguuaaagcucagaccucucacaaggcaaggccuguccugcaaauccugauuugugccuucuucaaaaaaaaaaaaaaaucuccaccccaucacauaugaccagcuuccauggcuugacuggccuuucugcucaccugcaggggaaccugaucucuccgacaaggaccgaaaggaccuggagggccggcuaaaggcucgcgaggaccugcugcuccccaucuaccaccagguggcggugcaguucgccgacuuccaugacacacccggccggaugcuggagaagggcgucauaucugugagagccacagcugccguguagggugcaaagagcccacccuguuuuccaaaacauggaggacauuugggcucgggggcggggagggcgguggugguugggaugggucaaaugcugcaggaggugggagucaccugggaacuuuaaaauaaucccgauccccagguggcacugcagaccagugaaauccaaacaccuggauggaagccaggcggucguauuuuuuaaagauccccaagagauucuaauaagcagcaaaguucagggaccacuagucugauggcucggucaguuuggaccuggaccagggguagaaaccguuguuccuguccagcauucacccaccccucaccauugcaaggacucccacagucaccuccuacccauguccagugcucauugguucucuugcugcauuguucucccucccagcugacucaugccucacacgagccuguguuugugucgguugagguagaagugggugccagguuuuuaugggggacauuuuuucaacuauggccagucuggaguccuggugacguccugccucugagcaggugccuucuccucccugagccucagcuuacuugccugggaugaucugggaaugaucucagagccugggcccagccccgggcagccacugucauggguguggucagagccagugucccgucuccuccuucccuuuccggggauucaagccuggcucguccacaggacauccuggaguggaagaccgcacgcaccuuccuguauuggcgucugcgccgccuccuccuggaggaccaggucaagcaggagauccugcaggccagcggggagcugagucacgugcauauccaguccaugcugcgucgcugguucguggagacggagggggcugucaaggugggccuggggugagaacgaggccggugagcacagggggugcugggggcugagacagcuggcccacagcugggucccucucugaggcauccucugcccccuccccaggccuacuugugggacaacaaccaggugguugugcaguggcuggaacagcacuggcaggcaggggauggcccgcgcuccaccauccgugagaacaucacguaccugaagcacgacucuguccucaagaccauccgagggugaguggccaccgcaccugcuucccagccuccuggcaaggacccgagccuggauugaccccuagcuacccgacuccuaugcagccacuugaacccgccacccugugcagucugggguuguccccgcccccuccccgcuccccagcaaagagaccacacucccuaaugucgggucucccagcacaguggcuggggugggacagagagccuagagguacucugaaggccgugugagaugcuuccaacucaugaaccuugcuggaauauggacuuguccaaagucacagcuggagcaggguuggucacagaacccacauuuggaaccgcuagccuucaggcugcugucuuccacgccaguguugaccuuuccagaggguccccucccccaauugccauggggucaccccgugaaggagggagucgagcacaggggaccccauuuuggggaugaagcugagacucaaggcagugucuugucucaggucaugucacaaagcagugaccaguagggacgguggugccucaaggcauucugaacuucaggucacagccccuccugcugcacaggaccaucacccccauggggaccacagcagggacucgggagcucuggguucugggguguggccccacacaaggacucugccacccuuggggccacugaaaaaguggcuggagugaucccagcccuccucucaccucccccacagccugguugaagaaaaccccgagguggccguggacugugugauauaccugagccagcacaucagcccagcugagcgggcgcaggucguucaccugcugucuaccauggacagcccggccuccaccugaccguggcccgcccagccacucccgggaccacggcaaaaggaaccacccagacccaccacccguacacccucagcagacccugaagacuugcuuuuaaacaaagaaaauccugggcacuucugcagggcugcugguuccgagcugacacccgucuuaacaaaaggcccaggagugccucuuccaaacaaaaacagccuccucuccauagcugggaaguuuauuuuguuuugucucugaagacagcaguuuuauugcaucacuaaaucuaaucaagcuaaaacaucccuguuuccuuuugcaaaacagugccuggcaugugggauccaggcguucuuuaggauccuuggauaccacaucgugaaaucuuuuauuuuuuuacucugagaccagcaccagauguaaguaagcaucucauauauuucagccaaauaaaugggccaagggaaaaaaauauauauauauagacaggacuagagaaaaccuauuuuuguaaugauguuucuuuggauacugucuagucacccagaaaaauguauggaugaauuuuuuuuuuuuuuuuugagacaaagucucacugugucaugcaggcuggagugcaguggcaugaucucacugcaaccuccaucuccugucucagccuccuagauaacugggauuacaggugcccaccaccaugcccggcuaauuuuuguauuuuugguagagacagaguuucaccagguuggucaggcuggucucaaacucuugacuucagguaauccacccaccuuggccucccaaagugcugggauuacaggcaugagccaccaucuucagccagaugauuuuuuuauugagagagugaaaugcuauuuuguuccccaaauggcgcuagugaaucacuaggagggucccacugauaggccauguuuagcacugguugccagggauucucuuuuugagagagggaaagcaaaaugaauggaaguacccagcuggagguuucagggcuucuggaggaugcucucgcauagcucgagguccucugcccaccucuucucuccaaggaaaaugaggacugccccuucccccugcaggauuggcccccagccugcgcaugcacccuccucuugcccaaguggggagcacagaggcggagaggaaucccuuaccacacccacggcccagcuugcucacgagugucaccucugugacggucaccacugcucccuuggagggccacuugaguuacuguugcuuccucgccugcuggcuugaugagcaccgauggugggaucugaccccgaggggcagagcugucggugacugaggacuggacuguggugaccaugccgauuugcucagggagaacguugcaaugcacccagcagcuccuggcucugcaggcggcacagccuggggcccugugauccucugguuucuuccauuggggcggagucggggauggagggagcuggccacaacccacugcucugaugggugguuuguccaaggaugcugaauguaaugccuggucaauguggaagcccaugagguugcccagggaagccuccaaaagcugggaugcuugaggguauccaaguugaaaaagacaaaaucugaccaucagccagugacaguccuggcaaaugaagguggggcggggcagugaggggugggagaaggugaaugauucauuauuccaccccgagguuugcuggggugaggggaagaaucgaugcugcuuugggaacugaagguuuuucuguugggaaggcccucuugguuuuggagagaaagacaaguuaugaguagcugcuacccuggaacggugggcagagagccuacuaggaaaugugcagaauaaacuauuuuuugaaggaa

SEQ ID NO: 191506 - RNA, 128829 nt, Homo sapiens
uuccuucaaaaaauaguuuauucugcacauuuccuaguaggcucucugcccaccguuccaggguagcagcuacucauaacuugucuuucucuccaaaaccaagagggccuucccaacagaaaaaccuucaguucccaaagcagcaucgauucuuccccucaccccagcaaaccucgggguggaauaaugaaucauucaccuucucccaccccucacugccccgccccaccuucauuugccaggacugucacuggcugauggucagauuuugucuuuuucaacuuggauacccucaagcaucccagcuuuuggaggcuucccugggcaaccucaugggcuuccacauugaccaggcauuacauucagcauccuuggacaaaccacccaucagagcaguggguuguggccagcucccuccauccccgacuccgccccaauggaagaaaccagaggaucacagggccccaggcugugccgccugcagagccaggagcugcugggugcauugcaacguucucccugagcaaaucggcauggucaccacaguccaguccucagucaccgacagcucugccccucggggucagaucccaccaucggugcucaucaagccagcaggcgaggaagcaacaguaacucaaguggcccuccaagggagcaguggugaccgucacagaggugacacucgugagcaagcugggccgugggugugguaagggauuccucuccgccucugugcuccccacuugggcaagaggagggugcaugcgcaggcugggggccaauccugcagggggaaggggcaguccucauuuuccuuggagagaagaggugggcagaggaccucgagcuaugcgagagcauccuccagaagcccugaaaccuccagcuggguacuuccauucauuuugcuuucccucucucaaaaagagaaucccuggcaaccagugcuaaacauggccuaucagugggacccuccuagugauucacuagcgccauuuggggaacaaaauagcauuucacucucucaauaaaaaaaucaucuggcugaagaugguggcucaugccuguaaucccagcacuuugggaggccaagguggguggauuaccugaagucaagaguuugagaccagccugaccaaccuggugaaacucugucucuaccaaaaauacaaaaauuagccgggcaugguggugggcaccuguaaucccaguuaucuaggaggcugagacaggagauggagguugcagugagaucaugccacugcacuccagccugcaugacacagugagacuuugucucaaaaaaaaaaaaaaaaauucauccauacauuuuucugggugacuagacaguauccaaagaaacaucauuacaaaaauagguuuucucuaguccugucuauauauauauauuuuuuucccuuggcccauuuauuuggcugaaauauaugagaugcuuacuuacaucuggugcuggucucagaguaaaaaaauaaaagauuucacgaugugguauccaaggauccuaaagaacgccuggaucccacaugccaggcacuguuuugcaaaaggaaacagggauguuuuagcuugauuagauuuagugaugcaauaaaacugcugucuucagagacaaaacaaaauaaacuucccagcuauggagaggaggcuguuuuuguuuggaagaggcacuccugggccuuuuguuaagacgggugucagcucggaaccagcagcccugcagaagugcccaggauuuucuuuguuuaaaagcaagucuucagggucugcugaggguguacggguggugggucugggugguuccuuuugccguggucccgggaguggcugggcgggccacggucagguggaggccgggcuguccaugguagacagcaggugaacgaccugcgcccgcucagcugggcugaugugcuggcucagguauaucacacaguccacggccaccucgggguuuucuucaaccaggcugugggggaggugagaggagggcugggaucacuccagccacuuuuucaguggccccaaggguggcagaguccuuguguggggccacaccccagaacccagagcucccgagucccugcugugguccccaugggggugaugguccugugcagcaggaggggcugugaccugaaguucagaaugccuugaggcaccaccgucccuacuggucacugcuuugugacaugaccugagacaagacacugccuugagucucagcuucauccccaaaaugggguccccugugcucgacucccuccuucacggggugaccccauggcaauugggggaggggacccucuggaaaggucaacacuggcguggaagacagcagccugaaggcuagcgguuccaaauguggguucugugaccaacccugcuccagcugugacuuuggacaaguccauauuccagcaagguucaugaguuggaagcaucucacacggccuucagaguaccucuaggcucucugucccaccccagccacugugcugggagacccgacauuagggaguguggucucuuugcuggggagcggggagggggcggggacaaccccagacugcacaggguggcggguucaaguggcugcauaggagucggguagcuaggggucaauccaggcucggguccuugccaggaggcugggaagcaggugcgguggccacucacccucggauggucuugaggacagagucgugcuucagguacgugauguucucacggaugguggagcgcgggccauccccugccugccagugcuguuccagccacugcacaaccaccugguuguugucccacaaguaggccuggggagggggcagaggaugccucagagagggacccagcugugggccagcugucucagcccccagcacccccugugcucaccggccucguucucaccccaggcccaccuugacagcccccuccgucuccacgaaccagcgacgcagcauggacuggauaugcacgugacucagcuccccgcuggccugcaggaucuccugcuugaccugguccuccaggaggaggcggcgcagacgccaauacaggaaggugcgugcggucuuccacuccaggauguccuguggacgagccaggcuugaauccccggaaagggaaggaggagacgggacacuggcucugaccacacccaugacaguggcugcccggggcugggcccaggcucugagaucauucccagaucaucccaggcaaguaagcugaggcucagggaggagaaggcaccugcucagaggcaggacgucaccaggacuccagacuggccauaguugaaaaaaugucccccauaaaaaccuggcacccacuucuaccucaaccgacacaaacacaggcucgugugaggcaugagucagcugggagggagaacaaugcagcaagagaaccaaugagcacuggacauggguaggaggugacugugggaguccuugcaauggugaggggugggugaaugcuggacaggaacaacgguuucuaccccugguccagguccaaacugaccgagccaucagacuaguggucccugaacuuugcugcuuauuagaaucucuuggggaucuuuaaaaaauacgaccgccuggcuuccauccagguguuuggauuucacuggucugcagugccaccuggggaucgggauuauuuuaaaguucccaggugacucccaccuccugcagcauuugacccaucccaaccaccaccgcccuccccgcccccgagcccaaauguccuccauguuuuggaaaacagggugggcucuuugcacccuacacggcagcuguggcucucacagauaugacgcccuucuccagcauccggccgggugugucauggaagucggcgaacugcaccgccaccuggugguagauggggagcagcagguccucgcgagccuuuagccggcccuccagguccuuucgguccuugucggagagaucagguuccccugcaggugagcagaaaggccagucaagccauggaagcuggucauaugugaugggguggagauuuuuuuuuuuuuuugaagaaggcacaaaucaggauuugcaggacaggccuugccuugugagaggucugagcuuuaacucugauauuaccccugcugcuacacaggcugcccucagcccccuaggucccccagaguccacuggccuggcccccaccccaggcccaucuugauggcccccuuugucucagaucaaauagcuaguacagucucagaaaugcacucacaauugcaagacagcauucaacaugcaacucuacauuuuccccuuccaucagacccaucgugcuuguaggauacuauaucaaugauuuuuaguacacauuguaaaauaugauaagggaauauuauaagcaacucuaugccaaauugacaacuuaagaugaaauagacaaauuccuugaaacacacaaaccaccaaagcucaccuaggaggaaacagauaacacaaauaguccuauauauaacaaagaaguugaauuuauagguaaaaaccucuaucaaaaacauaaagaaauaaugccaauucugcaaaaacucagaaaauaggagcgaacacuucaacucauucuaugagaucagcauuacccugauaccagccaaagaaauuacacgcacacacuguaaaaaaucuugugaauagcacaguuauaaagacacugacacuuaaaauggauauuuaaauaucaucuuguggccagacuuaguggcucacgccuguaaucccagcacuuugggaggcugacgcaggcaaaucacuugaggccaggaguucaagaccagccuggccaacauggugaaacccugucucuacuaaaaacacaaaaauuagccaggugugguggcacacaccuguaauuccugcuacuugagaggcugaggcaugagaaucgcuugaaccugggaggcagagguugcagugagcugagauugcgccacugcaccccagccugggcaacagagcaagacucugucucaaaaauaaacaaauaaauaaauaaagauaauuacaucuaaagaugacaaguaaaacaaagcugucauucaaacaaaauuaguaaaauaucuuaucucugauugggaauucuaaaggaacauuuugccaccaaaauucugauaauccccaucagccccaaauacuucaauugcuaucuuuuguguaugcugagaaauaaauucacgauggcaauauauauauauauauauauauauauauauauaauguuaaaaagguugauuuagaaaugugaauguccuccaaucaugguagcucaugccuguaaccccagcauuuugggaggcugagguagguggauugcuugagcccaggaguuugagaacagccugggcaacauggcgaaaccccacaucuacaaaaauacaaaaauuagcuaggcaugguguugcguacuuguagucccagcuacucaggcugagaugggaggauggcuuaugccugggaggcagagguugcagugagcugagauugcacccugcacuccagccuaggcaauagagccagaccucaaaaaaacaaaacaaaacaaacagacaaaugugaauaucuuuaaaaaucucacaguuauuauagcuguauuuugguauuuuuucauuuuauuuuuaacauccuagaaacccccagcagugggccagcugggccucucuugaccucugagaggugaagccuuugggacccccuuaccuagcuguuccaugagcuucuuguaagcuggaucgauccuucucauggacuuuaucagaucuuucuuucggaacuuaaucuccacuguccccucugguuccagaacaccaccccuuaaaagagaagaggcagggauggggguauaugaggcauugcccagcaagcaagggcuaauggauguggggggagcuggagggaagagagccagaagaucugggugucaguccucagcucuuuuacccccacacaugcugugugcccuuagacaagucacuuucccucucugggccucuguaucuuuacccacagauggaaagacugagccaacuguuuaaaauaaugcuuucugaacucuggagggccccuuucaggucuaagaguguacgacuuuuuccauggcagcauaacccuccugcucuccagccacaguccucucuaacuuugcuaauuucugcccuccuagaggaggggcacuguuucugaucgcuuuaaaucucacaaaagcaccuugagagcccaguguagucuugugugagcuguccucccauuuccaacauacauuuucuuuucuuucuuuuuuuuuuuuuuuguuuuuuuuuuagacagggucucacucugucacccaggcuggagugcaguggcacuaucucgguucacuacaaucucugccucccggguucaagugauucuccugccucagccccccgagcagcuuggauuacaggcguguaccaccaugcccagcuaauuuuuguauuuuuaguagagacgggguuucacuguguuggccaggcuggucuugaacuccuggccucaagugaucugccccccuuagccucccaaaaugcugggauuacaggcgugagccaccacgccuggccucauuuccaacauuuuuauuuaccccuuauucucccccugcccccuuuugcuuuugacagcuuagaagcccugaagaaugcuaucaguagcucugagcuuccugguggccagcaugaaaaguuagcaaugacuccauucaagugcugcucaguauccugagucuuccuggaggacugaccucagcagucccuaacaagggucuaagugcccugaaugcaggacaagcuuggcccauuugccaccauaucauaaugucuaccagaauggcuggcauacagugagguaaucaauggauauucauugaauuagcaaaugaaugagggagugaacacaggaaugccgugccuauauuuggaguagaaugacucuugaggccuugacauccuguguagcauguaguuuucacuucaaagucaucagucacugugcugugaacauuauugucaucauccuuucuguaagaaucucuggaauaaauuccuccuaaggaaagugccaaggagguuaccucucccgcgaagaaccgguauccucucaugcaaguauucauucagucauuuguuuagccaguauuuucugaccaccuaccaggagaguaaggcacugugcuagacccugggauauaaaacugaauaaaacauuuccuauaggaacucauagcucagagucuaaugagagauaaauggcucaucauauuucccuuuucauccuggcugccaggaaguucaagugcuuuuggucuuuccuuuuuauuuuuugauugcaaacuuccuugggaaggggaaguggaaaccaugaaagaagagacaacauuucuccaccacuuacagguuccagccacugcaucccuccaugaucucccaaggucaugggcucucaaggcugggagaacaagaaaaggcuaagccaggcuaagggcaacacacccaccugcucucuuugucugcauacauuucuaugcacagcggguugaugguggcaucuaugaccacccaggagccuccccggagcuccgcauagggcgggauauagaucaggaugggcuguuuguauugucuaaggccguccacgauguaggcuccaaacuucagcaccuggucauacaugucugaaaagcaaagcagccucccaguucagggcccucacucauccacacaugaaacccacugcccuaguuguccuggggguccugggagagugagcccagcugagaggcuuggagagcacugggcugggauuugagaguacugaucacucucuaaguggcugugugaccucgaacaggucauucacccagugugggccucaguggccucaucugugaaggcacagggaaaaaccaaucucuaggauucuuuccaacuggaauugaaaugcccucacccaugacugucccugcccugccccaccauuuccagcaaagaaaacccucacuaacagucacacugauccuuccccaaugugcaugggcaacauggcccuuaucuuccaccaagacacaucucuccagguccccaggcacccuacaugaaaacaagaaugcaauaauaacagcacugacaaucacacugcaugucagcaauuagcucaucagacucuuaccucggcccucugagguugguccuguucuuaacccccuuuuacaaaggagggaaacugaggcucagugaugucacccaguuaacaaggacucacagcaggucugucugccucccauccagcucuguccucaacaccccagugauccaacagccacucucucccaaaacaugcuugguggcuuaaaaagcccucacacaauuguaaggucacaugaggcucagagcagcuuucugcagagggaaggguggacaaacauccuccucaccuugccaaauggggaggugccugcccaggucacccggcagcuccuggggcugccccucccugaccugcaccucauggugugaccucuagaaagugacacuuugccuccaacccucaguuccucauuguuuuuuuuuuguuuuuuuguuuuuuuuuuugagaugggggucucacuccguugcccaggcuggaguacagccucaaccuccugggcucaagcaauccucccaccucagccucccaaauagcugggacaauaggcaugugccaccaugcccagcuaauuuuuuaaacauuuauuuuguuuuuuuguagagacagggucuugcuauacugccccaggcuggucucaaacuccuggccucaaaugaucuuucugccuuggccucccaaagcaccgggauuacaggugucugccacugugcccagcaguuccucaucuuuaaaacgggguaguggggcaccugaacaauauuuucuccucaggguuguugggagacacagcuaagaugaugaugggcacagacuaggacauuagcaucaccacccagagggugcuguccugggugcugaccccaaggcuuugggguaacauaggcagggaggggcuuaccuuucaugccaccggagaacccccuccaguuggcaaagaucaucaggggcaacuucucccgguugaaguccuugacggccugggcgguuuuguaggcugagucugggaaccacaccuguccugccugcugaauuaucuggaacacagagcugcggggaucagaugucucugcacaaccacaacccaggacagagggacggcugccagaaccucgcucuggauggcaggcgaucugaucugugcuggccccagcaccagagccagggcucagaaggauggaagccccaucuccuccgcucaggaccaggcugacccucccauugcagcccagcaagguucccguugcccuccuuuacaggcuccgaggggugccaagcucgucaaggucacacugaguugggguaaagccggcccuggaacccagcccucuugacuccugagcucuucucagucugugcccuggccuagcgcagaaacagcaacagaggcagggcaggaggugggagggguuucuagggaccuuuaucaucugcugaggaagaagcaagauggugcagccauuuaugcaacccauagagaaagugucagagaaacaggcacugagccccccagggccagggacugcacuggguccccugcuucuccaccuaaguuggcagggcagggaugggacccccacgcccaggacccacucucgacaguaccgcuggcuaaaccagcagccacagcucccggcccccucaccuuggccucagaauccagguuggcagggucugcagggacugccaccuccacaguccgugucuccacagcaaucacucccacgggaauccccccaagccuggaaaaugagcaccagugagccaggcccugggcagcaccccaggugcauuuggggaccucugggugugggggugagggcacguggaggagaaugcucuuuuuaaucuggcggauuauuuuauuggaaggcaaagaaaaagcccccaaaugguaagagccucgaaagguagcagaccuauuggugcccuuuuugaggcaagaaccaucagaggagggcugggaugguauagggccuggagcagcaugaaccacuagaacuuucugugacgagggccacguucuccaucugcacuguccaauacaggagcugugggcugcacguggaacguggcaagugugaggaauggaacaggucauccucugucacuuugacuuaguucaauuuaaacugaaggagccgggcaugguggcuuaugccuguaaucccagcacuuugagagucugaagcaggaggauugcuugaguccaggaguuugagaccagccuggacagcauagugagacccuguaucugcaaaaaauaaaaaaacuggcuaggugugguggcgcacaccucuagucccagcuacuugggaggcugaggugggaggauugcuugagcccaggaggucaaggcugcagugaacagcgaucaugccucugcacuccagccugggugacagagcaagaccuugucucaaaauaauaauaauaauaaugaaacuaaagcaucacauguagccagcagcuacuacacuggucuagacaucaaguugcacuuggaaagggcugagggauauugaacuggacagagacucagcucaggggaugccaugacaucaguuacuugcuacugaacugugcaucacuacaugguucucguuuacccuaugaugcaggggugggggagagcagucuucaaaucaaaguguuuucacauggaagaaggaguggauuuuuuuuuuuuuauuuuuugcuuuuaaaaauauaauuuauuuuauuuuauuuauuuugaagauggagucucgcucugucacccaggcuggagugcaauggcgcaaucucggcucacugcaacauccaccuucuggguucaagcaauucugcugcuucagccccccgaguagcugggauuacaggugccugccaccacgcccagcuaauuuuuguauuuucaguagagacgggguuucgccauguuggccaggcuggucucgaacuccugacugcaggugauccacccgccuuggccucccaacgugcugggauuacaggugugagcugccacgcccggcccuggcugcacuuuaguauuuauugccgaagauguaaaugauagcagccauucccacuuauggaguaugucgauuuuaaauauuucacacauguuauugcaucuaaucaucacaauaauccuuugggguagaauuauuaucccuauuuuacagaugugaaggaccagagagggugagugauggagauggggcuuggccucaggucuaaugcagagccuggacuuauagcugcgacaucguaccaggaaugagugguaaaugaugaggagggagcucggggcucauuauaaggaggaacuuucaggcagguggagcuguccaaagagaugaaagcuacaaggcugaagggugagcugcccagcuuggaaagcaugcaagcauugcagccucccaccaacaguggcauacaacagggcuccuguccauggcucuccuaagauggaauucagagugccagugucugugaaguuuucuggggagagcacccaaggccaccuucugaugcccaaagggguuguuagcccuuguggccuggggacugacuacagggucccaggccucaggaggaggcuggcugagauaccuucuaagggcacacacagacacugcagaaaucauuccccaaauugguuuuuucuuuuagaaaauccugaggccaagaagaaaauugccccuggaggucccuggccucacaccucggggccccaaugccuggugagucagacaugggcagccugcucccgucuucaugauuaccuugcucguccugucaccacggucugcgcccagggugccaugauuuccuugaaacugccguggucaaagaauccgcucugccacguucccuucagagcuguggacagaagggcagaagcccaggcuggagggccagguggcugggggcccccaggacacuccuggcugugcaaaagcucccuaaggacagccuggcuuuaaccucauagcccagauaccccuuucuaccuaaaaccacacagcccaaccccuucccuccuucccaaaaugccucaaaagacaaacagggcugcaauaaauauaccaagucaagaauucagucuguauggaauaugugacuaccaucaacagccagccaacuccaaacacauagauucuaaucauggucucugccuucucuuccuaagaugcagagaguggacagacaccuccagaaggugggauuuuaggaagggaccaccuuucccgaaaaacucaucccucaccugcuagcugcuggcugcagcuucauaaccacuuaauugggaaaaaaguuucaauuucccagagagacagagagagaauaugaugaugucaaugacagccauugguggggaagaaaugaugacuuaaauccaugcaacagcguaaauggcuguggcucugaccaggagggggcagccagaguaagaggcaucucaggcaugggaggcccggcacccaggcaugcaacagcacagcuucagcaucugccgaggacuggccugacagugagaagccgaacauuuuuuaauugagauaagcagcccccucaguguuuacaggccagaaagcccaagagaaaugaaaagcaagagaaggaagccacaggacuccuugcacuggcuggagucuagcacacucccgagggucaccucuccugcauugcacagccaaggagcagccaagucuaaagguagcagcaugugaaauucuagauuugggauauagugacgggagcagcucaacuuuccuguuguguucugguugcucagacugaaauaauauaccuccaagagagaaacucaucccuuucagagagagaaugugugugugcaaaaaugugugugcaugugcauguguguucacguguccacgugcguguguguguguguguguguguagguauagaagagguaaaauuggccaggcaugguggcucaugucuguaauuccagcacuuugggaggcugaggcaggcagaucacuugaggucauguguucaagaccagccuggccaacauggugaaacuccgccucuacuaaaaauacaaaaauuagcugggugugguggcaggcaccuguaaucccagcuacucgguagacugagucaggagaaucacuugaacccaggagguagagauugcaguaagccaagaucgcgccacugcacuccagccugggcgacagagcaacacugucucaaaaaaaaaaaaagaagaggagaccagauugccuauccuguguaaacucacagaguuccuuuguaagagagaaagaaagagaaagaugcagucuucucuuugaaacucugauguuucagcacugaauuuucuacugaugagacaguggggcaguuagagaccacggagcauggagcaucaggggagggagaccaggaccaccauugcaccccaccuccaucuauuagcuccagaaacuggaggcuguuuccaccccuucuuggucaauggcucaggaaaagccuagaguaaaaucuccauuucucuacuuucccugcauuugauuucagguauaccucucugggauaugagaacgaauaucaagccuuugucucaagcgcuugagacaaagugcuccuuugucucaagcccuagaaagaaacccgagaccagguccuaggcaaaauacuuuagaacuuacuugggugaggccuuccugcaagcauccaccgggggucguagggagcucuggaugggaggaauucaauuucucugucaauggggucagugggugugaugauagggacagggcugugauuauccuaaaaaagaaagccaagucucugacuuagucuguggugcuugucaauaauaccucugaucagcacuuugcuccucugacuaugauuaugccugguuaugcagcaauauccccucccuagggcuccugaagccacugcucugauuggaaaaugccagauaaggacuggccaucccauggauucuucugaaaucuaguuuaugaacuccugagugugcuucccgguucagauggugucacugaugcugggaaguuacagaaacgcaggaaaggguugcuacugcuauauauggucagauaggaggaaaaacaucuuaaaagaaagaaaaagagauugguugcagagaaugguaacagauggcaugcagauggggaaaaggggcacuugggaauacaaacugacauuugugacuugggguucuuggcagaagaucuggaaugaccugaacucuguaaacccaaccucucagaaaugguuauaaugaagaaugacaaccucacucauuuguaaggaauguuacaguuaaccaagaacugugcccacgauuguccccuucuuacuuuggugaggaccuaccaaacguugugcuuuaaauaucacuucacuuaaucaucaugauaacaccaugaguuaggugcuauuauuauucucauuucacagaugaggaaacaggcucagaaaaacuuagggacucucccagugucuuacagcuaccgaggaggaaggcaggaaucaaauccagccugacuguaaagcuuaaagacucaguauuguccaaugcugccucuugucaagaggcaauacuaccucuuucuaaaggauuaacagauagcauccuuacaauggcauuagugccaccaaaagagcaaaggacaccuaguacagggcugggcaucagagaaggaagaaggaguaagaaaaaucaaccccagccacaugugcagugcuuccugcuccucagccucccacaccacccaggaggugacagggacagaauuagccaaugagcuuaauaagagucuuccagguucuaagcugcagggggaguacugcaccuuuggcauauaggacagccacuccaggaugguauaaacccccucaaagucaucuggcacggugaugugggagacaccauuguaaugcaugaucugaacgccacccagcugguuguuggauguguagaccucucuucccaggaccugcuuugacacaacaugguuagcaauguccugcacggugcagggcucuaccaccuguuuggaaaucaucucagugcuucucaauccuggcuacacauuagaaucacccaggagauuucacaaauccugaugcucaggcuacauccagaccaauuauaucagaaucuucgaggaauuaguuuuuguguuuuguuuguuuuuuaguuucuagauaauuccaauaugcaggccaauuugagaacuggugaugcagcugacuucuaccuugaccaucucaaaagcaaaacccuagcuaguguuucugauucagcaggucugcagcagggcuugaggaugugcauuucugacaaguucccaucugaugcugaugcuguugguucaagaaccaggcuuugagacuuuggcugagauuugagcagacauuaaguauagagacuuuucaacaaggaaaauguuuuaauacagugaaaaaaguagaauacaaaacugcauauucacuauaaauuaaccacauaaagacagaagaugagagggaacuauaccagaaugauagaagcugcaaaauuacuuuuuugggggguuccuuuucuaauuuucugcaauguguaauggcacuucaauaauuuguuuuaaaaugucaguaauacagggaguuagaucgaccagaauugccuaaaacuaauuuuuuuuuucucauaaggacccagauagcugcaaauuggaaaaaaagagcucuuguaucaguaggaaugaaacuggcuucauauugagaaaaaucccccaccagagaccaaugggaauguuaaaaugacuccuggcccccaaggauccacucugcacaggccccuuuuuggucaccuuguugagagcacuugcuccugugaggaugaugugggaauucuccaccuggaucacucgcuggcccagccucaccaaguaggccccaaucccaauggcucggcaggucaccuguggagagaggacccccucugaauucuggagaguggcgagggacccaccccccacagcagggaagaguccaggaaccugcugggaccaaauggaaguuauguuuugaccaauggcaacccgauuuggagccaaaccacaguagaggcaaaagccuauucuucaggccacuuuauugagcuuggauuccuaucuggaaauaacaugguuaacaaagauugcuguaaagacaagcagcagacagugaauguuucagauuuuaagaggcuugugugcagcucuucugagccugggcauucaugggccauugcagccucuuaacaaccaaaaggacaccuaggagugcauguaaaaacuggugaaauucaaaauaaggucuguacugaguuaacaauauugugccaaugucaguuuccugguuucgauaauguacuacgguuauguaaguaccauaggggaagcugggugaaggguacuuggaaauucucuguaguaucuuauaacuuacgguggguccuagaugacuucaaaauaaaaagacuauacauauaaucuagaaaacaagcccaaggaagaugcuuaugaccaacauuuuccacuuggaaacugaagauucaacauugcauguacaaauaaggccuuccaaggcaguuuaucauuaaagaguacuauuauuccugcugcugcugcuguuagaguagguaguuaagcagacaugagcagggcaggagaggaaggcaaccaucaggugauaguuaggcaguugcuaaagugucucucuaaaauuaauauuggucacagcuggcuccagggaaaggcaaucuccugauagauagaaaacaccugaagcuagugauaagcagcuuccccauaagaucucaggagcugggugggugggcucaagcaugcaugcuaagagguaagauggcagaguuuaucugguaccgugcccuucuucuaggaacacucgacugguaaaggaggaaagccucaagugagcaugcacacaacuucaguaaacacacuguucaugcggccccuccuaagugcuggcagaccacgugcaugcagacagcccaccccaagggaagaaucaggggagaagaaacacaaacccuggaaucaugccaaugcauaaaaccucaaaaggguuggaugaggcacuuggaucucucagguugccuuguuuggcccucuuccaaguguacuucauuucauucuugcuuuaaaacuuuuuaauaaacuuucacuccugcugagagacuugccucggucucucacucugccuuagacccauacagauucaccaccacaaacacuacuaccacuacuacuacuaccaccaccacuacuaccaccacugcuaguacuagaauuacuacuaguacuacuacuacuacuacaguaguacuacuacuagaaacagaaaacauuuuuggaaaggccauggggaugggauggggacuacuccuuauaugccaguuaaagucagagaaaaguucuucuaaacauucaguaccuugaaaauaagaugagauuggacccugauucaaacaaaccacuagaaaaggguauuuugagauaacuguuaaaccacacuggguuucaaugauauugcugauucuguuggguguaauauuaguauuucaguuauguuuuuaaaaaccgggggaagagggugagagucauuaucuguuaaagaucuacccuuacguauuuauggaugaaaagacaugaugggggcuggcuuuaaaauacucuaaaacaggugcaggggaugggggugagauugaggaaauaucagugggcuggcaugugguaacuguaggagguaugugacgggcacauggggcuuauuauugauucucucuaauuuugugacaauuuuaaaguuucuauaauggaaaguugaaaaguaagagaaaauagaagaagacucaccaagcuaauggugacgaucucuucguaagccagagaggacuccccagcaaucaugccugagccccucagauucuccacgcccaagccaucauccuucccgaugauauccgugaucauguaucuucaaaagcaagcacagguuaaaggcugggcucuagccccaaaaaauccaagguggaugcauuucccaagaagggacugacugggcagcaaggugagagauuggaagcagacaaagcauccagaggcaaaaugaaauuggcaucuagaacccucaaaaugagugcuaagauuucuaaaagggcaagugcagcaucaacaaucaucacccugcucuguaaucccagcaguuugggaggacgaggcgggcagauuacuugaggucaggaguuugagaccagccuggccaauauggcgaaaccccaucucuacuaaaaauacaaaaguuagcugggcgugguggugcacgccuguaaucccagcuacuugggaagcugaggcagaagaaucgcuugaaccugggaaguggagguugcagugagccaagauuacaccacugcacuccagccugggugacagagcgggauucugucucaaauaaauaaauaaaucaucacacugcucccaucugugaaaggaaaauaaaaacuaggaccacgauucacaaugccaaaaggaacaauuuaagcugaagcugaguugugcaagcugccuuuccuuuuguuucuuuaguaagcagauagauacagauaaaagcugaaauaucuccacagguaguuccucuauguccaccuuaucuuauagaaagugcugacuuacugagcgcaggaagaauacauaacugacuuccccugccugcgccuuuucuccugcaacaugugauuaccagaacuucccucuuuccccuccagccugcuuuucuccuuuaaauacugaagcccuccaaaucaucuuugaagaaagguacacgccacagacgguuucuaugauuccguguucuuugcuucuggaugugucccuaaccuuggcaaaauaaacuucucaauugauugagaccugucucagauacuuuuugguuuauacaaccaaagauaucugccuguucaggggcugucucagugaaauaucacccucggcccauauuccuccaacggucuacagagagauggggguacacagaggaaacccauucacaaucaaucaaucaaaaauuccagggccacauaaugagaaacacugucccgccagccucuguuagagauucacaaugcacuuuagcaugugugaugguuaauauuaagugucaacuuuaggaugcaaaguacuguuucugggugugucuuugaggguguugcuagaggagauuaacauuugagucaguggacugggagaggaagacccauccucaaugugggugcgcaccauccagucauccagcugccagcgcggcuagaaaaagcaggugaaagaagguggaguaagcugccuugcugagucuucuggcuuucaucuuucucacaugcuggaagcuuccugcccucaaacaucagacuccagguucuucggccuuuggacucuuggacucacgccagugguuugccaggggcccucaggccuuuggccacugaaggcugcacuauuggcuucccuacuuuugaggcuuuuagacucagaccgagccacuacuggcuuccuugcuccucagcuugcagacagccuaucaugggacuucaccuuaugaucaugugagucaauucuccuuaauaaagucccuuucauauauacauauauccuacuaguccugucccucuggagaacgcugacuaauacagcaugcuacagguacuaagaaggucugcaauaaagauguuuaugagaucucauuuaacccaguguuucccaaacucaucugacuauggaauuuccccccagcuugucacuaacauugcaaaaaacccagucuaggaaauccugagucaguuaaucccacugagaaaaacauaacuuguccuggaaaagauaguagccuuugaaugcucucgaagaacagaccucucucugccccacccauaccuucccaguuugccaagucaccgcugcaucaguuuggucacaaaaugugagccugcggcuccuaggagauucacgagaauccaaucucauucucccuacaugacgugcuauuuuuugugaaaggagucacucauuuuagaaugacaaggauggacucaccuuggagaguuuaacaaauguuuaaggcaucagugcccccaacaggcauugguucccaucauacaaacaccaccaccccacuggaaaauaucgccacaagccccgaggaaagaagacagcugaaauuaaccaugagcaaaauuaaggagcuaccugauaaguuauuuaccuggacucuccuccuuccucgauguguuuacaguggacggaguucagggagcugauucugguguagucuuggggagucagguacagguauuuaaaucccuuaaaaaauacuuuagugaggcuacgaauccaguucccugcacugaaagccacuguuuuuuuuuucuuaaugugaacaucguagggauggauguuaauaacauguuaguaacaugucaaugacacauuaacacaucucauguaaauaccguauuaauaacagccauaaacugaaguucugcuuugagcuaagcucuccucuaaggacuaucucauuuuuauuucuuauugccagcaccccaacaugaaauuuuaauuuucaagauacacuguuuaaccacuauuuacauacucuguauauguauauauguuaaaaacuauuuuauugccaccccaaaaauuauuuuucugucuucuuggggguagugggcaauaucgcccccgagaaugcaugcucugaauggaaaggaugacuguccccugucauuucacaucacagaaugcgugcgcuucccucauucaucuugccuuuuauggcaagcugguaucuauacaacuccccaaagauuuuucuuuuuuuuugagauggggggucucacucaguugcccagucuggagugcagugguaugaugaucauggcucacugcagccuugaacuccugggcuccaagugauccucccacuucaacuucccaaguagcugaggcugacuacaggcaggcaccaucaugcucaccuaguuuuuucauuaguagagacgaagucuggcuaugcugccuagguuaccuagcuuggucaugaauuccuggcuucaagcuauccucccacccaagccuccugaguugcugggaugacaggugugagccauaauucuaagaacgcuaugaggccagggaguugacacaaucaccucugcauucucagugcacacugcauucaggagcgcucaguguauaucagcucaggguuuauagacuuuuuucauuauccccguuaaggagccuuuuuagaucuuuuuuuucucaucaccaucccccccgccacagugaaauguuaguaucacugauacacuguaugccuguuuauacacuacauguacaucugugcuuuauacauaagugagauuuuuuucaccucuugcaggugcuagcacucccacugaaaauacaguaguagcugagcagaaucacccugccccgccaguuucacgacguacuuugugggggucuucuggguccacccaagccacguggaacauguguuugaucuccucugccaugccaauacgggcgccacuguuggcugccacguaaauuuugggaaugcccucugcccgggccaucucggaugcccgcagguacagaagguccucuccagggccaaaggauccaaugcgaaaggugaugucauugccgaugacgaucacaucccguccuuccggguacuccugggucuuaaaccucauuuugaaggccaccaugcccaccuggcaaggggaugaaugcacaaggaaaaugaguuuguuucuuugggggaaaacuuuuuauuuuauuuuaguuauuauuauuuuuuuuagauacagggucuugcucuguugcgcaggccagagugcaguggugcaaucacagcucauugcagccucaacuuucugggcuuaagcaaucacuccugccucagucucucgaguagcugggacuauaggagcacaccaccacacacagcuaauuuuaaaauuuuauguagagacagguucucaccauguagcccaggcuggucuugaacuucugaccucaagugauccacccaccuuggccucccaaagcacugggauuacaggugugagcuacugcaccuggcccaaaaauauuuuuaagggggugacuccagccagggguuaggcuccgcugagcuauuaccucauuuccaccaggaagucgguucaucuccaccagcuggcccugagaguccaacacuaauucaguguaugucaggaugucuuugggauacuugucuggggagccccacaguuuaaagagagccuggggagagaagaggaaagagaaaaaacuugaagucaucaguagggaagaacuaucuuucccagacagagaugaucugucaugauuccagggugaauucuguaguucacucucucuuuuugaaucaugaaauauuuaaagcauauuuaaauaugagcacccauccaguggcucugucaaaucuugauuuuuccauaguuguuuaaaguuuuugaaagaaagaagaaagaugcgauugaagccccagcucauucuuccucccaacuccaacccacaggugaccauucccuugaauucagugccuacccaguccuaugcaugcuuuuuuuuucauuuuccuuuauccuguaugcauacauuggaaacauacaauaucguuuugcacugcaaacuuuaaauaaagaguaccacacuguacacauccuuccgcaaauuacuuuuucuauuuuuuuuuucucuuguugcccaggcuggagugcaauggcgcaaucucagcucaccgcaaccucugccucccggauucagugauucuccugccucaaccucccggguugaggcaccaccacaccuggcuaauuuuguauuuuuaguagagacaggguuucuccauguuggucaggcuagucucaaauuccugaccucaggugauccacccaccauagccucccaaagugcugggauuacaggcgugagccaccacgcccggcagcaaauuacuuuuucuacuccucuuuguuugagagauuuauccauauugauaaauuuagcucuggucugcuguucaguuuuccauucucucgauagauagauagauaaauagauagauauagacauagauauagauauagaggcagacagacagacagacagcugggugugguggcucaugccuguaauccaaacacuucgggaggcugaggcaggcagaucaccugaggccgggaguuugagaccagccuggccaacauagugaaacccugucuccacuauaaauaaaaaaauuagccaggcaugguggcucaugccuguaaaaaagagacaauggauuuaucuaaaaaagagacgauggauuugcuucugguucagucauguuucuucccuuauagcucuugaggucaaaggcaaaaggauacagacaaugacauucuuaaucauaaguuuccacuuauuaagcgcccacugaauacauacacuuuuccaacaacuuuugguagguacuguuauuauucuuauuuuacagaagaggaaacugaggcccagagaggugaaggaacuuggcuagggacagcaggaagcaaggggacagauccagcauucgagcugaggcccgaguuacucuaaagagcagcuuuuccuacucuuucauauccucuaugcaugaggcauaggcagagguaggaacagaugcuuccugccuacacuggaagguccuugaccuugguuucaugaacgucauucacuuguugaugggguuguuguuuuucuuguaaauuuguuugcguucuuuguagauucuggauauuagcccuuugucagaugaguagauugcaaaaauuuucucccauucuguaggcugccuguucacucuaaugguaguuucuuuugcugugcagaagcucuuuaguuuaauuagaucccauaccaacauggcacauguauacauauguaacaaaccugcacauugugcacauguacccuagaacuuaaaguauaauaaauaaauaaauaaauauauauauauauauauaaugucauuccaaagcaauccuggaaaaugaagagacauucacaucaccaaugucagugguucaggcuccuuuaaagccccuagggcauaaacauauaaaggcauaaaaaauacuugaagaaaaugcacccaaauguucuuucaggcauugauggugggaaaauuacauaugaauagaauuuuacuuccuuauucuuaccuuuccauaguuuccuauguauacuuuaaucaucagaaaaacauaauaaaacauuauuuuuuuguuuuuguuuuuguuuuugagacagagucucgcucugucaccagggcuagagugcaguggggccaucucagcucacugcagccuccaccucccggguucaagcaauucuccugccucagccucccgaguagcugggacuacaggugccugccacuacgccugguuaauuuucguauuuuuaguagagaugggguuucaccauguuggccaggcuggucuuaaacuccugaccucaaaugauccaccugccucagccucccaaagugcugggauuacaggcgugagccacugugcccaacccaaaacauuauuuuuuaagaguagacuaaaaauuacucaaggcagugacccccuccucuuucccacagcugucuagacuucgaauggugccugguaaguagcagguacuuaauaaaugaccauuaaaaagaccagaaggaaacacaucaaaauguuaagcaauuugucaucagagugugggacuaggaauuauuuuuucuuuguuccaaccuccuuuauuuucugaaguuucuauauccuaugacuuuuaucauugggauaaauuagucuuauuuggagaaaaauacuaugaagucguucucaacacauucauuucuuuuucuucaaugcagaccuuguucuuuuuuuuugaagacggggucucacucggucacccagccuggagugcaguggugacaucauggcucacugcagccucgaccucccaggcucaggugauccuuccugccucagccuucaaguagcugggacuacaggcaugcgccaccacgcccgguuaauuuuuguauauuuuguagagaugggguucuucaacuccugggcucaagcaauccucccuccucggccucccgaagugcugggauuauaggcgugagccaccgcaccuggcaagaccuuguccuuuagacuaggucuuuagaaggagaauuaaggaugggcuuugguucugguggagucugcugggaggacccaggggguaccgcgucugagccgccggacuugccugccugaacauuuccgggaagucauagauguaggugguucccagggucugggccuggaaucgcuuggccuggagcagauccuuggugacguagggaguauugaucagcaucccgugcuggggcccuugcuuguugccgaaggagugaaacaugaucuggaccagaaaggagggaaaacagagagugagagagaaucacacaucucccccaauuuauuucugcccaguccucaaugaaaaugcaggugggggaagcaaagcaugucacauggcaugacaaagugagugccugggcuacguaaaacucccuucuucaccacuguggagggccagaacaagaagggacaacaggggcuguggaaugcaguuccaaaaauacagugaucaaggcaucacacacucccaacaacaggcaugcauggaaacgcuggugaaauccgaacguggucaguguuggugcgaacaguccugugccaaugucaauuuccuguuuuaaugaugugcaauggugaaguucaaucaacauuaccauugggggaaacugggugaaaauccucugcacuauuuuuuuucuucuguacuaauuuugcaacugcuugagagucuucagucuucaauuacuccaaaauaaaaagugcauagaccaggcacaauggcaugugccuguagucccagcuacuugggaggcugaggccagaagauugcuugaacccaggaguucaggcccagucuaggcaauaucucuuuaaaaaauggcguguauauauauguauauuuuuauguacacacauaggaauuuaaauggcagucaaaagaacauuuaauucacuuuacaaaagucuguccuagaacaugguugggaaaguauuucccuaagugaaccaaucugaggacugcauuacagucaaccacaguagugcacaacuuaucccaaauauggccauauggccaggcgugguggcucacgccuauaaucccagcacuuuggaggucgaggcgggcagaucacuugaagucaggaauucgagaccagccuggccaauauggugacaccuugucucuaucaaaaauccaacauggccacagaauggauuaaacuuggagauucacucuccuuuuuaggugagugaaaaaccaagauucaaaggcuaacacauuuaacauaacacucagagggggcuaccccaacccagaaugacaugggagagcaaggcaagaccgccuccaaaugccaucuuaaucuacaaauugauggcccaagcagccugcuucugcuuugacuuagacccccacggcgcgggccagccuuacauuuccagaucuggagucagucacuucuuuguagaggcugauguccagguaguagcccgacucauuggugaugaacaggcggaugggaacggcacugccggugguggucuggcggauguugaucuugaccucagccuguagcacacggaguuuccacagccggcugccguagcgcauaaccauguagcgcacggacuccucgaucugccccaaaacacagcaauuccaguuucagggccaagacaucccaaggacauuugcaauagcacugauacuaauaagaggaugagauauacugacugcaaaaacgccugggacauaguguguauccaacaaaaaguauuaacuaauaacaagcaacggcucuugcuaagcauuuaaaacucuaccucauuuugccuucguaaguacucaagagaggcgagcuuuucuaaucccucacugacagauaaggaaacugaggcugauaagugacugaacuaguacugcuauguuauacuaucuuuacaugccuuugacucaagccauugcacugcuuccuucuggaacuaccugaacuagugaggccagagccuccacauggguccccugaaucccccagauaccaaacggauguaucaggacuucucuuuuuaauaauacuauuguauuaauuauuuuuaauaauauauauuauuaaauaauaaaauaaaauacauuuauauauuuuaauaauauuaauauaucgauauuaauauuaauuugauuaauaaucuuaauauuuuauuuuuuaauuuuuaaaauuuuuaguagagauagggucucuccauguugcccaggcuugucucaaauuccugggcucaagcaaucuacccaccucagccucccaaaguacugggauuacaaguggggcuucuuucauuccagaaucaccaccauaaaagucugucugcucgugaagagccaccugacagggaacauucagccacagaccucacggucucacgucucuccccacccacaugcaguccccagcgcagccuggaaccagggaaaggacaaaauuuuguuuugaaagacauuuugagcaugcuugucauccuuaaaguaaagcauucccgugcagggcauggcuaaaacauagcucuagaauugaauggcagaagguuugcucuccucccgcagcaacugaggcucagauacgcaugguuucauccuggaacccaggucuugaguggcaagagacaauaccccaaagcagcauggcucagagggugaacccagagcccggugagagccccccugcaaaggcgagaccuugaagggguccaugaugacagugggcacgaaguugaggaagaugugguugcagucggugcgcacgcugguguuauugaacgccaccuccagcucguccauggccuccaggagcagccgcucacccucguucugcagguauucgaaggaggcuuccugccaaagagugggaggggcagcugcucaggccaggggugcaggccuacucccagcuggcuggaaacucagccccaaagaggcagagacaggaggaaaacauuccccuccuccaaaaagugugccaggcaagaacagcagagcccugccucucagaggcgaagggacugcaaagcuguugaguguauugacauguguccuauuuucugcauucugacacuuugacaccuggggccuugcugacccuggaucauaccuggggacacaaaccaccugcucuaaucacccagggccagauuccugagaaccagagacagcuucuauaugccagggucugcugagaugauucacagccaauccuaaaccuguuuacucagccucacuuuuuucuucuccaggaaaccacaaucaaggcucucguccacgucuuccaugucuuccccucugucccucugcugccugaccaaccccagagccuccccauguggccccauggcagggaaaaccccuucuucuugggaacuaugaguaauaaacugucuuuuugauggcaguugucuccuuaucuguuggccucaccauaccucaacaauaauaaaaccuauuaaaacggcuuggccaggcacaguggcucacgccuauaaucccagcacuuugggaggccgagauggguggaucaguugucaggaguucgagaccagccuggccaacauggugaaacuccgucucuacuaaaaauacaaaaauuagcugggcaugguggugggcgccuauaaucccagcuacuuaggaagcugacgcaggagaaucgcuugaacccgggaggcagaggugguagugagccaagaucacgccacugcacuccagccugggugacaagagcaaaucucuguaucaaaauaaaaauaaaacaucuagcugacagguagcaaaaaaacugcaguuagcuuaauauccaucaauagggccaggcgugguggcucacgccuguaaucccagcacuuugggaggccgaagugggcagaucaccugaggucggcaguuucagaccagccugaccaacauggagaaaccccaucucuacuaaaaauacaaaauuagcugggcaugguggggugugccuguaguccuagcuacucagaaggcugaggcaggagaauuguuugaacccgggggugcggagguugcagugaacugagauugugccauugcacuccagccugggcaacaagagcaaaacuccaucuccaaaaaaauauauauauauaauaauuauauauacauuuauauaaauauauauuuauauaaauacauauaauauguauuauauuauguauauauaauguuauauaacauauuauauauuauauuauguauauuauauguuauauuauauaauauauuauauauauuauuauauauaauuauauauauaauaauauauauauguuuccaucaauaggggauuaguaaaaaaaaaaaaaaaauuauacacgguacauccaugcaaggaaauaauaugugguggaccacucuuuauuaacaaugaaagagguccacaagugacugaccaauuaaagaauaauauauucaaaugaucuguccacucucagcucuuaucugcaacuuaugccuacaacucuagguuucagggacggaauugugucuagaaacagucaacaacuaagcuggccccucagugacaggauucucgguccuugcgcuagguucuuaaaaaucguuuucagucuuauuuaaaauuuucacaauauaaucauggauuacuucuguuucuuuuuuucuuuuuuuuuuuuuuuugugauagggucucacucuaucccccaggcugaaguacaagggcuccaucucagcucacugcaaccuccgccucucagguucaagcgauucucaugccucggccuccugaguagcuggaauuacagguguacgccaccacgcccagguaauuuuuguauuuuuaguagacacaggguuucaccauguuggccaggcugguuuugaaccccugaccucaagugauccgcccaccucagccucccaaaguacugggauuacaggcaugggucacugcacccggccauggauuacuuuucuaaaugcaagaaacaauggaaaacgaucacucagucagcaaauauuaagaaauucccugaacaaaccaguauuuuucuauccuggaaauuuucuucucaugcgcagagacccacauaauacaagaaacagauccaagugccaccagccuggacgugaucacaggccacuuugcuguccgccuccugcccuggacuggagcauagcaagggcaggacccuggguguugguguacucuccauccccagcaugcagcccaggacccagcacagagcaggaauguaaggaagggagggccagguucugagagaggaagaaaugcucugcgacaucuuaccuuugugaucaggucagagugccugaugauggcgcggaugaagaaccuaugguccgucacuuccacaccuuccuucaccuuggcagcacccagguaaaggugcaucuugugguuggcacagggcacggcggucagaucgaaguuacgcauccgguuaaguuccagcuggaaggccagggcagguuccaagugacgguaaaugcgaucuucugcaaacuguaggcggaccagagagagaagacagacacauacacacacagcgugacguuggagcugcgucccugcuugguccacacccuacucugcagaccccugguguccauggguuuggcacucaggaaugcagcauucaugauguucccuaauuguaagcuacccccagggcuccagauauuugggguuuugcuaagaucugaggagagcuaugggcauugcaagccuguugugcugggugcagcgcuggcuccugggggaaccuagcuagucccuaucaccugccagcgugaccaggcuguucuccaucugucacagccuguggcaauucucaugaagccacuaaccccugguuucuugguggaaauugguccccgaaaagaaagcaacugacaguacuggaaacuaaacugaaaaaaaaaaugaagacauuaagaaaaggaugugucuuagcuagaaaaauaaagcuuuggauaaauuaaaaugcaaaaugcugaauuugguggggucuugaaucagugcugggaauaaaccuaccuguucuacaacagggaucgguaaacguuuucuuaaauggccagagaguaaauguuuuaggcugauggaucauacgggcucugucacaacuacucaauucugcuacuguuagagugaaagccagaguagacaauguggaauccaacggguguggcuguguuccaauaaaacuuuauucguaaaaacaggcagcuggucugcaagugaguuugccaaccacuguucuagacgagcauaagaaaaacaguuuggaaaaaaugucuuacugaguacaucagcaaguacugaaaauuauucaagcaagacagaaaccuguagugaggcugaaagggcaagauucucaggucugagugccaugcagggaacagagggcucucaauggaaauacaaucccagaggaagacugcagucuacacaaaaguugcuacauucuugaauauggggaugccuuaaggacugcagacuauauucuucaugaauaucaaagaugccagggagcugggaggcacgguggcaugugccuauagucccagcuauucgggaggcugaagcaagagaaucgcuugagccauaaguucgaguccagccugggcaacauagugagaccccaucucuuuuuuuuccuuuuuuuugagacagagucucacucugucacccaggcuagagugcaguggaaucaccuuggcucacugaaaccucuauuucccagguucaagcaauccucccaccucagccucccaaguagcugggaccacaggcuugcaucacaaugccaggcugauuuuuuaauuuuuuuguagagacagggucucacuauauaacccaggcuggucuagaacuccugagcucaagcaaaccuccugccucagccucccaaagugcuaggauuacgggcuugagccaccacacccggccccaucccaucucuuaaaaaauaaaacaagaugcuagagaagagaaaacaucauuacuuuuggccauaccucaucucuugcucugaaugugaaaaacuugggaaauucuuucugcaaaaagaaauccacacacaagacaauuaaaucaagcaagacgcacugaaauauguacauccuuauuuagugauuguaaacgauuacauucacuucuagaaugaaucauuuggaaauccuucuccuuucuaaugaucucuuucacccaaaucuacaaaauaaauaucaaauaaauggcacacaccaaggcuuggagaaugggaaagacucauagagaugaacugugaacuaaccucuugggcaaucaagaaugugauucgucggaguccauaauccacaaggauauuuuucugcauuaaaaaccaaagacacaauggaauauuauuuggccguaaaaggaacugaaguauugcugcauguuaccacacggaugaaccuguaaacauuaugcuaaguggaagaugucaaucauaagagaccuccugugaucugauuccauuuauaugaaacguccagaauaggcaaaucuauauagagagaaaguagauuagugguugccuagggcugugguggggagaggguuuuuggguuggggacagaggggagugacugcuaacagguacaggguuuuucuauggagugaugagaauguccuaaaauugauucuggugaugguuguacaaccuggugaauauacuaaaaauauauuaaauuguacacuuuuuuucuuauuucuucuaaaaaaaaaaacaggauacaugugcagaacgugcaggcuuguuacacagguauauaugugccauggugguuugcugcaccuaccgaccuguccucuaaguucccuccccucggcccccaccccccgacaggccccggugugcguuguuacccucccucugcccauguguucucaauguucagcucccacuuaugagugagcacaugcgguguuugguuuucuguucuuguguuaguuugcugaggaugauggcuuccagcuucauccauguccccgcaaaggacaugaucucauucuuuuuuauggcugcaaaacugcacacuuuaaaugggugaauuguguaguaugucaaugaugucucaauaaagcuguuauuaaaaagauaauuaaaaaauaucacauuguauacuguaaauauauauaauuuuuuuugagacagggucucgcucugucccccaggcugaaauacaauggcaucacaggcuuacagagcaaccugcuguuauuggcacacuuggucaucaauguaaguagccauuuuaaaacugccaguuucuggauuauuccaacaaaaacacucccagaaaaucuccaaacuauuuauugggugugcccuccguaccugggacuggcuaagccguguauauacuuugucauugaaucauugcaacaccgugagcgagagaaaugcugaccccacguucagccacaucugcccaaggucgccagcuaugaggcgagcagagcuagagugggaagccaggucuguggcucugaaguacucagcacgccugccuccccaagggccgccucgacgagcccagccccuccuccuucuccaagaacccccaccaaaaccagaggcacgcccagaguaccuuggacuguacgaauguccguaaaaucggcaccagugccucauccuccagguggucugcacacuggauggacacauucagaauguggaugggcucuucucugaggcucugagagggagaagcaagggguagggcuggaaagccugggggccacggcccaccugcuccccagguugcucccugggcuuagacgcuuaccuugcagucauccucggaguauagggaggugcgggccucgcugaagaggggggugucuuugggcacguuggcgaagcaagagaugacuucaucaaaauuucugggggugcggguagagagggagggcugaggggcugcugacccauggggaugaggucaagcuuccaagccaggcagcagggaacgccagacccucccaauuucccagccaacacccuuugaucuuauccaacucuacagagcucaggagguucccugucuacuuuguccagagcacccgugaugggguccuucccaaaagggaagaaugaaccuaagugaucugugaucaggaauacagggaaggauuccagcgcuuucaggcaucagcugggcuugagaucaacucuuggcucccauuuuuacuggcugggagauccuagaaaccucaccucaccccgagucaaagaaagguaauaagaguaaucccuaugccucaugaggcuguugugaaaauuccacaagauacuccaagcacaaagcagaacacacagugaaaggcugaaaaaagacuauaacaguaacuauugagagcuaacauuuagucacuauauuaucugcauacuaauuauacuuuaaauauguuauuucacauauguuaucucauuuaauucucauggcgcaccuaugaagugaguccuuuauuauucccauuuuacagauaagaaaacgaagguauggagagguaaaaauauuuugcucagucucuuaguuagaaagcacauagccagaauucaaaccaggcaagcugacacgcaggcucacacucuuggcuacgaugcucuuauuauucuguuguuauugaugugcugugccaggcaagcugacauguaggcucauacucuuggcuacaaugcuauuauuauucuguuguuauugacaugcugugccacgugucugggucucucccaccccaucuguccagugaauuggggggggauucaagggaagucugcccagcccccaugcucaggguguuggagaccgggccaugcuggguaccuggugaaguccucgaaucuccugaaggcuaccauggcucccaugcgcuggcacaguggggagaagccgcuguccaugaagagcucugugcugugccucagcaggucaggguuggugaugcugaugggcacggucauccuguaaggugauggcaagucggggaugaggcagcugcuugcagacccaacucuacgagcugcuccuacuccugaagcuucagugagcuggaccagauuuagagcucuuccaaaugggggcuuaaaaugggcaggggaugagacaauggcuggggccggggccugaggagggucucaucugaucccucaggaccuggugaagaguaagagcucaacaaguguaggaaucaaugauucaugcaugagaguccagucucaacacagucccgaggggagccccaagugcugaacuugaccacagagaagaaacacucccagcaucaauuucuccuggagaaauccaccagccccaggcagcuggugaggcagucaggcuugguccugacggacacuccaguccucugcucccuguaaucccuccaucaaacuugcccuugggacaaagucagcagccuucuggaguuuagacaacgaugcucccagaacuggcugcucaccagcagcaaaucucaaugggccaccugagguuguuagaauugggccuuggaaucagauacgggagggguaaugaaauggugugcaggaagucagcacagcaggccccacacugcucuucugagaaaggagaccugcuugcuugcaaggacagcccuuggcuggccucugggaacuuggacuuggggaagguuccuaucguucccugaaggugacaaggggggcucacugugccucaacuguuugcacaaacagugugguuuaugcugaacaccugcuuucuucugcaagccugagauuucgaugcagagcagagggugaugugaccagccaccaaucccuggugcggggcuggaagacaacccuucacuuguguugucacaacuccuugcugggggaaugaagugcacccugcgugaauccacugggagaggacccuggcagcacaccugcuuuccucuggacuucacccugaugccuucugccuuggcuaacugcuuuguauccuugcccccuaauaagucagagcuauaagcaugacuaugucccgagaccugugaguucuccuaggcgaugaucgaaccugggggugcuuuuggggacccugacacaggugugugcauuccuguugggugcucugaaaucacgaucauggccccucugcuccccgacagcucaauccaggggucacaaacuugcaguggcaguguggcugaaugccacucacagaaugacuuugguccaugcagcauuuuaauaacauacaugaauuaacauguguucauguauucauuuaacaugaauuaccuguccccauugaaaaauggaaggacuucagguuaaaaaaaaauagauuuccugcuucugcuggaaaaaaucauggagaagucugguugugauggucaguuuccugcagggcaacagugggcagagcuaggacagcagccccaucgcagggggauguagccaguucccacccagcacagagguccagguccaggcugcagcuggcacaaagcccugccaacuucucaucugaccuucccuugggucucggugaccuaaagcaccaugugccuggcucuacacacacaaguguugagggccaagccaggccaucuuggggauagacuuuauuccucauggcccuuuacagaggcauuaaagggcugguuggugggggcagccgcaggcaaggucucuucacaggcccagaguacauuucuggcacugagagcaaucaugagaaucuuagauggccaggaaucccccaggguccucaaugucucucugggucaaaaaaggacccugugcccauacugaaaaucacaaccaauaaccuggauauacguguagcucacaaggcaugacccacagcccucaggagagccgcccuucccuuccuaacagggcugacuugcugggacaauaagaucaaaagagaaggccaggcacaggggcucgcgccuauaauaucagcacuuugggaggccgaggcaggaggaucacuugaacccaggaguucaagaccaaccugggccacauagugagacccccaucucugcaaaaaaauauuuuuaaagaauuagccaggugugguggcgcaagccuguggucccagcuacacagggagcugaggugggaggaucacaugagcccaggaguucaaggcuguagugagcuaugaucacaccacugcacucuagccugggugacagaacuagacucugucucuaaacaaccaaacaaaaaaaucaaaagaguccuucucaggaguagacagcuacaaaauaucuuacaccaccacugcucuccaaauccccagaaugaccccaggcugcaagcagucaguccccuuucucucaaugggguaaaaugucacaauccuauuuuuggaaauaagaaggguaaaaacaaauaacuaggaaaggcagugccucguggggaagcccccuuuucuucauccaaaacauagcagcaucuuucuucuuaaaaccaacaggaaaagaaaguuauuuuaaaaauccuaagaggccagaaaaauccccgcuucaccaaagcaugaacccuauugccuguacagaucugaucaaccgaacucccaaaucacaaugacaucaaugccgccguagguaaggccuugggcacccccauaagaacuaaaaccagaggggugagggagcgugagagagaacacuucgaaucccaaggagacauaauuacuuuaagagaagguaucccacucuaccugaccuaaaugguauuaauacuuuggguccugaaacaagauggacugaaaaaaagacugugagugaggaacucagacacaucagauauuuuuaggugagccaggcaugguggcgccugucaucccaucacuuugggaggcugagguggacagaucauuugagguuaggaguuccagaccaaccuggucaaugcagugaaaccccaucucuacuaaaauuacaaaaaaaaguaguggggcuugguggugcaugacuguggucccagcuacucaggaggcugaggcaggagaaucgcuugaacccaggaggcggaggcugcagugagcugagaucgcgccguugcacuccagccugggugacagagugagacuccaucucaaaaaaaucaaaaaaagauauucucaggugagaacacugaggguaucuacugaacuacagcucuuggacagcagacuacaguggacacagacaggacaggugcccucacaccuggcucagagggccccugaaugcuguggaaaggacuuggaggugagaguguggccugggcucaaauucccacuccacgugcacaagcagcucagccuaggucaggugagggcccagggcucccaucuguaaaacgaggaugagaacacauuuuuggccgauagaggauaagagcugaauaaaauaagagugugggcugggcacgguggcucacgccuguaaucccagcacuuugggaggccaaggcggguggaucaucugaggucaggcauucaagaucagccuggcugacaugaugaaaccccaucucuacuaaaaauauaaaaauuagccgagcaugguggugugcgccuguagucccagcuacucgggaggcugaggcaggagaaucgcuugaaucugggagcugagauugugccacuggcacuccagccugggcaacagagcgagacuccaucucaaaaaaaauaaauaaauaaaagagugugggagcacugagcagagugcccaggccaauggcaugccacuagaugguaauaacagcguuagucaugaucaucuccgggaucacuuacagucaacaacuuccuuugugccaggcacugucuaaaaugcuacaugugccuuaucucaugacucuucccaauggcuuggguggcauugucuacuagaacuuucuaccaugacagaauguucuagaacuccacugucaaauaauauggcagccaugagccacccaguaugacugagaagcugaauuuuuuuuuuuuuuuuuuuugagacagaguuucgcucugucacccaggcuggagugcaguggcacaaucuuggcucacugcaaccucugccucccagguuuaagagauucucaucccucagccucccgaguaaccugggauuacaggggugugccaccacgccuggcaaauuuuuauauuuuuaguagagaugggguuucaccaaguuggccgggcuggugucaaacuccaggccucaaguuccugaucugcccccuucagcccuccgaagugcuaggauuacaggugugggccaccauggcuggcucauuugcauucuuuguuuuuucucuuuuuuuuuuuugagauggacucuugcucugucacccaggcuggcguguaguggugcaaucucagcucacugcaaccucugccucccggguucgagcaguucucccucagccucccggguaccugggauuaccagugcacaccaccaugccaggcuaauuuuuguauuuuuuuuaguagagauaggguuucaccauguuggccaggcuggucucgaaccccugaccuugugauccacccaccucagccucccaaagugcugagauuacaggugugagccacuacuguguuuggccucuuuuuuuuuuuuuuuuugagacggagucucgcuucuucgcccaggcuggagugcaguggggcaaucucagcucacugacucacucugccucccggguucaagugauccuccugccucagccuccccaguagcugggauuacaggcaugugccaccacgcccggcuaauuuuuguauuuuuaguagagaugggguuucaccauguuggccaggcuggucuggaacuccugaccucaagugaucugcccgccucggccccccaaagugcugggauuacaggcaugagccaccgcgccuggcccaugugcauucauuuuaauguaaauaggcacacauggcuacuguacugaacagugcagguguaggaggugggcucugcauuaucaccauguuagaggggagaaaauggcgcugcagggagcucccacaggggaagugcuuaucgcugaugucuccccagcagcgugcccaaacacacuugccagguccuuccagagacaggacgacagaggucaggaagaacagaaacacaggccgucccugggugugucccacuccauaccgguuugggugggaggacggcagcaugaacuggaauucuaccacgcaggugccguccgggagcugccggugcugcaggcuguuuaacucauaggcgauguagccccuccgcacguaaaccugacaaggcagaaacacacggacauucucucaggggccacugcagagugugcucaaaagcugagggcacucacggggaacagguaccagaaaugaccucuaaaauaucuaucuguaagcaggccgggugcaguggcucaggccugcaauccagcauuuuggaaggccagggcagguaggucacucgaacccaggaguucgagaccagucugggcaacauggcaaauccccaugucuacuaaaaauacaaaaacuagccaggcaugguggcaggcgccuguagucccagcuacucgggaggcugaggugggaggauugcuugagcacaggauguugaggcugcaaugagcuaugauagcaccacugcacuucagccugggcaacagagaaaaauccuuccucaauuaaaaaaaaaaaaagauuucuaagcagcaguuaagagcaaauuugcucauauuucagaguguuacuaguuacacaaaauccacucuaaacucuagagcagggguugauaaacuucuguaagagauagguaguaaauauuuuaggcuuugugggacauaucaucuuggcugcaacuacucaauucugcuguuagcacggacguagcuguggacaacauguaaaugaauggguguggcugcauucuucuuuuuuuuuuuuuuuuuuuugagauggaguuuuguucuuguugcccaggcuggagugcaauggcaugaucucagcucaccacaaccuccuccucccagguucaagcgauucuccugccucagccuccugaguagcugggauuacaggcaugcaccaccaugccuggcuaauuuuguauuuuuaguagagacgggguuucuccauguuggucagucuggucucaaacucccgaccucaggugauccgcccgccuuggccucccaaagugcugggauuacaggcaugagccaccguaccuggccgcguucugauaaaacuuuacagaaacagguggugggccaaauaugguccauggucuauaguuuaucaaacccugcuuuagagcagugcuguccaacagaaauauaacacaagcuguguauguaacuuuauuuuauuuauuuacuuuugagacagggucucacuccaucacccaggcuggaguacaguggugagaucauaacccacugcagccuugaacuccugagcucaaaggauccucccacuucagccucccaaguagcugggacuacaggcaccaccacaccuggcuaauuuuuuuuguuuuuuauauuuaguaaagaaaggaucuuccuauguugcccaggcuggucugcaacuccugaguucagugauucucccaccucagccuccuaaagagcugggauuacaggcaugagccaccucaccuggccuauaauuuuaaauuuucuaguaaccacuuagaaaaaagauaaaaaauaauuuuaauaauauauuuuauuucaccccacauaugcaaauauuaucauuucaacauguaaucaauauaagaaauuauugagaugguuuacauucuuuucuccauacaguacuacaucuuuggaauggaguguguauuuuccacuuagagcacagcucgauuuagacuggaugcaguucaagugcucacuaaccacacguggcugguggcugccauaguggacaaugcaguucuggaguuuaaacacuggaagcuuuucaacugaacaggaaaugcgggaacugggcagcaggagcuaauacagcaauuagcagacauaauugcuuuccauuaaaagacuugcccuuggccagcacuggggaacuugaauuuggggaagguucccaccauucccugucaagaauggggucaggcaugguggcacacgccuguaaucccagcacucuggggagccaaggcagguggaucgcgugagcccaggaauuccaggccagccuggaugacauggcaaaaccccaucucuacuaaauauacaaaaauuagcugggcgugguggaaaaacaaaacaaauaaaaaaacccaaaagcauccuagaaaaaucucuaauugacacaaacagcauuuagcacuuuaaaaaguaacuguaagucaagcaugguggcaugcaccuguaguccaagcuacuggggagggugaggcaggaggaucgcuugagcguagcaguucaaguccagccuggucaacacggcaagaccugucucuaacaaaacaaaaauuguguuuaaaguaacuacagaagagguguauuaggucucccuguuagaaacaaagagugaggccugagaaagauucuuccagaggugaaacccauagaggaauaaaaguugcaggcccaggagacccuguggcuguaauaugcuaacaagcccaagauggucuccagaagacccaguaaaccuucucacugugugacucacaggcucccaaggaugcagaagagaaagugggggcaacaggggacugagacucugagcucagaagauaaagaauauuggaaaaacuacugccagcaaagcagacccggguaagagggccguguuaaaaacauauuuucuuaaaaagauucuaaaagggcagcagauuuauugggaggcugaggcaggcagaucacuugaggucaggaguuccagaccagccuggccaacauggugaaacccugucucuacuaacaauacaaaaauuagccaggugugguggugggcgccuguaggcccagcuacuggggaggcugaggaaggagaaucauuugaacccaggaggcagaggcugcagugagccgagauagugccacugcacuccacccuaggcacaagcgagucucaaaauaauaauaauaauaauaauaaaagagcagauuuaaaacucugauuuccuggaaccaacacaacacuucuugguuccugaauucaagaagaccugaauucuugcucccgggagcaagaccaccugggaucaccuggcucuaaucuggguuuugcuacuggccacgcccuucuaccucaucacucggggggcagggggucaccuuaaguugucaccugggcuccucuagcucuggcaguuccaagcagaaaagucuuucaaagguauuuaaugcacgugagucagaaaguuuagaugaggugccucagacuuggcucucagggauuaguauuuaaugugcccugccuggaagaggcuggaaugacaugagacagcagugguaacuagcauggaaucuggaaugaggcagacccaauaaugcaaaaccugguucugccacuuucuagcugugugacguugcauaagucacuugaccucucugagccucaguuccuuccucuguaagaugggacuauuaacauagcuaccuugaagagaaaaggauaggaucacauucaccaaggcauguggccuagggucaggugcaugguagcggcagugaacacuagaacuggcauggucagugcuguucucugggccucuccugcuuaccuccaaggacgccaugcacacgacuuuguuugcgugauagaagaaaguaggcaggacgucgaagaugguuguuuccgaaaguauuaauuucuaagggaaaugaaaaggggaaacaaggaaaaguaaaugugaacaaguuucagguuuuucuuuguuuuuauuugagauaaacuggagugcaguggugugaucauagcucaccgcagccucaaacucccaggcugaagcgaucuccccaccucaaccucuugagcagcugggacuacagcgugcgccaacaucguggcucuuuuuuuugugugucuauuuuuuguagagacagggucucacauguugcccaggcuggccucaaauuccugggcuuaagugauccuccagucuuggccucccgagugcugggauuacaggcaugagccaccgugcccagccagugaguaaguuuuuuaaucaccagucugaugagugggggcggugggagcaggcagaagucaugcuuugaccacuaaaagcgaucagugcccugcagcgcgcugggcuccuccccuauuuaaucauaggagagcuggugaagaacuccgggaugacggcaccugggacaggucucccaucaggcacugaggggguaccugagaacauguaaaugagccagaguccaggaauagggaagaugaggccgcgacucagccacaggagggcucacagcuuccagauaugcuccauauggcugagguuuguaaacugcaccaggugagcccccacugcugucacacuguccuuccuggaggacugggcuccaugcccaccucuccuagagucuccccaggugaccccucgggcagcccuggccacauugggcugaacugucugcaucuguggcugugcccugcaccccacugagcaccuggagggcaggaggagccguuuccccagaggcccccaccugggccacagugugugcucugcagauggugaaaggaaggagacgggcucaccuugagguucucggggcagaacugguggccguacaugucaauggcagacaggaaaauggacuccaccugguuaugccgcagcucguaggaggggaggugggaggcaaucaggaucugcagggggagggaugggggcgcuggcgugagccaaccucccagggcagaaggcagaggcucgggcacgggccggcagcacggugggacugugcauggugagggcugagcacgguaggggacacauaggaggguggggggaaacgcacaucguggggaccgcacccugagacccuaccugccgggcucugagggccacuuugcagugcucgcuuuugcucagcugagugagcucguugaggauggagaucagcucguccgacagggaagggucugggccacacagcucauccuuaggggacagaaaaagaagccaaauggcuuuucuccagcccagggaaacaugcagcacucaucucgacuuggggagcaccugccgcaaaagccaggcggcugcuccacucuccaaacaggcccagcacagccuguuaugcaaacccucaccacuuucuacugugcacccaccccagucagucauucauucacucacucacucacucacucggccacccauucauccaccccacaacaugcccuaaaugccugguaagaacaaacaaauacaacuaagucccugccuacguuacuauuaauagccagugauuaggccaggcaugguggcucacaccuauaaucccagcacuuuggguggcugaggcaggaggaucgcuugagcucaggaguuugagaccagccugggcaacagcgcaaaaccuugucucuacaaaaaaaaaaauagaaaaauuagccgggcaugguggcacaugccuguagucccagcuacucagaaggcugaggugggaggaugauuugaucaucccuugggagguggagguugcagugagcugagaucgcaccacuguacuccagccugggcaacagagccagacucugucucccccccaaaaaaaaaaaaaaaggucagugauuaucaggcacauacuaugugccagguggcuaguaaacagcuagacccuuuauauacaacuccccaaauucucccacccccacgaagaguuacuuauuuugauucccauuuuacagauaggaacacugaggcucaaagaggcaauaugccucaccccaaagccagcaaacaugugcaagacagagccagauucgaacacagcacuauucugcccccaaagccucccgcuccuuccccuacacauugcugccugacuuaaggcgcucacgguuucagaggagagggacgugggguugaaucuugcaggagagggagggacaaugugucuguguugcaucccuccucucugcuucugaaagaagggccuuucugcuggagaccaggccugggugcagccgguguucgcaucuccucuuaugcccuaagugcauauggggcuugggaacagcucagcgcaggugcucccuaaccacccacugaagauggagcaaugaaugcuaaauaucagagcuccugagcaauaugcccccauuccccaccccgggcauccacuaagacuggucuucaagaggucaccagaugguagagcuguggggcauuuuuuucuacauguguuucugcauuuuccuauuauaaugaaccgagacugauuuuaucaucagaaaaaacuucaacauauugauauuucauacacaaagacacaggaacaucaaugcugaagaaaugugguaggaaaguguucuaaaucuccucucccuucucugauuugcuuucuauuauuaaacggugguggcauaacuccccaccaauccccuaggcauguggcucccaggccagacagcacaggugcuggccagcagcuagacuggugcuuuucuaagaggugaaaaacucaagaguuugugugaacauuuuuuaaauuuccccccacacaucuaagugugaauguuaaaaaaucuaaccauugccuucuacauacaaaagauaauaauaauaauaacaaaaacauuuuucuaggcagggcaugguggcucaggccuguaaucccugcacuuugggaggccaaggcggacaaaucaucugaggccaagaguucaagaccagccuggccaacauggcaaaacccuguuuccuacuaaaacuacaaaaaaauuagucagguguggugguacgugccuguagucccagcuacucgggaggcugaggcaggagaaucacuugaacccaggaggcagagguuguagugagccgagauugcgccacugcacuccaaccugggugacagagcaagacucugucucgaaaacaaacaaacaacaacaacaacaacaacaacaccauuuuucuuucuuguuaacuuugugaagcagucucaucuuguauauuuuaguucucagaaucauguuuuguuugcuucguuuugucacuaacgaagucccaugaccagugaacuggugucagaaacuaggucccuuuaaaagccucaaaaaaauucauuucgaaauaaucauucaauucacaagucuuuguucaaaaccucucagguaccaaauaccaucaggugcagagaacucacuauuuucuaacaaaugggaccaagaaagucagaagaauaaugaaucucacauuuaucccgagacuguaauugguucaacauuuuuagccucuaucaccaaggagguccaggaaaaugucccaauucccaagaacugggggcugcuccacccaucuucccuuggcuguccucugguguacaugauauuucaugacuucaugcccagaagagagucaauaugugcacagaagaacgaacagcaaaauaacccacagacccacugccuuugaauggcaagcugacuguaauagauuacaggcauauuuugcuugacaaacacucaaacuccaggaaacuccauccaaagaauguauuuugaaaaacauuauauuauuuuaguaauagaacuccccccaaagaguggauaucuccuugggcauaaauucccaguccuggcugcguguugcaaucacuuggagaguccucucucccaauuaauuuuuacaaacuucaaaacuacagaagaauugaagaucaguauguuaaaaacccauaguaaucaccuagauucacuaauuguuaaaacuuuugccacauuaucauauuugauuuuucucuaauaagaacguacgugcgcauacacauacacacucucucuuuuucugaaagucaguugcagacaccacaauccuuuacacuauuuucgcacauaucucccuuccaccuacuacagaaccauuaaaacaccaaagaaacugaacauuaaaccaauaauauuaucuaauauacagugcacauuuagguuucccacagggaaacuuucaaaaagcacuaaugccugggcccuaccccuagaaacucugauuaaauugaccaaggguggggcaugggcaauuguauuuuuuaagucuccccacccccuaggugauucuaauguacagccaggauuaaaagcugcugcgugagauuuuuaaaugauucuuuaccaaaaaucccaauauuuauuaaugcaacuuggacaggggacaggguauuaacuauucucugagaucguggccaaacucugccuacugacuguuuuuguaaauaaaguuuuauuggaacauagccacccucauucauguaccuauugucuaguuuucaggcuacaguggcagagcucacagagcugaguaguggcaauaggggguggacguccucaagccuaaaaucuuuacuaucuggagcccuuuacaaaaaaaaguugccaggccgggcgugguggcucaugucuauaaucccagcacuuugggaggccgaggcugguggaucaccugaggucaggaauucaagaccagccuggcuaacauggugaaaccacgucucuacuaaaaacacaaaaauuagccgggcgugguggcgcaugccuguaaucccagcuaaacgaggcugagacaggagaauugcuugaacccuggagguggagguugcagugaacagagaucgugccacugcacuccagccugggggauagagugagacucugccucaaaaaaaaaaaaaaagauagauagaagauagauagaacccgggaggcggagguugcagugagccaagauuaugccauugcaccccagccugggcgacagagcaagacuccaucucaaaaaaaaaaaaaaaaaaauugccaaaccccuuucuacuauaagccaaguccaaguugcucuuacucugcugauccuacauuuuccaagucaguugcaagggacauaucaaagaaaaauauuuuuaguuauaaaagacugcuauuaucggccaggcgcaguggcuuaugccuguaaucccagcacuuugggaggccaaggcaggaggauugcuugagcgcgggaguucgagacaagacugggaaacauagugagaccucaucucuacaaaacaaacaaacaaacaaacaaacaaacaaacaaacuagcugggcgugguggugugagucuguaaucccagcuacuugggaggcugaggugggaggauggcuuaagcccaggggauagaggcuacagugagccaugauggcaccacugcacuccagccugggcaacagagcgagacccugucucaaaagaaaaaacagacaaaaaacaaaagacugcuaucaucgaguggaaagagaaacaagaacagagacuccauauuucuucuucuccacacacaggacucaaaauccaauauccugcggcuaauaguucaugagucuggagucagacuauugguucaaauccuggcucuacauuuaggagcugggugcccuugggcaaguggcuuaaccucucugugcucugccaaagagcugugacagcaguacccacuuucuaggacugcugcgugaauuaaaugagcaacuauuuauuuggaaagcacuucaggaguaccuggcacaaacuaggugcuuugcauuagucaugaucuucccagugccaacaaacccgacucauugccuguuuuuguauacaaaguugggauuuuuuuuguuguuuuuugagacaggaucucauucugucacccaggcuggaguguaguggugugaucacagcuuacugcagccucaacaucccaggcucaagcaauccuccugccucagcccccugaguagcugggacuacaggugcacaccaccacaccuggcuaauuuuuguacuuuuuguagagaugggggucucccuauguugcccaggcucgucucaaacuccuggccucgagugauucuccugccucagccacccaaagugcugggauuacagaugugagccacagugcccaguuuuaauuuuuuuucuaagaaauggagucuugcaauguugccuaggcuggacuugaacuccuaggcucaagugauccucccaccucgggcucccaacaaaguuuuaugggaacacagccaugcccauucccuuacauuguacaaaggcaguguugaguggucacgacagagaccacaccaaccugcaaagucuaaaaaauuuacuugcuggcuuacuuuuucuuuuauuuauuuuuugagacagaaucucacccuguugcccaggcuggagugcaauggcacaaucucggcucacugcaaccucugccuucaggguucaagcgauccuucugcuucagccucccaaguagcugggauuacagguaugcaccaccauggccagcuaauuuuuguauuuuuaguggagacgagguuucacuauguuagccaggcuggucucaaacuccuaaccucaagugaucugcccgccucagccucccaaagugaugggauuacaggcaugagccaccgcacccagccacuuucuggcccuuuuaagaaaacguuuguggacuccugacccacccccagucuaguaacaggcccucuuccugcuuacgaucaacaugaucaccagcugguucuucuuggccaccugugcgugggagaagaugcaguccagcaccugggacaugucuggcuugaacugcucccugagguuuaucacacacuugucguagugggcugggggagacaaaacaccacacagagguaaagcucaggcuccucacgccccccaccaucccacugguguuggcaucagcaucucuugccuugcugaaaauggugcucaacacgcaaguaucuucucaggagauccaacaccacuguuuucauauagccgcggaucccgcugcgguaucuggggagaagggaaggcugcucuuaaugcucacacccuuccuugaguaccugaauauuuaguauuuuuuuuuaugauuuuuaaaaagagaaaggauuggcugggcaugguggcucaugccuguaaucccagcacuuugggaggccgaggcaggcagaucacgaggucaagagaucgagaccagccuggccaaaauggugaaacccugucucuacuaaaaauacaaaaacuagcugggcaugguggcacgcgccgguagucccagcuacucaggaggcugaggcaugagaauagcuugaauccgggaagaggagguugcagugagccgagaucgcaccacugcacuccagccugggcgacagagcaagacuccgucucaaaaaaaaaaaaaaaaaaaagagagagagagaaaggauuuuagaaaggacacugaggugggaggaucacuggagcccaggaguucaagccugggcaauauagccaagaccccauaucuacaaaacaaaacaaaaaaauuaaggccaggcaugguggcucacaccaauaaucccagcacuuugggaggcugaggcgugaguaucauuugagcucagaaguucaagagcagccugggcaacaaggugagaccuugucuuuacaaaaaaaucaaaaaaauuagccgggagugguagcgcaugacugugguccuagcuacauaggaggcugaggugauaggaucgcuugagcccaggaggucaaggcuguugugagcuaugauugcacugcugcacuccagccugggugacagcuugucucaaaauaaauaaauaaaaauuaauuaauuaguuaauuuaaaaauacauuuuuuuuuuugaaacagagucucgcucagucggccaggcuggagugcgguggcacgauucucggcucacugcaagcuccaccucccggguucacgccauucuccugccucagccucccgaguagcugggacuacaggcgccugccacccacgcucggcuaauuuuuuuguauuuuuaguagagacgggguuucaccguguuagccaggauggucucgaucuccugaccucaugauccggcugucuuggccucccaaagugcugggauuacaggcaugagccaccgcgcccagccaaaaauuuuuuuaaaguaucuagaggcacccucuaauccugaggccuucaaaggauauggaguugauucaucugcaggccaaaaagaacacugcccugcccaaagucccacaucaaacuggaggcaaaacuggaguagguagaucccaagccuuauacuugggagggcgccuuucuggccacagaguuaagaaaaaaaaaaaacuucauagauuucggauacugaacagggguagccaauuuuagcaagcuuuaacuguuaaaaacaaaauuuuucaauuacuuacccaagguauagagaccauuuuaaaaagacaaacuggaaaaacauuuaccaaaagauccccauguaaauuuugcuucucccuuuuuuuuuuucuuuuuuuugagacgagguuuuguucugccacccaggcuggagugcaguggugcaaucacagcucacuguaaucucugccucccgggcucaagcaauccucucaccucagccucuggaguagcugggaccacagguggccaccaccaagccuggcuaauuuuuguauauuuuguagacaggguuucaccauauugcccaggcuggucucgaaccucugagcucaagcaauccauccgccuuggccucccaaagugcugggauuauaggugugagccaucgcaccuagccgcuucuuuuaaaacaaaguuuuaaccuggauguucuuccaaaaaucugaacacaggagucaaguuucucaggagaugcgccacugaguuguggggaaguagacgcuucauggcagcaucaccaaaucacaacaaaacagaccaagaugcuaaaagacucugauacaaaugugauuuuaaaacauacuuacacaauacaggacagggcuuuaauauuuauggucagcacagaaaacuugcuagaaaauucaguuaauuuauuaaugguucauuuuuccuagauguuucucugaagcuuaaaggaugggcuuaagguuagcagucuauguguuuuaggaggacucccuuccuagcccuuggcugugaaacuugcaguuuguggggaauccacacuaaaaucucucucccuaacagcugaggagcuccuugaaaaggaggccaguuuucuacaaucucacauucuuuguaccugugaguuucuggcacaugggaaacaugccuggaauuuacugguucaaauccaagaaugcuuugauuccuuuuuucuuuuucauaaaagacaaggucuugcucuguccccaggcuggagugcaauggcgcgaucacagcucacuauaaccucgaacuccugggcucaagcaguccucucaccucagccuccugaguagcugggccuauagguacacaccaccauccccgacucauuuuuuuuuucuuuuuuuuuuguagagacagggucucgcuacaucacccaggcuggucuccaacuccuggccucaagugauccucuugccuuggccucccaaaauucugggauuacaggcauaagccacagcgccuggcccugauugucuucauaaggaaagccuucuugcuagguggauuuuucaugaaaaguggcagaaaauccuuuugucagccgggugcaguggcucacaccuguaaucccagcacuuugggaggccgaggcagggggaucacgaggucaggagauugagaccauccuggcuaacaugaugaaacuccaucucugcuaaaaacacacaaaaaaauuagccgggcgugguguugggcgcccguaguuccagcuacucgggaggcugaggcagcagaagaauggcgugaacccgggaggcggagcuugcagugagccaagaucgaaccauuacacuccagccuggccgacagagcgaaacuccaucucaaaaaaacaaagaaaauccuuuugucaucagaauaguccugcagcgggaaaccccuguacaauaaauaacuacuugagaugaaauacaauuauucauccacuuuccuuugcaauugucccaaaagccacaauaacaauuuuugcaguguuuuaucauacauaaagcuauuucaucccauugucucaaucuaauguaucuaucaaguauuuacuauuugucagcacuucacaaaacuuaauacauuuauaggccagacaugguggcucaggccuguaaucccagcacuuugggaggucgaggagaauggaucacuugaggucaggaguucgagaccagccuggccaacauggugaaacaccgucucuacuaaaaguacaagaauuagccaggcaugguggcacaugcccguaaucccagcuauucgggaggcugaggcaggagaauugcuugaaccugggaggcggagguugcagugagcugagauuuacaaacagagauuuacagaaguaaaguaccucacccaggguucugcuguuaguaauggcacugcaggacuauaacacacuuucucucaguucaagccugcccugaagacagccccagagcaccacccuggugcaaugcaugcgacgauucaggugacaaccacauccuacggggagacccaggauucaccucuggaccaacugcacgaugcucuggguguugaugaagaagaccucucgaucagccuuccgcugcaggguggcugcauggcaguccaggaugguggcuaucuggaugggaaaacaagacaggucugacugcugaugauucagaugacacacagcaguccccuaaagaaaggguccccaaaccaguacccaaacgagcacugguccguggccuguuaggaacuggcugaacagugggagguaagcagugggugagggagcgaagcuucaucuguauuuacagccccuccccauugcucacauuaccaucugagcuccaccuccugucagaucagcgggagcauuagauucucacaggagcgcaaacccugcugugaaccgugcaugcgagggaccuagguugcaugcucguuacgauaaucuaaggccugaugaucugucgcugucucccaucacccccagaugggaccuucuaggugcaggaaaacaagccuggggcucucacagauucuacauuauggugaguuguauaauuauuucauuauauauuacaauguaaucauaauagaaauaaagugcaccauaaauguaacgugcuugaaucaucccgaaaccaucccccuccccgguccguggaaaaacuaucuuccacaaaaccggucccuggugcuaaaaagguugggaacugcugaccuaaaggacccaccacagccucccagggaggucccauccgagacucauuugaagauugaaaauuccaggcccaaagccuuccagcuacccugaaacaccccuguucauccccucaacggugaggaauucaagcgcucaaaaugccagcgaucacauggaggagugcacacauucgccuuauaccauuccgcacauaucaaugggauggggaacaaggagaugggaaugucccacucuagcaaaaaccagggugcucauggggaaggguccugucuuuaucauuacacauaauguuaucgguguauugccuuuggcaucaaaaauauuuuuaaagaaaaaaaaaccuggaucaaugacaaauuccugaaaguuccaaguguguacuuuuucaguuaggauccucuagaguuuggcuuuuguuauuuuuuaguucagauauaacuuacacaccaucauauuccaccaucucccuuuaaaguguacauucagugguugguaguguauucauaaaguugugcaacuaucaccaccaucuaauuuuaaagcauuuucgucacucuaaaaagaaaccuuguagucauuagcgcucacucuccauuuucccugcacugcagccccuggcggccacuaaucuacuuccuucuucaugaacgugccuauucuggacauuucauaaaauuggaaucacacagggcugggcaccauggcucaugccuguaaucccagcacucugggaggccgaggcaggcagaucaccugaggucaggaguucaagaccagccuggccaacauggugaaaacccaucuucacuaaaaaaauacaaaaaaauagcugggaauggugguguacaccuguaaucccaacuauucgggaggucucaaaaaaaaaaaaaaaaaaaaaagaggaaucacauaauauguggucuuuugugccuggcuuauuucccuuagcacaauagguucauccacgugggagcaugaaucaguauucuuucuuucuuuggcugaacaacauuccaacccauagaacuccuaaccuccgagaauggccugaacuacacuguccucugguuucccaaaucaccaauuuguggguggguggaugaugaugguggggaacccucccaccagagggcaggaaggcaaacaggcagaggggcucuucccagugcaaaugccuuucaaaugccccacaaaaccaacaaccacaacaaaaugaacaacgcgaggccgauguguaaauaacagagauauuucuuacuucccuggaauggcuuccauucuuuuuuuuuuuuuaacauguucacaaaugcaacuaugauuaugauaagacaucucaguacauucuuuuuuuuuuuucuggagcacaguggugcgaucucggcucacugcaaccuccaccuccuggguucaagcaauucuccugccucagccuccugaguaguugggauugcaggugugcaacaccacgcccagcuaauuuuuuuuuuuuaguauagaugggguuucaccauguugaccaggcuggucucgaacuccugaccucaagugauccaccugcccuggccucccaacgugcugggauuacaggcgugagccaaugcacccgaccucaguauaauucuuaaaaaauauuauauauauacauauauauguuuauauguauauacacacauacauguauauauguauauauacaugcacguauauauacacauauacacauguaugugcguauauacacauacauguauauauacacauauacacauguaugugcguauauauacauauauacacauguaugugcguguauauacauauauacacaugugugugcguguauauacauauauacacaugugugugcguguauauacauauauacacagauaugugugugcguguauauacauauauacacagauauguguguguauauauacauauacacacagauauguguguguauauguacauauacacacauguguguauauauacauauauacauauacacacauguguguauauauacauauauacauauacacacguguguauauauacauauauacauauacacacguguguauauauacauauauacacacauacauguacguguauauauacauauacacacacauguguguauauauacauauauacacauauauacacacguguguguauauauacacauauacacauauauacacacguguguauauauacacauauacacauauauacacacacguguguguauguguguauacacauauauacacacacguguguguauguguguauacacauauauacacacguguguguauguguguauauacauauauacacacguguguguauguguguauauacauauauacacacguguguguauguguauauauaugcauauauauguguguguauauauauauacacacagauacacacacacacacacauacauggagcucccagaugaucaccuacaaaauccaggggcagaaaaucaaagcugcaaaccagugaaaaaacaaaaauaaaaaaacuugcaguuuccucuaaugaugucagccaguuuauuuuuugggaaaugcucacuccaucugcaacaacugcucacuccuauucagaaucuuggguuuuaggcaaugaggccuaaggaauacugauguucauucaaacaacuguugcuuugaguaaaugauaggauucugcagacaaggcucaaaaggaaacccucggccccugauauguuaggcuauaagugggucucaaggaguucaacuugaucagaggccagauaucgagccagaccgggagccggcccagugugaccauccuggugggguggggcugggcaggggagcacgcaccugcuggcuggggaacuggcacagcaccgaggugauguugcuggcauacugggccaucacccugcggacagacuucuccacaggggcggggaugcggccugccacgcuggucaugaucuccugcagcuccagcagcggcagugacgggugccggagggucaucaugagcuucugcacccacuccuucagcugaagcggggaccacagcaucagcccccagcccugcaugggcaugggcaccaccgccccaaacagggcacccaacacagcucaacccauccugaccccaugcacucaaguggcugaagauccagacccagcagccucuggggcaguccagaguggaauggcccccugaccacaggggaauacucaguuucccuacauaggaagacccugacucccccucucugugcaucagaaagccagcauggugugggggaucaaacauaaggucacaugaugagcugauguuuauaggauacuugcuuagugccagacaguguucuaggaacuuucuuuucauguuaucauuugaucccuaaaagcaaccauauaaaggaagucuaaugauuuuguccauuuugcaauugaggcaacugaaacacagagagguuaguuaaguuaaccaaagucacucagcuaguaagaagcaaacccaggcuauucagcuccugagacucugaacugcugcccuaugcuguuuccggggugucucaguagccaaugcugauggucuuuggaugacgaugauaguggggccaacauccuagugugguugugagguuucaaagugaacugaugcauaaacugcgaagugccccaacuaauaaaaguugcaauuauuguggggugcgguggcugaugccuguaaucugaacacuuugggaggccaaggcgggaggaucacuugagcccagaaguucgagaccagccugggcaacauggcgagaccccgucucuacaaaaaauuagcugggugugguggcaggcaccuguaaccccagcuacuuggaaggcugaagugggaugauugcuugaacccagaggucgagguuguagugagcaguguuucccccacuguacuccagccugggagacagagcaagacccugucuccaaaaaaaaaaaaaaaauguugcaauggugguaauaaucaucaggcagcauaacgugggggcgaagagcacagagucagaauccugauggccaugguucagaucucaucuuugccuccucauguaugaagcacagcaagucucuuagucucugugucccucaguugccucaacuguaaguggaaauaagaguuccuaccuuaucgguugcugggaggaugaaaugauugaacuuuuaaguaguuagaaggugacacagcgggcacgguggcucacgccuguaaucccaguacuuugggaggccaagguggguggaucaccugaggucaggaguucaagaccagccuggccaacacgguagaaccccgucucuacuaaaaaauacaaaaauuagcuggguaugguggcacacgccuguaaucccagcuacucgggaggcugaggcaggagaaucgcuugaaccugggaggcagagguuacagugagacaagaucgugccaccacacuuuggugugggugacagagcaaggcucccucucaaaaacaaaggggggugacacaugguacauacuugcuaaggguuggcgguuauuaucgucaucaccaucaugauuugcucuccugagacggacccgguacagcacacagugugaugcuuagucacugcuaugagcaucaugggucuuucaaggaggucugcaaaucagagaacuucuuguuucucuacugagugagcagaugagacccagcaagggugaaugacgaacagagguguguuucaaacaaagugccuugucugucaucuccuuaagcagggugacccccacugacuccuuccuuaauguccuacuggaguauucucagucuugagcugaacugcuacaagcccaguuuacgaucaaggagaaaaagucaggccaauguuuacaauugaauugaggaauucccugaggacagguccuucauaaacacaaccgaggggcugggugcgguggcucaggccuguaaucccagcacuuugggaggcccaggcggauggaucacuugagcccaagaguucaagaccagcguggggaacauggcaaaaugccaucucuacaaaaauacaaaaaauuagccgggcgugguggggugcaccuauagucccagcuacgugggaggcugaggugguaggaucucuugagcccaggaggucgaggcugcagugagucugggugacagagugagaccuugucugaaaaaauaaaauaaauaaaauaaaaacaacagaggaccgaccauuuucucauuucuuacucaauaaugaccucugcugucacgggguagaucuucugacccuccgcacuggucuacacgccugcgcucauaggugacuuuaccuuuaugcuaaaaacgggcucuggcagacaaaagccacucaugacguuggugagguuuuccaggacgcuguggaagaccuggugcaguuucucuccgaggaugggcagugucugcugggcagggaguucuccugugaacgguucagccugaugagacaccacaagaacgacaggucaggaaaacucugggaauuccaaaugggaccgggcagaacgggaggcaggacagaucugccggcuuccguaaucaagugaggaugaggucugaggaaaaaaucaaagacaaugaacuggaaaguuaaaacggccaaacucacaccccaauguggguuuuccaaaccauuccuuuugcaaauggcccaguacacaguuucacaccccagacaguuuugugggguggcggugagaucuguuuuuuuuuuuuuuuugagacacucgcauuguccccaggcuggacugcaguggcaugaccucggcucacugcaaccucugccucccggguucaagcaauucuccugccucagucucccgaguagcugggacuacaggcgcaggccaccacgcccagcuaauuuuuguauuuuuaguauagacagguuuucaccauguuggccaggauggucuugaucucuugaccucaugaucugcccgccuuggccucccaaagugcugggauuacaggggugagccacugcgcccggccgaucuguuuguuguuguuguuguuuugcuuuauaaucaacaaaucucauguucuguauuuauuuucauucucuauugaaucccaaaguuaaacaccucacaguaggaugaaaauuuaugaacaucucauacaaaugcaucugauuuuuguaaaucauaaaaauucagucuuagguaaacacauggaaaaauaaaaagcucccuagagggcaacacagacuaaaugugcucauucgucuacucauucauucuacaaauaccuacugugcaugacgcacagugcuggggugcuguucucccagcagagaacacuccguuuccugcccacccucuaccccuccacccacacccauccccaccccuagcccugcaggcuuuucuccccuuuuaagagaugacuuggccgggcacgguggcucaugaccauaaucccagcacuuugggaguccgaggugggaggaugaacugaggucaagaguucgagaccagccuggccaacauggugaaaccccaucucuacuaaaaauacacacaaaaauuagccagucaugguggcgcgugccuguaauccgagcuacuccagaggcugaggcaggagaaucaguugaaccugggaggcagagguugcagugagccaagauugugccauugcacuccagccuggguaauggagugaaauucugucucaaaaaaaaaaaaagcugacuugaggguuuuccccuacacaaucugaucauagcuucuccauguggguccccacagcccagggccaagggcggucuucuaacuacacucaccaagugaaguuacucgaucucccagucugucucacaagcauuuaugugaggcugcagggaaugggugggcaggcccugccucauuaacccagcacaggaaaugugugcugaaaggaaucacagugcagguacccagaccugcccacugauccaaaaaggcccagucuauuccuagcuuugggaacucccuaaagagacuagugaugccaggcacaguggcucacccuuguaaucccagcauuuugggaggccaagguggacggaucgcuugaggccaggaggucaagaucagccuggccaaccuagugaaaccccaucacuacuaaaaauacaaaaauuagucaggcauggucgcacaaaccuguggucccagguacuugcuacccgggagucugaggcaggagaauugcuugaacccaggaaguggagguugcagugagcugagauugugccacugcacaccagccugggugacagagugagacucugucucaaaaaaagagagaaagagacuaaugaaaagaauuguaacaacagucaugugcagcaacauggauggaacuggaggauauuacauuaagugaaauaagcugggcagaaagacaaauuuagcauguucucacucauaugugggagcugaaaauuaaaacaaauaaacucauggaaauagaauguagagugauggcugccagggucugggaaggguaguggggcuggugggaguggggaugguuaacggguacaaaaauccaguuagauagaaugaauaagaucuaguauugaggcuggacaugguggcucacaccuguaaucccagcacuuugggaggcugaggugggcggaucaccugaggucaggaguucgagaucagccuggccaacauggugaaaccccaucucuacuaaaaauacaaaaauuagcugggcauaguggcaggugccuuaagucccagcuacucaggaggcugaggcacgagaauugcuugaacccuggagguagagguugcagugagcugagaucacgccacugcacuccagccugggcgacaagagcaaaacuccaucucaaaaaaaaaaaaaaaaaaaagauauaguauugauagcacaacagggugacucuacagucaauuaaaaucgacuguacauuuuaaacuaaccaaaagaguagaacuggaauguuccuagcgcaaagaaaugaaaaaugcuugagguaauagauaccccaaucacccugauuugauuauuagacgguaugccuauaccaaaagaucacauguacccccauaaacauguacaccuauuauguacccauaauaauuauaauuuuuuuaaaaaagaaaacaaauacaauuaauagaauacucuggagaaaagagaccaugugauauuuuuaaauuuuuuuuuuacuggacagauguacuaauuauuuuagagucuugcuuaggaggguguaaacauucauucauucaucaagacuuguuauuucugagcacccacuaugcuccgagcacugugcuaagccccaggaucacaacaguggacaucgaaaguaguccuugaccucagggacucaucgguaaugacacagcuugacaaauuaagaggaaucuaaauuggaggugcccccaagagccugagcucagggucacaugacagacacucuggugcacccccuggugguccugaggacagggggacgcccccggcaccugccugcuacacguucauccaacaaccaauauuuacagagcaccucugauguacuaggcccuguuuuuggcacuggggccccagcagcgagcaagaaagccaaaaggcccuguucucacgguguuuccagucuccuggaggccaaauaauaaagcaacaagacaaucagugagaucaucuuugugagguacgguguguguuugcacguggguggaggugagcacaauuuuuuaaagggcgguugaaagagaccugacaacuauaugcaaugugcuaaccuggaugggauccuggacaauagguaaaaacuaagaaaaucguacacucauguucauagcugccuuauucacaguagccaacagguagaaacaauccaaguguccaucaguggauggguggauaaacaaaaugugauucaccccuacaagggaauauuaugcagccuuaaaaaacagggaaauucugccacaugcuaucagauggaugaaacuuggagacguuacgcuaaaugaaauaagcuagucacaaaaggccagauacuauauagauuccaccuauaugaggcaccuagaggaguugaauugauagacagaaagcagaacaaugguugccaggggcuggagggaggagggacucaggaguuaccauuuaacgagugucaaguuucaguuuugcaagugcuggagauggaugauggugauggcugugcaacaaugugaauggauuuaauacugcucaagagaacauuuaaaaauggcuaagaugguaaauuuuguuauguguauuuaaccacaauuuuuaaaaaaugaacuaaagaaaucugagugaacaauaauguaccaauauugguucauuaaaugugacaaauggaccauauuauugcaauaauaguuaaauuuuaaaguuaauuauuauucuuaaacaauaauaccuaauauaucgauauugguucauuaaauaugacaaauggaccaugcucgugcaauaauaguuaaauuaauaacaguaaauugauaacaauaguaauuaauugaggccaggugcaguggcucacaccuguaaucccaucacuuugggaggcugaggaggguggaucaccugaggucaggaguucaagaccagcauggccaacauggugaaacccugucucuacuaaaaauacaaaaauuagcugguauggugguacacaccuauaauccccagcuacucaggaggcugaggcagaagaaucacuugaaccagggaggcagagguugcagugagucgagaucacgccacugcacuccagccugggcgacagagcgagagucugucucaaaaaaaaaugaauaauaauaauaauacuaacaauuaauugaaugauaauuaaaugaaugacagggaaacuggccacagagaauaugggaacucugcacuacuuacauaacuguucuguacaucuaaaacuauacuaaaaauuaagucuauuaaaaagaaaagguggucaauggucaagaaugcccucauugaggggaagacauuggaaucaaagcucccaggaguugagagugaucccugcaaagucugggguagguccuucacagcagagaggacagccgccaggagggagggguccaguguauucaaguaagugauggggagagggacagaggagaaaggcagagaagaaagcagggaacagcuagcucauuuggggucuugcaggucacuggcagaaauuggguuuugcucuaagcaggauggagagccacagagagggaucugaguaaagcagggcgcggcuuccuuguguuucugcaccaucacgguggcugcugcgacgagcucugucugcagguggaggcaggagaagcgcuaccagccuugaguccaccugucucacugaaccaguggaggucacgagugcaccugcaccagccagagcacuugggccguggagccacauaccggguggacuuuagaagggucaucgagcuccagccuggccaccacgcagccugcuuccagcacggcaccuggacgcuugauguacuucacccggccucuuuccugaacguucagggucaugaucaucuucaucaccuauuucguaaaaagaagaaauaguacagagcccaccgggauugacacccagagccacccagaacuagugaugccggagcagggacgcgccgggacacuacccagggacgcgccagaaugacucccuggguaguguucaggcagaagguacaaggaaaagugaccuuuacuggaagccugcuaagugccaggcaagugccauucaaucugcaaagccagccaaggagguguuuaugaugcccauuuuacagauauggaaacugauguuuauuuccaaagggggagucuucucuuagaaauacuguuaaaucauauuacauagagugguucauauacacguuccuaaaacguacugcauaaaucaaacauuuugugaacaguuuguuuuauuaaaggcacuuagaaaacccucagggaacacucugugaaaugaagaaucugcucaucagcccuuuuaauuuucccgaaugucuggauacgugcguggcaugagcuuugucaccaugguggcggccgcagagccaggacugugcuaucucucuugcuuggcaguucacagcuugggcacccaagucagccaggccuggacuagaaucccaggaacugcccccaccaauaccucugugaucuucagaaguggcuccccuccuugagccucaguuuccccaaguguaaaaugaggaauaaugacaguuucaccucuuagggcucuuacgaggauugaaugagaugcagauccugccaugcagcaggucaauaugcaguagcuacuauuauugauguauuuucauugcuauuauuguuguuauuuuccggguuugaauccuggcuuugugugaccuccagugaguuucuuagccugccugggcccagcuuuuuuauaaaauggggaucacauuugugcccaucucauauauuugcugggaagguuaaaaaauaaagaucaguaaaaugcuuagaacagcaccugccacaugguuauggcuuugcaaguguuggcuuaacaccuuucaauuauugcuggggucaauauuuaauauuuaaucauugauugacaauaauuguuauuaucaaucaauucuuggcugugugcaguggcucaugccugcaaucccagcacuuucagaggccaaagcagguggaucaccugagcucagguauuugaccagcuugagcagcaugacgaaacccugucacuaccaaaaauacaaaaaauuaagccaggcauguuggugcgugccuguaaucccaacuacuuggaaggcugaggugggaggaucacuugagccugggaggcggaguuugcagugagacaagaucacgccacuacacuccagcccgggugacagacugagacuugucucaaaaaaaaaauaaagaaaucaaggaaacugauuuacacaacaguuuauagaacaguuauguaaauaguacagagaguuuccauauucucuguacccaguuucucugucauuaaccuucuuacucauuccuggggagaugugcauuuuuugaaguuuuuuuuuuuuuuuuuugagacggagucuuucucugucgcucaggcuggagugcaguggcgccaucucagcucacugcaagcuccgccuccuggguucacgccauccuccugccuucacgccauccuccugccucagccuccugcauagcugggacuacaggcgccugccaccaugcccggcuaauuuuuuguauuuuuaguagagacgggguuucaccauguuagccaggauggucuugaucuccugaccucgugauccgcccgccucagccucccaaagugcugggauuacaggcgugaaccaccacgcccagccugaaguuuuuuucuuugaauacuucaggggauuuggcugaaauccacagacugauucccuuagaaauuugcagacaguggucaaggggagagguaggccuguuuguucagacaugggacaaagccagaagagugggaguuugaggguucaggauuccccacggccggcucugcagucaccuccaucucagcguagcugcucccagccucaacguggcccccauccuccacuguguacugugucagcuucccagccgagggggaucucaggacuguaggaucguucuccuucucaaacacacacgucuuauugccgaugguaauucgguaacugggagagaggaggagucggguagggagacugaugaggacuaccaacucagcaagcccuaguccggcuuucaauaccauuuccccuuccuaaagggggaguguacccucuacauucccaaaggguggcaguugauaguuaucucagagacacugagagugaggugggugaacaaaaaggcugugaugcuuucuuauuuuauuuuuuuuuuugagacggagucucgcucuguugcccaggcuggagugcaguggcgcgaucucggcucacugcaagcuccgccucccggguucacgccauucuccugccucagccucccgcauagcugggacuacaggcgcccaccaccacauccagcuaauuuuuuuuuguauuuuuaguaaagaugggguuucaccauguuagccaggauggucucgaucuccugaccucaugauccgcccgccucagccucccaaagugcugggauuacagacgugagccacugugccuggccaaggcugugaugcuuucuuugggaggccgaggugggaggauggcuugaggccaggaguucaagacaagcuugggcaacacagugagacccugccucuacaaaaaauaaaaaaaaaaaaauagcugggcgugguagcauaugccaguagucccagcuacucaggaggcugaggcaggagaauccuuugagcccaggaguuugaggcuauugugagcuauaauuacucugucacccaggcuggagugcaguggcacaaucaugguucacugaagccuugaccucccuggggucaggugauccucccaucacaacccccuaaauugcugggacuacaggcacacgccaccacacuuggcuaaucauuguauuuuauagagaugggguuuugccauguugcccagacuggucucaaacuucuggacucaagcgaucagggucucacucuugcccaggcugggcaacagaguaagaaccagucuuuaaaauaaaauaaaauaauaaaaaggaugugacccuuuuuuggcugaaagcugguuccuuuuacugacauacuuccaacagggccugacacagaaaaaucaaucaguggauaugauucaacaaauauuuacugauucaaagucuuaaccuuugaacuggggagaguagaaccuauaguaauccugaacauucuuggcagauagaacguggguuaaaaaagagauaacaggcagggugcaguggcucaugacugcaaucccagcacuuugggaggccaaggcuggccaacugcuugaguccagaaguucaagaccagccugagcaacauggcaaaaccccgucucuacaaaaaauacaaaaauuagccaggcgugguggcacaugcccguagucccagcaacuugggggacugagguggggggaucaucucggagcccagggaaguugaggcugcagugagucaugauggugccacugcacuccugccugggugacagagcgagacccucucucaaaaagaaaaaaaaggagauaacaaaauauuacucuggcauaaaccuagucuuccuucuuccaaaacauugaggauugagaagagagucuccacucucuaacuggagcuuuucagacauccccuccccuuucaucaccuuggcuggggucuguuucauugcgugaucucggggugaucagacacacuggaggcggggcaucuuuggggccuaucucacuaucucacaagccccugugcuaagagcuuccagggcaucuuguguguuacccgucagguacacgacacccuuuccugccacuaucuguuuguucagugugucaucuucccgaaugggcuggaagcuccacgagucacacccagaaugcuaucccaacacccagcacagcgccugguacggaggagcuuaguaggucacugccgcacuaacuggguggaugccagagcccagaugcacaggcagcaggcaccuggucacacaccucgcaggccacagagcugggagucaugucccguucagcucugaauccccaccaaccagguuacuagaaaagggccuccuaggauccuccccuaaauaucugccaguugcacagaauuccaaccaagagauuaacuucucugcacacccccagaauuuaccagaaaggcaccuucucuaagacccuuggaccugcacacaggccagugcuguguuuuccaugccuaggacagagagcugugcaugcccagcccacagugggacucgcacccccacgcaccugucaaccucuuccuucauguaggugguguagcuguucccauuguaggagagcaggagccccccaucauucagccggugggcaucaaucucgauguggcagccauucaugaugagaacgaacauggucagagacugccgggccaccuguggggacaagccccuugucaccgccuggguucaggaugugcucccagagcacugcugggccccgcuaacaacaaacaagagcugguuguccaccacagagggccaagaugaacacccccgucucucggacccagcccucacaauuccugccaagggagcagcugcugauggggcugggggaggccuggaguagcgagccacaccugcccuguggguaggcuaauggccgcuuauauagucccugucaagccguguuggcaacugcauguccucuggggcuagagacucccuucugauuccugucuccagcucucacucugugugaggcagcccuggagacuccaccagcagccaggugcaauggacuaaacguuuguguccccgcaaaauucauaaguugaaaucccaaccccuaaugugauggcuuuaggagguggagccuuugggaggugaugagaucaugaagguggggcccuuguaaaagagauuagugcccuuauaaaagauccccuguagagcucuguggcccauuucugacaucuaaggacauagcgaaaggacagcaucuaugaaacgaaagguggguccucaguagauaccaaaucugccaguaucuugauauugaccuucccagccuagagaauugugagaaauucagugugugguuuagaagccacucagucuuugguauuuuacgacaguagcccaaauggacuaagacaccuggacauggacuagggcucugcuucccagacccagcucugcccaggagcacacaagagcuuugggacacgugagagagacacagccaagcccuggccccagcacuacaucucccuccaggaagagcgccugccccaucugguacuucaguucaguuuucucucagaaaacacacacccuaaagggccuucaaccuauaaaauucacaguuuaugacacaaggcagcaagaaauagaggaauguguauugcagcauuauuuguaauaacaacaaaaauuagaacaaaauuagcaagccaacaaccuugcaauggaacacuuuagaucugcccugucugauacggugaccccuaaccacacacagcuauuuaaacugaucaaaaugaaauaaaauguaaaauucaguuccucagucacacuggccacuuucaagcucucagucaccacauaagggcagcaucuuggacacagaagauagggaauguucccaucacuauuaaaaguucagggagacagugccacagacaugaguuuagacucguguuaaaaaaaaaacuuguuaauaacauggaaaacuuuaugccaugaucauaucaaagcuguaaaacugcauuugcaccaugaucucaacuuuguaaaauuaaugcaaaaggaaaaaaauauauaacaaagauuugcuaaaauguuuaccaggauuaccucuaggcauuagcacaugauggauuuguuuuccugauuuuuuaugcucgcuugaaauuuugaaauuuucuacauugugcauaugugacauuuaaaaucaaguugggggcagcuagguccccaaagguagccaagaggcauuaggggcaaaggaggaugauugugaaagcauacccugaucaaugacacacagguuuaguugaacuaaagcccccaaaucuccaaaguugugaguucuacucaugcucaucaauauuaaauagaaaguacuaauuaaagaaaacaaaaauucugucucauaagcagacucaaacucuguccucuuuucccuccugacaaugugaggcugggaaguacugggcaggccugggcuuacaggggacacagccuccugccauugcauuggaacccggggcacugaugccacagccggcucaccccaacaaggacccugggcccagaacaccauggcuaggacaccaagccucacccccuaccugugcaucucagagacauuucugacacuguugaauugaccuuggauggcccacaaagggcaacuaggcacuucugacagaggagagcaaccggaauaagccccagggacuccaguaguaaaccagggaagaugccaguaaucuacacguggugcagagacagagaacaaaaccagccucagagccccuggaaacagacccgggcccacuauucugucucagcaaaggcccagcucacauucuauagggguugaauaauauccuccaaaauucauggccuuccuggaaccuuggaaugugaccuuauuuggaaugaggucucugcagauguaauuaagaugaaaucauacuggauuaggguggacgcuaaauccaaugugacugguguucuuacaagagaagagacacaaagacacagucauggaagauaaugugaacacacacacacacacacacacacacacacacacacacagaggcagaggccaggggguggcucaugacuguaaucccagcacuuugggaggccaauguaaacacacacacacacacacacacacacacacacacacaugcacacacagaggcagagguugggggguggcucaugccuguaaucccagcacuuugggaggccaaggcagggcagaucacuugagcucaggaguucaagaccagccuaggcaacauggugaaaucccauuucuacuaaaaauacaaaaauuagccaggcaugguggcauaugccuauaaucucggcuacucaggaggcugagacagaagaauugcuugaaccugggagauggagguugcagugagccaagguugagccacugcacuccagccugggugacagagugaggcuccguuugaaaaaacaacaacaacaacaacaaaaaaaaaaaacagagacagagacuggggcaaggcauccacaagccaaaaaucaccagggacugccagcagcaccagaagcuggggaggcucggaacagauccugccccagcgccuucagagagaccacggcccgccaacaccucgauuuuagacuuggcuuccagaacugggacacaauaaauuuuuguugguuuaaaccaguuugugguaccuuguuaccgcagcuacaggaaacuuauccacgcuccauugugcccucugcagaaugcacagcccuacauguucuaaaagccaaaguguuuaggugucaaggucacggacuacauggggauucccgaggaacacaagagcucaaacccaagcaugagcaaauccacuccagggaugguucauggaagaaagaaacucccugaagcuugcagaguguuggagacaucggagaggcacgggggcauuuaccuugagaauguacuuaacaccuccguaaauuaauuccacaucuacgagguucaguagugaauccgcugggaggaccuggccccugaaagaaaagacaggguuguggucagccuugggagggacugagaacuccacagccaucccuugcauuuaaaaaaauuacgcaacucucugcaucagcaaaccugacugcacuaaaaaugcuaagccugggcugggcgcaauggcucacgccuguaaucccugcaccuugggaggcugaggcaggcacaucacuugaggccaagaguucgagaccagccuggccaacauggcaaaaccccaucucuacuaaaaauacaaaaauuagccgggcgugguggcaugcagcugucaucccagcuacucgggaggcugaggcacaagaauugcuugaaugcaggaggcggagguugcagugagcugagaucacaccauugcacuccagccugugugacagagcgagacuaugucucaaaaaaaaaaaaaaaaaaggcuaaaucugauuaaaagucacgcacagaaccugaaucacccugagcagccugauauugcuuagaacuuaaggaaucagcacuugcugagggauuugaaaucuuacaaaggcuuuucaggagcaaaauccauaacggucucuuggaaaaauuucacauaugggauccugccuucggcuuaugaaagaaaccagagcagggacugugauucuacuaccguucaaaagcauaaccaaacacuaaaaacauuucuuaccaggcacaguggcucacgccuauaaucucagcacuuucagaguugaggcaggaggauugcuugaggccaugaguuugagaccagccuggggggcaacauagugagaccccaucuaugcaaaaaguuaaaaaaauuggccaggcaugauggcaugcaccgguggucccaacuacuugggaggcugaggugggcagaucacuggagcccaggaaguccaggcugcagugagcugugaucauaccacugcacucuagccugggugauagccuggaugacagagcaagacucugucucaaaaaaaaaaaaguuuauccuuuuauuuucuuuuugauaguuccuuugccucuugcagcaguucucaacugggggugauuauucuacuccuaacccugggacauugggcaaugucuggagauauauuugauugucaugacucagagggaagggcugcuccuggcauuuaguggguagaggccaggaaugcugcuaacauccuaugaugcacgggacagguucccaaacaaaaaaaaagcauccagcacaaaauguuaauggugcugaggcugagaaaccccggccuauccuaacagagaucgccugguugcuuuccauucugguccauuucaugaugacccucugauucuggugagggucugggaaugcacccgcuuguagagaugaccuuuaagccgcuuugcuucccaaauccaccuccuugaacucagaacuccugacuauuaugauguaccuuacacaagucagcauggauccguacacaacagccuguucacugacugccacccuggccucgagaaucccauucccuaacccacagccucuucaaggguagccuagguugaucuguagaggaauuucccagaggcaagaccggaggagagacucaccaauugccuggugacuaacuggccacacaaauaaaggagacagauucagccuccuaagccgcuaacacauaucacaaaagcagaagggaacugccacagccccuaccuuuccagggaguguaagaaaucugucaugcacguucugaacaucgcaucggccacguucaaggccccgcauaccaccccaagcaugauauccgguuucuccgccuaggagaaaaugcacuucaguauccucaggaagccgaggucucggccauccagaggggagacacaggcagcucacucccuaccugcacuuucucagcaaugagguaguccaaccacccggugucgaugucguuguucuggaagcucucggucuccaggagguuaaugagguauuccacgguaguccuaaagucgccucggauggacaguuccuucaaagccaccaccauguuccuugaagggaaaggcacauggaucauuuuccaaauucaugcauacaucaacagaguugcugcaaugaugugauucagagaacuggaaaagcacaggaguggccgggugugguggcucacgccuguaaucccagcacuuugggaggcugagguagguguauuacuugaggucaggaguucaagaccagccuggccaacauggcgaaaccccaucucuaccaaaaauacaaaacuuagcucagcaugguggaggacgccuguaaucucagcuacucaggaggcugaggcaggagaaucacuugaaucugggaggcagagguugcagggagcugagaucacaccacugcacuccaggcugggcgacagagcaagacucugucuccaaaaaaaaaaaaaaagaagaguuaagagagggcucugacugacacagccagugcauugaaucagcgccaggguuuacugccuggcuaaucuuggccaagugacuugagaacucugggccucaguuuccucauauggaaaauggggaaauagcccugacuucaugaggguguucgagaauugaaaugagacaauccauguaaugcacauggucacugaucaauaaauguuaacuacaaugaacgugauuaguuauuauuguuauaauuauugacuauaauaguuaaugauuaguagagaaagaaccagccaggcauggugguucaugccuguaaucccacugcuuugggagucugaggcgggaggauugcuugaggcaugaguucaagaccagccugggcaacauaaugagacgccaucucuacaaaaauuuuaaaaucagccaagcgugaugguaugugacuguagucccagcuacucaggaggcuaaagggggaggaucgcuugagcccaggaguuugaggcugcagugagcuaugaucacaccauugcacuccagccugggcaacacagugagacgcuaucucuuaaaagaagaaaaaaaaacaaagggaaaaucggucaccgccucugucucucccuugaccuauucaaaucuccuguccccagagcuggugccacccucucaccuuccacacagcugcucugccugguguguguggggugcaccugcagauggacggcacugucacccggcucaggggccuggugggccccauggcugccucuccccaacacacagacuccaaaucuccaagagcaccaguucaaauagcuaaaccucaggccaggugcaguggcucacgccuguaaucccaacacuuugugaggccaaggcggguggaucacuugaggucaggaguucgagaccagccugaccaacauggagaaaucccgucucuacuaaaaauacaaaacuagccgggcguggugggacgcgccuauagucccagcuacucgggaagcugagcccuaugaauucauggugagugugggcagguaucugaacaccucuucuucugggagagaaagcuuucuuuuuuucuuuuuuuuguuuuuuugagacggagcuucacucuuguugcccaggcuggagugaaauggcacgaucucagcucacugcaaccuccaucucccagguucaagcaauucuccugccucagccucccgaguagcugggauuacagauggccaccaggaugcccggcuaauuucaguauuuuuaguagacacgggguuucgucauguuggccaggcuggucuugaacuccuggcuucaagugaucugcccgccuuggccucccaaagugcugggauuacaggcaugagccacugugccuggccgaguaagcuuucaugucuugcagcauccugugugcugucagcagguaacggggaaggacacugaugaccccauuuugggggugagaaaaugaagacccaguaaggucauacaaggguauccauaggccaugaaaagucagcugugggucuggaagcuggguaugagaguuaacccgcuggucucacgggugagugacuugucccaguuuccuuggggugguccccauuuuagcacugagaaguccuucaaccugagaaaccggugccaggaaaacgaggacaguugaucccccuacuggacucucacuaacagcaauaagaaaagcuggaauuucugccugugaguucuguugaaguugcgguugguccacucguagcaugugacaagccacaggucacuucacucggaggggucugggcuggcugaccugucuuccgccuacuccuauuaaguaagcccuuuuugcugcaaucuuccauaaacuucaaggaucuugauuuuucacuaagcaugauuaaaauuaauuauucuaagcuggcaaagaaaaccugaucaucaaaacugcccaacucaauuuaauucguggcuaagugccccacgucagauuuuaaugcuaaggccuuugggauuuuuucacuccgaagggcaguuacccacacaaaaacauuuaauuacaaaguaaacuaguuuuauaccuuuccacacccaugucaagccaggagaagugucggagauggugugucagaauuugggggucccucugucaaugugggcuucucagcucugcagaaacuaucacaaguaugggaggacuuggcugagcuggggacauggggcugcugucacaggccucagaguggugggugguucacagcaggacacacuccuuaaaauuuagucuucggugugaaauacaacccauuagggaacuacugauaagguuuaaauguaaaggaguuucccucccccuuucuucagcuaugguacuuagcaccuuuuacacuuuggguaucuccuagaacaaucuuuagaucuccuucaagcuagaacucuuauaagcucaagaccaaaugaccuuggugcacuuauuuuacuuuguggaucuucaauaaaggaaaaaaagggcaggcuuugaucuugaacuucaagcacaggguauuuuaaauggggccuacccugugauuuacuuuucuuggucuccugaaaugcuacuguaucugaagccccaggggaccguuucauuucuuaaaggaaggaauugggaaaaggaggaagugggaagggagggaaagaaggaaggaaggaaagaaggaggaagaaagggagggggaggaaagcagagaagucaggaaaagaaggaaggagggaggaagggaggaaagaagggaaggggaggaggaaggacgggaggaaggaagggaggggaagggauggaaggggaggggagggcagaagaggggaggaaggaaggaagaaaggaaggcaggaaggcaauggaagggaaggaaggaaaaaaggagaaaggcugagagggagggaagaagaaaggaagggaggagaaagagggaaggaagaggggaagaagggagagagggaaggaaggaaggaaggaaggaaggaaggaaggaaggaaggaaggaaggaaggaaggaaggagauacugacgaaauggccucuucccgguucucuccccaggagaagcagugcccaaauugggaauccgcaaacucgugcaggccuccaguagcggccacgcugaaguaaccccacacguucuugcugcuccggaaauucaguuccuggacagucccggagcucggcuuaaaacccuggaguccggacagaaaaugcaaaauggaagaaaucauuacuccagauauauuuucaucagaauucaguccugggaaaacccaagaaccccuacgcugaccaaaagcuuaggguagucaauagaacacugauaucgcuuguuacagguauggauguaucuauucauggguguacccauaugagcuccucaaugccuauaauucuuauuuuuuuuaacuguaaaaaaauaacgaaguugguucagucgcaguggcucaugucuguaaucccagcacuuugggaggcagagguaggaggaucacuugagcccaggaguucaaaaccagccagaguaacaucaggagaccccaucucuacaaaaaauuaaaauauuagccaggugugguggcacacaccuguagucccagcuacuuguggggcugaggcagaaggaucucuugagcccaggagauuaggcugcagugaggcaugacuacgccacugcacucccgccugggugacagagcaagaaccugucucaaauaaauaaauaaauaaauaaauaaauaaauaaauaaauaaauaaaauaagcgaguugggacagagaugguagugcagguguuaaaugggcgaacauugaugauugauggagcugagugaagggacauucugacuuuauaugcuugacauuucgaaaauaaaaaguuuaaauagaagugaagacagguuagauuuccaauucuggauaaugaaaaccucugcaggugaagaaauccagggcauccugggcagggcccuugcugcuagggaagaggccauuucguugguauuuccuuccuuucuucucuccuuccuuccuccuucccucccuccuucccucucucccuucguccuuccucacuccccucuucccuccuuccuuuccuaccccuuccucccucccucccuccaucccccuuuuccucaccccaucggccaggcugcugccaacacacaccugauucccucugggagaacggcccgucucccucuaaguacaauuuugguaagaguggguggacauggcaccucucacugggauuagggcuccugaacuaagggaugaaggauuuggggagagguauguagaagugagagauggagcgacccaagugccugggcuguuaccauaccugguccuccauccuccuaggaaccugggaacgagccaucaucccuccaaaaaauuccccuuuugcuuguccaccagaguugguguuugguucacagccaagaacccuaaaugaauacagcuacccuagcuuaaaauuauuuaauuaaaagggguggagguguacccucucuuacccccaguuuccugaggguaauaauuaagcaauuaaguuguaguagauugaugaguccugugacaaucaacggucgguaugcauguaaacuguaagggaugccaguugguuuguuuuuuaagacccaaguaaggccaagucacaaagggacucucuacaaugagccagacuucauacuguagcaaaaagcacacggggccagaaauccaaggacuaggguucuaaaccuggcugcuugucccaaagauaggcauggcuuuuggaguccacugaugggucucagcaggucccaggugggagacaggaagcaaguuaccccaggcucuuugccuguaauguggggugacgauguccagcagcaguaguguccuauaagugagcagugagacaugggaaggcucggcccagagccuggcaauaauccaaaaauccaguaaauccagccaggugugguggcucaugccuguaaucccaacacuuugggaggccgaggcggguggaucacucaaggucaggaguuccagaccagccuggccaauauggugaaaccccgucucuacuaaaaauacaaaaauuagccaggcgugguggcgggcgccuguaaucccaacuacuugggagacugaggcaggagaaucgcuugaaccugggaggcagagguuguagugagccaagauugcgccacuacacuccagccugggugacagggugagacuccaucucaaaaaaauaaaaauaaauaaaaauaaaaauccaauaaauccaauaaucaaauaaaccaugggaugucccuucccaugccucaguuuccccauuuguaaacugagaugccuggauagcuugugggugucucuucccaggcuaacauccagggucccccacaugcugggagaucugagaugguggaaacacaggggcccccauaacuugccucgucuggguuuucgcuggugauucuggcggcaaugacguggccucgggcgaggggaggguuugaggggguuucaaaagaaaugggagucacuccccauggugacucuccauacagaagccggauauccuucagccggugcaguggcacgcccauggcgaucuaaaaucaagagauccaacccacagacugucaguccuaccagaacacggccccaaaacaccaggcacagugguagaugcaacggagguucagucaaugauuuaggauauacagacacuacucuauagacaacauggugcucuacuguggccagagagccaaagaaagaaaaagccauaagacaugaacuuuucacaguggagcaaauaguacaguugggaaaaggaaaaauauuuaugaaacaacaucacacaacaagaaaauacaugcaucaaguaaaagcacuagacuuuuagagcuagggaaggugagaagcaaccauguuggcugcagaguuaaaggaaguuuuuguaaagggcacccgaaggggaaacuggacaugaagaauggguaaaaaguagacaauuauggaaccagcuuaaccaaaugaucagauuuaacaggcuucaugaugagauguauuaaggacacaacaccuguguaguauucugccaaaauguguagcaggaaucgaaccaggaagaaacaaucagagaaauccaaugagggacauucugccugagcuccucaaaaaugccaguguccaugccuguaaucccagaacuuugggaggcugaagcaggcagaucgcuugagccuaggaguuggagaccagccugggcaacauaaugagacccgaucucuacagaaaaaauuaaaaaaacauuagccaggcauggugacuugcaccuguggucccagcuacucaggaggcugaggugggaggaucacuugagccugggagguugaaucuguagugagucgugauugcaccacugcauuccagccugagugacagagcgagacuccaucaccaaaaaaaaaaaaaaaaauuuuaaugccaaugucaaggaugaaaaaagacuacgaaaugcuuucagauuaaagagauuaaagacacaugaaaauaaaauggaaugugucacccuggguuggguuggauccuggauuuaagagacaaaaaacagcuacaaaaagacauuauuggaacaacagggaaaauauuuaaugugaaugguauauauuagauauagaugugguaucaaugcucuauuucucaagugucauaauugcacuagggcauuggaccggaaugcucuuguuguaggaggccuuuagaaugaaguauucagaggccauauguuacgaagguucacucaaaccauugcucaaaagauugagcccacggccgggcacaguggugcauaccuguaaucccagcauuuugggaggccgaggugggcugaucaguugaggucaggaguucgagaccagccuggccaacauggugaagccccgucucuacuaaaaauauaaaaauuagcugggugugguggcaggcaccuauaaucccagcuacucgggaggcugaggcaggagaaucgcuugaaccugggagguggagguugcagugagccaagaucgcaccacugcacuccagccugggugaaagggcgagacuccaucucaaagaaaaaaaaaaaagauugagcccccuaaaauuauacaaacagacagaagagagacaaagcaaauguggcaacugauggaucuauaugcagggcguauggguauuaauuguaucauucuugcaacuuuuuugaaaucuuucaaacugaaaaaaaaauaaagaaaacuuuuuaaaaaauucugcugaaggaagaaaaagaggaagggagggagaccagccugggcaacguaaugagaccccauuaugggaagaaagaaggaaggaaggaagaaaacaaugaaaacaauuuagagaagaaauaaaggacauccaaauuggaaaggaagaaguccaauuauccuuguuuacagaugauauaaucuuaaaauuggauaaaccuaaagaauccaccaaaaaaacaauucgaauugacaaauucaguaaaucuacaggauacaaaaucaacauauaaaaaucaguagcauuucuauaugccaagagcgaauggucuggaaaaaaaaaucaagaaaguaauuccauuuaugauagcuacaaacaaaauaaaaucccuggaauaaacuuaaccaaagaagugaaaggucucuauaauaaaaagcauaaaacacugaugugagaaauugaagaggacacacaaaaauggaaagauauuccauguucaugguuuggaagaaucaguauuguuaaaauggcuauauuacccaaagcaaucuauagauucagugcaaucccuaccaaaauaccaaugacauucuucacagaaauagaaaaaaaaauccuaaaguuuauauggaaacacaaaagacccagaauagccaauaccauccugaaaaaaaagaacaaacacuggaggaauugaauuaccugacuaugaguuauauuacagagcuacaguaaccaaaacagggugguacugacauaaaaacaaacacauagaucaaugggacagaauagagaauccagaaacaaauccauacaucuacagugaacugauuuuugacagacuugcgaagaacaugcaauggggaaaaagucucuucgauaaauggugcugggaaaacuggauauccauaugcagaaucauaaaugaagaaucaaauucuucaaaucaaaauagacuaaagacuuaaaucuaagaccugaaauuaugaaacuacuagaagaaaacauugggggaacucucaggaacaucagucugggcaaaaauuuauugaguaauaccccaaaggcacagacaacuaaagcaaaaaaaggacaaaugggaucacaucaaguuaagaaacuucugcacagcaaaggaaacaaucaacaaagggaagagacaauccacagcaugggagaaaacauuuguaaacuagccaccugacgagggauuaauaaccagaauacauaagaagcucaaggaugagcauggugacucaugccuguaacaccagcucuuugggaggcugaggugggagggcugcuugaacccaagaguuugagaccagccuagacaacauagugagaccuuaucuguacaaaaaauuuuaaaaaguuagcugggcaugguguugcacacuuguagucucagcuacucaggagguugaugugggagaaucgcuugagcccaggaggucaagacugcagugagccaugaucaugccacugcauuccugccugggcaacagagcaaggcccuggcucaaaaacaaaaaagaagcuaaaacaacugaguaggaaaaaagucucaugaauccaauuaaaaacagacaaaagaucugaauagacauuucccaaaagaagacauacgaauggcaaacaggcauaggaaaaggcacccaacaucucugaucaucagagaaaugcaaaucaaaaccacaaugagacauugucucacuccaguuaaaauggcuuuuauccaaaagacaggcaauaagaaauacuagcagcugggcgcgguggcucaagcuuguaaucccagcacuuugggaggcugagguggguagaucacgaggucaggagaucaagacuauccuggcuaacacggugaaaccccaucucuacuaaauacacaaaaaauuagcugggcgucguggcacacgccuguagucccagcuacucaggaggcugaggcaggagaauuguucgaaccgugaggcagagguugcugugagccaagaucgcaccacuguacuccagccugggcaacagagcaagacucacucucaaaaaaaaaaaaaaaaaaaaaaggaaaggaaaaagaaaacagaaaaagaagugcuagcaaggacguggagaaaagggaccccucauacacuguugguaggacugaaaauuaguacaaccacuauggaggacaauauggagguuccuuaaaaaacuaaaaguagaacuaccaaucuagcaauccuacugcuaaauauauacucaaaagaaaggaaaucaguauaucgaagaguaucuguacucccauguuuauuguagcacuauucacaauagccaagauuuggaaucaaccuaaauguccaucaacagaugauuggauaaagaaaaugugguacaggccaggugcaguggcucaugccuguaauccuagcacuuugggaaguugaggugggcagaucaucugaggucaggaguuugagaccagccuggccaauauggugaaaccccaucucuacuaaaaaugcaaaaauuagcugggcauaguagugugcaccuguaaucccaacuacuagggaggcugaggcaggauaauugcuugaacccaagagguggagguugcagugagccgagauugcaccacuacacuccagccugggcaacagagcgagacugcaucucaaaaaaaaaaaaaaaagaaaagaaaaaggaaaaagaaaaugugguacauacacacaauggaguacuauucagacauaaaaaagaaugagaccaugauuugcaacaacguggauggaacuggagaacauuauguuaaaugaaauaaaccaggcagagaaaaacaaacuuugcauguucucacucauuugugggagcuaaaaauuaaaacaauggaacucacagacacagagaguagaaugaugguuaccagaggcuggaaaggaagagguaggggcauggaaagcgaggaugauuaaugggcgcaaaaauguagugauuaagagaaugaauacggccugcuauuugauauaguacaacagggugacuacagucaacaauaauuuauuguacauuuuaaaauuaacuaaaagaguauaauuggaauauucauaacaccauaacacaaagaaaggauaaacgcuggagggggauggauacccauuuacccugaugugauuauuacacauuguaugccugggaggcggaggcugcagugagccgagaucgcgccacugcacuccagccugggcaacagagcaagacuccgucucaaaaaaacaaaaacaaaaacaaaaaucucuugcacccuauaaauauacagacuuacuauauacccaucaaaauuaaaaauaaaaaaaaaauuuagaguucccuuuaacccaagagguuacaacucuggaucacauauucuuaacagggaugauauugccucugaagagacaaauauuuguucuugggagugaagaaaaucucacucuuuucaugaauaaagcacagauauaucuacaauauccaaacagguaugugguauauuugugauauuaaaauuucacaagacagggauuaggauauaaaauguguccaaaggauccuugcagggagugauaaugauaacaagguuaagaaacauuucucuaggucuaugaauguccugaaauuguauaaaagauauuuucccagggagaacuauagcuuuuacagauuucucaaagugcucuuuggccagucauuccccugggacagucggccaagagaugggcgggauggacuaaugggagcagcacauggaccccugacccagggcagagaagucccagggccccaagcccauuuucucaccuguagcugggcggccggcagauuaacaucagcaaucauuucugugcagggauguuccaccugcaagcgaggauucagcuccaagaaguggaagcugccauccugacuauagagguauuccacugucccugcacucacauagcccacggucuuggccaggcggauggcacacugugaagaaacagaaagaggccaaggggguuccagaggucuuuucagggaacuguaaauggugacuaucaguuccuucaccaaaugcagacugagcaccugcuacaugugaaauauuuugggacuggccaggugugguggcucaugccuaucacccuagcgcuuaaggaggccaaggcgggaggaucacuugaggccagaaguucaaggccagccugggcaacauagcaagacucugucucuacaaaaauuuuuuuuuaaaauuagccagacauggugacagguuccuguagucccagcuacuugggaggcugaggugggaggaucacuugagcccaggaguuacaggcugcugugaacuaucaucgcaccacugcacuccagcgugggcaacacagugagacucugucucaaaaaagaaaagaaauauuuggggaguucacagaccggcuaauccaauaaaccugugugaugcugaaaucaccucuggaaugggcccucaucccucuuguuaggcacccaugccaccauucagccacacugaccguagaaaguucuuccugacucugagcugagacggcucucucugaagcugcccccugggcucugagaaguguaccugcuccaugaacucgaauauggccagcggggcgaugguggccggugcuuccucaacgaucuucugaugccgccgcuggauggagcagucgcgaccaaacagagacacagcauucccauacuggucagcgaggaucugaacuuccaggugacgggcgugcugggccagcuucaugagaaagaugggcgagccugggaucucacucuguaccugucgggggaagcagagcagccugaucuucauggggaaaccagcucuggaagcuucuggaaguucucaggagagaacauaaaacaaacgcagugauguguuuaggguacucauccaggacucugcugaucuuuuacuuuuguugucucacagacauaauauucuguggagucccgacuccacaguaacgaggagaaaggggccccaggugggggacggccccagguggggaagaacaaugaacaacugcucgagagauggcuaaucacaaacaaccccaggacguaaugaccucacagccccuccuccagcaccacccuauaaaaccucccaccagcccuugccucuuugcagacagauccuucucugcugugcugccuguugcaaucuugcaacauauuuucauacuuccuccaauaaaucugccuuucuuuaccuacagcugucuugguaaauuccuuuaccagcugcaccgccagcccaauagucacuaccugcaacauauucucuuuuuuaagucaaacucugugaaaugguaaaaucucccacagucacauccccuaaagauauugcacuguuaaagaguuugguguccaaacuggcuuucuucuaugcauauagcaacacauacagagaaaguuucuuugaaugaaaaugggaccaaaacacacuaaucugugguugucuuuuucuuccacuuacugcacuuucucagcuagcucucccggguggaaucuaaggacaaacuuacuucauccuguuaagagcugaaaggcauuguuuuauaggcaugucuucuagagauucuuaaagacaaugugaaaaguauucacgugcaaugauuucuaagacaaauuaaguuuaacaaauuugcaauaauguauaggaugaagucaugcaaaaaauaaugaaacaacuguaugaaugucuauguaaaaguauauacagugacagugcugaaaagagccccccaccaucggcagcugcuaauagugguuacaucugagaaaggagaguuggaagguaauggggaaaaggguuuuuccuuuuuuauucuuaacacauggcugacuugacugacucucuacauuaagaacauauucauagugcacucauauaaguaaaauaaaaaagcuugggcaucugugugcacaugagggccugggguaugugggaacucucuauucuuuccgcuccauuuugcugugacccuaaaacugcucuaauaaauaaagucuauuuuuuaaaaagcaaaaaagcuuuaaaaucuguaugaccccuaaugcaauauggaauccaggacugaauccugcaacaggaaagggacauuggugcaaaaacagaugaaauucaaucuagucuggaguuuaccaaacagaaaagugcccauguuaaucucuuaguugcaaaguuauaugaaaaauguuaacgagugaaaccgggcgaaggauagaugugaacuuucuguacugcugcugcaacuucccuuuuaauaucaauucuuccccccacccaaauccccaaaacacuuguacaccccaacagcgauacaaugguagugaaacugcugcuuuauacaacauucacauauuauaccaagagugguauaauuaguaaaacuccuagaaagcaauguacugauauguguuucaaagugcauguaaagugugugcuauuuaacuaagucuuucuccccaagucuuuauccaagaaaauaauuaagaagaaaaaagagcuaaguguuauuuauaguacuaaauaucacauuauacugugguauuauuauucauaauaacaaaguagaaauaagcuaaacauuuaacaaaaaaggaaagguuucauaaauaaggcuauugccacacauaaaauauugaguaaucaucaaaauaauugccaaggcaggaauaacauaauaauauucaugaucuacaauuuggaauguguuaaaugcagagcaaaauuucguguagacugaauacagcucuuuaaaauauacauaugaagaaggucuagaagaaaagcuagaaauauuaaaauagcuuuaagaaugggaagauugucaguauaaauguuuucuaaacauugcugauaacggacauaagguuuuaaaagaggaaaacuagcuaccaguaaguaaaugugcaauucguuccuacaguuaaaauugaucaggcagggcgcagcggaucacaccuguaaucccagcacuuugggaggccagggcggguggaucacucaaggccaagaguuugagaccagcccagccaacauggugaaacucugucucuacuaaaaagacaaaaaugagcugcgugugguggcacacgccuguaaucccagcuacucaggaggcugaggcacuagaauuguuugaaccuggaaggcagagguugcagugagcugagauugugccacugcacuccagccugggugacagagugaacucugucucaaaaauaaaauaaaauagaccaucuagaaacauuagaaauaacaagaguacuaauauuuauaaaauaucccauuccucuauaggccaauauagucacaaacagcuauuuugauccuguaucucugaaaucauuucuagauacacugauuuauagacuugaacuaccuaaaagauucugucaagaucgacacaaaaccaugggcuuuucugaguaaaaauguacgcguuuguugcaaaauacgauacaacgauacauccagcuccuacaaaugucuucuugacugucacagaauaaugcuaagagaaauaaucuggcagcccacaaacaauucccaaagacagaugcgaaaagacacagcaagaacugcucacuugucugaaaaggaucgggaaguccuccgcacucucagccuuccggauucccuucccuccgccaccuucagaagcuuugaucaucaauggaaaaccaauucuuucugcugccugggugcaaaggacaaacagaccucuuuagagguuagccaguugccaacugcuaccaggacagaggcaguucgguucuggcuccccuggcccccacaggcucugcauuuaccuccaagcccucaucuacgucuuucacgcaacccuugucauaaacaucuucugggacacugauucuuuuucccugcugcagaucaucuucuguccacuccacugucaggccuggagagucacaaagaaaccugauuccucccaaauccaggagaaacacacacaacccagaaaccacagcgccucucccugcugacauagugcuagaccugggcuucuggaccagcggaauacagacacucccuucagcuucucacaauggcuuuucauuuccucaagaacuaacccaaccuugaaugagaaaucaagcuuaagaaacuaacugccaggcgugguggcucaugcuuauaaucccagcacuuugggaggcugagguggggggaaucgcuugaacccaggacuuuaagaccaacccuggcaacauagugagaccuugucuuuacaaaaaaaauuuuauaauuagccaggcaugguggcaugggccuguagucccagcuacucgggaggcugauacaggaggaucacuugagcucaggaggucaagacugcugugagcuaugaucaugccacuacaguuuggccugggugacagagugagacccugucucgaaaacaaaacaacaaaaaaggaaagaaacucagacugagucgaccaacaacaaccauauuaaucuaaauccaaaaaaaaaucccaauucuaccuuauggagucauuuauaugugaauaauuauuucccaacaccaugcaaagauuuaacaaaugaaagcaaauuuuccaucccaaauuuaaaauucaacuuuuggggggggaaaaaaaaacaaauuuaauaggaaacuuuugagacgguccuauuuauuuuuuaauuuguccuagaaacuccacuguuaggaauuuauccuaagaaaauuauuaaaaugcacacauaaauuuagcuguaagauuaucaaagcuccauuccuuugaauauuuuuuaaauuagaaaaaauaaauuggaaacaaccuaaauuguuuaaccaugaggacuguuaaguaaauuaugauacauccauaagauauaauccuaugcaggcaucuuaaaugguguaaaguguauuuuuuacauagaaagauauucauuagugaggaaaaaaaaagucacaaacuaggaaauguaagauggguuguuguuuccuuuuaaagacagggucucaucacccaggcuggagugcaguggugccaccauaguucacuguaaccucgaccuccuaggcucaagccacccuccugccucagccuccucaguaguugggacuacagguaugcaccaccauaaccaguuaauuuuuuuuuuuuuuacuuuuucuggagauggggucuugcuauguugcccaggcuggucuugaacuccuggcuucaagugauccuccucccucagccucugaaagcacuggguugggggguuggguuacagacaugagccacuggccaagaucugucuuuuuuuuuuuuuuuucccaaagaauauggccagaaaaagguuggaaagguagauaccuacaauguaauaaauguucaacacugggucauaggauuaugaaugauuuccauuucuuuuuuguacuucuuguauuuucuaaauugccuacaauaaauuauaccacuuguuuacuaauuuaaaauuuuaaaauauuuugcuaaugacuaaaaaauaaaaguaaguaacauuuguaauggaaagaauuguuacaagcauacuucugucacccugaccguucacauuaucaagacugggcugagaagcucccccagagggaagcucggggucccuuaccgcuuccacuccagggcaggguugggaccuguagcgucugggcgacaacgguggaggcgaucuuaucuccuaaggcccacauggccucacugggagggccugaggaaucggggacaagaagggaagcagaauccggucagucacaagacccucgaggcugaaggccgaccgagugcacggugguggggccagguaaggagcagaugacagagaaaauucucuggucccagcucucaaggagcuuaaccucaugucagggaagaaaaauaaucuguuagucugcuauugcaucagucaacuuucaacguauguggauuguaaaccuguugugaguuacaaccuaggcuacaguggcauauacaaaauucacuuuggagggaaggcagaaagcuagaucaaagagguaagcuaggagcucaaagagcuggaccauagguuagcaaacucuuucuauaaagagccagaugggaaauacuuucaguugugcgagccugcaggucucugucacaaugacucaacuuugccaguguugggugaaagcagccauaggcaauacauaaacgaauaagcacgaccauguuuuaauaaaacuuuauuuacaaaggcaagccauaggcuggauuuggccuaugagcuguaguuuguccagugggcuggaucaucaaccuccagaggaauuaagacugauaaugagaguccuggguaacugucagacaggacagaugcccacauguacucagaguccacagacaaagaaaacgucaaugggcaugggacucccggcuguaccucaggugaauaucauguauugauccgcacugaguugcuucacauuugggcaagacuguuuucagacccaccgguaaggagaagcagggauuuauuacaugauaguaaaugauuccccuaaacuacacaaggacauggacauaauuacaugugcaaauuuguuauauagguaaacuuaugucacagggguuugugguacagauuauuucaucacccagguaccaagccuaguauccaauaguuauuuuuucugcuuuucucccuccucucgccuuucacccucaaguagugucugcuguucccucuuuguguccauauguucucaucauuuagcucccacuuauaagugagaacauuuaauauuugguuuucuguuccuguguuaguuugcuaaggauaacggccuccagcuccauccauguucccacaaaagacauaaucucaguauuuuugauggcugcauaguauuccaugguguauauguaccacauuuucuuuauccaaucuguuauugaugggcauuuagguugacuccaugccuuugcuacugugaauagugcugcaauaaacauucguguucaugcgucuuuauggucgaaugauuuuaaauuccucuggguauauacccaguaacaggauugcuggguuaaacgguaguucuauuuuuggcucuuugaggaauugccucacuguuuuccacaaugggugaacuaguuuacacucccaccaacagugcauaagcguucccuuuucuccacaaucucagaaucugucaagaaaugguaucucacucugguuuugacuugccuuucucuaaugaucagugauguugagcuuuuuuucauaugcuuguuggcugccugugugucuuccuuugaaaagcgggcagcuccuaauuccaugaguuggcagauuagcuaugugcccuuccacccugggacucacucacuccucacgacagaagugugaggugggaaaucaaacggaccuccgcuuuacaggacaggaggagaaagagggucagacccagcagagugucccagcaauaccccaauucccauguaucugauggggacacacucuaccuaagaaagcaacuccauucuugcacagcagcuccggaaguuuaggguuuucugaagcauggccccagccagcccacaccgccugcaaacacagaaaggggugagcaacaaucuuccuucaagaauaugccucccagccaggugcaguaacucacgccuauaaccccagcaguuugggaggccaaggcaggaggaucacuugagcccaggaguucgagaccagccuggccaacauggcgagauccugucuauaaaauuuuuuuuuaaaaacagaaugugcuucgccucacuugaacacucuuuucuguguuacaucagcccaggaauuuggagccuugugggaucuggacccuccaccccuugugaacuguggaauugaacuagaaccuaggggcaucaucccacacucaggggccacacuugggcaccccaguccaucuaccugcacggggauucucuuggcaauguccacaaucagcuccacguuggcauaguuguuguuauugggcccuccugggacggggacguaaugauccgccaucuugauguacucugaaauuaaaugggagggagaaggaaggaacugcugacagacugacaucaauggcagaacauuacaagaugugacuauguacagccauggaaagcagaaccaugcagauuucuaugguaacaauggacaaacauguaugaaaauguaaagagaaggccaggcgugguggcucacgccuguaaucccagcacuuugggaggccgaggcaggcagauggccugaggccaggaguucgaaaccggccugggcaacauggugaaauucugucucuacuaaaaauacaaaaauuagccaggcgugguggugggcaccuguaauccaagguacucaggaggcugagguaggagaaucgcuugaacccaggaggcggagguagcagugagcugagaucacaccacugcacuccagccugggugacagaacgagacucugucuaauaaaaaaaaaaaagaaagaaaauguaaagaaaaugaaauaugauuuuaauuaugugauacagauauguuucuggacaaggccuggaaggccuggaaaggaacgaaggaagaaggaaguaaucugucaacagacugggauuagagguggguuuuuaaaaaaaguccuauuuaaaguuuaucuuaauauuguuuuaccauuaaauaauauaauagggcugggcacgguggugcacgccugacaucccagcacuuugggaggcagaggcaggaggaucacuugaggccaagaauucaagaccaguuugggcaacacacagagacuuugucuccacaaaaaaaaaaaaaaaaaaaaauccaaaaaaaguagccaggaaugguggugcaugccuauagucccagcuacuugggaggccaaggcaggaggaucacuugagccuagaaggucgaggcuacaaugagucgugaucaugucacugcgcuccagccugggugacagagcaaggcccugucucaaaaaacaaacaaacaaacaaaaauacaauacagaguuuuaaauuaugguaaaaaaaaaaacacacacaaaauuuaccaucuuaaccauuuuugaguguacaguucaauagugaaguauauuuauauugugaaacagauguccacaacuuuuucauuuuaugaaucugaagcucuauacucaugaacaacucccuuucucucccucccucauguccuuggcaaccaacgaucuucucucucucuaugaauugcacuacucuaguuaccccuucuacauggaaucaugcaguauuugucuuuuugugacuggcuuauuucacuuuuugugaccagcauaacguccucaagguucaucuguguuguaacauaugacgggauuuccuuccuuuuuaaggcugaacauaacgcaauguuuugauuuuaaaauacucaugcucuuuaagccagaaguuccaugucuaggaauauguccuuaaaaaaacacacgcuggcugggcgcgguggcugacaccuguaaucccagcacuuugggaggcugaggcgggcagaucaccugaagucaggaguucaagacuagccuggccaacauggugaaacuccaucuccacuaaaaauacaaaaauuagccagucguggugguacaugccugaagucccagcuacuugggaggcugaggcacaagaauugcuugaacccgggagguagagcaagacuccaucucagaaaaaaagcaacaacaaacaaacaaacaaaaacccacacaucaaugaggccaaagucagagaacagccacugagcaguguuuuggacuaggaaaaguuagacucaauccaaacacagggguugggacaucuguacuauagaauugcuaagauccugaaauugaacaauguggcacuuuauaugcaaacacagaaagaaaucccagagcagcugcuccuuccggccugccugccuccuauguuuaucaaacacagaagugucggccaacggggagauuccagagaugaugaagugagcggccagacaggcuuccugguccuuguccaguuuuucuuuuauguuggagaagauaaacaagaaaauaaacacaauaacuacagacuccggucagugcugggaagaaaauaaaugagguucucugagagagaugcgaugaucauguugagaccuacaggcuggguggggagggaguccacugcacaaagggcucugggagaagcaccuucaauagagguuccagcaggugccaagacucugcaacaggcccaggagcuaccagaggucagggugacugguacccggcugauggagggcaagagguucaagauggagccaggaggggacuuaauaggccugggugacaauuuugaauuuuagacuaaccaagaugggaggacccacuggaugaugcucugaacccagaccaggguucccaucccacccgcaucacaugaugguugugugacccuggacaagugauaaauucacaucccugugccucgacugugccaucuguaaaacagagcuguaaguaacaaaugaggccaugucugugaagagcuuggggcaggaaggcuuaggggauggugcugagguugcuaauauugggaacagcacacagccucugaugcauuuuaaggagaagcacaaaaagaccugaagaccugacuuauguugguuuuuguuuugcuuuuuuuuuuuuuuuuuugagacagucucacucugucgcccaggccgcagugcaguggagugaucucagccuacugcaaccuccgccuccuggauucaagcaauucuccugccucagccuccugaagagcugggacuacaggcaccugccaccaugcccggcaaauuuuugggagguauuuuuaguagagaugggguuccaccacauugggcaggcugaucucaaaacuccuggccucaagugauucgcccaucuuggccucccaaagugcugggauuacaggcgugagccacugugcucggaccugaguuaugcuuuuagguuuauguuguuuuauuugagacagagucucagucuguuucccaggcuggaaugcagcgguguaaucacagcucacugcagccuagacccccugggcugaagcgauccucccaccucagcuuccugaguagcugagacuacaggugcgugccacuauacccaguuaauuuuuuuauuuuuauuuuuuguagagacagggucuuauuauguuacccaggcugcucucaaacucaagggcucaagcaauccucccaccuuagccucccaaagugcugggauuacaggggugagccagcgcucuggcugagguuuuuguuuuuaacaaccuucagaaaauacagcagaagaaguuaugcuuuuaaaaggucacuuuggcugcuguggggaguagggccuauaaaaggauaagacuguucaggaaaaaaguaaaucauccaacaguuguuuauagaaugauucauuauaauaaacuuaggcaaaugaacggaagaaugaacaaaugauugaaauacaauuacauacaccugcaggagaaacagcccccaaucugcuagaacacagacauuucucaaagaucgaauuuccucucugcauguuaaccaucugcauuuuuguaaggcacaugaguuguucuugaugucagcagacauuuuaauuaaauaaagaaggaaggacaaauaaauacagacucaugagagguccugaccaucgggaguccaggauggacuugccuaggcacaggggaaggaggcgagggcaggcaaggauggagcgugaugggaggagagggucaaggcccagguaccugcguuggccuuaagguccucgggggucaccaucacaacaaaccggauggcccgcucguugcggaacaucucauaggcccaccugcggauggagcgcaugcacuucacggcggcaaucccguuguuggcaauaagcaccugcaugggaagacaaggaaggagcuguagaugcacaucuaccugcgcugggggccacgugcuaccccgaguccaccucacagcugcagagccuccugcagcccccgcagcacaucauuccucuugguauuucuauguauuuccauggcacacaccccagcacagagcaggagcucaaagucugccauccacaugaauggaucaucaaauggauggauggauggauggcuguuugucugaaauauauauauauauauauauauauauauauauacacauacauauauuuuuuuuuuugagacagagucuugcucugucacccaggcuggaguacaguggugcaaucacagcucacugcagcuucgaccuuccagcuucaagugauccucccaccucagccucccgaguagcugggacuacagguguacaccaccacauccugcuaauuuuuuaauuuuuuugcagagacaggauuuugucaugucguccaugcuggucuugaacuugaacacaaacccaggcugggcccaaaugaucugcccaccucacccucccaaagugcugggauuacaggcaugagccacugugccgagcccagugaaugauuuuuuuuuuauuccuuuggugucauugugaucacccuuaacacuuuuugaguguuuuacaguacaauguguuuuaccugucuuauuucauuucauccucacaauagcccuuugaaagaggcuucacuauuauuucuauuugaggguuaaacuauuaaaacucagaggagcguggcccucacccccucucugcagcaggcagaaugagccugaacccgaaucucccaccuccagcugagaggaggggccccugcaccccaaucggaccccacccagagugccgagacccaucuguaccuucucgaugacccgaucccccccaaagcgugugacaaacucagcgggagaagccacgguaaagucucugugcagguccagcuucuuguguucccguccccucuucaccagguggagucccgacaugcucggccugcagaauaagaaugagggacagacgugcaugagggaagaagccugggacucagagcucggcaccuguaaagccaguggagcagaggagccaaacugcaccagagccccccugcuuugcacuugcucuccagagccccugaagcaauuuacaaggaggcucaagggcaggaagcaccuucgguuuuuuuuuuuuuuuuuuuuuuuuuuuugagacgggaucucauucugucaccuaggcuaguaugcaguggugcaaucguggcucgcugcagccucgaccuccuuggguagcugggaccacagagggcacuaccaagcccagccgacuuuuaaacauuuuuguagagauggggucucacuauguugcccaggcucguccaaacucuugaugucaagugacgucaaagccuuucaaagcauugggauuacaggcgugaaccacuguacccaacugaaagcaccuuaagaggccagcuaagguaccagcacaugaacuagaaggagcaguuucuucuaccugucccaagguggauguuuagauuuuuaauccuaaguuaauuuuuacuuuacaugcccauuguuuaggaaccugaauaauacuaaaaaacuuauaacaagggugagaguuuuaugaucagggaagaaguccacacauucuaaucguuccgacuuguuacaugguauuaauaucuuucauguacuuuucuacauuuguauuucagaaguuuuuaaguuuucuuuuuuguagagacaggggucucacuuuguugcccaggcuggucuugaacuccuggcuucaagugauccucccaccucggccuuccaaaauacaggcaugagccaccacgcccagcccacaaaauuucuuuagaaaacugaaaacaauuuuuuaaauguuuaacaacaaaacagguuuccugcucugucccuccacaccagaggaaacugaugcugauuuuuucuagcaauuacacaucuccauaguccuaaacaacaaguguaugcaaucuugugagucauccaugugagacagcaucuauggccuucccauccugagagaugugaauuuaguuaucucacaaggccaccccaucggcuccccuccaccagcuggucaauaccauagaagucuacuguaauuuagcaaacuggguauucaauguuuuacuuguuugugaucauuauucacauaugaaguuugugaucauuauucacauaugagagcugcaguguaccagauuuuaguuccuuucuuuuugccuuuuccuggaguuaaugauuuuuuuccuuuacuuaguguuccuuguaccuguugcuaaaucaccccacuccuccuaauagauucccaguacacauaagauaauugaucaggccacaugcaguggcucauaccuguaaucccagcacuucgggaggccaaggcaggaggacugcuugagaccaggaguucgagaccagccugggcaauguagcaagaccccaucucauuaaaaauaauaauaauaaauaauugaucaguucuguuuuuuuccacuggugacaucucuccugaaggccucuguucuccuuccguagguacuggcuguccucuaggccccuacaucaccauuguuuuggggcuucccuuugcugacaucccuagaauucccuuugccuuuccuugggguuggauuccuaauuugggggaauggguggcucgucuuucuugguagacucccuuguuuugcuggggcauauccuccaguaguuucauccacuuaagaagaugguagaauggcaaggcgcaugacaaugaugcccucaauuucccugcccuauuccugacugggcuuccuuaucaccaucacccuggagacucccuuucagucuauguugaaucuccuguuuccugucuccuguguguugcucuuccuugguuuacccucugguuucaguggaagacauccucaaguagcuuucuaagaaaggcuauucagggccaggcgugguggcucacaccuguaaucccagcaccuuggaaagccgaggagggagaauugcuugaacccaggagguggagguugcagugagccgagauugcaccacugcacuccagacugggcaacagggucagacuccaucucaaaaaaaaaaaaaaaaaauuuaaauuagcuaggcaugguggcaccugccuguaguccuagcuacucaggaggcuaagguagaaggaucacuugagcccaggaagucaaggcugcagugagcuaggauugcaccauugcacuucagccuuucuccugcccucacauucaaccuuaccacuuggcugugugugaaaugcuaggaagggccaggcaugguggcucaugccuguaauccuagcacuuugggaggcugagguggguagaucacuugaggucaggaguuugagaccagcccggccaauauggugaaccccaucucuacuaaaaauacagaaguuauccagacacagaguugugcaccuguaaucccagcuacuugggagacugaggcaggagaauugcuugaacccagagaauggagguugcaguaagccgagaucgcgccacuggacuccagccugggcgacagagugagacucuaucucaaacaaaaagaaauuucaggaaggaaaaccuucuucaaguuuuagaagccuugugccauuguguuguggcuuccaaggcugcuagaacaagaguaauucugauccuugauccuuuguaggugaccuguuuuuucauauccagaugcuuauaggagcgucccucuguccccagaacucuaugauuucacagugaugagcucaaguaugugucugcuuccaccaaugaggcugcacaucucucaggcccucucaaucuggaaacuuccauccugggaauuugucuucaaauacuuccuugaugggcugaacaugguggcuuacgccugugaucccagcacuuuuggaagcugaagugggaagaucacuuaaggucaggaguuagagaccagcuuggccaacauggugaaaccccgucucuacuaaaaauacaaaaauuagccgggcaugguggugugcaucuguaaucccagcuacuugagaggcugaagcaggagaaucacuugaacccaggaggcggauguuguagugagccaagauugugccacugcgcuccagccugggcaauagagugagacuccaucucaaacaacaacaacaacaacaagaaacaaauacuuccuugaugauguccuugccucuuuuuuucucuauuuuuucccgaaguccuauuaucuggauguugaaauuccuacacuggccuacugguuuaugcauuuuuccccucuccuauucucucucuucuucuacuugcugguugauuuuucucagccucaucuucuaaacauucaguggaguucuucauuucugcuaucauguuuuugaugucuacgagccuguuuuuggccuacaaauguucccuuuguuauagcauccucuuccuaugagugcaacauccugucugaccucaacgaugauauuaaugagagcuuuuuaaacuucucuucuccagcgugguuucuguuucuuccaagcuuccugugucuacugguuuggaccuugacuuacauaugagaaacuggaccucagggccgggugcaguggcucacgccuguaaucccagcacuaugggaggccgaggcaggugaaucaccugaguucaggaguuugagagcagcauggacaacauggugaaaccccaucucuacuaaaaauacaaaaaauuagccgggcuugguggcgugcaccuguaauccccccuacaugggaggcugaggcaggagaaucgcuugaaccugagaggcggagguugcagugagcugagauugugccauuacacuccagccugggcaacaagagcaaaacuccaucucaaaaaagaaaaagaaaaagaaacugaacccaaaugucagggaagccuugguuccaaccuugugacuaugagugagaacagaauuucugagacugugguggaccugguugacccugagcucaauguagggugagguaggagugcguuggggauccccugagucaguaucuuugugucuuucucucucgcuggccagauuccccagggagaaguuuuccagucuucugccuggacaguaaaggucagccuggagccccggggggaacggggaaguucuaagaauucagcaccuauucagacccuuaucuuccuauuugggauacaggccccaugcccucaacugugccugucgauccccucucccaagacccucuauauguaccuuugaacugcugccuucuguuggggucgaaguggacagccccugccgcaggagacaggggaggggaccugggagucuuccacccuguccuucucauuuugguacccuccuuaccccucagcuccaggggcaucccuugcugccagacacuaugccuuuuggggguucugugguacagauggccagggguccccaacuuuccucacugcuccauuaggacucagccuuaagccagugaccacucauucaucugcuuucuagcuucuaaaagguuaaugcuacgcugggcacgguggcucacgccuguaaucccagcacuuugggaggcgaagaugggcagauaacuugagggcaagaguuugagaccagccuggccaacaugaugaaaccccaucccaacuaaaaaaacacaaaaaguagcugggcaugguggcgcacgccuguagucucagcuacuggggaggcugaggcacaaaaaucacuugaacccgggaggcagagguugcagugagcugagaucacaccacugcacuccagccugggcaacagagugaaacucuaccuaaaaaaaaaaaaaaagagaacuucauuuauuuacaaaaaaagguagaugcaacccaagggacaucauuuguagacagaccccugaucugggggaaaaaaaugcuaaaguauuaagagccguuaucucuuugcuauauuuuaaaaaauguucugcaaugauguguuauuuucaauaagaaaaaagcuauuaauuuuguaagaggaacacccauguauacauguagguauacacacacacacacaccacacacacacauacacacaaaagaauacuacugagccauaaaaaauuauauauauauauacaccaaauuuucuguaucuagucaucuguugguggacacuuagguugauuccauaucuuugcuacugugaauagugcugugauaacuauacaaguacaggugucuuuugauauaauuauuucuuuauuuuauuuuauuuuauuuuucugagacugcgucucacucugucgcccaggcuggagagcaguggcauaaucucggcucucugcaaccuccaccucccagguucaagcaauuuuccucccucagccucccgagcaacuaggguuacaggugcccgccaccauguccggcuaaauuuuguauuuuuaguagagacgggguuuuacacguuggccagaguggucuugaacuccugaccucaagugaucugccugccucagccucccaaagugcugggauuacaggcgugagaccccacaacuggacuccuugcuaauuuuauuuauuguuuucaaccaaucauguuaagauccucccaaugaaaagcgaaucugacugagugauuucuuuuccuuuguguacauacccaguagugggauugcuggagagacuggcagaucuauuuuaguuccuugagaacucuccaaacuguuuuccacagagguuguacuaaucgacauucccacacacagccgcaccccucauucuguccacgaccuucccugacuggcuggcuugaugguucagcuucagaaagucugagacaucccauuucuacacacacaaacauuaaaacucuagcaauuugaccuaaagcacaacaaagaaaaacuucauuuguggccuagggggcaaaaaaaccauucuuggccaccauguugauuucgaaacuggugacagagccccuccaucaggcaggccacaagcccauuaccgcaggcuaggcaagcgaacacacaaagcugccggacuggccuuguuucaggcccaaucuccaggcaaguggcuauuuuaauucuuuuugauaaagcuggaagccaaccaacauuggcucuagagagcugaccuucggccagcauuugcuuccacugaaggaggaucauccuaagugccauuguccagugagaagcccuguccuuauacagcacggcaagggugagagcugaaauguuucaaggugacuuuggaaaugacuucagguacaaucaacagcagaggugucagccaaacaccaaaugcagucagcugccggagcacaagaccaggcagaauaguaucaggaauggaggaaauaaacauucucggcugcccacuauggacugggcacagggggccucucagugaaucuccacagcccuguauggaggagucugucaucuccagguucacgaugaggaaaccgagguucagagaggaccauuuaccuccaguuucacagcuggcaaguggcagagccccguuucaaauccaacucuagcugaccucagaaucuaacuucuaggcagaaagacaaucugagauaaauggaagccccucuauuaacuggacuuuuaaaacaugcauuacacauauggccucuuauauuccucucaaauaagagacaaacauguauaaugcugagguuuuuuguuugguugguugguuuuuuuuuuuuuuuugagacagagucuagcucugucacccaggcuggagugaaguggcaccaucucggcucacugcaaccucugccucccagauucaagcgauucuccugucucagccucccgaguagcugggacuauaggugccugccaccaugccuggcuaauuuuuguauuuuuaguagaaaugggguuucacuauguuggccaggcuggucucgaacuccugaccucaggugaucugcccaccuuggccucccaaagugcugggauuacaggggugagccaccgcgcccagcccugagugcuuaacugggggaaauuuugcuccccggggagcaauaccuggagacaucuuugauugucacaacuugggggaugcgcuacuggcaucuaguggguggagaccagggaugcugcucaacacccugcaaugcacaggacagccccacaaagaacuggacagccccaagugucaacagagccgcaguuuagaaacucugguagacugcggccauccuccuaggcuuugaagccagaaucuaccgcuuauaaccuguguaauccugggaaaguuacuucaauacucccugccucaguuuccucacaugauggaauuaacaguuuaucccuggaccuagccaaaguaaacagcuugcaacacuuuagcuaccauguacgucugcaggauagcauuacaggagcccaggcugggccauuaggcuagggccccggcauuaaucagaccuucaauuucuucccucucuuuucuucuauaaaauagagaugguaacggcuacccgcacugcuaagagcugauucugagccaggcaauucuguaauuacaacuacuuccaaacaagaaagcaagaaagaacacuguguagcccaguaaagguugauaucguucaaacagcacaaaaccacgcucuccagaaauggacccuuggaaauuucucaagccaccugccccaucaguacccccugggaugacuaccuuggcuaggccaggggugagugggcaaacuaggacccaugggucaaauccacucggccaccuguuuuuguaucucccacaggcuaagagcgguuuuaacuuuuuagauuguuuuuuguuuuguuucguuuguuucgaaagggagucuugcucugucgcccaggcuggagugcagcggugugaucucagcucacugcuaccuccaccucucagguucaagugauucuccugccucagccucccgaguagcugggacuacagaugugugcuaccacgcucugcuaauuuuuguauuuuuauuagagacaggguuuuaccauguuggccaggcuggucuugaacuccugaccucagggcgaucugcccaccuuggccucccaaagugcugggaccacaagugugagccaccgcacccagccuuauuuguuuuuuauagagacagggucucccucuguugccaggacuacagugcaguggugcaaaaauaguucacugcagccucaaacuccugggcucaagugauccucccaccucagccuccugaguagcugggacugcaggugugcaccaccaugcccaacuaauugguuuauuuuuguagagacgggguuucaucauguugcccagacuggucucaaacuccucaagcaacccuccugucuuggucuucuaaagugcugggacuauagacauaagccaccaugcccagccaacauuuuuaagucaucgaaaaaaaaaaaaaaaucaaaagaauccuguuuugugacacauaaaaauuauaugaacuuugaauuuccccaucuauaaauaaugucugauugaaacacagccaggccuguucaauuacauaacuauggcuucuggugcaggaaacagcagaguugaguaguuacaacagagaccacauggccacaaagccaaaaauauuuacugucuggccguuuauaauagcagucugcugaccccaagcuaggcacgaguuuucaacccugacaugaaaaacuuuauaagauucugaugucggggucccaucagcaugucuaggggguagaggugggguccccggcauccagauuuuucaaaaaucuccccaccaggaaauucuaauguguagccaagagugaaaaccccugauaggucuacagccaauauuugcaugcaggcagcuggccuuucagagcagaauugcauggcagugaaaugggacucauuaaaaaacaacuucugccuccucauccccaacuuuauuucaagcccuucugcacucugauccacaaucauuucucuacucucugaacugugaccccguucucaugccaugaaaaaucagucaucauuugcgaccucaccuucucaggaguucuggcuucuuagauggcccgagccuucagcacaagaucccaaaugccucccaacuccagagggcucuuucauaaccgaacucugucuuuacuuauuaguuuucaucaauguuugugcugacccagggcaguacucaagaccagcgacuuccacacagagucucaacggaccaagaaagagccgggcaugguggcucaugccuguaaucccagcacuuugggaagcugaguugugaggauugcuuagcucaagaguucaagaccagccugggaaacauggugaaacccugucucucuaaaaaauacaaaaauuagcugggugugguggcgcaugccuguggucccacuacuuggaaggcugaggugagaggacugcuugagcccggaggcugaggcuguaaugagccaugaucaugccacugucugggcaacagagcaagacccugucuguaauaauaauaauaauaauaauaauaacaacucuagaaaggccuaugagggcuagucccuuggacagauguggaaacugagguuccaaggcuugaugguaccugcuccagaagaucacacagcuugguggcaaaguuagaucguccaaauccaucuuuuuagccacucuaagcuaagagaggaacaauguagucccccaacaaaguauguccauauuauuauaaauagggggaccccacguccuggacuugcugggacaauuccaaauuugugugagguuuuucuuuuuuuccauuaaagugguuugugaaauggguacaacacucuccacuuagugcccccacagugguauuuugaagauggcaugagaccacaccuacaaagcacuuggccuggcauacugaaagcaccccaugagugguaguggcuauuacuguugcacccaucagccucgaauuggaguuacugagaagacaucugccuuccacaauggaaccgaaguuccuggagggcggaggucacgguuuccaaccauuuuugcgacccuuccugcuaccaguugcaggccuuaugcaugggaggugugcaugaauguuuauggaccagguaaacauauccuaagaaaauaaaggauggaggcagagauucagcuacagggguauuccucacugugcuguugauaauagcccccccccaaaaaaaaaaaaaaaaacagagagaaacagccugaauauccgcuacuuauaggggauuacuuauacuuuuuuuuuaagagacagggucuugcucuguugcccaggcuggagugcaauagcacaaccauugcucacuacagccucgaucucccaggcucaagcaauccucuucccuuagucuuuccaguagcugaaacuccaggcaugcaucaccauccucagcuaauuuuuuuuuaaguagagaugggggucucacuauguugcccaagcuggucucgaacucccgaguucaagcaguucuccugccuuggccucccaaagcgcuaggauuacaggcaugagccaccacaccugggcacauuuuuuuucagagauggggucuugcuauguugcccaggcuagagugcaguggcuguucacaggaacgaucauagcacacugcagccuccaacuccugggcaaaagcauccucccuccucagccuccugaguauuugggacuacaggcuugcaccacccugccuggcgaggauuauucauacauuuuaaggugcacccauuuaaaggaacacuaugaauccaguaaaagcauguuguaggcagggauuggcaaacauugucugucaagggucaggcaguaaguacuuuagaucuggucagucucugucccaccacucaaauccuccagugaggcacaaaagcagccaugaacuaggcauaaaucauaaaucgaugagcaggcugcaguccaauaaaacuuuuuucguagacacugaaauuugaauuucauguaauuuucacgugucacaaaacaaucuucuuuugauuuuuuuuucaaucacuuaaacaugaaaaaaccauucucugcuugcaggccaucccaaaacaggcagugggucauaguuugccaagcccagugguagaaaaauacuuaauguugaaugaaaaagugaguuacagaacguucugcaugauucaaguuuauaaauuaaaacauaucugcaccggaaaaaaaaaaaagcugaagaauauacaacuguuaacaaacaucacagggguggaauuaugggugauuuuuguuccucuuuuuugcuuaucuauaauuuucugaauugucaacaacagacacaccaucaauuugguaauucuuuuuaagugcaauaaaaugaggacaaaaaaggaaagaaacaaaaccaaguagguagagcuacaaagcacucaggcacugagaugccuacgcucaucugcucagaaaaugacccucaaugagagccugcucaaguucacgucgauuugcccaggcuucagcuucaaaagagaccugccuuccacaaccaucagcuucuggaggcgaaggagagaaagcggggaaggcgugccccugcgcaagggcugaucuuuaggcaccugugugcuccgaagcgaccuccuccaagcaacgucacccccaacguccagccuccuuccuccccucccgccaaggccagcuagaguuuccaaggcgggcaucaucuccccagcagccaacucaagcccguguuucuuuggauggggguggggguaaagggggcggugcuaagaggacacacagcuugacuucaaggggaaggaagacugcguaaguuuguaaaagaucauggucauuacaauugcaggcuuacuuacuuuacuucgcgaucagggaaacagaucuugcacuuggcaggacucauguugaccaccccgcaggccaaucccaccgggcucccgcaggggugcagagcaugcaccccuuaaccgccugaagccgacccgaggcccgggacccagcaggacagccaggucgcgacccggaggccgagaugcaguccuagagcgccgcgggcgggguucugcugcagccggcgggcgcccaacuucgcgcugcgcuugcuccaucccgaaaugcacccugcgcgccagagucccgggccaucgcgcccgccuaggccccacccaggccccgcccccacaccgaccccgccccaggagggccccgccuuccggacggagccccgcccccgggccggccuaccuccgacccgccgcugagcuucggcagccgaaaugagcugcggagauauauauuuuuaaagccucucuucugcuuugcuccccaauaugggacaccccuacauauuggcagcaauugauaugcuugaauacacacacgauagggaagcgguggaaaauaugggaaauuuaaaaugugagucagaggucgccacugugcccguuaaaagucccuguugucaagucgacuuuuauuucccaaaguccugguuucucucaucuuuucaccuccacucccugggacagguggcugcgcaaucacccagugugcuucuagcacgcacuuugcaccaccuggguccgcuacugaagcgagugccuccaggacagggaggaccccagcagcccggugauccgaaauaaacuucugguaagacuaacauuuacuaagugcuccuuuguuccucugugucacuuaauccucguggcaaucuuauuguuuuuaucccuauaauacagauaaggaaacuggggcccagagaugcauguuaucugaagugccagagcccagggucuugaacucagacaaaccgauuccaguuagaauaaacgaaugaggccgggccugguagcucaugccuguaauaccagcacuuugggaggcugaggcaggcgcuugaggucaggaguuugaggccggccuggccaacauggugacacccugucucuacuaauaauacaaaaauuagccgggcaugguggugcacaccuguagucccagcuacucgagagacugaggagagagaaucacuaaaacccgagaggcggagguugaagugagcccagauggcgguacugcauuccagccugagugacagagugagacuccaucucaaaaaaucaaaaauaaaugaaugaaugcuucuucaaguaauguaauaaaugcaaagaaccaaaacacuaccuagaagucaucgcaguaauaauaaagguagccuacuuucauagccaacaaaccaaccaaaaauaauguaaaugcuggccaguaaauucccuucuggguaaucacucugcgguucucccaguguacacauuaauuaaauuugugugucuuuucuccaacuaaucugccuuuuuacaaguuaauuuuucagcgaaacuucagagggcaaagcagaagauauucccuuggucccuacaaucauuaugcauucuaugcauguaacaaaauuuuacauguauccuauaaauguguaaaaauauaauguaucagaaucaugaaaacaggccaggcaugguggcucaugccuguaaucccagcacuuuggggggccgaggugggcagaucacuugaggucaggaguucaagaccagccuggccaacauggugaaauuucgucucuacuaaaacuacaaaaauuagcugggugugguggcgggguggccugaagucccagcuacuccagaggcugaggcaggagaaucacuugaacccacgaggcagagguuuaagugagccgagaucaggccacugcauuccagccugggcaacauugcaagacucugucucaaaacaaacaaaaacaugaaaacaaauuuuaaaauacaauuaaaaauucacuucacaggaaggccacgugcaguggcucacaccuguaaucccagcacuuugggaggccgaggcaggcagaucacuugaggccagcaguucaagaccaaccugaccaacauagugaaaccccaucucuacuaaaaauaugaaaauuagccagcgugguggugcauaccuguaauuccagcuacucaggaggcugaggcgggaagauuaccugagcccagguagcugaggcugcagugagccaugaucucgcuacacuccagccuggggaauagagcaagacccuuucucaaaaaaaaaaaaaaaaaaaaaaaaagaaagaaagaaagaaaaggcacaggcagggccacacuucccgggggugccaaguacuuggccacaacauaaacacccugggccccuguuuaagcagccaugccugacagcaguggauagcuaugcccugaccauauauuaaauaacauuucaacaacagguuuaagaaaaaaaacagauaaacaaaauucucaguucuucaaguuucugggaagguguucacagccuugucuucaccuccuccaaaaaaguaacccacuguauccugauuuuuagagauucaaaccaaaaccaacaaguauucaucccccaaauauccccaguguaaauguaaccaccucaaaauagggaaagcaaugaaaaucaagaaaugaagauauuucaaaauaccccaacccuaccaaagucaguuaggaucaugcagaagagaacugcuugccagcauacuuguauugcucuagauuuuuauucucuauugcaaaaaccccaacacuacuuaaacacuguauagauauucucacuucucugcuaauacagccugaaagacagccucacacaucucacuaugacccagggucucaaauaagggauuucauuuagaugggugggcucaucauuucaucacagugaucaugaccuugcauuuuucucuaauugcauuauuagggaauagaagacggaaagaaaugaauaauauucagucggugcaaaacuaauugcaguuucugccauuaaaagggauugcaaaaaccacgauuacuuuugcaccaaccuaauauccaccuccaagcacaacaccaccuuuauacaaacauccauuguugugcuuuuugaugaaacaguucaagcauggugguaguugcugucucaugcauuaagcccuuccucucagacuuacuagaagcucaauuuuacuuacugguauugcagagggaaaacccaggucaaugaacaauacacacacaaaaucaacaagaaaauccgcaugcauguggccagcagcgugguagaaagacugugccauccaugggcuugaacuuacccuuccccucacggaugaccuuaaguaaaucccgucucuccacuuccucaacuauaaaauuauccacauacaauuugccuucauuuuugcagaaaagcaaaaugaaauaaucucuuucaauauauggggugggggggacuguguuacauuaaguauagagcagaagugaauaauuuuucuaaaauagggcaaugaugcuuaagggggaggggaauguaugaaugguuaguugcucuguaccuuguauuaacuuaauacaagaacaacucaaagacagggauccucuuucccccaagcuccuagaaaacauuuuaggaggccgggcgcaguggcucacaccuguaaucccagcacuuugggaggccaaggagggcagaucaugaggucaggaguucaagaccagccuggacaacauggugaaacccugucucuauuaaaaauacaaaaauuagcugggcaugguggugcaugccuguaaucccagcuacucgggaggcugaggcaggagaauugcuugaaccgggacccgggcgguagagguugcagugagcugaaauugugccacugcacuccagccugagcuacagagcgagacuccgucucaaaaaaaaaaaaaagaaagaaaaaagaaaagaaaagaaaaaaagaaaaagaaaaagaaaaaguaaacauuuuaggagcuaaagagacuugaaaagagaguuucucccagccccuuccuaagucaauaaaugaauaaauuaaacauuacaggaagauccuuggcauuucacucaggggcgcauaaaaauaugcauagacaauuuaguuuccugaccuguuccuugcuuggagccgauaagagaugugggcugggaugacgaacaagcagcugggaggcugcacugcaagcccacccagucugcuaucugggaaagugggggcgaugccaggucccuggugucagcucccuuuccugguauuccuucaccuaccuuugccugcagggcccccucuguauguccagaccccacagagccucauuugccuuccugggauccaaggucugccuugcuaaacuguucuuaccucagugaucccaacauggucguaaaugguggcgggaaggaacacuucagcacccaucugcuguuuuggacuuuauccuuuuaucgggacacuucaccugccuuuucaauccucuuccuccuccguggacacagguugcuacaccuuuaagauguaagcccggccagggcuugggaauaaccaugcgcacaggcaagaacuuuggaagaagcccacccaacuaauggcuacugaaccaccucugggccguccacccccagcacuugcucccacucgaucucaacaaucuccuaaaguaggcacuaguauuauccugccucaacagagcaggaaauugcagcucagacagguaacaggagaggucugaauccagaccugauuguggguccugggcucuuaugccgugcacuggaucuaaugaccaugaucgcaccaugggugcugcuucgagugcuguacuuacagcaacucaaugaagccugaucccaacccugugagggagguaacacgaugacuucauuucagaggaaacugaggcacagaaaaucacagaacuuggccccaagucacaugauggcuagguggagaagccagcacaccagcccccagccucagccaccagcguguugugcucuuaacuauuccacagcucucucuguaaaaaugauggggaaugcccuggccugugggcucucagaccccuugcccuggucucccuaaggacagaggcuguaucucaccaucuuugcaucuguagugccaacugacugccuggcacccagagggguugcaauaacugcuccugggccaacgaauggaugggacaaaccuugacuuccccaccuaccauuucaucccuuaguguguccucucucuugccuagaacccagacuaucuguggucauuuaccagggagaaaaugguucuaaauuaacaauuuccuuaagagagauagggucuugcucuguugcucaggcugggguacacuggcacaaucauagcucacugcagccucaaacuccugggcucaaacgauccucccgcuucagccugccuguaaauuaacaaacuuuucugccauuuuccagcuacucuccuucucuaucucccagcccccucccugcuguccauuccuccacauauaaaggaacaaagccaccaacuguuagagccacaaagaaccucagaguguccagucuggccccugagaagguagaugauguccucaagcucauacgacuuaaagguuauccauaaacuacccuaaucucccaacccuucccacuaauagaaagaacaaguuaggaggaggacggaggugcccguccuggaguccaagccucuuacccgcugggggaagguuaggcagugacacuaauacuagcaguucguugacugauuucacauccacaucuaacgagggucuggguucaaauggugcucugggccucugauuaccuugcugagaggccuggaaugucucugggcuucagcuuccuaucuaggaagugagaugauugguuuacucuuucucccaauauuuuuauacuguuuuauuauuauacauuguuaaaaugcauuauaaaaugacauuuagagcagaaaguuagaaaaugcagaagaaaauuuaaaucacucauaaucauaccacauaaaaugauuauuuacuauuuggagacacucuuuacagucccucuaagacacacacauacaaacacauacgcauacacacacacacauuuauuaggcacauuuacuaagcagaagcauuuuuugugcuuacuauaugccaggaacuauucuaagcauguuauauauaguccauaaucccuuaucugaaauucccagggccugauauguuuuggaacuuggaaauuauuguuuuuaggaagguaaaacuuucuguuccacauuaucauauuaauauuucagcagcagaauaggauaaauaauuacuauacauaaccucacaucaauucaggacagguuuugcugccaaaugaguucaccacuaauuuaugaacuucaauuucauagcuuuaaguuucaggauuccagcugcaaucucagcaauccugaaccugucccauuccauucaguccacaugcgcaccccacagggucauacuaagucgggguacaagcuaggaagagguagcuuugaaccugagugucucaucauaggcccacuaugcacuacuaaccacaugcuguuuguccaacaaaaugggaucacacagaacaggagguucuuguaaccgugcucauuucagagcauguaagcagugauuuugccacaucauguaauguucucauuagcucuguuucuaaguguugcaugggauuuccaaaccucagggacuguuuccaaguccaaggaaaggccaaguucuaaucccugcccugagaucaacccaaaggggaggagaugggaggagagagcuuaacgagguuguuggauucauauucucagccagcccuugccagcugggagaaaggagagaaaggcugaguuugcaugauccuaucaaagacagaagaaaaauuuaaaauuggaguuucaccccagaacuagucuccaaagucacaagauacaaggagaaagaauuuuaugaaaacaaaaauuuacugcugcuaaagagcaacaacuauaaaaugccuauucaccuguuaauuaauuaauuaauccauucauucauucauccauucauucauccauucguucauccauucccacacucauucaucacauguuuuacauucccccguaaugcagaauucugucuuuggcaagcuuguugcagcucauuucauucauguauuuagcagauauucaaagccuaccaugagccagcaccagccuaggcaguggggaaaaacagagaccacuauaacuauggcccuggcuucacggaacuugcuuccaguguagggagacagguaauaaccaaguagaucauaaaaaaauaaaagacguaaucuuuuaggagccgguuguggagguucacaccuguaaucccagcacuuugggaggccgagguggguggauugcuugaacucaggaguucaagaccagccuagccaacauggugaaacccagugucuacuaaaaauacuaaaaaaaaaaaaaaaaaaaaaaaaguagccagacauggugaugcaugccuguagucccagcuucucaggaggcugaugugggaggauuucuugagccugugggguugcagugagcugagaucacaccacagcacuccagccugggugacagagugaaacugugucaaaacaaacaaacaaacaaacaaacaaaaacagacauaaucucaagaaauaauuaaauguugcaaagacaacuaaucagagugauugauaaagauacugaagguaauugggggguagauuuuuuaaaugugagaaagggacagggaaggcccuuugaggaagugacucugaugggcaaagagcuagcaguagaggcaggaccggcuacagaauuugcaggacccagugcaaaaugaaaacacagagccccuuguugaaaaauuauugugaauuuggggcugggugcaguggcuuauuccuguaaucccaguacuuugggaggccgaggugggcagauugcuugagcucaugagauuccgaccagccugagcaaaauggcaaaaccucaucuuuaccaaaaauaaaaaaauuagccagcugugguggcacgugccuguagucccagcuagucaggaggcugagacgggaggaucacuugagcccaggaagucaaagcugcagugagccaugaccaugcuacugcacuccagccuggguaucagagcaagaucaugucucaaaaaacaaaauaaaaaagaaucucaagacggcgacaacaaagcgucaaaacaagcacggggucccuugaagcacagggcaugccugugaagcuggcccuggugggaggucuggguucagggguugggagaaagagaguguuucaguucagagggaacccagugcgaacucccaaaacaggaacacaguugugagaacucugggaugcucugggcacugcaggaaggagacagccccuugaagacugcuucagaaagagcuuccucccaaaucacagacuuaacacaagcauuuuccauccuugccuugccagucucccagcuacuggccuggcaggaagaggugaauguaggaaguggccuuccagggcagagcagcagugaagugacugcccaaggaaacugcagagagcagaagcagauccacaaauacaagucacuucuucacuguggcuuccacgugagucagaacccucaaauaaauaccccuggccucuucucccaggccuuaguuguuugucuuggaaauggggcaaggguuggauccugucuggaaggacuagcuuaaaccucuagccccugcuuccauuuugcagaaacaggaccucaaacgguuagaagauuugccagaggauacagauuauuuagcaacuuaucaagaaaaaauaauaauaauuuuuuuuucgagucagagucucacucuguugcccaggcuggagugcaguggcguggucuuggcucacugcaaccucugccucccagguucaagugauucuccuaacucagccuccugaagagcugggauuacaggcaccugccaccacgcccagcuaauuuuucuauuuuuuuuuuuuuuuaguagagaugggguuuugccguguuggccaggcuggucucaaacuccugaccuugugauccgccccccucggccucccaaagugcugggauuacaggcaugaccugccgugccuggccucaagaaaaauaauauuuuuuuucagaaggaguuccuggauucagcuaacagggauucuugcucacuguauuugccuuuuugggucaggcuuccuuuccucagugcuccagcugguuacaggcaacuggcuggcuggccugcaugcaccacccuuaaauauaauuuaugcuuguucucacuuauaaguggagcuaaauaaaguguacacauggaccuaaagaguagaauaauagauacuggagauuuggaaagguggcauggugggaagggguaaggaaugacaaauuaccuaauagauacaauguacacuaugcaagcaauggcucguaaaagcccaggcuucaccacugggaauuauauccaagugacaaaacugaacuuguaccccccaaaucuaaaaaauuaaaacaaaauuuuaauauaugggaggccaugauuuugagcugagcuccugugcuuagccccuacagaccaaaccaaaacgacggaucacuccuggccaacugccucgcaaucagucugaacuuugaaacugaccaguuuuccaaaaaacaauagcaaccaaucagaagggguccaguguaccugagccaacaugauaagaaaguugcauuuguuuuaacccugaagggaaagucauuuugaaacuaugaagcgggccgggcgcaguggcucacgccuguaaucccagcacuuugggaggccuagacagguggaucacgacgucaggagauggagaccagccuagcuaauauggugaaaccccaucucuacuaaaaauauaaaaaauuagccaggcaugguggcaugugccuguagucccagauacucaggaggcugaagcagaagaaucacuugaacccgggaggcagagguugcagugagccgagauugugccauugcacuccagccuccagccugggugacagagcaagacucugucucaaaaaaaaaaaaaaaaaagaaagaaagaaagaaaaagaaaaagaaagaaacuaugaagcuccccuuugucccuuguuucugcuuucuucagcccuguucugccuauaaagccaagcuccucucugcucagcucuucggaagacccauucuauuuuacagaaugaggugcugcaugauccuagaauuguaaauaaaagccaauucgaguuuuaaaucaaauuugcugugauuuugucuuuugacaccaccuuccauggccuacacccaaaacugcuuggguguugaccugugaacaccagggaagagguauuacuacccugccuguaugugugcaaaagagucaauggguaaccagcaaacaccaggcuaccacggaucccaaagaugccaaaauccaaagccaaaagcucuacaagauaauaaaaugcucagccucauuuuauuuauuuauuuauuuauugagacagagucucacucuguugcccaugcuggaguguaguggcgugaucucagcucacugcaaccuccaccuccugaguucaggcgauucucccacuucagccuccugaguagcugggacuacaggcgugcaccaccaugccuggcuaauuuuuuguaguuuaauagagaugggguuucaccauguugcccaggcuggucuugaacuccugagcucaggcaauccacccaccucagccucccaaaguacuaggauuacaggugugagccaccuuaccuggccucauuuuauuuuuuauuuuuauuuuuuguagagacagggucucauuauguugcccaggcugcucucaaacuucugggcucaagggauccucccaccucagucuccccaaacgcgugagucaccaugcuggaccucagccucauuuugauaugcguuguuuccaacaggcuggaacaccagguuuggacauaauuuuuucauccagucaaacaccagaggcagcaggcaccagcacacaugucuaaggcuugacucccugaagauucuuugaugugggauucucacuacaguucauuagaaacaacaagcacacaugagucuucucugucagaagccccugauucuggggcugggaauguuccuugaggaagugccagugucucaggaggugccagcagaaccacccgcauugccccugggugcuaaaauucuaaauucucaacucugaaaaugcacacauaccggggacaaaauaacuaacuguaugucagugagcuuuagggccacaggucacaucucaggagucuggugcagccuccucauucauuuuuuuuuuuuuuuuuuuuuugagacagggucugccugugucacccaggcugggaugcaguggggcaaucucagcucacugcaaccucugccuccugggcuuaagugauucucccaccucagccucccuaguagcugggacuauaggugcauaccaccacaacuggcuaauuuuuauauuuuuuuguagagaugagguuuugccauguugcccaggcuggucuugaacuccugagcucaagcaauccacccaccucggccacccaaagugcuggaauuacagguaugagccaucaggcccagccucagccuccucauucuaaagaugauaaauuggagacucagagaggggaagggacucacccaaguucaugcagcacaucacuccuucguucaccauaucauagccuuugaaucgcccacaauccuacaaugucauucagcuccacauucacugccuuuccaagaucccucugucccuccugccagcuguuugcugggacaaaguaaggauaaaagauugaucuacaauguuagguuucuaugccaugaagacacgagggcaggaaauucacucaacauuuugguuucauuuucccuaugaaagauaguuaaguaggcuagacgugauggcucaugccuguaauuccagcacuuugggaggccaaggcggguggaucacuugaggucaggaguucaagaccagacuggccaacauggugaaaccccgucucuacuaaaaauacaaaaauuagccaggugugguggcacacgcccauaauuccagcuacuugggaggcugaagcaggagaauugcuugaacccgggaggcagagguugcugugagccaagaucaugccacugcacuccagccugggugacagagugagacucuguccaaaaaaauaaaaaaagaagaaagaaagagaaagagagagauaguuuucgccuuuauaaauguaccagcucagaaaaaccuugguuuaagcucaaaccaguaaagaccccucaaaaugguggcaggaagacaguggguggaaaggugggagacuugccccccuuucuauuuauuaucuaccaaauauggaugcuuuauucucuugccaaguaccugagaaauauuaguucauuuaaucuucacgacuauuuuggcauccaagacucaggaaauaguaauaauaauaaucauguuauaaguuuguugguuugauacauucuuuuuuguuuuuuuauuuugagacagagucuugcucuguugcccaggcuggagugcaguggcacaauuauagcucacuauaaccacaaacuucugggcucaagugacccuccugcuucagccucucaaguagcuagaacuauagguaugcaccacaaugucuggcaaauucuuaauuuuuuuuuuagagaugaggucucacuauauugcccaggcuggucuugaacuccuggccucaagcgauccuccugccucauccucccaaagugcuggaauuacaggugugagccaccaugccugccuacauuaucccauuuaaucccuuccacauuuuacagagguacuggggccuggagaggugaagggucaugcccaaggucacacaguaggggguggcagagccaaagacugaaccccacuccagcugacuccacagacugugcucuuuguacuagauucugagacuuucucuucccuuaacccuucuagaaacucaaacacucuuccccugaaaaguuucaguauauggaauacuuuccuccuccuuuuucucugucuucuacuuccagcuaccaggguuaaaaccaagcucacugcuaacauggacauguauggaagaccaccucuagauuuuucuaauuugggagagaguacaggagaugcuuaaaagaauagccaguaaaacuucacuccagaggagaaaaacacacuagaaggaagaaguagaacaaugagaacagagguuucccucuggcuggugaaguuuugguugguggcucuuuucuucucucuguucuccuauauuucccaaauuuucuaccuggaagugcuguauuccauuuguaauuuggggauggcagaggagaagguggauaacaacaacaucaacaacaaagccacugacugcagccgcugggauagucccaccuguuaugaaccuacaggcauucauuuccaacaaucaaauugauggagaccuuuagaguguuugaguuucugcuuuucaggcaucacugggggaaggcugguuuuucaguugucaguuaccugcugaaugaaugaaugaaugaaugggcugggugugguggcucaugccuguaaucccagcacuuugggagaccgaggaucgcuugaguccaggaguuggagaccagccugggcaauauggugagauucccauuucuauaaaaaauuuaaaaauuagcuaggugugguggugcacaccuguagucccagcuacccaggagugcacugaggugggaggauugcuugagcccgggaguuugagguuguagugagcuaugauccuaccaguacacucagcuaacagagugacagaguaagacccugucucaaaaaaaaaaaaaaaaaaaaaaaagaaugaaugaaucaaugucucuucaggaggcagagagaacugccccucccucuagacuaccaucaucacuuguggcucuugccagccuuggcucauucagcuuaaauuauaacuaaacacaaggucaucuuccccaacuaggcugaggucuucuagaaagucaguuucauggcaucgagcccugugcaugcaguagaugcacaaggaaugauuucuuuccuuuuuuccuuuuuugagacaaggucucgcccugucacccaggcuggagugcagugacgugaucucagcucacugcaaccuccacuuccuggguucaagagauucucccgccucagccuuccaagcagcugggauuacaggcacacgccugcaugccuggugaauuuuuguauuuuuaguagaaacggaguuucaccauguuggccaggcuagucuuaaacucccgaccucaagugaucugccugccuuggccucccaaagugcugggauuacaggcaugagccacugugcccagccucaaggaaugauuuugaaaggagggaaggaaggaaggaaggaaggaaggaaggaaggaaggaaggaaggaaggaaggaaggaaggaaggaaggaaggaaggaaagaaggaaggaaggauggaaggaaggaaggaaggaaggaaggaaggaaggaaggaaacuucugagaaggcucgugucuucuccuuuugugcauagccacccuugaagcuuuggcaucagcaaacagcuugaucaaggugggcacagguugggaaggguguggaccccaccugaacucugcacuccucaguuacaaggagaaaaugcacauuaccucauaguggggacgcgggucucagcuucaccuguggucagauaagccuccagggacagggcccccaagcuggcccggcugcccuuccggguagacucacgagaugagccagcaacagaguccucgucggaggaguagucaucaaaagagcccaggaugaaguuggucaucagcugccucuugauguuugccugcuucuugucuucuuuggagggggagccagcuugcuggcccuggggccuggcugaggaggacaggccauugguaucuguggccuccagaccuugugucccagucccguuggcuugaagcucuggggagggugcugcgucacuggaagaaaggggguuucuugggggcuucuggugggagggugguagggaguuucuccgccgaccggcaucuuuggggccuuugugggaggcuggcucggccuggcugggugucuugggcagaguguggcccuccccauuucucugcggugucuccccugaguuaucagaggcuggaaagggcuccuggcucgggaugagguuugcuucugauuuacucuuggugaucggcuuggaguccgucauuuucccccagauuuuuaaccaggaaaaggucagacaggagaaaaucagacaagauagacaaagaagcaagaccauucagaaaau

SEQ ID NO: 191507 - RNA, 19838 nt, Homo sapiens
agcuguggguggagucaccccgcggacuggacgggaaccuggcggggucaggucccgucaagcagccuggcucauggcugugugcggccuggggagccgucuuggccuggggagccgucuuggccugcgcgggugcuucggcgccgccaggcuccuguauccccguuuccagagccgcggcccucagggcguggaagacggggacaggugaguggcuggcgggaagggcaacucgaacaccugccgugaaucguggugucgucgccauggguacgucacaccgccgugaggucaccgcggcaaccgucaggugacgucuccacgcuguucugacgucaccauggcaacgugggccacgugggcgccagagaccagguagucuuugccuaagucccaaugaagucccgcuaucaucgggcagggcagggcauaucccaugugggccaggagggcucucgacucagauugugaccaaucuccaaagcaguuuauuccccaggucccagauacaccagcaccuucuaaagauggcuuuccucauauuccuugaaacuugcaccucaacccagaccucagaaccucuagaguaccguggauuaauaauggauuaauuuaguucacagauccaggaaauuaaccuucgaaugggcuuguaaugucacauuuuaauuuugagcuauguccuugaguuguuuacauuguuuuuugaaaaugccacuuuuugagcuguauuuuggcaauucuucaucucugaguacacucgaagccucauacuauggaaguggcucagguuucuuuuccugcaagaggcccugaguugguggaguauaagauaaaaauuuggguaggauagaguuaagaguccuagcuacuugggaggcugaggcagaggaucacuugagcucaggaguucaaggcugcagugagcuaugaucaugccacugcacugcauuccagcuuaggcaacagagcaagacccugucugugaacaaaauaaucauaggccagauacgguggcucacgccuguaaucacaacacuuugggaguuugaggcaggaguauugcuugagcucaggaguucaaaaccagccugagcaacauggugaaacccgucucuaccaaaaaaaaaaaaaaaaaaaaauuagcuggguguggugguauacacccgugcucccagcugcucgggaggcugaggugggaggauuguuugagccugggaggcagagguugcagugagccuagaucgugcaacugcauuucagccugggugacagagugagaccccaucucaaaauaauaauaauaauaauaaauaaauaaauaauuucgguaggauagaaguuacaguuugugcucuggucuaggacaguuuugggcaucccacuccugccucuucuuggauggucuaggaaggugucucaucugagccauaguuuccuccucaguaaaaugaagagaauagguguuggcuaccuuugggguuguggaaagauuccaggauaauuccagaagauaaugccuguaaacuacuuggcacagugcagggacaauggcaaaggaucaaucaaguccuucagcaaauauuuauugagcaucuuuguugagcaaggcauuacaucagcuacucuacacacucugucauccagcucuggucuugcccacaaaauguuugcuauuagaaaggaucuaggggaaagaaaucaacaagagaugaccaucuaagcaguaagggguaagugcugccucugagguuacaagcagcaagcugggacccucugaaggagcugacccucuguguaagccauccccacucaccagauacugauguuuauuucucauuaggccacagccuuccucgaagacacccaggauccccaagauuuacaccaaaacgggagacaaagguaggguggggacaggugaaaaaugcaaagaaauacucauggcauacaccauuuuaaaguucuuccaaauucuuugcagccacuuuaaaguauaauauaccaggcgcgguggcucaugccuguaaucccggcacuuugggaggcccuguugggcuaaucaucugaggccaggaauuugagacuagccuggccaauguggugaaaccccaucucuacuaaaaauacaaaaauuagcugaguauggugguccaugccuguaaccccagcagcuacuugggaggcugaggcaggagaauugcuugaacucgggaggcagagguugcagugagccaagaucaugccacugcacuccagccugggugacagagcaagacuccaucucagaaaaaaaaaaagucucagaaaaaaaaaguaugauauuugacagaucucaaaauauguuacaaaaauguaaugugaaaugaaaaacacccaagagauauuaaaugacaaaagccugaaucugucuggauaagcauguacauauauguguguucagguguguguagaauagucugaaagguuacaccugggacuguucugggagagagauuaaguugugagaggggaacaaacagaaggacuuucacuauuuacauacuuuuauucuauuuuauuauuuuuuauaaugaguauauauuacuuuaauaguuuuuaaaaugcuagaacauguuauauagaaaaaaguaagaugcagaagaaugcguugcuaugauccuuuuuuuuuuuuuuuuuugauacaggguuuuacucugucacccaggcuggagugcaguggcucagucauggcucacaacagccuccaccuuucagacucaagcaauccucccaccucagccuucugaguaucugggacaacaggcacacaucgccaugccuggcuaauacuuuuuaauuuuuuuuguagagaugaggucuugcuguguugcccaggcuggucuugaacugcuaggcucaagguauccucccagcucagccucccaaaaugcugggauuacaggaggcaugagcuaccgcaccaagacaguauaccauuuuuuguaguacaaaagcaugcagaccacuaguauguauuguuuuuuggauauauacuuguauaguaaaaguauaaaagcauguacgggacauacucagugccacugaaugguaaacuuaagaagggucaaaaugguaaaauuucuguuauguaucaucuguuaccacaauuaaaaagaaggaagaggauguuggaaaggacuuauuguaggguugggcuuguguugggugguuacaaggaaguggggcuuuguucuggauugaauccuguuaggaagcagggcuguuucugucacuggguaucuuuuuuuguuuuuugagacagggucuaguucuguugcccaggcuggagugcaguggcacgaucucagcucacugcaaccuccuggguucaagcaauucuuaugccucagccucgcgaauagcugggacuacaggcaugcaucaccaugcccaacuaauuuuuucuguuuuuaguagagacggggauuugccauguuggccaggcuagucucgaacuccuggccucaagugaucugcccaccauggccucccaaaguccugggauuacagugugagccacugcaccuggccuguaauuggguauguuaauaauuuguuucuagaagacagaagggacaaagaggugcuaacgcuguaauggauaaagaugcagcagucacucacauuagccagggaagggggagguuuggucaucuuuuggaguuuggacacagucgucugugcucagacguucuuccgcaguggccuugucuuggucucgaaccgucauagucauagaguggccugucugaugguuuucugugaaaugguuuguguucagcagaacaccacagucuaccugugagugccaggccggcaccuggcaaccccaaagccugcccgauagcgaaagccagcuccaaacugucaggggcaguuuucacuuucucagagguugggggagaaaggcgggacugugagcuaggcagaggcacagaggacuuugacuucaugugaaauauaaugguaauguauauaugauauaaaauauagaacguguuguauuucuuuaucaggaugguuaguaugugguuuuuaaguugaaaagcacaucaggaaagaagugagcauaguggcuaacccuuggggaguggcaacuaaaagggguuacaugggggcuuucaggguguugcucauguucuguuuaugaagcuaggugcugaucaaggagguauauucaguuaguaguaauucaccaacuugcacacuuacgauuugagcacuuuucuguguauaugcuauauuucaaguugaaaguucuuuaaggggugguacgguggcucaugccuguaaucucagcacuuugggaggcugaggcgggugaaucacuugagaccaggaguucaagacuagcucggccaacaugggcgaaaacccgucucuacuaaaaauacaaaaauuagccgggcauggugguacacacuuguaaucccagcuacuugggagacugaggcaugagaaucacuugaaccugggagggggaggcugcagugagccaagaucacgccgcuguacuccagccuggaugacagagugacuguucaaaaaagagaaaguucuuuaaaaucuuugaaaguuuaaaaaaaaaaaaacagcauaucaggaaaacagaaucuuaauuuggguggcuaaacauuuuuuuccacaggguuuucuaguaccuucacaggagaaaggagacccaaagaugaccaaguguuugaagccgugggaacuacagaugaauuaaguucagcuauuggguaagggggacaggauuggccuugagguugcguuugagucgaguaugaguaaacguaaugaaugugaagcucucacgcaugcugggcagcagccucggagguugucagcccuuauugaacuuuccucagcccugaagcacaggcuggucagcuccacaaggcuguggggcugcagacuccuuucccuucuggcccugccugugccugcgcuggccucuggcccaugccaugugaagcugccucccucucaucccucacuuuucaggugagccugugugugccacugagguuaguauacugagugaaagaggugaguuaguauaaugcacaguacauccaaugugaucccuuuugugacuguuguuuuuuacauaagccaaaguuuagaagguggacucaaggauggaccagaucaggaugggccaggucaugcugugaucacagacaaccccaaaaucuccugacuuaugacaccaaagauggacuugcuguucccacuucaugcccaucacaggguauauucuuuggcuccaugcggccuucauucugggacacaggcugcuaguacagcugcugccuggggcaauuaucagucauuguggcagagggaaaagaggucauggugaagcucacauuggcuccugacgcugccaggggauugugcagugucaguguugucgccagugagguuuacccaagaugugauuauugcugauugaaaacuuuucccacuaccccaccaugaugacuugaaauauagucaacauuggcaguuuuugacagucuuuauggagacuaaacuuuguugguaaauaaaaguugaaaaaaaaaugacuaggugcagcggcucacaugucuaaucccagcgcuuugggaggccgaggugggagaaucacuugagcucaggaguuugagaccagccugagcaacauagcaagacuucaucucuacuaaaaagaaaaguuaaaaaauuagccaggcgugguggugcacaccuguagucccagcuacucagaaagcugaggcaggaggaucacuugagucugggagguugaggcugcagugagccaugaucgcaccacugcacuccagucugggugacagaguacgacucugucuccaaaagacaaaccuuucuugggaaugaugccuuccauuuauucacauuucagcggccagagccugucacgugcacaugccugacaucagcgggguaggaggggcagcaaauauuugcaagcaggagcacagucugcccagcaugcccuacaggcuggugacagggggagcagcaacagucucaggugcuggauccugaaaucugaccccggggcccugggguuauaggugcaugggagccagacagacccagcugcaaauuuucagcaccgcugcugauugucucugggacgucagguaaaucacguggccucugugagccucaguuuacgguucugucaaguagucaucaugauaauucccaucucacuguucuuguggggcuuaaaugagaugauuccauguuucacccugaggacagugccuagcacaaguaaaaauaauguuagcuauuaucacucuucuuuuuuuuuuuuuuccgagacggaguuucgcgcuuguugcccagacuggagugcaauggugugaucucggcucacugcaaccucugccucccggguucaagcgagucuccucauuauuacuauucuuaacacuuaccuguuccuggcuaccauuucuccauggcgggccugacuaggugagauuuucgggacagauaaugggagguacagauagucagccagccggguagagaaggcaaacaaaccccuuggugugugugggaggggguccagaagagggcagacacaagaccaagugggcaaagggagaaaaggccaguucucgcaucagcuauucuaaugagcucuaaaacacgagccaucgucucucaguugaggaggagcgggagguuggagaaaccucaguuguggauucuuccuuggucagauauugaccaagcaucugcagugcgaggcgcugcucaacagagaaccucagccccgccuuccugagcugcagagugcagggagcagaaccucagccccaccuuccugagcugcagagugcagggagcaggcagcacucacugggcagcuacgagggugggagcaggcuuggggcaagugcccaggguggggccugccacuggccuggucacggggcaucccucggcaagcagguacuucugcacaccuccugugaggcaggcauggggcauccgcuaugauggagacagacugugucccagccugcacagcccucccuuugguccagaggggaagacacaccagacgggaaucacauacugguguguuuaguucuaacuguaagaugugccaggaagaugggcuggauauucuccauuggcccuuucaaaucccuucucuucaccuucucuuuaugcaugggaggcugaccuuaucaccugguggcugugccaccucgauucguuggucuucuggcauucagguggguccagccagugggaggcaccaguaggugauaggagagugagugcagagagcucaugagugugugugacccuguuccccaguggugcauggcucugguggcagcugggcucccuaccuaacucccucccugcugagugacuccagaauucagcucccuccagggugaguuguaccuuccccgacccuugcccuucaggcuccugcauuucccugaaacucugcccauaccucugugaauugucccuucccaaagcccuccuccaggaaucccugcagcgcgccacugucuccugcuggggcacugacuggugcaggagggaagugcaggguucugagggaggcagagccaggguccugaccugugucggggggcaguuugcuuucucugccuuaugagggaaguccuccccagccuucaaagucuccccuccagcaucaccuccuccaggaagcccucccugccucucuagccaaggucagauuaggcuucuauugcucuuuccuucagagcacugaucucaguuugcaccuucacauucaggaguaugucuaaucugauuaccuaucacacuccugaauaucacgcuccugaacaugaagguguaagcuuugccugaagucccagagacacucagcagcggugcagaauuugcaccugggucugucugguucccacucaccuaucaccacagggcugcgggucagagcucaggauccagcacuugagacugucacugcucacccugucaccaacuugcuggagagagccugggucagcuucuguucaccacugacucuccugggccuggccagaguagcuguucaaaaggaauucuugacuggaaauaaugagcauccgaaaaggcauuucaagaaacaaauaccaccgcccccaaauggaaggcuauaauguucuuauuguuagcaagaaaaauaacauggcuauuauagcuaaauuaacuaaauggccugccaccugagaaucuauuguuuauggcaagacagggccuagggacauuacauuacaggcaaauucuuuuuccuuuuucuucauagguuugcucuggaauuagucacagaaaagggccauacauuugccgaagagcuucagaaagugaguaacaccaucucacccaagcugggaaucuucagccccgguggccaucacgggacucagcauccagccaccaguuacucuuugugucaccuggggcuaguuacucucccucugugagcuccauuucuucaucuguaaaaugcggacaggccagguaugguggcucacaccugcaaucucagcuacuugggagacugaggcaggaagaucacuugaggccaggagccuagguaacauaauaagacccugacucuacaaaauauuugaaaauuagccaggcauaguggugaaugccuguagccuuagcuacucaggaaacugagguaggaggaucucuugagcccaggaggucaaggcugcagugagcugugaucaugccacugcacuccugccugggcaagagauugagacccugucucaggccgagcaccaugguucaauuaagccuguaaucccagcacuuugggcggccaaggugggagcaucacuucaagccaggaguucaagaccagccugggcaacuuagggagacccugucucuacaaaaaaaaaaaaaaauuaaaaauuagccaaguaugguggcaugcacccauagucccagcaacuuacaaggcugaggugggagaaucgcuugagucuuacagguugaggcugcagugagaugugauuacaccacugcacuguagccugggcaacagagugggauccugucuuuaaaaaaaaaaaaaaaaaaaaaccucugucuccaaaacaaacaacuggagacauauaaucuuccuucacaggcgaguggggaggauuguacuaaaugagggaauuuaaaaugcaacgguucucaacccagggccauucugccccucagggcccgcugagcaauaucuggagacauuuuugguugccacaucuggguguuggggguguugcuggcauguaaauauccugcaaugcaggggacagcccccgucaacgaagaaugacccggccuugaauggcaauagcaccgaggcugagaaagccggugugaagugccucgcucaugcccgaugcagagggaaccugggaagccuagcugcagugagcccucagcccgugggacucaugcgucacagugucacuguucuguucccuaagaaggagggggccucugacccacgcagagaacuucaagcacggagacagggucaccaccccagaaugcccagggugccgcacuuuccaccuccacauggacccagguccccagaaaccgcuccccgcagggucagcccuucccacuuccguucugaagcccaggcuggagccugcucaggccccugggaacagacggaggguaguagguggggcugccacaggcuguggcugcaggaggaagccucagcugccagaacauucugugugguggaggaaggcuuucaaccuccugaggagccgcgguagcagcggucauuucugucugcuguacgcguugggucgcagcugucacgucaccuccucaagggccuucccuggccaccuaaucuccagcuggguuaggcacugcuccuggauuuccacauccucuaaccacaggcaucacaagggguguuaaccuguucacccauccaccucccacccagccuuggcacugugagggcggggacagugucugguucaccugggagccccgccuggccugguagccgcucgcagggccuguggaugaggccgggcagcaaugccacugcuuuccucauaucacccauuucacccucacagacacccgugagguggaaguuaauguccacagcuuauagggagccaaacugagccucagaaaggcugacuugcccagcccccacagccaggcaucaguagagcuggaaucugauucccaaacuggugccauuucuccccagcccuugggguacacgcugcacguggccaaccaaguggguaguauuaucacucccgcuuugacugugaaagugcagagaccccaagcagggaagcagcuugcccaaggucugcuggucagaagcccugggaagguuccagcccagugcuggaugggcagccucugcucucacacaccauggccugcuucuugaaugcugucacaguggccaucuuaggagaggucagaagucgcagaccuucacccuccugguagcccaccauccagcuugaguggacccuggcugggcacaaagucagaggugguacuuguggucuucacaugcaugagagcuguuggacauuugucaugcaggggccuggaguccugcagcagaccuuaacagaccacuucuguuccaagcaaacccacuccccaccuggacagagcacaggccucacccagccaggcuuccugcucccagaauccccacacgccucggcugacuacauucuccaagcuccuuguccuuuagaguuuagaaagcacugucacauuugaccucuuggcccaacuguuacagguuagaaaaccaaagcugucaaauguugagaaaagaagaaaaccucacagggccuaggugcacaggagacguggacagagcccagacgguuccucuugacugucccugggugugugaugcgugucaucugcuuaacccagcugcugcccccaugggagccuuuuccucccucagacugcaaaagagccacaccaggucccccucagcagggcuggguguccaacgaagauguugugcugaaaguucagaguuugcuuucaaaugucagccaguucaaggucugauagccuguauuagucuguucucgcacugcuauaaagaacuaccugagaccggauaauuuauaaagaaaagaaguuuaaucugcacaugguuuugugggcuguacaggcuucugcuucuggggaggccucaggaaaccuacagucauggcggaaggcaaaggggaagcagguacaucuucacauggcugauaggagagagagagugugaagagggaggugcuacacacuuucaaacaaccacaucucaugagaacucuaucacaagacagcacuagggggcuggggcuaaaccauucaaaacuaccccaaugauccaaucaccucccaccaggccccaccuccaacucuggggaucacaauuuaacaugagauuuggauggggacacauugccaaaccauaucacagcccuucaugagcuagcuggcacaggcuuugccggcguauuagguggcgccucugcacauugucucuguccagcccaucucacauagaucuugacugucacuuucugucgccccccagauccagugcacauugcaggacgucggcucggcccuggcgacaccaugcuccucggcccgggaggcucacuuaaguaauucucaaacuccuguggguguucagagggcccuagggucaggggacucuccuagggucaccaucugggaucccaggcccccagggacccacgggugggucaguuagccuugcucguagcuccugggagggaagguaccuucugagccaguggaagcagucugcgggacacccagguggaagggcggcgggggugguucccgccauggucuggugggugauggccucauggcaguucccucugcuccuuggcuccucagaguauaccacguucaaggcggggcccauccuggagcuggagcaguggaucgacaaguacaccagccagcucccaccacucacggccuucauccugccuguagguacugggcaggcuuaaccgggggcggcugcaggcagguucagugacagacacacaugggcucugaauaaaucccucuuuucacagugacagacgcuguccuccaguuccccaagucccuccagguccucaccggucccucccagcccugcccacucuggagcagcgugcccggugggugugccguggcagggcuccuggaggcagaacacugcccgguuuggggggcagggcuggacuucagaggagcuccuguccgcagugggcacaccuuucccacccugcucaggcaaugucccuuucuccuuucagucgggaggcaagaucagcucggcgcugcauuucugccgggccgugugccgccgggccgagagacgguaagagggcuggagagagggagagggcccaagggagagggagaggaacaagggggaggggggagggagagggagaggaggacggagauggggagagggagaggggccucugcacagcgggcaggaggcagguacagcagggccaucucugagccauccagccacacaucaacagaccuugucugggccccuccacugugccagacggggaccaggacagaccaagucccuguccucagagcaccauguugugaaguggagacagugacaugugaccaaauagacuaucagacaacacaauugcaccuuguuugugagcccuguauucugagaacagcaggaaguuauugcuggguucucagccucagccaucuuggggacagggguagacaugaaaggacccugcuggcugcugggugcauaaggcuccugaaaggccugcauggcuguggggagcccagguggacguugucagcagacuagccaccaccuccuccaaagcuacugacagccuuuucaaggaaucuuuagaagaaaaugagcaaagucucuaucuacaccacucagagaccaggcugccagccagcuuuacagagaagagaaagcaagcccuacuuugauccaauggacuggcacuuuauguucauaauuucauuuacuccuuguugauagcccugggagagagguggugguggccucuguuuuacaggagucaggaagcuguggcucagagaaaugacaccauggucacggucccccacaugguugauagcagaauccagauuggaguccacgucugucugggccaagccugagcucuuccacggucccacaccacuaagguuuuguucuuuaugaaaggcucucgggcccagauagcuccuuagagaucccagguaacagaacaagcuuuggcuucaaaagaaaaaacugucauuuguacaaagccauccaucagcagugcucauaauagcaagaaacuggaaacaacccaaaggccccgaaaacaggcauggcggagcagcugauagguccuccaugcagcagagaguuacgcagccauggcaguggcaaggugcagauuguccugagguggggacacacaccuggggcaccucgggugaggaagcuccucgcugagcaugcggugcccacuagagacagccuggagcucugugacaggccugggugcacacccuccugggccgcuagccgggugcauggcuuuggguggggaugagaacccugaggcugggcuuuggguagcuggcuugccaacaagggguaugccacagggugauaccugggaaaggcucggcaagggcccgccaccacacuggugcccagcagauggccguccagugucuaauguaucugcaaauagacuggcauggaccccaggaauccagaauccugcggaaucaggagcuuggucugccugggucuuuuucuccccugugaaguuguucuaagucaugauguacaaggggcuuagaguuuagcccauugggaauuaagggucaggcccccacuuccuuugaaggcuagaggcagaccaccccaacuucaccccacccagacccagguccagugguacaaaagcuggcuggcuggggugugguguaggccagguggcucccucaacucaccagccauccuugaucccuccuuggccaggccguccugcgaugugcugguggaaagggggccgauggccuguuuaaacccaccugugauggauuugucaucuccacugccggccgagccugugcagguucagguugagcgguggcaggaugugaaaugcugcucaagguuuaggcccaggucagagccuguugagccccauaaugucacgugacucagugucuccucccuuucuaguguggugccucuuguccagaugggagagaccgaugcgaacguggccaaguucuuaaacagguacucgcguggaaccuggggguuccucucugaaagccgaggcucaucugugggaaguagcagcggugcagcgguccgggaagcaguguggggcagcauucccgcacccccuccuucauucccuuaguguuuaugaacaucugcucugugccaggcaccacgccgggcacaggggaggcaguggugaacaaggugggcccugugccugucccgauaagauuuagaucuuauugggagaggcugcuguaaaaaccaggaagaaaaaccuaagugcaaaguggcauugcgggggcaaagggcguucuuagaggcugggugcucaggggaggccucucgguggugacugaccagggagccaggcuucaggcccucucucagccaguuuccuguccccgagagggccugcggcagcaugaaccaacaagagagccgggccaagcugcgcucaggggaccccaugcaggccccagugagccaggcuagcccagggagggcuuccucugccucgcggccggcccaugaggcuggagccacaccuggcccaaagccugcucugcggguuccugccccagcccuggcuucuguggcaucagugugggcaaggccagagccugggggcagguagagagcugggggagcaggucugcaccccaggagcuguccugggugucuagaaagugaccucaggcccuugacuguggccacuccucccagagacauggcgcuuugacggguccugagcagcuccuuuccuucugggagggggguuucgccgggagugaggagcaggucuacuucaccuucaaagcagcaacccugcggucccauagcauugcacgggacaggccauuucaucuccucagugaggcuucacagagccaacaagcaacaggcacaccacugcccuccaggagcaugcggcccagggguaaaauacccugaacaaccuccccuucgcucuuccugagagccagccguggggcccagggggccugagucaggggaggacucaggaggaugugguguggagcuggccucugagggcaagacuggggcagagagagagggaggaacguggugccucgugcugggagugaaacagcaaaaggugcggacagcagaaggcagaagagcugacagcguaagcgccuucuggggcccguggcgucguccucuaguucccuccacugcugccccugcagaaggccucaugcacagaugaccauugcuguugguucaaaggaggaggcgggaaaggggcugggcucuggucucuagagugcuccagccugugcuucucacccgguaccuuuggcgauguuuggaggcauuacuaguugucacacugggugcaggggugccacuggcaccugguggguggagaccaaaggugcugucagcauccuacacugcacaggaugcacaggacagccccgaacacacagaaugauccagaaugucaguagggccuaguccagcagugucagcaucagccagggcaggaacuagaccugcagagccccgggcccagcccagcccagcccuccugagucagaaucugcacgucgcugagauccccuggugaugccugugcacacuguaguuugggaaacacccaaacugaucacgcaccugagcccugaucacucaaaggugcaaaaaccggcucagagaggaguccaaagucaucugccccaugggguagggccggggcaauggccucauccugcaggaauggccccagccuugacacuggaguagaguccuuggcauucacagcagcuggccucgugugccauccauuaagugcaagauggcugggcccccgcccucccugcacaaugugcccagagugcgucauuuauaucuccuccuuguaggcggauaugggaagacccaguuagcguugaucucucauuucaaaccauucuguuugcuucucucucucugccccuccagacucagugacuaucucuucacgcuagccagauaugcagccaugaaggaggggaaucaagagaaaauauacaugaaaaaugacccaucggccgagucugagggacucugaaaucacagaaagugggagcuuggaggaucccuccauggcgauggccguggagagaggagcuugcccuucugggguccugguuccugaagagcucacccagagaggcucaaagcagccuuuugucccagcucagcuuugaucuacaccucuugccaccuuccucaagggacugugacccuuuggggauucugucccugacccugcuuccccaagcucuccugggucuuggagggaugugggaaugaauuggcauugcaggaaagacagguaaagugauugcugcaaugagaaggagcugugcggaaaaggaauaaaaguuggaaaggcuggagccgugugugugugugugugugugugugugugugugugugugugugugagagagagcccucccacugccagcucagguuguucacagauuuggaaugggaccagaggcccuugaaaauguaauugugauuuaccugugccaaaggugcuuuaaaugucacauuuguaaaggggaaggcggacaagauuuggaaguuuagucaccucugagccacccaucaccgccaaagugugggggaaggauagcugcagauugacaggcgaggcucagaaacuccuggcuuagauugaagugugugugaugggggugcagcuuagaggacccccucugaaagggauggagaugcugaugagaacaacacuaccacuugaaggugaacauucccugucugguuggacugagucaagggucugcggugcagcaucuucagcuugagaaaaugagguugucaguuuccagcaaggcugacauccaccagacugauuucuccgauguugcacuuggcuggcuuaugccucugagaucggugccacggcuguauuuauuucaguugucacugcugcucccuccugcuaugaaacgacacugccagugccagcaguguccuugggaaaggcaauauuuaugaagggcagaagaggcagccccaagaaccuaaagacugcaggcugcuaauugcaggaaaugacuuuggaagggcaggcucuuguccaguuucagggcugaaaugccuggcgaacuccauucagccaucacauauugacugaguggcugcuuagcaugggccaccgcgcuaggcucgggacagcuggucuuuccggccaucuuucuugcuggcaagucagcaaacauuaccuucuuagucacgugcauauuuuugccuucauucuuaccaccuggccugcaaaguuugcaggagggccagguauauucacuugugucuucuggguccuuucauugcugacaggcugugauggcccucuugagccuugggcagggugggugaggugcagaugaccaggagugugugaaugccuuccaggagguggcuuuguuccgugccucccugcccccaucgucacuaccaggucugguacggagucggugcucaguguuugcaaaacagagcugaaaacggacuuugggaggccgaggcaggcagaucaccugaggucaggaguuugagaccagccuggucaacaugguaaaaccccauuucugcuaaaaaaaaaaaaaaaaaaaaaaaauuagcugggcaugguggcgggugccuguaaucccagcuauucaggaggcugaggcaggagaaucacuugaaccuacgaggcagaggcugcagugagccaagaucgugacacgacacuccagccuggcugauagagugagacuccgucacaaaaaaaaaaaaaaaaaaaaaaaaacccugaaaacgcaaucacuaaggcucggucagggaguauguucaaagagcuugcagcgaaucacucaauucugucuacaccucaaaaucucaaaaucuuccuggaauauauauauauauauaaaauaacacagcagcccugcaugccuagccaugggaaagcacagccuccaaaggauaaggaaagcuuuuugaguaaauacaacauccuaaagugacaaucuuugaaacaaggccguucaccuguugccaaguccuguccuuccaggaccgggugucacagccuggauguuaacagucgcguucucagacccccgccucuguaucugucucccgguucaccagcaaacacuucucugagaaaccaccugggugcagggcagaugccaccacucagcagguguuucucuccugugcuaccaaccugggaaaaauggagaaagcuugcuuugggggcuggaaggaugggguguuuaaaacauuugcucuucugcagugccuuucaaaagcucuaucaagagcccgaggcaaaagaaaagauguguaccccucuguacacugagcaaauguccucccauauuuugaaccaggugggaaaaguuaaugaaagcccuacagucaggaaaugugacugcgaagcccccgcugccccaguguuugcacaccacuggcaacucucagaaacaaucagucccauugcacgggaacacgggguuuugaaacaaacagcagccuguuuuuauuuaaagucgugaucccuugcuuaucguagauuuuuuucauaauuugauuuuggaaaauauugcacacaaauacuacucgaucccugaguuugugggcacuuccuuacauuuugcacccaugaaaaugccuccuccgccuccaggucaggcucccuggaaugggguguuuagugucauuuccagagacaagcuggcaguuggcucuugugucagagagaagcccacagucacagugacaccagcccgcacuguggaagggcuugcuaugugcagugcccugagccaaguguuccacagacauuaucucauuugaaccccauagcagcccuggaaggaggcauuggguggggaaccaaguuguccuggggagucagugccaagaugugagccccggacgcggccucgucacucacagccccgugcuccucagcucccacccacugccgcuugacagucguuuuaaucacuaccugggcuguggcgaacaaugccaggcucugauagauccugcugucucauuucucaaccuaguuucccuuaacuaauauuucauggcuaucguuaaugugcguuuuucaucgaguaauuuccacagcccgaacuuguaacacaucccaaugacaaacguccccaguucggaagcccccgucaguggcaaugucacccuugcugcugccucgacaccuuccgacagcccauucaguuuuaugaucgcccugucccagugaucacuacugaaccuuuaagaauccagaugcauuucaaguuuaauugaauaaaauucuuuguauaauaaauuccgcaugaaugcuacauaa

SEQ ID NO: 191508 - RNA, 14241 nt, Homo sapiens
cggccccgcucccgaggcccuacgggcguggccucugucccgggucccgccccccagcacuccggaacagcgcgcucgcagcgggaggucgcgaagccugggacugugucugucgcccauggccgccgcgcugcucgcccgggccucgggcccugcccgcagaggugagugcgcuggggauccguacggcggggcuucagcccgcgucuggcccagcgggcggagguccuggcggccggcucugucagagccgcuggcaggcggagccccacuccgggagcgcucacggccuuugccccaguucugcugcuccuugcgccgacccagcccggcccuucaggcgucccugguuccugcacagaccccuaccccccgauugaccccagccaccagcccaguucccaguucccauaucucccucccuucauuucacccccacuagagguucagggugcguccuucuuccggagccaggccugggauugaaccagacccgcaucugugaccuugggcaagacagccccuccucagccucgguuggcccauguguaaaauguccacagagaaaaucagaguuguugggaggauuaaaucauaggguauguaaagcacuucgugccuggcguguaacagguguuccacaaaugcucguucuugcugguuaauacaguaccuuucccaucuuacgugucuccaguuguagcagccgugacacauauagccacggcuuccuuugccuggccugaauuacaaggggaacgcuacugagaacuguguuaagcgcuaguuagucuuucuuucgcacuccgaggagcggaauacuauucgccuccacuuguuauagaaacggaggcucacugacguuuaaaacccuugccuaaggucacagagcugaggucuuauuacuguugguauuauacugaggacugaaggauguaguguauggaaaugucuagugaguguacuaagcauucaguuaguaugggguuuucaguggccgccauggacauuuugggcugacaguucuuuguugugggggcuguccucugccuuguuggauguucagcagggaucccggaccccuauccacuggguaccaauaguauuccccugcucuaguugugacaacuagaacuggcuccagacauugccagaugucccuuggagggcaaaauccucccuggugaguuagugggucacuaggauucuuggagaccuccugccuccuccuuccacucacuucugcccuugccggcagcucucuguccuagggccuggcggcaguuacacaccaucuaccagucuguggaacugcccgagacacaccagauguugcuccagacaugccgggacuuugccgagaaggaguuguuucccauugcagcccagguggauaaggaacaucucuucccagcggcucaggugagagugcaaccucagcagcccacgauaguggucugcccucugcuacuggaugaaugguggcagugacagucagcggcacucggacucugguagaggaaccccaaagcagggccuggaacccagaaaaugcucuggaaguuucccuuguccagccuguggccaguagccaggacuuaacuucugggacaacaguaauaugugguggauggucaguugcuuacugugccagccacugugcucauucuaaauagugccuuuaggguguuuggcaugcacuaggcacuguucuugagauggguuaucucaucuguuccucacaacgguccugugaggugaagguacuauucuuauuuauuuuuuugagacggaguuucacucuuguggcucaggcuggagugcaauggugcgaccucgccucacugcagccucugccuccugaguucaagugauucuccugccucagccucccaaguagcugggauuauaggcgugcacugcucugccccgcuacuuuuguauuuuuaguaaagacggcguuucaccauguuggccaggcuggucucaaacuccugaauucaggugaucugcccaccucggccucccaaagugcugggauuacaggugugagacaccacgcccggccaaagguaguauuauuauauaccccauggacucagacuugugaacaaguuaaauaacauacccaaggucauggagcucaucagcggcagccugcucgaccuauuuucuuuuuuauuuacuuauuuuuuuuugaaauggacucucgcucuguugcccaggcuggagggcaguggcgcaaucucaacgcacugcaccccucugccuccuggguucaagcaauucuccugccucggcccccaguagcugggauuacaggcgggcaccaccacgcccagcuaguuuuuguacuuucaguagagaugggguuucuccauguugggcaggcuggucucaaacuccugaccuuaggcgaucugcccgccuuggcgucccaaagugcugggauuacaggcgugagccaccgugcccggccugcuugaacuguuuucuccccugaguuucccaucagcgcgcucccucccgugccacuguguucuuccauuugcauucagucugucugcagcuacgcguugaagauguuacugccguacacgcugaccuaaagauguccagcaccugguguaaacacucaguaguagauaguuguuuaauuaaugauuugugaaaagucaaaccucuccggccucuucuccuugccuguuuuuuuuuuuaauuuuaauuuuaauuuauuuuuuauuuuuaaaaauuuuuugagacagucuugcucugucaccagguuggagugcaguggcgcgaucucggcucacugcaaccuccgccuucugaguucaaacaauuguuuccugccucagccucccgaguagcugggauuacaggcgcacaccaccauacccggcuaauuuuauguauuuuaguagagacgggguuucaccguguugcccaggcuggucucaaacuccugagcucaggcaauccacccgccucggccucgcaaagugcugggauuacaggcgugagccaccacacccggccuuaaaaaugaguuuuaaaagggacguaaaacauuguuuuuauaugagggacccacuaaccguuucccagauaugaaggcagcaggugcugcaggcuugccuugucugucacugcugggaaaggggucuuacaguuucuuacgguuucucuugggagucuggagaccaccaggcucagccucaucagugcuguugccucuucucagggugcaggucaggguugcugggucacagacacuaggaaccaagagugaccauugcagggggcucuaggaggccaccccuugagauagcucugaaggucaggccucucuguagaaaauacuaaaauauuggggcugggacgggcgccuggcugcuguuaguuaauuaccaucaauuuacauaggucagaaacgauggacaaacccgaacccauuuuuuucccuugacugcuucucuuuuucuuuuuucuuuuuuuuuuuuuuuuugagauggagucucacucugucccccaggcuggagugcaguggugcgaucuuggcucacugcagccucugucucccagguucaagugauuauccugccucagccucccagguagcugguacuacaggugcccgccaccaugccuggcuaauuuuuguauuuuuaguagagaugggguuucaccauguuggccaggcuggucuugaacuccugaccucaggugaccuggcugccucagccucccaaacugcugggauuacaggugugagccacugcuuaauuauauuuuggguuucuccuuuuugacugucucgucucuucccucuccugccaccccuuuuuccuucccucggugcuggucucccugucucuuuuucaggaggcccuuuaacgagugcacauuaccaugguuauugcuuuuguccccacuuuuuuucuagaauguuccuguagcuggccacaguuuguugccugaaaucuagagauaaauuucagagugagaaggccugggaaacagccccugucaccacugauaaaauggggugaggugacuguguccaggcucugggaugggauggagaaggcugugcucuuaggugcugccccagagcggugcuccucucuuuugaaauuugcugucucaacaccagagugggagugaguggaacugccaugucuuucacagccacagguagaugcuuuauuuuuuaaauuauuuuugugugugugugauggagucucgcucuguccccaggcuggaguacaguggugcgaucucggcucacuguagccuuugccuccuggguucaagcaauuuuccugccucagccucccaaguagcuggaacuacaggugcgcaccaccacacccggcuaauuuuugucuuuuuaguagagacgggguuucaccauguuggccaggcuggucucgaacucuugacuuuguuauccgcccgccugggccucccaaaguucugggauuacaggcaugagccaccgcgcccagcugguagaugcuguaaaagaaaaugcugauggugagaaaggagggaagacaggagcugggggaaaauugagggcgaugguauaugcuagugagguccuuugggugugggaauugugaauuccuacaacuuuugauucuagcucauugagaagugucgcauuagucagagggaggcggcgcuguguagggaggaggaggcugggguucugucuugccuccugguggccuagaccuggccacugacaccacauacccuuucugugugaauucccucaucuguaagaggaauauggggucacccucauucugcuaccugucgggacgugugaccaagcauuuuaggugaguaugaggaacugaacgcaccuaggagaguuucauccuuuuacucucuuucugggaauuuggguucccacuguguuucuggggaugagauggaguuauggagcgauuggcucaugugccauuuauuccaggguuuuauaccaacaaguuccggggugaaaaggagggugugucucuguccagggagaucugaaggugcuuggagggugaggcggcuugagcuaguuuagccuuauucuguuuugcugguaagcuagagaaaaaggcuuuuggugagguucaugccuaggccugaccgugagucuuggacaacugcauauuuauuuuuguuuuuguuuuuuugagacagggccucacugucgcccaggcuggagugcagugacacaaacacagcucacugcagccuugaccucccgggcucagggcucaagugauccucaugccucaccuccugcaguagcugggaccacaggugugcaccgccaugccuggcucauuuauuuuuauuuuuauaacuuuuuguggagaugggggucucgccauguugaugaagcuggucucaaacgccuggacucagaugauccuccuaccuccgucucccaaagugcugggauuacaggccugagcuaccacacccucuuuuuaaaauuuuuuuaauuaaaaaauuuucuuuuagaaacagggguaucaucauguuggccaggcuggauuugaacgccugggcucaagugauucuccugccucaaccuccuccugaguagcuggagaccugcguauuucuagcacuugguagaguauuguccagcagcagagguguuccuuaauaaaauaguuuuuuuuuuuuuuuuugaggcggagucucacucuguugcccaggcuggaguauaguggcacgaucuuggcucacugcaaccuccaccuccuggguacaaaugauucuccugucucagccucccaaguagcugggauuauaggcgcccaccaucacgccuggcuaauucuuguauuuauuuuauuuuauuuuauuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaaggagcaugcugccuucaagcaucuguuuaacaaagcacaucuugcaccgcccuuaauccauuuaacccugaguggauacagcacauguuucagagagcacaggguuggggguaaggucauagaucaacagcaucccaaggcagaagaauuuuucuuaguacagaacgaaaugaagucucccaugucuacuucuuucuacacagacacagcaaccauccgauuucucaaucuuuuccccaccuuucccccuuuucuauuccacaaaacugccaucgucaucauggccuguucucaaugagcuguuggguacaccucccagacggggugguggccgggcagaggggcuccucacuucccaguacgggcggccgggcagaggcgccccucaccucccggacggggcggcuggccgggcgggggcugacccccaccucccucccggacggggcggcuggccgggcgggggcugcccccaaccucccucccggacgggguggcugccggacgggguggcugccgggcggagacgcuccucacuucccagacggggugucugcugggcggaggggcuccucacuucucagacgggguggcugccaggcagaggggcuccucacuucucagaugggguggcugccgggcggaggggcuccucacuucucggggcgggcaggcagagacacuccucaccucccagacgggguggcggucgggcagagacacuccucaguucccagacggggucgcggccgggcagaggcgcuccucacaucccagacggggcaguggggcagaggcgcuccccacaucucagacgaugggcggccgggcagagacgcuccucacuuccuagaugggauggcggccgggaagaggcgcuccucacuucccagacugggcagccgggcagaggggcuccucacaucccagacgaugggcggccaggcagagacgcuccucauuucccagacgggguggcggccgggcagagacugcaaucucggcacuuugggaggccaaggcaggcggcugggagguggagguuguagcgagcugagaucaagccacugcacuccagccugggcaacauugagcacugagugaacgagacuccgucugcaaucccggcaccucgggaggccaaggcuggcagaucacuccugguuaggagcuggagaccagccuggccaacacagcgaaaccccgucuccaccaaaaaaauacgaaaaccagucaggcguggcggcgcgcgccugcaaucgcaggcacucggcaggcugaggcaggagaaucaggcagggagguugcagugagcagagauggcggcaguacaguccagcuucggcucggcaucagagggagaccguggaaagagagggagagggagaccggggggagagggagagggagagggagagggagaauccuuguauuuuuaguagagacgggguuuuaccauguuggccaggcuggucucgaacuccugaccucaggugauccaccugccucagcuaccaaagugcugggaauacaagcaugagccacugcgccuggcaaaguacucugaagugugggcuagaaaaguguucuguucagaggccaugugugugcugccgcaggucugugucuccagguccucuuccuagugaaaagcacucucucacuuggacuuccccuucccuaguugguuccugccugcugaaauggugccugcugaaauggugccugcugaaauggugccugcugaaauggugccugcugaaauggugccuauucugagcaggaccccccuccccagguguguggcggccacagaacaaucuucuuuuuaguaauucucaaaaugacaccucccugguagcucugaguucccauuugucacuguggaugaguuuccuauugcugcuguaacaaaugaccacaaacccuguggcuuaaagcaauacagauauauucucugaccauucaagaccagccugggcaacauagcaagaccccaucucuaccaaaaaaaaaaaaaaaaaauagaaaaaacaaaaccaaaccauggcagccacuugagaaaugcuguucacgaguuacucaacccgagucaggcauccagugugggucccacagggcuaaaucaaggcaucggcaggacugaguucccucugcaggcucuggggaaauccacuccugucuuucccaguucuagaggccgccugcauucuucccgccagaguuccugccucugcuuccgucgucaccucuccuucucugagucugugucugucuuugccuuacaaagacucugugaugacacugggugacucugaucauccagaauaacccucacaucuccagacgcuucacuuacgugugcaaagucccuauugccacggaagggaacauacuccugggaccugggauuaggauggggacaucuugggcgguugcugucaugcugccuuccacacacuggccaucuccuucccagcuucucugcccucugacugcagcacagcaucugccugggggccgcagagcuugaugugcacuugugggggucauagcucaagccucucagcacacacguuuaugccccacaugugguacgugugggagacucggagaugacgcuccgccccgcacuuagagucuuacaagugaguuucccaugggaacaguucaaggaagaaucaaauaagcaauuucacagagggacacacagguugucacagaagugcugcaggcuccuaggugcccccucuuuuccauacguuauugccaaaguaagaacuaggcuuggugugguggcucgugccucuaaucagcaugagggaggcugaggcaagaggaucacucgagccaggaguucgacaccagcuugggcaacacagugacacccugucucuaaaaaaacaauaauuuuuuuuuuuuuuuugagacagauucucgcucugucgcccagacuggagugcaguggcgugcucucgguucacugcaaccucuuccuuccagguucaagcaauucuccugccucagccucccgaguagcugggauuacaggcacccgccaccaugccuggcuaguuuuuauauuuuugguagagauaugguuucaccacguuggccaggcuggucucgaacuccuggcuucaaaugauccacccauuuuggccuuccaaagugcugagauucuuugggaggcugaggcaggcgcaucacuucaggucagaaguucgagaacagccuggcuaauguggugaaaccuggucucuaccaaaaauauaaaaauuagccaggugugguggcaggcaccuguaaucccagcuacucgggaggcugaggcaggagaaucacuugaacccaggagguggagguugcagugagccgagacugugccacugcacuccagccugggcaacaaagugagacucuguuucaaaaaaaaaaaaaaaaaagaaaaaagaaacaaacaaagugcugggauuacaggugugagucacugugcgcaguccuuaaaaaaaaaaaaaaaaaaaaaaaaaacaacuuggcagccacuugaugauagaugcuguucaacaguaccucagccugggccaggugcugggcucugccuuucauguguauuaucucagucaggccucagaacaguccuuugaggugaguacuguuuuggggacggggaagguaaaacuuuuauauucacaggaguauagaaaaacaagaauauauuagcaaacauucuuauuaguuuauguaagucaugguaguauaagaacaugguugagacuaggugugguggcucacaccuguaaucccagcacuuugggaggccgagguggguggaucacgaggucgggaguucaagaccagccuggccaagauggugaaaacccgucucuacuaaaaauacaaaaauuagcugggcgugauuaugggcaccuguaaucucagcuacucgguaggcugaggcagagaauugcuugaaccugggaggaagagguugcagugagccgagaucugcacuacugcacuccagccugggcaacagaacaauacucugucacaaaauaaaauaaaauaaaauaaaauaaaauaacauguuugcaggaaugagauuguauaaaagggcucgugaaaagcaacgguucccucccguccccaucccuguccccgucccugucccuguccccgucccugucccugucccugcucucccagagauaagugguuuuacuuguuccuuuuugaaguuagguagauucugugguccacauuucccauauuacucaccugaaaguaauaauacuauuauuauuauuuuguuuuugguagagauggggucuugcuauguugcccagacuggucucgaacuccuggccucaagcaauccccucaccuuggucucccaaagugcugggauuacaggugugaucacugcuccuggcccacucuuaauaugauuauuacccagaauuaagagucccaagcucuuauccuucauucauucucucacuggccuugggcauguagcagugagcaagagcacacacagucugugcccucguggugaaggcaaaagaccuuaauccagagaagcacguucaucccugagaaauuccagccgcagaagugcugcaggagagggacugaaggauuugacucagcgaggcuggggauggcagcccaaagcagcgaggccugagcugcgaucagaaggagaggaggggcaauaaccagcugagggauaggagguggcaugugcagaggcccugugguggggagggugcguguguguggaugugcagagggggcuggacgaaggucaguguggcucacgcuguccugcuccuuaccucugaguucccugaaagcauccugugccuucugcuugcucgcugccguggcuguggacggagcggggagcaggcguggaggcgggggcaggacagcuugaaugagaagugccaucauauagaccucagugggacugggucuucagcuucuggacuuggggaucccuugugcguggcuggggucacauggccugaguuucugcagggcacugccucgggggcaggaggguuugggcuuggggagggugggcucgcccccggcagcugcccauggcgugccguccuucccugugcccaggugaagaagaugggcgggcuugggcuucuggccauggacgugcccgaggagcuuggcggugcuggccucgauuaccuggccuacgccaucgccauggaggagaucagccguggcugcgccuccaccggagucaucaugagugucaacaacgugagcccccucccaggccccugggacacacggguggagggaggcucccgugagcgggcaggcucuggccucggcucccagcccugaucucucuggagacgucacaggccuugguccuacuggguaggcccuggacagaacaggcccugaggugcagcccgcaggugggcaggaugcgccugggccuggggccuccgaccgcuccccgcuguccuccuagucucucuaccuggggcccaucuugaaguuuggcuccaaggagcagaagcaggcgugggucacgccuuucaccaguggugacaaaauuggcugcuuugcccucagcgaaccagguaccugcccuguccccucaccuguccuuagggugacaggcccagaggggaggagaggaaggugcuaggccaacugcccacugcuucggaggccagaggggaggcuccccgugugguugguagggugagcgcucuugccaccgcggcgcugggaggaagauugccuucgggguccccugguuuaagacgccagcuccugcacaccccccucgcccucuggucccaucacugagagcuuugggacccucaucuuuggagcccgagucauaggguuucgugucugccagcagggguguggagggagugaggcuggugcccuuagguugugugggguggggcgugcgcugagcccugggucugugugggcagggaacggcagugaugcaggagcugcguccaccaccgcccgggccgagggcgacucauggguucugaauggaaccaaagccuggaucaccaaugccugggaggcuucggcugccguggucuuugccagcacggacagagcccugcaaaacaaggugggcccacccagagagggguucagccggauccugggcugcugucauuucuguuucuagggccuucucuccuuggcccgacuggaccuauuuuugcucuggggcaagugggcugucccugucccuccucagcugccacugaagccugcaccuuccccagaagccggcagagggugucaaggccugagcuucugagggagguggggaggggaccggguugguguugggugugcuggugugaggguguggcugaggggcagcucugagaaaaccacccgccucuccuuucagggcaucagugccuuccugguccccaugccaacgccugggcucacguuggggaagaaagaagacaagcugggcauccggggcucauccacggccaaccucaucuuugaggacugucgcauccccaaggacagcauccugggggagccagggaugggcuucaagauagccauggugagcccggcaguggggguggcaccuugaggccaggcccgcgccccggcuggcgggccacugaccagggcgguccccacagcaaacccuggacaugggccgcaucggcaucgccucccaggcccugggcauugcccagaccgcccucgauugugcugugaacuacgcugagaaucgcauggccuucggggcgccccucaccaagcuccaggucauccagguaaugguggcagcuuuaggagcugggccuagaggcuggacagcgggcggagaguguggccuccugacugcucuccguccuccucccccucccuucuguccccuggaggggcagcugcugaccuguggugugggguggggcuauugcaguucaaguuggcagacauggcccuggcccuggagagugcccggcugcugaccuggcgcgcugccaugcugaaggauaacaagaagccuuucaucaaggugcccacagggguccccgagccauggcccagaauguggugggcccagggacggggagagguuggggcgggucucugcuccuuggccccgugggucagaggugugggccugggguuuacagccccauggggaggcuccacaggccuccccugcugagggagugggggagcaggggauggagggguccccucaagggaaggcucugacuguacccccauguuuaggaggcagccauggccaagcuggccgccucggaggccgcgaccgccaucagccaccaggugaguguccacagugagcucugagggggccagcugccccuucuccagcuuuccccacgccggggucuucucccuccugagccacuguucucaucucaggccauccagauccugggcggcaugggcuacgugacagagaugccggcagagcggcacuaccgcgacgcccgcaucacugagaucuacgagggcaccagcgaaauccagcggcuggugaucgccgggcaucugcucaggagcuaccggagcugagcccgcggcggacugccccaggacugcgggaaggcgcgggagccaggggccuccaccccaaccccggcucagagacugggcggcccggcgggggcucccuggggaccccagaugggcucagugcugccacccagaucagaucacaugggaaugaggcccuccgaccauuggcagcuccgccucugggccuuuccgccuccucaccacugugccucaaguuccucaucuaaguggcccuggccuccugggggcgggguugugggggggcugagcgacacucagggacaccucaguuguccucccgcgggcccuggugcccuggcaugaaggcccagugcgacaggcccuugguggggucugucuuuuccuugaggucagaggucaggagcagggcuggggucaggaugacgaggccugggguccugguguugggcaggugguggggcugggccauggagcuggcccagaggccccucagcccuuuguaaagucugaugaaggcagggguggugauucaugcugugugacugacuguggguaauaaacacaccuguccccca

SEQ ID NO: 191509 - RNA, 2350 nt, Homo sapiens
ugccacggaaaccagauacauuuauuaaaucuacucuuagccaagcaauaaagaugucuacagaguucacaaccugcaacacuucaccagggaaugcuagguaaaggcaacuucaguuuaacugaguacuccauuucaaguggguaaugucugcugguuggcagcuauccaguuuggaaaacuguggaagaugcuguugcuacccagauuguucuguucaacaagugggccugaagccugagcaguguagccagcuguguggggagcagagguucacuccauugcuucugcagccuccucaccugacuccuccuccuccucuaauaagcagcuucuugucacagacuucuggauagcuucccgcucuccuggagaaggcagauaacagggaugaaagauaucuuugggagugauuucuucagcuuaaggucagucacugcucagugggcacugggcuaguguugcuuaccuucaucagugcaguucugcaacaagaucaacagcugucuccuguuguacugaauuaggaacuucugacauguucuuauuguaccuggcauaugaguuacuguggucaacagcuugugaaagaucucgaccuuacagacuuucagagguagggggaagugucuuguuagcgggacagcagcaagacccacccaccaguuuagacugaacugugaacgugucaccaauugaaaaucaguagccauaccaccucacuccuaccucccacauguaauguguugaaaaagcauggguaacgguguccuuuguucuccaaguaugugaugaagggaagagcugaccacacaagcugauagaauucuuuucugcaucgaaguagcacuauuccaguauaggcauugagauaucgaacuacaacaggaaagaaaaaucauuuuggaaaacuuuugcucugugugguggcucacgccuguaaucccagcacuuugggaggcugaggcgggcagaucacuuuaagucaggaguucgaggccagccuggccaacaugaugaaaccccgucucuacuaaaaauacaaaaauuagcugggugugguggugcgcaccuguaauuccagccacucaggaggcugaggcaugagaaucgccugaacccaggaggcagaggcagcaaugacccccgaucucgcugcugcacuccagcagccugggcaacagccagacugucucgaaaaaaggaaaacuuuggaguaacagagccuacuaugugccaaaaguauguuguaggcaaguggcacguagaucuaucagcgaguaaaagagaaaagccaaaacacccacuguguugcacaccacucagaacuggugaaugaauuuagaauugaaaaugcuuucuaauucacuaguuaauucaauaaauaggagcagguaggaggcgauccguuuuaauuuaggaaaaacccccacaaaacccuugccugaaaaacaggcuguuuuacugcauuugggcuccguaauuauuguagcagucagcucucagucucaccugacuuaggagaguuaagucuaucugcauuuaacucuccagaagucaaucucaaacaagguuaaagugggaacuaauuuaaguggugugaaagaagggccccucuguccuagcucauccuguauuuacauauauugacaaucauguguucuguacuuuaccaacuauuuaagggcuuucccggaguacuuuugacaauuuuuuuccauaugauguuaauguaaucggucauauaauagcucuuacuaggaaguauacacagcuucccucauuuaauucucuacccuaucaaauucaaucacaaccaauuacagaaauuaccugucaagcagguaaaaagaggcuucuagcucaaagccccacugccuucgggccccuccuuuuagcgcucugcuaauuucggacucucgcuuggggucccaggcgcuuaaagagauaccuuacaaaaaacggugcacgggcuuggccacucgugccccuucuuucuuccuccggcgccugcccccuccacaucccgccauccucccggguuccccucuucccccagcgcccuugcacccgcgaagccgauggagcaggcggcugcgccgaaaguuccgugcacccuggcgaucgugucccguacgaggcugcucagaacucggucaucgaggcuuaggcggcagcgggggucgucagacaccaguucgcagagcagguaccugcggcaggcgagaggaagguggacacuagcggggccgcgaggacccagcaaggcacugggagggucuggaagggaaugcuuaccugugcuugaaccgcaccauggcugccuccgcgcucuccgguccggcgugca

SEQ ID NO: 191510 - RNA, 2626 nt, Homo sapiens
cggcgcugcggcaguccagaucaaaaauggcgguaguugguguguccucgguuucucggcugcugggucggucccgcccacagcuggggcggccuaugucgaguggcgcccauggcgaagagggcucagguacuggggccggggucgacgggucgagccucagccccacucgggcgagacagggagggacugugaccuuggcccgaggccuugcgggagggaaagugagacccgggcccgccccauaccggcgcugaacguuuguggcuucuccgcagcucgcauguggaagacucucaccuucuucgucgcgcuccccgggguggcagucagcaugcugaauguguaccugaagucgcaccacggagagcacgagagacccgaguucaucgccuacccccaucuccgcaucaggaccaagguacgcccuuguacaucucuucaagcguccguucucuuuucguuaugugugccuuagugcaaguucuucauucucugaaggcaugggugccaggcguguacagcuuguuuauccucacaaacagaaaauguauuuucuuccauuuuguggauggacagcugacacuugggauuacgucucaauucucuucuucaaggucauacaauaagugcucuucaguuucccuuuucuccgauucauccuaccuccugccuucugagacaguucuuuuuuuuuuuuuuuuuuuuuuuuuuacuucugagacaguucugaaacagguguccguuguguaaagccuggagguuugggaaauccaauuagaguggcaaagucugaaggugguucgcguaagcgaacccagcagcuacaugggaggcugaagcaggagaaucccuugaaccuaggaggcggaguuugcagggagcugagaucgugccacugcacuccggccugggcaacagagcgagacucuggucucaaaacaaaacaaaacagcaacaacaaaacaugggcaucuggcagcuacuaguugcauaaugaagagacugacagcuuucucuauuccccaccaauaccuuuucucgacuguuuuaucauugguuguugauguagauauauuacaauguuguguccucuguuguuugcuguaucuuuaacaagggcuuauucugauucuucaauacuggccaugcgcgguggcucacgccuguaaucccagcacuuugggaggccaagguggguggaucgccggaggucaggaguucaagaccagccucgucaacauggcgaaacacuaucucuacuaaaaguacaaaaaguagccgggcgugguggcgggcgccuguaaucccagcuacucgggaggcugcggugggagaaucuaggagguugaacccaggaggaggagguugcagugagccaagauccagccauugcacugcagccugggcaacaggagugaaacuccgucucaaaaaaaaauaguaauaauauacuugaucuuagccaaaaggccgagaagugaugaaaaaaguuauuauuauuauuauuauuauuacaucaccuagcccauauaggacuggccuuguagaaacuuaaccuagacucuugaauuuguugagucuuugagcggcacucccauccuuguacaaugcaauuagaagccaaacaguaaagguuucucagccucagcacuguugacauuuggggcuggguaauucuuguuggggggcuaucuugugcauugugaaauguuuagccauauccuuggccuguacccacuagguggcaguaguaccugcgcaaccccacucccgcuucccccucccccgcccccaucacagugucucccgauacuacccagugugcccugaaggggcaaaaucacccuggguuggagaccguugcccuaaaguaaugcuuuucaaagguaauaggcaagauaauucagggugggcugcaguuucccagcccagauauuguuugaagucugggauggugccagaaaucugcauuuaauuaagcaucucccuccccuaauacugccaccauuuugauauaggugauuugaggauuacacuuucauaaacacagcacuggauauacuaguuacuagggagaggaugaugaguaacuaacuugagcuugcauuuucugccauccauauuuguuucuggaauuaaaacuguccuguagccaggauaacuuuaagggcuccccugguaguuauaagagcuccuuaaauaaugggaagguugaacuacaccaguagauaaaggacuaauuuccauuuuguuuuuauauaugaucugucaccccguuauaagcaguucaugacgguguucuuucuaaauuauuuucuggaauuaucuaacugacaucuucacuccacagccguuucccuggggagaugguaaccauacucuauuccauaacccucaugugaauccacuuccaacuggcuacgaagaugaauaaagagaaucuggaccacuacccgggcaccagggaccacagcacugguuuggaccguuacucugcacauggaccagaaaaaguauaugggaccuuaagcucaccuucuuuacuuguaucaaaugaugacugguauacuggucucccaucccuuugcuuguggcaggagauggcuuaaauaaauaacuuaaa

SEQ ID NO: 191511 - RNA, 206336 nt, Homo sapiens
aguugccuacuuuccccgcagugcgauaaaccccucguuggggccgccuuaguucucggccgcucucggaggauggcgaucugggagccccuccaugggaccccucucacacuuugucacuggaauuuuauuuauuuuuuaguucauauuuuauuuugcuuauagaagagaaagauaucccuuccgaagaggaggaagcuuacagaaguuuauaaccuuucaaaaaguaaauaaguccaggcuugccugauucugcccuacccggacuuccuuaucccgucugugggagacccaggugcuuucucauuacucuucagaaggaaaccgcuuuggaguucguguaauugggacuuggggaucagggagaaguugccgaaacuucucauaccaguaacuacugaaguagaagauucuggaaaaauccuugucuugggggcacaggcuaaaaccugaaggauuuuuaagaugaccaagguuccagccaccaagaagcuucagaguucccccaacucgggggcuguccggcccuuuuaugccucggagaaccuaaggcagguaagucuccccucugcugaaaccaaucauguuuucgagaacaagugaaauaggaauuagcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucauguguuuuuuggcugcauaaaugucuucuuuugagaagugucuguucauguccuuugcccacuuuuugaugggguuguuuguuuuuuucuuguaaauuuguuuaaguucauuguagauucuggauauuagcuuuuugucagauaaguauguugcgaaaauuuucucccauuuuguagguugccuguucacucugaugguacuuucuuuugcuguacagaagcucuuuaguuuaauuagaucccuuuugucaauuuugucuuuuguugccauugcuuuugguguuuuagacgugaaguccuugcccaugccuauguccugaaugguauugccuagguuuucuucuaggguuuuuaugguuuucauguccuuuguagggacauggaugaaauuggaaaucaucauucucaguaaacuaucgcaagaacaaaaaaccaaacaccgcauauucucacucauaggugggaauugaacaaugagaucacauggacacaggaaggggaacaucacacucuggggacuguugugggguggggggaggggggagggauagcuuugggagauauaccugaugcuagaugacgaguuagugggugcagcacaccagcauggcacauguauacauauguaacuaaccugcacaaugugcacauguacccuaaaacuuaaaguauaauaauacaaaaaaaggaauuagccucgaaaccaacaagggagagggagagagaggagagucauggugugauuaaauugucgagacacauucccguugcuaucaauggcugguuucucuuaaagagugaaaacgcgaaccagaucagugagcugggccauccuauuagccaguaauuccaaaaugauggaauaaaucagcaaugacacuguagaacaucagaaaaaaauuaagaugaauuguagguuugccgucugcaggacuuacucucagagaucugcuggucuccagaaacaggcauauccccucucucuauggagaggcugcagagggucaacuuuugguguucaaaggcuagguuugccacgcaccagcugugugacuuuagacaggugaauugcuuagccucucugaggcuuuauuuccuugugucuaugaauuuagaacaggaacaucaacuaggcagaagcagugugaggacuaaaucgaauaagcuaugaaaauuguccacugugauguuaacgcuggauaauguguuuaugggacaugaaacaguguuguugauuugaaaaacaaagaaaaaucgauacguacugaaugacuggaguuaaugguuccuguuuuuuaaaugaucauaacuggacgagcacaacuguaagugugcauuuguuauuguauccucaaaccccacuuugcauggacuggccaaggucagcaaugcugguccacucuagugcauccacaaggcacaguuguggcucacagucaugccccaggaaggagggccuggcagguggucagucugugaaggagagcuuaaaacucacaagggcucuccaugugguccaaaauguucccaagcugcucuucucuaaggcuuaacccaucucugugcacuccucauuacucagcccucuuagcaagaccacucugcaagauacagccuuuuuccaucuccuuucaucucaaaauaccacacagaaggauguucaauccagagcagcccgcucugggacugaacuucccagcauagcggugggagaaugaaugagggaaagaaugaagagggaaaugaacacuucaauagcgagggugaacaucagagcgggagcagcagacagaaucacccuggguuuggaucugccucuucgcagcccuguggucuugggcaagcugcagagcugcuccgcuucagugcugccaucugcaaaacgggaaugucauagagcuuccucaugggauugcugugagcauuaaaugaguuaacguacgccaaaagcuacgagcacaguuccugacauauaguaagcacacuuuagguuuuaguucuauuguuauuucauuuauuuaguaaacauuuauugcacugcuguuaggugcuaaacacuugcucuaguuaaaaaugagacucgccuucaagaaucuuacaaucuauaguguguaugcuugggauggggaguaaaagagauaagaaacguuauaaugcagguugauuaaugauguguugaggaaguaucagaggguguugugggagcaaagaaaagggacagcuaauuuagauucacgcauguguguguguguauuugugugugugugugugugugugugugugugugugugugugucuccauguuggauuuugggaagaaacaagccauguacucaaauaaauguaauagaguuuuucauccuaccauagagagauguagagaguggaggaagauguagaagaugaaaugaucaucucuuucuugggaggaggguagugggacucagggaugucaagcaaugggaagaaggcuuccaggaaacuguuggauagaccaagacuuccggcccgaaagccucauugaaauccuucgcaccccucucuacuuucuaggaaauaaugaagaccccagggguuccuagcucacauucaaaagaucaugcccuuaggaauuucaagguuuuagaguuauaguaaagcauuaauuaaccuaaucuagcgucaauagaaagugacaagccacaaggaaauauguagagaucaggauugaugucugggguaaaucaaaugaauaauaacugcagucaugaucaugaucaugacgauaguuggcauguauugaguaugcaugcaucaugugccacguauugaacucaaaaaacucuuaagugugauauuuucagaaccuucuacaauccuucaagcuaugaacuguuaccucuucaugagauggcaacacugaggcucagagaggacaggucccuuacccaagggcacccaacgggcaaggaacagaacugggauuugaauucauaucugucuggcucugagcacaaguccucuccaucucaccauucuagucaagcugugauaaaugguuguucuguucaaugugcccagcaccacaggggcuacaaaaauaagguguaagacacaaucauuggcuucaaauagcuuccagguuuguuuggaggaggaaagggaacgacaccuaaaaguagaaucacaaaaugccaggcggcccgguaagugucuaaugaggaggaauaugaggaguggccucucccgggggaagguauagccacacuggcugcgugguaauauuaagaguccccugcauacuaguauaaugaaugacuguuggaaaaaaccucaaaagggucucgaagcccucugaacuggccauuuuccuuucucacaggguuggacauugcuauauccuaacgaauguuccacuggcaacugccuuguacaggcucuucaugguuuuuguuuuuguuuuuuuuaacugagggaauauaaauaacauaugcaaauccucuguuugaaagucuuuuguuaaagaaaccgucuagcuugcccuuauguuggguucccuaaucugcuuagggagucccuuuucccuuuguuuccuaaggaagcagacgaagucuaaugggaucagacaugggggaggggagaagcagauuguguauaggauuaccacggacccacgauuucugccuuggaaaaggcugaaaaagagaggugcuuagaacaucccccuuuauguucuagaaugaaaacucaaaaguagcauuuggcaaaaacuguaaagguuugcaauccuuuauacaagcucugucucuuagugucugaacuuuccaccucguugucauuaaaaacccagagagaaaagcagcaucccuaauuugggcagauccuaaaacuuccaggaaccauucugggugacuugcucauauccuagcuuuuagugauuaaaggagcagauucugccaggcgcaguggcucaugccuauaaucugaacacuuuggggggggccgaggcaggaggaucacuugagcccaggaguuugagacaagccugggcacuaaagugagaccccaucuccacaaaaaguaaaaacagaacaaaacaaaacaaaagaacuagccaggugugguggcauaugccuauggucacagcuucuugggaggcugaggcaggaggcuugcuugagcccaggaggucaaggcugcagugaacugugauugugccacuauacuccagccggggugacagagcgagauccugucucaauaaaucaaccaaccaauaaaagagcagauucuucgcaaacucugugcuccagcuggggugucagagcgagauccugucucaguaaaucaaccaaccaauaaaagaguagauucuucggcaaacucuguggguucgaaccccaacacugccacuuacuagguugugugaucuuggguuacucaauuccucucugugccucaguuugcugcucugugaaacaagcguuaucacguuuuaucuaauccaagaagccuuccauuuccagaugcaucaccauuuucuugugcugcuaaaaaagaaaacuuaacaaauuaaacuaucaccuguuucaauuauaugucucaguuucagagguauuaaaaugcagaaagaaaaggugcaucuuaggauagaugaaauacauguaaaaaugcuuccccaucaaagggguguugugggaauuagaugacuuaauguggguaaugcuguuagaacagagccuggcauacaguaaauaccauuaaaugguagccaccauuacggcguuguuuaauccuuucaacaacuccauaauagagguauuguuaauaagcuuuaguaccuagguagacuggggcuugaagauccccagggucuaguucucugcugagagguaaguuggcaggugccugaagaagggggcaaacccagguauggaaaagaccugggccugacggucuccauccuuccugccgccccacccccugccccccaccaccaagugaugaggauggaugucuccagagacagccuuagaagcccaauccagcauauacccagcugggcugccuggagucggaaaaggagaaccaacauauuugagaaacauuuuccccaacaagagaaaccuggacucccagcacaauacguuuccauggcaaacauaaaacgauuuuccuccuuguccaaauagaagaaauugugaccugaagagauaaauggcgggcuguagugagucauugguuuuuguuaaaggugacgucagcgcucagugaucucucuggccucuaaucacugagaccacgcccccugcauggaaucacugauuacccugaaaaaaauaaaacaaaauaucuaacaaccacuugagauucaauucuaaagaaucucagcuggcuguuccauuuuuauaucacucaugacuuaagccaggaaaagagaaaugagggagaagggacucuuuucucucuccaagagguucuucuagcuccauugcuacugcaugagauaaauugcagaauucauguuuuuuguuuaggugguuuguuugguuuuuuguuuuguuuuguuaucuuuauggccuaaugcuuuggacaggcaaugcuugccuuagcgaaucuugcugugucuaauugcaugggcaugugacagucggcucuuuuccaugauaaaucaggaugcagggaaggaguguguucauuaccuccugacacgagaagagcgaucggcacucuucaugcuggacaaaaugaagcaggcuauuugucccaucugcaaggaggcagcugcucugcagggggaggggagggugggagaggagugaagaaaugauccaagagucuuguugaugggauaauaagcuuuguaauuaguuagaagcucugccuuugaagucaggcaaagguggguucaaauccucuuuuugacacucuagugugaguuucugguaaaugggguugaagaacaauaagaucuauggcauagauguuuuggaaggauuaaauaaaauaaugcaugugaaauacugagcacgauacccaguuagccuccacuaaguggugacauggucauuauuguuacuugugcuccucucccuucucugauuggacaugagugcuaccaugacuguuuugaagauauggccaacccagagaugaagucuagaggaaacugaguauuaacuguaaagucacauagugagguccaucauuaaugaggccaggccucagcuuaaggguagaagggaagaagcagguccaaagauauuuuuagaguugguaugagaauauauuugcaugagagaugcaauguguuaguuguagagaagggggugcuccugagcaugguuugaguuccuuggauuuaccucucagcucagucccauuauucaucuuuuaaucccauagagagccaaaggguagugaggaaaaauaaaaggaaaacaccauauauaaauuaggguuguuuuuggcugcaaguaagagaaaaacugaaaagcagcgaaguaaacaaauaggaauuuauuuuucucaugugagaagucuggagguggauagcuguuggcauuggcucgagagcucacuagcaucaggcuggcaaggcccaaggcccuuucccucauggucacaaaauggcugucccaggucacaaaauggcugucccacauccauauuccagcagaaagaggaaaaagcagagaggaaaagcuauguuugucccuuuuaugagggaaacagaagcuuuccaagaaccuuccugaccuauuuucucuauuucuaauuuuccagaacagugucaccucucuuuucuagcaguaagaauggcugggaaaguaugcaucuaacaugaguauagaaagcaggagcaaggaagcgauggugauauugaagaugaguacuggauugacuauucagcagugacuugcacaaaugauuucacaaaaauucaaauaauagggaucccaagccaugcauugacagaggguaacccaaaaaaggagucaucccuauccccuacccuacacaacaacugcuuaggaaucucaagggcacuuguccauaguaguacccaucaaagagcugugggggugagggaaaaaguagaguucccccagugggaacauuuauucacucaacuaacauguauugaguuccaaggauaggccaagcaugguuauaggugguggggacacagaagugaauaaagaaaaucaaaugagacacucuggacacucugaaaaauguagggagaauaacacaagcauggaucuaaacaaauggaaugugugccaucuuuauuccugugacccccaucuguuucacuguuuggugaggcuuaaggaaauucugguuagauaagccuuugcacaacuguggaaagaaacuuauucuugacuuccuuucaacauccccacagccaucagcuguuaaauucaaaagcugcaaaaauucauaugggguucaguggcaaauagcacuuacaaaaaaucugacagaagccaauuaaaccuuucuuggacugaauaaaccaacauauuuuuucucagagauauuucugacagcuaaauucaaaaucauaaucaucauaaugggauaccuucuaucaugagaugguggcauuuucccuucuaaauuccuguuuucaaacucugcugagaaaauuucuugcggggcucaauuuugaucuaauguauuucugccuaaauuggaauuuaugcaaucgguaguuuuauuuaauaacuugaaaauuagccgcgucuggcaaucggcuugcaagcuuggaaaugccucgggguuucuggauuucacuaagcggggagauuauacaacugggacagauucugggauagguucagcauugucagggguuucauaguggcuguagaucaggggcagaacagagagagacuaucccucauugcagccugguacaugaucagggucaucuuuugagguauauauugagcaccuaccaugugacagauguuuugagggcgcuaaaaugcagcagacuuguggucuucucccaaggaacccacagugcuguuggaaagaacauuuauaaauaacuaugaaucaagauagugaauaacaaguaccaaaagaaaggcaaacuauauauauauauauauauauauauguauauauaagcuugagguagaaacaaguucuaucauggaaagacaggugcagugaagccaucugaaucuugaacguuggcuggauauagacuugggugguacuagacacugagccaaaccuagaacucauuuucuaauacaucagggaggaagggagggggcguauuaccauucuccugcaaaaaacaacuucuuucuugguauccugucugaaaaaaugcugccucacagagcuccagcagaucacucuuuucauacucuccuucuccauacccaaaguuacccaaguuucugucccaaaggguugucaaauuagggaggacuuugccccaugaacucccacuaaagcuuuaaauaauuggaaauaucuaguguguuacuucucuccaggcuuuacguuucagcagaguuucucaaauuuggcacuauugaacauuugaggccagauaggcugucccuugcauugcagggugugaagcagcauuccugaccucucccuauuagaugacaguugcagccuccccauggugacaacgaaaaacaucucaguauugccaaauguccucagggggcaagaccauccacaguugagaaucaccagcagaaggauacuaaagucuugacuacccuuccccaguugaaugccuaucugaugguaaaaccuuccccgucuaaauaaaugaugccgucauguacccaguuguucaaguagaaacccaagcuucaucuaugaccucugccucuucaucaccccguauguccaauuaacuaccacaggguggguguucaguggaugcugccuccuuccccaagguuacuaccugguccauagcaccauuauuucuugccuggaccaccccauuggccccauuacuguacuuuuuaccuuccaucugacccauuaucuuucaaugcaagugugauacugucauuccccuuguuaaaacaauucaaugacccucuauuguccugaaaaugaagacgaauaucuuuaaugaaguuuaaaagucucugcaugaucuggcccauggcagguucuucagccucaucuuucuucacuuggucaccacuaaggagccacacuaguuuuggaauuucugccuuauaucuucuuccuccucuuagaacauucucucucucucucucucuuucucucucucucucucucucacacacacacacacacacacacacacacacacacacacacacaaucucuccuacuuccuucaaugucagcuuuaauaucacuucuuuugacaagccuucccuggccaccaccuccccauccaggucacacgcuucuuuugcaccauaaaauuccccuuuguaauacuaucuucccuaggaaacuguaagcuccuccagagcaagaaacaugguggcuuuuuuguugccaccacuuugguaucccacaggaccugccacaucagacguacaauuaagacuuagaugaguaagcucuuucuagugcucucuugucucauaaguauaacauuaaagccaaaccaacccugcuuaagacagaaaaaggaggcugggcacgguggcucaugcccguaaucccagcacuuugggaagccaaagcaggcggaucaugaggucaggauuucgagaccagccugaucaacauggugaaaucccgucuuuacuaaaaauaccaaaauuagccaggugugguggcaugugccuauaaucccagcuacucaggaggcugaggcaggagaaucacuugaacccgggaggcggagguugcagugagcccagaucaugccacugcacuccagccuuggugacagagugagacuccaucucaaaaauaaauaaauaaauaaauaaauaagagagagacagcaaauggggccugcaguuuagaugggacauagaaagggagguaccucucaagaccucuccucaaacagucaguuuagaugggacauagaaacggagcugccucucaagaccuccccucaaacagccaaauccuuaugguuuuucacggcaauaucuuuccagaaauuugaauggugguggagcaggcauagcccuuaccuggaauuaagaggccugguucccagcucucucacuaucuggcuguaugacuuuuguuuuuguuuguuuguuuuuuguuuuuuuuuguuuguuuguuuugagacagucucacucugucacccuggcuggagugcaguggcgcgaucucagcucaauucaaucuccaccucccggguucaagggauucuuuucucagccucccaaauagcuggguuuacaagcacaugccgccauacccagcugauuuuuuuuuuuuuuuuuuuuuuaguagagauggaguuuugccauauugcccgggcugaucccgaacuccugggcucaagagaucuacccaccucggccucccaaagugcugggauuacaggugugagccacuguaccuggccuggcuguaugacuuuggacaaaucacuuaaccucuuugauuucuuugucuucaucugaagaaacagggaaucuuaaccuggaaauugcuaggcucccuugauggcacuugaaaaaaaaauggcuaccacuuacugagcaucuauuuugcaccaauuucuuugccuauauuauuaaaaugaacucuucaauccaguguggcaggugcuaucaugacaucuaaccucuacuuguagagaugaggaaacugaggcuugaagaaguuuugcaaccuguccagagacaccagagaagcaggugauggaguuaggauuugaauccagaaccaaguaacuacagaaagccugugcucuuaagaugagccugguagguugcaguaagaaggggcaaguaucucucuaaaaggggcaacuauuggugcaauuuuuaaagaauauguuuaaaaagccucuggaagaaaggggaaagugccaauuuuagcuguaggcaaugcaaacaagaaugugacugugcccgugaccacagacaaggauauuugcauuuucuugagcuuuugcuaaaauaugcuagcagguuucugccagaaaaaaacacagcuaaggaugagaagaagagggagaaaaaaccugcauguggcuuagacucaucuuucucuuucuuucuuucuuucuuucuuucuuucuuucuuucuuucuuucuuucuuucuuucuuuuuuuuuugagacagagucuugcucugucaccgaggcuggagagcaauggcgugaucugggcucacugcagccucugccuccuggguucaagcgauucuccugccucagccuccugaguagcugggguuacaggcgugccccaccaugccuggcuaacuuuuguauuuuuaauagagaugggguuucaccaucuuggucaagcuggucucaaacuccugaccucgugauccacccaccucagccucucaaagugcugggauuacagucauaagccacgugcccggccuagacucaucuuucuaaauaauguucauuucaaugaagauguauaagccauuucuaauuagagucacauuucuaaaaaagacauauuuugauacuggaucaauauacugccaaaaccugcuagaaaaaauggagaggaagacaggcccaacuaaugagagaugaggcucugggguguguguggcugaaauguugauaaucguaaacagcuuaauuggguugaauacuuugaguaaauaucaaguuaaauggauucacucugaauccaagcucugacccacugaaauuuuuauuuucuccaaaaaaaauucuguaucauaauugccuguuuauuuuucugaucucaccacuggacuuguagcuccuugaggaaggugacaccaugcguugcucaugauucuauccuagagccuagcacaggggcugauacuggcaaaauguucaauauucucgucucuauucucaggaccaaggguagcuccacauagugaggcaacacauuccuuaggcaacuagaaauuccauuuggacaaggccuacaaauguuuuauuacuauauucccaguacaugcugggugcuccauauauaugaauaccauucuaauacuuacuauguaaacuugggcaaguuacucucugugccucaguuuuccucuccuccaugcaaaaauaauaacaguuccugccucaucggguuguugagaggaucagggacagccccaggcacguagucagugcucacaaaauguuaucucuuaauauucuccuucaaaaucgaagccaauggcucccaaauaucaagaauuaaaauauuuaaauacugacauuuccagagaugacgauucuuaugcugaucauuuuuaugcauucaggaaaaggcagccaaaaggauaacaugacuaaaauguuucacuucuaagagcccuugaagaaaaugcccaaaaggcaauuagcacaugacugucgccuguguugcuauugcucauuagcugaucccauccucugcuaaucaaacugcuucuuugauauuuuuagaccuuuuaaaagaggcuccucaaaacucaggaagcaaugcuuauuggcagauaccaaagaauuugagacaccgugaauauggcauucucauagagaaugugagaauggugagagcauucugcagggucuuuuagaaccagaguaagcaguuuggaugcuucuuuaacccuaacuagccuccucaccuuuucacuuccugccccaaccaacaaacagccuucccaguccccuguuccuuguguucuaugguucaggauuuaaauugccucaguaaaagcacauuugagucuccuucacuaaacaaacucuagccagagcugauugaguuagcaucugggucacgggcucauucuagguuuugagucccaauucugaugcuguuugccugcucugugaccuuacacuacccauuucacuucucugaugcugaaagcucucaccuguaauagaaucucgugaagauucaagauaauguucauaaggacugaguccaaaauaauagcuaagguugauuugugauugacauuuuucaaugcucuugauguuuuaugugcaucccagccaucuccauguucugguauauguaaugccaggcucuuuuguccagaaaaagauggcauaguauugagaaaagaaaucuccuccugauaaaucaucauucucucaaggucguccuggagguauauuuuuguauucuccaugagguuaaaaauuaugucaauguuuuaagaauaaguaaaugguacauuauauagccaugaucaugauaauagaaguaacucauguuauuggcugaguacuuaauugugugccuugugccaugcaaaccccuuaugugaguuaugcaauuccaugcagucuacagugcuaagaggcaggcauuauuaauuccauuuuacagaugaggaagccugucaacaagggucauacagcugcugguuaguggaccauccaucauuuuuaaccauuaugcuguauuucucaacaagguaaacuugacuuuuuacuggggguggguggguugagagaaaauaugcccccacucucaaaagaagagcagaaggaaggaaaaccacccacuuugagaagcuuugggggauagaaaaaacauugacugcaucuuauaacuguucacuucuggcuucucuucacccaccaaggccaagguccagggcguguuccuuuuuuuuuuuuuuuuuuuuucuucugagacagagucucucucuguugcccaggcuagagugcaguggcacaaucugggcucacugcaaccucugccucccagauucaagcaauucucaugucucagccuccugaauaacugggauuacagguguguaccaccuaauuuuuuuguauuuuuaguagggacaggguuucaccauguuggccaggcuggucucaaacuccugaccucagaugaucugcccaucucagccucccaaagugcuuggauuauaggcgugagccacugcgccuggcccagggcguguuucaaggacacccuguucaccccaguagucccugaaguugacaacggacagacauuccacaggacucucaauccacuccauccccuccaagaacccugugaagucuccaucccgucuuuuguaaugucaguaaucacgaauauacccuguucauugaaugaagccugggauuaucuaaucaacccaacuuuaucuuugccucucauuacucccuucagauauuuucagugcaggaagcucuucucuggagccugcauaaaaaugguguacccagugccuuuucugcucacccuugggugacagccacucuaguagucucuuuaagucacaaaacacagccacaauucaaaaaccaaaagcauugacauaagauacuaagcaacauuucaaccuucccucaaggagaagagugguccuguucuccucccuauuaaggaugguuucaggcaggccacccaggagggagauguggggugugccccuaucuugaaccagggagauccccagcucuucuuugcuuuauuauuuauuuauuuauuuauuuauuuauuuauuuauuuauuuuuugagacagagucucgcucugucacccaggcuggagugcaguagcaugaucucggcucacugcaaccaccgccuccuggguucaagcauuucuuucgccucagccucccaaguagcugggauuauaggcgcauaccacaacacccagcuaauuuuuuuguauuuuuaguagacacacaguuucaccaugcuguauuuuuaguagagacaggguuuuuccauguuggccaggcuggucucaaacuccuuaccucaagugaucugccugccucggccucccaaagugcugggauuacagaugugagccaccaugcccagccucuccuuugcuuucuaacuguauuggcuggaaaagaaaauaggagacaugggaaagcucuuaucagcacugccauaaaaugguucuauucucucuggguccagcagaugccuaaaauuggcucauucugaagguaauuuuguuggcugaagguaauuuuuucaaaguucucuacuacaaugcucugguucccgcucucaacauauuuucuaccagcugugcacuccccucagauccuaguuuuucagaaguccaccccauucagacucaugauauugggguguccugcauacuggugggagucauuaugggcaggaucccagguugcuguuucugccuuuggugucacaucugauccccagguuucacacaccccugacauaccacugaagacaagcaccacuuccugacgcagcagcuauucuccaucucucuaccuuccuugccccagaagcacuucccagccugcgucuguucucuggauuuuccaggagggugucagagaccagcccaccaguccccagcugcagggaucucaucuucagcucuugagcaaucccaaugguggccucucccucauucauuuugaggugaaggauaaagcauccucuucccuuuggggucaggauucaaagcaucacagaagcuguugaugaaauugcuucguaagugccucucucccuuuccacucucuaguuuuguauucucaaaguggguaagaauugagagauccauucucccauagcuaccuugaagaugccuucaggguggucuuucucacuuucacuuggugucugaugccuaucuugagcccucaguccauaccaucuguauuaguccauucucacauugcuauaaaaaaauaccugagucuggguaaccuauacagacaagagguuuaauuggcucauggcucugcaggcugcacaggaaacauggcagcaucuacuucuggagaagccucaggaagcuuuuacucauaguggaaggcaaagcaggagugagagccuuacauggcaggagcaggacccagagagagaaggggagaugcuacagacuuuuaaacaaccagaucuuguaacaacuuuauuguaagaacagaaccaagagguuagugcuaaaccauucaugaaagaaccacucuuugcuaaagcauagcaagagugaccuuuacuccaguucccaguaaguuccuuguuuccaucugagaccaccucagccuggacuucauuguccauauuacuaucagcauuuuggucacaaccauuuggcaagucucuaggaaguuccaaacuuucccucaucuuucugucuuguucugagcccuccaaacuguuccaaacucugccuauuaccuaguuccaaagucaucuccacauuuucagguaucuuuauagcaaugccucacucccaguaucaauuuucuguauuagucaguucucacacugcuauaaagaacuaccugagauuaauuuaugaggaaaagagguuuaauugacucucaggaagcacaguuggggaggccucaggaaacuuacaaucauggcaaaagggcaaaggggaagcaagcacaucuucacauggccaguaggagagagagaaagugaagggggaaagagcuacacacuuucaaaacaacuagagaucaugagaauucauucacuauugugagaacagcaagggggaaauccacccacaugauccagucgccuucuaccagaccccaccuccaacacuggggauuacaguucaaccugagauuugaauggggacauggguccaaaccauaucacuauccugccuguuagucuauccuguuauccuaccauuuacuaaggguucacugugugccaggugauuuacaaacaguguuuugaaaccugaggacaacuuugugaggaagguguuaucaccucuuuuuuacagauaagaaaacaaaggcucagaauuuaaauauguuuauaagauguugcacugcuaauggauggagaagcuaacccugaaaaccagcccagucuggcccaaaagucucaauauuucccucugcaacaugaccagagcugcuaauaauugcugggauggagucuuggcuucauucucaaguuucucaaauuucacuucccagucagacaugguggcucaugccuguaaucccagcacuuugggaggccgaaacagguggaucacugaaggucaggaauucgagaccagccuggccaacauggugaaaccccgucucuacuaaaaacauaaaaauuagccggaugugguggugguagguaccugugauccaagcuacuugggaggcugaagcaggagaaucacuuggaccagggaggcggagguuauagugagccaagauugugccacuguacuccagccuggguaacagagugagacucugucucaauaauuaaaauuaaaauuaaaaaaaaauaaauaaauucacuuccagaugaugcucauacagcuuuuaugagcccuccuugcuaccaaagacucuuaagcucagaaguuacaggagcauuugagaggguggagugggggugaggggguuaugacacuguucaccucagaugcagcugucucagggucacucacaaaacaaagugucccuuuucuccuuuuuuuuuuauauaagaacaugguccuccugcaaauugacuugaaaggaagccagauuccacuguuccuugucugccugugaaggaagauagccucuuucagcacuuaaaggaccuuaauccaugauagggaacuucaugaaauggcuggggauguugaucagaggucagauggccccuaaguagccaacacagauccaaaggaaaucaaauaaugucacucuccagaaagcaguuuuuauuucaccaaagguuuggaaacugugcauuaaacaaaucucucaaaaucucucucucucucucacucucuguccaucucucuccgucucugucucugucucucugucucucugucuguauuucucucucucugucucucauucuuugucucucuauguuucucuccuucucucuccccucucuccuucuucuucuucuucuucuuuuuuuuuuuuuuuuuuuuuuuuuugagauggaguuucacucuuguugcccaggcuggagugcagaggugugaucucagcuuacugcaaccucugccuccaggguucaagcaauucuccugccucagccucccaaguagcugggauuacaggugcccaccaccacacccagagggugagaaaaagggguguggcugggcgcaguggcuuacgccuguaaucccagcacuuugguaugccaaggcgaguggaucgccugagguccagaguuugagaccagccuggccaacauggugaaaccccgucucuaucaaaaauacaaaaaauuagcuggguguggugcucacccucuuccuggcuaucugcucucucugucccugcucucuugcucucucuccucugucuuucucacucucucucacccucuuucuagcuaucugcucucucccugcuugcucucucucuuucucucucucucucgucucucuccuaccucuuuccuuucuucuccauuucucucucucucuuucucugucuacccuccaucaugacaccuaacaauauuucuuaguucuuccuaugcuuccuuuuagcuuuuuaaauaauuguaacaauuuuaucuguuuaaaaagugaacagaaaaacccuagacagccuguucauuuggacaucaaggaaagcagacuuucagaccaauugcuaggcaauccaaucccacagacuccuuguuucguuaaugugcuuucgucugccuggauuguaaugggugucugucuguaauuguguacuuuagguaaauagaucauuagauaagauugauaacagaguggcuuagguaauguuuuaaaccaaaagcagaaaaucaucgggugucuccagcuguaaaugacaggaccacaauucauacaguuucaguuaagggucugucaggguuuuucagcauaaaucgccauuuucugaagguucaccuuucugcuuuagcaaagaaacggggagacuuucuuuccagcuacagcacagugcacggggcuccaggcaaauggaugugaguuuguuugcauaaagaacuugauaucaaguuacugcucauuaauguagaccacaaaauguuuuuacaaauaauuucuucauuuugcaaaggcuggcucucagccuuugcugcugcuccaaccagggucacagagcacucagacacugucuuuauguucuaguagcaguagaauucaggcuaacagagacaaagccaaagaaaucucuucuuggguuaaagaggcagaacaauccaaaccaauagauucucccaguucugaagauggggccucaucaucuagagccacagaaucauagaguaaccuugcagggcaucuaaccagcuuccuauccaaaaugggaggauauguaauguuuuuggcuaucaggcacaguaugagccauggcucugcuauuuucuuccuguuugacccuugaacaaaucaccucucaugccaagccucaguuuccuuauccacaaaauggagauaaagacagugccuacuuuuaaaagucuugaaacuuggguaaccagggugacuuggucucccugagagagggcuggccugaggugggcacaguacuaauagguggucugaucuucuacauugucuuccuauuuguugguaaaauuguuggccuggguucaggcacauacucagagcucauuaaaaccagacagauuaggaaguuccucccuuuaagaagcuuucucuaacucucuccuuguuuucuuccucccuaacucugugcgguuccacagucagagccuucaucaugcaacugcugauacgucugugucaccaccagcagcagauucaucagagcaggaacagccauuaaugaucuuugaauucauucauuuauucaaaacccauuugcagcacaccuacuauguacugacgcagggcagacgagccucaaaauuggggcuuagcccgggaggguucuuggcuuugcccagggaagaauucaaggucaagcugguaauguuagacaacaauuuuuauugaaguggcaguguacagcagcagcagaacugaugcuccuugcagagcagggcugccccauaggcagugugccacgaguagcagcucagaggcaguucugcagucauauuuauacccauuuuuaauuauaugcaaauuaaggggcagaauauguggaauuuucuagaaaaagggugguaauuuccagguugucggguuguugccauggaaaggguaacuuccaguuguugccauggcagugguaagcugacauggcaugcugguggauguggcucagaaaaaacugcuuccaccuugucccuguuuuagcuaguccucaauuuacuccaguguccaagucccaccuccucagucaaguccugccuccuaccucaguaccaguuaagccccauggaaaaaaacauaauaaauauuuguugaacaaauuaaugcaacaucuuccgcaaauaguggaccuauuaucuccuuguacagcuacuugcucuaaacaguacaaacucuauuuaaaauguauuguucuuuuuaaguuuccacucauucuuaacuuuagauuuucuggauaauuccagaauauucuagagggccauuuacuccuggaaccagccaucuucagugaaaucucuuugaauaucugagaugagguguucuauggaaaucaaguuucccuagguacugcaccuuuugcuuuguuauuagaaugauacauaguuauccauuucauuucauuuuauuucauucauuucauuuauauucauauucauucauucacucauauuuauuucauuuucuagaguuccucacccaucuaaugccauauuucuuucuagagacuuuagcaaagaacucaugucaaucuuuuaugagauuguucagaccauuuccuuccaaaaucuagugcagaauaugaccagaauuaucuccuucccaauacaguaucaguccccagauacaggcacuguggugaacuuuccccaaaguuuccauccaguuuucuuccuuuauuggcucuugguccauuuuucacuuuauuccuguguuuguccaaagauaaaauuccuagcaaugcaaaugagaaauauaucagauguuucacuucagguuugcaacaaaggccugaaaaauuggccuuucaucauugcaguaucuugcaucaggaccaauuuugcaaugucuugcauuucucucuguguucugaaguucuuuuccacuaguagaauuuuucuaaauuauuuuauucucacccaaaugcuuuaaaaaacaauuuuauuaaaguauaacauacauagagaaaagcacacaaauauaaguacauaguuuuauaaguuuuuacacagugaaaagauccaugcaaccucuucaccaaaaucaagauacagaccauuaccagugcuguuguuucaaccuuuguccucuccaaaacucauguugaaauuuaauugccauuguagcaccauuaagagaugggggccuuuuuuauugaaauguaauauuuguaaauauguugauggguacaggugauauuuuguuauaugcauaguauguguaaugaucaagugaggguacuuaggauaccugucacuaggaccauuuaucauuucuguuuugagaacauuucaaguccucacuucaagcuauuuuuaaauguacaauacauuguugauaacuauuauuacacuacucugcuauccaacauuagaacuuauuucuuccaucuaacuauauguuuauacccauucaccaaccucucuccauucccaacacccacacccauaucuuucccaggcucugcuaucauucuauucucuacuucaugagaucagcuuuuuuuuuuuuugagauggaguuucacucuuguugcccaggcuggagugcaauagcaugauauuggcucaccgcaaccuccgccucucaaguuuaagcgauucuccugccucagccucccaaguagcugggauuacaggcaugugccaccacaccuggcuaauuuuguauuuuuaguagauacaguuuuucucuauguuggucaggcuggucucaaacucccgaccucaggugauccacccacuucggccucccaaagugcugggauuacaggggugagccaccgugccuggcugagaucagcuuuuuuagaucccaaauauguaugagagauauauuaguccuuucucacauugcuauaaagaaauaccugagacugaauaauuuacaaaggaaagugguuuaauuugcucaugguucugcaagcugugcaggaagcauuaugcuggcaucugcucagcuucuggggagaccucaggaaacuuacaaucauggcuaaaggugaagaggaagcaggcaugucuuacacagcaggagcaagaacaaaagaaaguggggggcaaggcgagcuacacacuuuuaaacaaccagaucucaugagcacucacuaucaugaggacaguaccaagggggauggugcuagaccauucauggaggauccaccuccacaauccaaucaccucccaccaggccccaccuccaacacuggggauuacaauucaacaugagauuugggugggacacagauccaaaccaugucaggugauuacaugcaauauuugucuuccuguggcuggcuuauuucacuugcuauaaugaccucuaguucccuauaaggugauuagaccagaaagccuccacccucauggaugggauuauugcuauuauaaaagggugaguuuuguccuuucucaccccucucuugcccuuccaccuuccaccaugggaugacacagcaagaagguucccacaagaugccacgccagccccucaaucuuggacuucccagucuccauuuugagccaauacauuucuguucauuauaaauuacccagucucaaguagucuguuauagcagcacaaaacagacuaagacaaccagaacccaaaaaacccccucaaacauccucccagacaugguccuccuucuccccaaugguaaccaccauccugaccucuaucaccaucaauuauuuuugccuguuucuugaauaucauauaaaugaauaauaugggguauacucuuuuggaucuggauucauuucacaauguuauguuuaugggauucacuuauauuuuugugcauaacugucauuuguucauuaucauugcuauauaguauucuacaauaugaauguaccacaauuuauuuaucuguuuacuucuugaaggacuuuuggguuguguuucagggagaagaugggaguggagcuauuacaaaaugcuaugaauguuuuuuguacaaugccuuuuggugaauaaauguagauuucccaugaguggaauugcuggccagaggaaaugcauauguucagccuuauaagcuuuauaugcugccaaacaguuauccauaggggugguucaauuuauacuaccaccagcagugaaggaaauuuccaguugcuccacauccucaacaaucuugguauugugaguguuuuuaaugucagcuauucuggugggugcuuaguaguaucauauuguggaaaugcuuuaaucugcauuuccuuaaugccuaaugagguugagcauguuuuuuuagguuuauuggccauuuggauauauucuuucaugaaaugccaguucaagucucuuguucauuuuuccguuguuauacacaucucagaucuacuuccagauguggggaaacaagcacugguguaggugagagugaaaaucuguacauucuuggaacaugguuuuaaauacaccaagacccuuuauguagucauuucacuuuuagguguugauugcauggaaauauuccuaauaaguacuguccucaagaauaaauauugagaauauugaguacuuauacauauauuuuuaaauauauagauagaugcuuaucacaggucuuuuuuuuuuuuuuuuauugaucauucuuggguguuucucacagagggggauuuggcacggucauaggacaauaguggagggaaggucagcagauaaacaagugaacaaaggucucugguuuuccuaggcagaggacccugcggccuuccgcagcguuugugucccuggguacuugagauuagggaguggugaugacucuuaaugagcaugcugccuucaagcaucuguuuaacaaagcacgucuugcaccgcccuuaauccauuuaacucugaguggacacagcacauguuucagagagcacaggguuggggguaaggucacagaucaacaggaucccaaggcagaagaauuucucuuaguacagaacaaaaugaaaagucucccaugucuacuucuuucuacacagacacggcaaccaucccauuucucaaucuuuuccccaccuuuccccccuuucuauuccacaaagccgccauugucauccuggcccguucucaaugagcuguugggcacaccucccagacggggugguggccgggcagaggggcuccucacuucccaguaggggcggccgggcagaggcaccccucaccucccggacggggcggcuggccgggcggggggcugacccccccccaccucccucccggacagggcggcuggcugggcagaggggcuccucacuucccaguaggggcggccgggcagaggcgccccucaccucccggacggggcggcuggccgggcagggggcugacccccccaccucccucccggacugggcggcuggccaggcggggggcugacgcccccaccucccucccggacggggcggcuggccgggcggggggcugacccccccaccucccucccggacaggguggcugccgggcggagacgcuccucacuucccagacgggguggcugccgggcggagaggcuccucacuucucagauggggcggcugccgggcggagggucuccucacuucucagacggggcggccgggcggagacgcuccucaccucccagacgggguggcggccgggcagaggcacuccucacaucccaaacagggcggcggggcagaggcguuccccacaucccagacgaugggcggcggggcagagacacuccucacuuccuagaugugauggcggccgggaagaggcgcuccucacuucccagaugggauggcagccgggcagaggcugcaaucucggcacuuugggaggccaaggcaggcggcugggagguggagguuguagcgagccgagaucaugccacugcacuccagccugggcgccauugagcacugagugaaccagacucugucugcaaucccggcaccucgggaggccgaggcuggcggaucacucgcgguuaggagcuggagaccagcccggccaacacaacgaaaccccgucuccaccaaaaaaauacgaaaaccagucaggcguggcggcgugcgccugcaauugcaggcacuccgcaggcugaggcaggagaaucaggcagggagguugcagugagccgagauggcagcaguauaguccagcuucggcuuggcaugagagggagaccguggaaagagagggagagggagaccauggggagagggagaccauggggagagggagagggagagggagagggagacgagagggagagggagagggagagcucaagucuaucacaggucuauuuuaucaaaaaucuuuuaguugcaaguaacaaaacccucucaaauuuacacaagcaaaaaauauuggaaucagagguucacauuacagaaacucuaagguuucaggcauagcuagauccaagaguuuagacaaagucaucaagaaucugccuauauucauugucucuauuuccauuugugaugguuucauucucaggcaagagcucuuuauugagugucaaaauggccaccagcagcuccagguuuaaauucuucuggcuuaggaacagcagggaaaaaaaaauaagcuucucuuucuguaaagaaacaucaagggucgcaaaagaaucaccccugaguuauucacuuggagcccagagaccaggguuacccacauuugagcaacauguacugaggauggagaagggauaagucccaagaugaaaauccaggugcuuugaucaaaagaaggcagcccaacuguugacaagacaaaaacaguuagugucuauuccaucagcauuaaucauauuuucaaaaaacuggcaacagcccaaaaugugcaccaauaagagaaucaaauaauaagucauguccaugcauacuguggaauauuaugcagccacuaaaaugaacaagguuaaguccguacauauagacauggaaagauggccauugugcauaguuuaaugaggggagugaucauuguauguacaguauaaugaguauggccauauaauuuauugcccaacuuggacacuuuucagaguaaaaugaggugcaucaucaguuauccuggaaaaauacauauaaauuaagauuguccuggacaaacacauauguauuguggccagaauucuaaucccauuuuuauuuaaacaucuaucuuauaucuauagcugugucuauaucuaucuacuuaccuacuuguauguauuuauaauuuguuuuuauuuaagacuuggagguugauucuaggaugcaugagaaggggcuuaggggagacucagccccuuuuaaauuugagguguaaauuacaugccauaaaauguuuaaaacuuaaguuacagcucaauuaaauuuuacauaucuauauaccuguuaaccaugaccuuaauaaauauauaaaacauuccagaagauucucucaucucuuccuaucaauacugcacccacuucucccugcaauaaauaaauaaauaaauacuacacccaccacagauguaaccaguauucuaacuuacaauauugaguuguguccauucuugaucuucauguaaugaaaucauaggguauauauucucuuuuaccucuggcuucuuuugcucaccauuauaucugggugauuuaauccacaguguugcacguaucaguaguuuauuauuuuucauugguaaauaguauuuucuuguaugaauauaccauaauuuauuucuuuacccucucauugauagacauauggaguguuuccuauuuaggacuauuaugaguaaaucuucuuggacauucuuuuacaugucuuuugggugaacauauacacuagauuuucuuagcugggucauagaauaggaauauuuuuaguuuaaucagaaacuggcccacaagguggcucaggccuauaaucccagcacuuugggaggccuaggugggcagaucacuugaggccaggaguucgagaccagcuuggccaacauggcaaaaccccaucucuacuaaaaauauaaaaauuagcgggugugguggcacaugccuguaaucccagcuacucgggaggcuggggcaggagaaucgcuugaaugcagaaggcagagguugcagugagcugagacugcaccgcugcaccccagccugggcgagacagccagucucccucucaaaaauaaaaauaaaaaagaaagaaauuggcaggauuccagcauucuaaggugucagccauguaugagagcuccaguugcuccauauccucaucaaaauuuagucuuucuuauuuuagccucucuggugaguguguagugauaccucaucgugcuuuuaaccugaauuuuccugaugaguaaugauauugaacaacuuuucauguuguuacggaucauuuggauuccucuuuugugaaugccuguuugagucugcugucuuugcaaaauuuuguccucuauuauugacuuguaagaguucuuuauauagucuagguaugaguccucuguguguguguguguguguguguauucacgaagugccuuuuuauuccuuuaauggugccuuccauaagcagaaauucuuaaauuuaacaaagucaaauuuauccauucuuuuuauuauaguuggagcuuuuuuucuauauguauuagaaagccacaagacacagcuauuaauauugcuuuaaacagucaguauucuauccaggcauucauacauuugcuccaucuggucucuuuguucuauucuguggguacuuguuuccaucugggauugacuuccugcagccuggagagcugcuuuaguauuucuuguagugcagaccugcugguggugaggaauuuccugagcuuuuguaggugcgaaaauaccuuuauuuugcuaccauuuuugaaaaauacuuuuauuggagacagaauuguaggugagcagauucuuggguuuugguguuugguugguuguuugggguuugggauuuucauuuuuuagcacuuuaaauaugucauucuguuguuuuaugucuuucauaauuucuaagcagcacucuucacucucugaaauuuuaguucuucuuuugcuuccauggcucuccagugccuucgaaaauacgauccuuguaaucuugcuguugcaaugaaaacaauaggcuuucacuaacugccacaaccuacucagaaauugaaaacaagcuuuaauuuggggcgguuucgagcuaggauauuugcuucccuuccuucuucucuccuuccuuccuucuuuguuuugacuuugauauacucauuuauuuuuaaucaacuuuuugagguguaauuuacauauaaccaaaugcacacauuuuaagucuacaguucaaugagauuugacgauuguaugcacccacguaaccaccauccuaaucaagauauagagcauuuuuauaguccccaaaagaccucucauacccauuugaagucaauccccuccuccuacccuaaaacccaggcaacuccucaucuauacucuaucacuauaaguuaauuucuuuuuuucuguuuucuaauuuccuauaaauugaaucacauaguauaugcucuucugugucuagcuucuuucauccaacauguuuuugagacucaucauguuguuggacauaucaguggccugcucucuuuuauuacugaauaugaauauaacagaguuuauccauucaccuguugaugcacaguugggucaguuccaguuuuucuuuuaaaagucugagaagauaaaaguaauuugccggugcaucuuauaauugaugcccacacugguaacagagcacagacuccgcugggaacagagcacagaggagauccacggggcgaucucccuuuggacaaccgcaagcaugaugaguguugcagaaaggcaagcacaggcugucacaggagcaaacagcaggaagaccuuguuuuguccagggauucaggaaaagcucccugaaaaagcauuugagaugagagccaaggaugacugggagugaaugaugugaagauggagacaggcucugagguguauagaaaacucaguggacauggaaggcaguuggaaauuaguacaucaccgagcaucuacacagugaggcagauguugugauagacacuucuuaaaaauauuguuccauuuaauccucagaacaccugugagaaguauacuaagcuccauuuuaugaacgaugaaucagauucaaggaaaugagauaacgugucccaggugacagcauuaguggucauagcaggauucgaacccagcucuaucuggccucaaaacucaugcuuccucccuguccugagacgagcccugguuagacugauugcaaaggagauggaacaaaagggacagauucaagaaggaucaacauguuccuggcaguaaugaacacuaaaaaaaaguucuauuuauugaaugaauaaauauccaaggaaaggaaauccuuuagcauauugucuguguuuccucguuuguauuuaguucauuguuuaaauuaaaaauaaagacacugaugacugacaaauuuauuaaauccuaugcagucuaccuggaaauugucacauuauacaaaugucaacuuuuguguguguguguguguuuuguuuuguuuugcggucagaggcaagggcuaaaagaaagcaagaucagagaaauaccaagagguguuuacugacuaaagggcaaagggaucuaucaguuaaccaaagcaagauaaauagaacugccaauuaacuuuauauucucagaagcagugagcaaagaacgcugccugaacaaugaaaguguugcugcaagcuuucauauuugcuguugucugcauguaauuuguuuccuuuuacauagaaauaugugguauuaacagaggaaugugauuagaauaccagcggaagcucucuuugauaggagacacacaggcaggugccuaacagccuauggagaucaggacaguuucucuccaguaaacucacaaauuguggggaccaugaucugcuuaauaaguaaaagggcaauggggccaagauuacaauguugaaaacauccaggcuucccaccuggaguccuggccucacaguaauaauaagaauaaagauguauugagauauaucuagaccuaacuauauaaauagacagauagauauacacacauacacacacugugcuaagaugcuucacaugaacucccucauuucacccucaaacaaccacaggguagaugguuuaucaccguuuuagagauaagaaaacuccaguuaguacgucacugaagaucuacacagugacguagauguugugauagacauuucuuaaaaauauuccaauuaauccucagaacaccugugagaaguauacuaaauauacuaagcuccauuuuaugaaugaggaaucagagucaaggagacgagauaacaugucccaggugacgguauuaacggucauagcaggauuugagcccagcucugucugucuucaaaacucauguuuaggagacucuucugcuuuccaccaaagcccuugauuugaaccuuugcucucuccugaauccacacuucuccugaaggaggagcaagguggagaugggauagggcacaggauggcugacucucugacuggagggccuaagaaaccccacuuugacacacacacagaaaacugugcccuggguggggguguggggcuucaugagaaaaucaaguagcaagagagagucuuaacaugcuuagauggcaugugccuguucuccugauuuaauggaugagaaaacugagauccagggcaagggcagugagauagugagggucucuuagaaugaguacagccuucagggacccaccccauguacccgugggaucaagacgagccagaggauaccuccuaaguaagaacagaaggaacagaaaacccuuaggguuuguuguuguuguugugacagaaucucgcucuguugcccaggcuggagagcaguggcacagucucggcucacugcaacuucugccucccagguucaagcgauucuccugccucacccucccgaguagcugggauuacaggcacccgccaccaugccuggcuaauuuuuguauuuuuaauacagacgagguuucaccauguuggccaggcuggucucaaacuccugaccucaagugauccacccaccccggccucccaaagugcugggauuacaggcgugagccaccgcaccuggccugaaaacacguaucauacuugcuaugugccagacacaauucuaaccacuuuuccacagauuaacucagccuucaaacaauccuaaaaaguagguaugauuauuuccugcauuuuacagccaaagaaacugaagcacagagagauuaagaggacuugugcaaggucauggagggcuauaguccuacccucugaaguaaguuaaacccucuccagaaaaagcccucgagucuccuuuucuuguuccuucaaagucacucauagcuuuccuucccuacaugauaauuccaccgccuauauccuccaagucccccaaacucugcauuugaaauauuaugggaucuucacauauuuauuuaaaaguauagaauaagauaucuauuuuaguguuugugugccugaguuauggaggucugagucccagguuugcccuuagcugugaccuugggaaagcuuaguacaauguagaggucaacaugacagcucugcccaaaaguccgugaagugacaaacagauaaacaagauauagccuauccauacaguggaauauuauucagucaugagaaggaaugaaauacuaaugcaaccugcaacauggaagaaccuugaaaacguuaugcaaaaugaaagaagcuggucacaaaaggaugcauaugacaugauccauuuuuaugaaaguacaaaccagggaaaucuauagagacagaagguaaauuugggguuuccaggggcucagaagccugggaggauaaugggguaauauauaaagggguuuuuuuuuuuugagcugaugaaaaguuuccagaauugaucauggugaugguugcacauaucugugagucucuuaaaaacuuuugaacuguacacuuuaaaugggugaauuguauugugugugaauuauaugucaauaaaucuguuuuucugaagaaaaaaagaagaacaagaagaaggaggagggggaggaggagggaagggggaggaggagaaggaaagaaggaagaaggaagaagagaggagaagaaaagaaggaggaggaggaaggggaggaggagaaaaaggagggggaagggcaggaggaggagggggaggaagaggaggaggaggagggggaggagaagauagaaaagaagaagacggcucugaugaaagaauuccuggguucaagccauagagcugccauuuuauagcuguacaaccuugagcuacuggcccaaaccucauuuuucuugucuaauaaauauuagcugagaaugauaguaaaugauauuaaaauguuuagcaaucaguauggcuaggacaccggacccgccauuaacucuuuuguggcuggaucaugugaaaguccaaggagcuugcuggagagggacuggaguggucaggggaacacagggcgguacucucggccucacaauaaagaauuacgccuuccgacuucugagcugagaauuugcaaccaugggggaaaccaucugaaauuggguuugucaucagcagcuucuaaagguuguaccaguggccucaacuuucaaauacaugcccuuuugcccucagcaccauuuugcagugcagcuauuuccauguaauuaacacagguucaugaaugugcccaccuuggguuuccaugacaaucccugcucguaauuaacguggcccgguugcaucucugugcuucgguucaggccaaccuccacuuagucgccacuuuaucuguaauaccccaaauuuaauuggugcuaauuauuucucuuucuaugcuggugauaaccugaucguuucguaguucuuuuuccccuuuccucuuguuuuucugaacuaacgucuagagaggaugaagaaagaggaauggguggggacagacaaugccuauucucuuuggugacagaggaagaauuguggaaagauaagagucucaauauccaaccacacagugaggucucagcugguagaacucaaggcugcagaacuagggauacaggagguaaaagcaggcaggcagguugguacaagagaagaaaauaacacaagcaugaccuuauacgaggccuuccuuuccugugcuggaggaaugaaugcuaaauccaggccugagaaguagccauauuuggagagaaagacgcucgcaauguagguuuuaaaaagauuuacaaggcacaaagcaccaagcucaucuccaaggaagucuccccuuucagcccagaaaagggugaacacugcaaguggagagcugacaaacagcauuccugggggaugggggaagcuuucuaguuuuauuggguuagaaaaaacacuuguauugcauuaaauuucuuaaaucugcagagugccagagauucagagggcugcagaacuuuaaagcccacugaauccuugaaagcuaauguaagcucccuggaaaucaucuugccagagaaacacugaugcauagugguuaagaauauggacuugcucacuagcugugcagccauaggcaaguuacuuugccucucugagccccacagucuccaucuacaaauggagaaaauaauaauacuuagcucguggagcuguugggaggauguuaggaggauguaauuagcucgugggguuguuaggagguuaauguguugaagcagcaucccguauguuguguuuguuaauuacuauugccugcugccucccaguaccuagcacggggccuggcauggagcaggugccaguaaaugguuguugaaugaaugaauguggugaaauggggguucagaggcuugccaagggcaucaguaagugccucaauuauucagaauuuugccuuucaauccaccaccuaaaaucagggauuucaaauguaaaugucuucaagacccaggcaggaaauacaaaugaguaaauucagcuuggggauaaggacguauaccucccuaucaaacacaagaagagaccaggccagaccagcuuugaggccgcuucaggaaagguggucacuuaacguguuccaacaugccugaaccuguccaacgccugauucagucccauaagcccaacccugcacuuagacaauuccaaacaacacaauccauuuuaaaguuccauuucucuccaacccacagaauccauaaugaauuaaggaaagcauaucaaauauaaucaugcacuauuguuaaguucuuggcaaaguugccaaaugucaggcagacagugcgccccguggugcauuccacauccgggacuauggcuuaaguugucaugauaaugaauugccgugcucacuuaggcuugggaauagauccagaauaucaugucgaguugagaaaagaagugccucgcaaaggugacaccuuauaccucauuugcaaggcaacaaucccaaacacacaucacagguauggauggaugagagaagguuauuuucaacacagcucuuuaaaacuguacuugagggccugaagucuaugugaaggggucacguggauggagcaguccacuccucccugcucaucucaggaacagcucugacaucucaccaacaaccuaggccuugaaggcugaaaugcagaaguucaguaauaauuuaagccuggaacuggugggggcauucaucaaaaacacuuacucuucaacaguuugguuuagaauaugaggcaggcauaguggcucaugccuguaaucucaacacuuugggaagcugaggcaggaugaucacuugagcccaggaguuugagaccagccugggcaacauagugagaccccaucucuacaaaauauuuucaaaaaacuuagccagguauaguggcacaccccuguagucccaggcacuuaagaggcugaggugagaggauccuuugagcccaggagguugaggcugcagugagccaugaccauagcacugcacuccagccugggugacaaagugagacacugucucuauuuuaaaaaauaaaauaaaauaguagcuuuuuaaucacccugggcccuggacccuaaugccucagcgauuggauggguugguucucucuaccugauuccauuucuugagacagccuuguguuucuucauuaaaccaccaucacuggggacuugauuccuucuauaggagaacaagaucagaucaugacauugugucuccaucagcaaaauagauacuugagauaauuaauaaaaaaugcaagacacugcccccaccccaagugguacccauguucaauaggagagaggggaggaagggcuuaaagccagaaaacuucagggauuuuucuccagagcccaaaucucauaguucccaaccuauucccaaggccuggauagagcaguggcucaauaaauaguuguggaaugaaugagugaaugaaugaaaugaaugagugaaugaaugacucggucugcuuugugucagaaaaaaacaacuacccuuauagucagagcuggguuagaaucccaugucuaccgcuuaaaagccaucaaaucuuggucaagacacuucucuuuucugagccugagguuuucccauuggugggaucucagaagcgcucccaaguugcuguuucaauuuucuaaaacaaaccacagcauccauccaguucuccaggcagcuguguuuccuaaccccagaguuguucauuucuuuaggaauaggcuuuucuccgggcuucaagaaacaaaccagcuuggaauucuuccugcagagccuggccaggaauuccccucccuggcucugggaagagcccauccacuagagccuacauccauuauuaaaaggggcuugugcugagucucugugaugaugccaccuaaggacucucucaaucuggugaucccaggugggagguggcacuaggacagagguuagaauggcagguaagcaugaucuuaggccggacgcaguggcucaccccuguaaucccagcacuuugggaggccaaggcggguggaucacuugaugucaggaguuugagaccagcuggcccaacauggugaaaccccaucucuacuaaaaauacaaaaaaauuagccggguaugguggaucgugccugaauucccagcuacucgggaggcugaggcaggagaauugcuuaagcccaggaggcagaguuugcagugagcugagaucacaccaccgcacuccagccugggugacagagcaagacugugucucaaaaauaaaaaauaagaauggcagguaagcaugaucuuuaagaguuaggcuagccugggcuugaagcuaggcuucucuacuuaauggcugugccacuuugccucucugagcucucaucugcaaaacuggggcauaaugucaaucuuucaagagacugugagguuuagagcugauguauagaacccuaguaacuaggaaccacccucccauagcguggcuuccagggucccaggguaacauaaaucaagacagagacaaucacugggcaaaaucucagagauuugauugacacauaaaaaucccccacauuauggaagucaggcagugccauaguccaaagcugcuucuggaaaaugcuucaguguucagccuccaccuacgaauccccacucagagagauaucucggugcuugaguccccccgccuuaucagcaggcaugacauagauuucacacaacaccugggcccuagagaugguugcauaacccacuaaacaagccacaaugccugggccuuagagguugcuacacacgccauggugacaugcagcguaauuuuaaauggacagucacuuucacucuuccuuguuuaugauguguucauuucaauagugcauuaggaaaacucuaacaaggcguuucaaaagcauaaugucguggauauuauugcuuaggagagaacuaaaguagauacuuaagguuuuuuguuuaacguuacuguaaagaaaaauauuaauaguaaaaguggcagugcaugaguaccacaauagauuaugaugauuguaagugaaaguuugaauuuuggaaaacguggaaucaggaggagggggcaaugucagguuuaagcugcagaguggguggcgucuccuuuacaaaguacugaaaugcagucaagcugacugaccuggaucuaacccuggagcaacuucaacuuccugaugcuaaauggggagcucagaauauaacuccaauucccuuacagucauaaaaugccuagcacauagcauuuacucaauaaauaaucugugauucuuuugguggugcuuaagagaacacugauugaccuaaagaaaagcuggcuccaaucacucuaaaccccaccggcagcuaugugacucugagccaguuacuuaaccucucugagccucaguuuccucauuugcaaauagggguuuucaucaguccaacccugcuuaucacaauugaggcacugucaauagaagcuugcugccaaaccacuuacuacaugccucugaguguaggaccaugucugucaccguggugagcaauuucagcaaagaggagcagcgugguggacuugaaacugcacuggugaaaguuuaugcuuuaguuuugccaccaaaaaucugugcaaacuuaggcaagauacuuucucuccgggguggggugggggggggucucaguucccuuaucuguaaaaugagauggggggcgucccccuucauuuccacaaguucucauuaauggaagcuuggcuuagccucuuuucuagccauccagauguuucuaaaauacaccacuucugacauggcagagaccaaacauguggaugauugacuacauuuuucacguuucauuuguuaucuagacaggcuuuaaguacauggauaaugaaccuggaauuucaaaugaacuugagccaauuccuuucucacucucucuuugaggcaagaaagguuucuuugaaggaaaugaagagaacuuuaucuuuuuuuuuuuuucugcuccugacagaacaccagcucuugcccaggggcugaguaguaggaagccaacuugccagagggagaaaaccuaugcugaagaggcaguuuucugugcugguuagguacacagacuuugaaauuccaaaagcucuggguucuaaucccagcucugccacuuaauggcuguuagacuuucaucuagagacuuaagaucugagggccuucucguccuuagauggauaauaauaccuuugucacuggguuauugugaggauuaaauagauuaaaauauuaaauauaauguauuacaccacucauccauggcagccaugaagaaauuaccuauaagggucaaugcuauuacucuccuccuuuuuaaagaugagaaaacuaaagcacagagaaguuaacugacuugcucaacuucagagguaguaaguaugaagcuaggaaaggaaaccuuauagaaauaauaaagacaaauacauagauaguugcaaucuggacgggaaaggguaugaugagagaugcuauagagggguggugguguuccuggaaaggggucuugaucgagaccccaagagaggauucuuggaccgcacauaagaaagaauacggggcaaguccauagaguaaagugaaaccaaguuuauuagagaaguaaagaaacaaaagaauggcuacuccauaggcagagcaguggcaugggcugcuuaacugaguguauuuauaguuaguucuugauuauaugcuaaacaagggguggguuuuucaugaguuuucugggaaaggggcaggcaauucccagaacugaggguuccuccuccuuuuagaccauauaagggucauuucugguuguugccuuggcauuuguaaacuguccuggcgcuggugggagugucuuuuagcauaaugcauuaaaauuaugagcagugaggacgacuagagguuacugucauugccaucuugguuuugguggguuuuggcuggcuuccuuaccgcauacuguauuaucggcagggucuuugugacccauaucuugugauaccaguccugccaaccgccuaucuuucugugacuaggaaugccuagccuccugggaaugcagcccaguuggucucagccucauuuuacccagucccuauucaaaauagaguugcucuguuuccagcgccucugacagugggguuuagggacaacgugucuuaagaauguauccauauggacagaaacuuuugccccauugaugugcugguaaauguuuaacaaccagcuuucuggaaaaaacaaacaagcaagcaaaaaacccuaauuugcaauguuuguuugccaguuuccaugguguaaauauucccacuguggccaauuucaagcuaucgaucacugaacaaagaauugggaagcagaugcauacaaucagcucucaugcaaucacccucaccagcuaguacaccauugcuuucuccgcacuggacuugaaagaucccccugagcugucuuugcugggccacaucccuccacccuaccuacugacccaucagagaauguccccauacaaauaaaauguguccaugagccccuccccccaacugucucucuaugaauagcucacugauggcuguguuuuacuuaaucaaucaaaauaaugggguguggagucagggacugagagaccagaguccuucguccaccuaaacugcucccuguauaugacaaagacaguuuucagcagaaugaacagaaauagagccguggagggaaguggcuuggaugucaugaaaauuucauguguuucugaugcaugcaggaugcaauguggggaagugggugagccagaaggcccuggggacaguuuucgaaaugaaucaaguccucagcuucuuccugcaacaaccagccccucccuugaagcucuuaguauaaagucugacaaacguggagccaccuaaucaacuugcccguugucucuuuaaaagaccuccucuccugacuuuccucuggugaaaagagcagagugguaaucagacagaaaggucacauuauaccaagaaauguggcuguuggaagagagcccacacacccacgcccaucuggauuuguguguuggacacguuuucuucuuguauuucauuaauaacaaagaaagcauggccaccuucagaaaaacgcacuugcuaauaccccagugaagcuuagcccacucaauuggaacagcagaggcaacccucucugagcugaagauugggguuugccaaaaacugccuuacacuacaaggcucauccuugaucacuuugaucccuccuguccuaucuuuccaggaauaccugcaggucuccaauuaaccagaaugaagaaacagggccgagggcaguggcucaugccuguaaucgcagcacuuugggaagcugaggcgggcagaucgcuugaguccaggaguuugaaaccagccugggaaacauggugaaaccccgucucuacaaaaaauacaaaaauuugucaggcaugguggcacgcaccuguagucccagcuacuugggaagcugaggugggaggaucgcuugaaccuaggaaaugaagcuugcagugagccagaauugagucacagcacuccaggcugggcaacagaguaagacuuugucucaaaaaaauaaaauaaaauaaaauaaaacucaggggaugguccuaaguacacagugguaaucucaggaugcuggcuucgucugguucauucccaaaccucccuuaggcuccuauauccuuuaaacagugugccccuauauauuuccaacagaguggcuacuuuauaggcaaugguauaaguaguuggggcuggggucauuuacccauuuuggaauauugggggauguucuguagcugcagggauuuagggcuagagaaaggccuugucuuucucugggcuggauaguauuugcaagcuuccacuagacaauguggauggagacuaagcccucaauauuccaacucaggccagacacaguggcucacaccuguaaacccagcacuuugggaggccaaggugggcagauuacuugaggccaggaguucgagaccagccuggccaacauggugaaaucccaucucuacuaaaaauacaaaaauuagcugggugugguggcacgugccuguaaucccagcuacuugggaggcugaaguaugggaaucgcuugagcuugggaggcggagguugcagcaagcugagaucgugcaacugcacuccugucugggcgacagagcaacacuccaucucaaaaaaaaaaaaaaaaaaaaaaaaagaaaaagaaagaaagaaaaaauuccaacccaagucucaagagacggagaaguaaaauaagaaauaucuuccaauuguuguaaagccuugucucuguaaccacaaaaaucugguaaauucaaauaaucaguucuguuuucuuuuuauucucaguguuuacaugcacaaguaauaacaucacuacauuaacucuguaaacaguuacaauauuauaaauaagguuaaaaguaucauucaccaucaucccaaaccaguuuuacuccagaaguaacaacuggucacuauauaguuauuaacuaaacuaacuaaauaguuaauaacuaacaaaauaguuacaaaacaguuauuaacuauuuagugugaguccuuccauauucccacuucuacgcacaacuagcaaaugaaaaaauuuggaaucaaauccaggaaaauuugguuucaaagucuuuucauuuuaccucuacacauuuuuuucuacaccaaauuuaaccgcugugugaacacaggcucuuaaacccuuugccaaggagcauaaggaagugcuugcgguaugccaggcacagacguggcaucguugucugggguaaauacucgagguuugcugucucacgccagggaaaucgaggacgcagacacacaagaaaugaguuuaagagcagagguuucauaggcgaaagaaagagaaaagagaauagcucucuuucuugcagagagagaggagcucccaagugggacuuccagcuccauggugaaaugcacgggguuuuauagaaaagcuugaggaggcggugucugauucacauagagcccgagagaucagucggaccagguaugacguuugcauaguaugcaaagaagcuggccaucccacccuaaucucuuacuagcagaucgguucucuaccuggcgggugccguguugucuguuccuuacuguacacgugguugacaaagaaaagggaagauggagccaccauguugaacaugccuggcccucagguagccuuuuccuauugacacagcugcuggcauucacccgugcaagcuucuagcuugccuuucuaugucugcagcuugauuuuacaggcuucucuuuguuagaaaggaaaugauuugggggcugccuuuuauuaaaagggaaaccuuaccaaggacucucuuacccucacuaucugccuaaauaauuucuuucuagcuccuguaucagcacuaaaccaagaaccucaauuaaucuuuacagcaacaucaugagggccaguguaauugguuccauuuuugcagguccacagacugaggcucaagaaaauuagguaacuggucauagagcuaauaagcaucagggauaggauuggaacccaggucuguccaugcucuuaacaaacauggugccugccuccccagacacagcugaaauuugcugucccuccaacaguuguaaguggauuggugaaauuguuuuuguuuuuguuuuugcgaagauccucaaggcacaagccuauauaguaucacaagcaaagcccuaugcacaggccaagauugacacaggcuugucaagacagcaggcagugagccuguuggauaugugcagagagccagacccauagacgaaucuucccucuguacaugguggguaagccacccaucuaagauguugauaacaaucaaugcucagcccagggccaacacauucuggugggucugggacaagagggcaaggucaucagacgacagcuuuauucaguaguucuccacucauucuggaagcccccagcucggccuggcuugguuuuaccaggcagaggccaauuccagcauugaagaggagaagaaaaaaagaaaacacuaggagcucaugccagaccuuugcuaggaagcuaaaaauaguuguugcugcggaaggccacagaucaugaaacacauaugccaacauaauaaccguguauaaaaucaccccaugugggguguccuccaaaccacucacaauuaagcuuaagugaugauauauagaacaucauuuuccagguggaggacacucaaauguuuuguggccuggacacccaggagauguugaaagggcuagacuggacugaagccagggcuugcaucuggagccaugggcagccuuacugccauccaugaaguugauuggguacccacgagguccacaacacuguucugcacuuuguuggguuacaggaacaaaaaggaagcaugccauggcauggcagagguggguaagcuucuuaucuaauccucauagcaacucugaaauagacacucuaauaaucauauaaugccuggcacauaaugggucucaaugcaauguuacuuagacccagggcuuucuugaaaguauguauggugaaaugugcaaacagaucagaugaagauuuaauugccauagucauacacaguaauucaccugcagaugguaacugaugugugggagaugcuaaauauggaaaggcgaugacugguuugaacugauucagggaagcuacuggagguaggguagcccuuuggccaugacuuaaaaguuaaguaagcagaagccucaacacccugcuuggauauaaagcaaagcuaccauugagaauacccagcaggcgaaaugcagauguuaauuaaauauagaugugcauauacauacagauguguacaguggacaauugaaggucaagcccaacucagugguuacuaaaguguuugugugggggugcaggcaagaaaguaucucaaugccucuaucucugaaaugggcacaaauggaaucagauuguggagcgggacugcaagaagucuucuaguucaucccucacacacacauucucuaagagauggccaagugucucagaggcuuuuucaagauuuuucaguauuagauauaaaucccuuggaagcaguuuuguuuuacauucuuaagaggacaaccacaguugggugggaacagucaugugugcuagaagcagcucauacugaaccuauuguauucaucuccuuccaacucuuggucggaauuuggugaucucauauugguagaguaaaaucagccaugaugggaauauuuacaccaugggaauuggcaaacacuguaaaucagggccuuuccuucuccccuggagagcagauuguuaagcauuugccagcguuuggugggaaaugaauaucaagaaaguauagugagaaccugacgucguaauaucucagaguuggaagggauuuuaggucuucucuuacccaaccccagauuuggugcuagaauucuucucccaggaguuucucugaggauggggcaguuacuaacagcagauggugaaaugauuuuucaguguuacauagacauuaacaugaaaucgcauagcagaaaagguacuuguuuuuaaauucucuuuuguccuuuuuuauuaugcaaaggagaaagucucaauuuagugcuauucaauuuuuaacaccucucuaaggacuuguugcucuuccuuuuaacagaaagggcaggccucaggcucagagccuugugaagauuagugccuagcuguaauugaauagcuucuuuuguuuuuauuguauuuacuuuuauaguuacuuucuauuugugacaugcaggaauggcuuucuucuuacagugauaguaguaaguuuacuuuuuaucacguuucuaaaaugagcucaauuagagacaaauauuaaguaaauuauaauaaaauuaguguagagagauggcaaauauccugaaggugguuugugaaugaccaacacgucuggaacacagacguacccuagaucaggcagacuuugccugaauaugcccagugacagggaggucaccacucgguaaggcacuucuguuacgguaaucagugaaacacuucauuugaauuaacagggacuuuuguuucuuccuccccaugaccagcaccauauuuaaauuaaguguauuuccuacaauauucucuuauugggccaaaacuacucagucugcaaggucuccaguuucuauucuugguuugccuuuggcucaauaucuccauuaauugucaugggcuuagggucuuuaugaugaacugagccaugaugaccuuuaaagucgaauucuguccuuggugugucaacauuucuccaauugaagcuguucucccuauacaagaggaauuggagucugugguugccaagcaaacguggcaggauaauuuguuucugugccuuaaaucucuggaauuacugucucuagcucccuaucuuuguccuuuggaaaaccagauccucagugugauauccugauacucagacucagugguaguaaucacugcucccuacuguggccuuccugugcaccaggcaccaaacugacagcuucccaugcauccucucacuuacaccucaugacaaccccaguggcaccugcuauugccaccccauucuaaggacgaggaagcuggagcucagagagucgaagucacucaaggucuccuggccagcaagcaguggagucuggacucuuagaucuguggccccaaagucucagugcuccaaacuuaugagaaggauuucuuaucucagacccuaagaucuacaauggaaaguugaagcaggugacauggggaggugccugugcuacaaccagagacccuuuaaggaaaauucuuguuuucuaaagucagaagaaugugcaguaagugagcacaaagcaggcuggcucuuugcaggcaucugacaccuucucaugaccuuccuaucuuuaucguuagugcuugagagagagagauaaggcggggcaggggcagagccagggagaaacccuacuugaccccauccaggcaaaugcauaccucucuucuccuuccacaaacaugaagcugauuuucaugugcuuuagccacgaaacuuuuagccacaaaaacucuuucccuugucaauguucaguaauuaaaauuuucucaaaaccugcaaaugagcuucacagcagucuuuagcguuuuaccaugaggcagagauaugucuuccaggccuuuuuuugacauuaauccauucagcagacuuggccugaugcucggcugugugacagccagcgcacuggucacuguggguacagggaagcacgaugagcaccauuucugcccucugucuucaucccaauaaguccugacacagaaggggaacaggguacaaaaguucugugggagcaccuaacugaugaagggguggagggaaaaguauucguaacagggggaagagcaucugugaaggcccugagucaugagacagcaggagcucaaggaggcccaguauggccuguacuacugggcuggcccaucacaggcauucagaacagugggaaugaaugaaugaaugaaugaaugaauaagcagaguguaauggggcacacugggagaugaggauggagauacacacuuaggcugauucaugaagucuuugaagucuguuaugaggaauuuugaccuugagccuaacugugaggggaggccauggacgcauucuacacaauagugaugugauuauguuucauguuuccccaaacaugccgggccaccaagcugugacuaucucaccacccacccaucccaauacacucaaugugaauacaaagcuuuacuucucuccuuugcucccaaagagaugaggugcugaaaaugcagcagacccaggguaauuggagaucuacugauggcggaaccucuuugugcuugccuguuagccauguucuugaagcuggucuugcaggcauaacccuggguggccacugcacuggaaauuaaauuaauuaaagaaauuaaauaauugaucaaaagucuggaagugauuggaugaauagagauuuaaauccagaucugggcugggaucaguggcccacaccuauaaucccagcacuuugggaagccaaggcgggagaauuacuugagcccaggaguucaagaccaaccugggcaacagugagauucuaucucuacaaaaauaaaauuaaaaauauauuauccagaucugcuuuugcuucuauagcaucucuuucuggauguucuagagaagucuucucgccccacccauauuuccuauuucagagacaggaagcuauaccgaccacauggucccacccuccaggcuacagaugauuggaccaaagggaaacaccugauacaagcugaaccaaucagauuuccuuaucuggaacuuggacuuuagacacugaaagacggauccagauagccacagaguauggagaugagggccccauaaacucuagggccgcgacagcuaugaugggcugugugcgagagcagaaggagccaggauagagaaagaauaaagaaacgagugugcagaaaauagcauaucugagcauucaugccuuuugagagcucaagagacacagcaaguagcugagcuguccugucacuggauaccaugagauuuccuacauuuuuaaaaacuugagcugaaugaaccuguuucuuucugcccaccacagauaccugaauaaaacgcaaucuagacaacacaagagaccuucaagagggcauguucaugagaugggugagcguguuauaagcugaugaaaagacuugggguguccauggguuucuuuguaauaucucugccuagccacuuuaaagagacagaccuaggccgggcgcgguggcucacgccuguaaucccagcacuuugagaggccgaggcgggcggaucacgaggucaggagauugagaccauccuggcuaacacggugaaaccccaucucuauuaaaaauacaaaaaauuagccgggcgugguggcgggcgccuauaguuccaacuacuugggaggcugaggcaggagaaugguugugacccaggagguggagcuugcagugagcugacaucgugccacuacacuccagccuaggggacagagcaagacuccaucucaaaaaaaaaaagagagagagagagacagagcuaagauauugugcagccaagggagagugaaggcagaaaggugucaaagcacagggcugcaaaaugaaagaugcuucauuagggguuuggcaucugcuucuuaagaaaagaagaggagcacagcucaggccuucuuccucccugcagcuucaccacuaauaaaggcagcugggugaugaguuucuguaucuggcaaaucuacuucauuuuccaucccucugucgacugcaauguaagacagcucaagaagaaauuaauacuuggagucagugucagccccacugacagcagaucaaggcugaaagacaaauugcucaucacaguucagggagccggagcugggagaagacagaccugccauucccugcgagcuccgggccgcucccacugguggcuaacuuuacaagggacccauccuggcuucugccuaccugugaagucugcagagagcugcaaggggcugguccugggagagcaacuuguuggacauccuuagggccccuuaaugacccuguguuugcagcaugucaccaugucacugguaugaccaagccuaaugcccuagaaaagcuauuucugggcaucaccugucaccagcucauuccaagucguggauucucaauuuucuuuaugacaccuugaccgcuuggccaugaaggauauuguguuuuguggguugaguucugcacaagcuccugaccaaacauugagugggggggcugauauccagcccuugcuucacuggcgaaaccaugugcccuggcacggggcugcauucauuuggagagaggguggcuuuuucuaauuuuuacagaggugcugcuuagauuaaugaaguccuggcaacauuguguuauagagcuaugggcuuacuuguuuauggucugugucccauagguagaauauugacuccuugaggacaaggacugugcuggaaauauaccauuugccucuccagaaccacuugccacccuucuccucccugcucugugccccaggagaaugacaacuuaaugaccucccuugcucuccagccuccaguuggauucagccaauagaaagcacugcugggagaucaaaggugauaugguuuggcuguguccccacccacaucucaucuugaauuguagcucccauaauucccguauguggugggagggacuugauggaagauaauugaaucaugggggcaguuucccccguacuguuauugugauagugaauaagucucacgagaucugaugguuuuauaaaggguuucccccuuucacuuggcucgcauucuuucuugccugcugccacguaagacgugccuuuugccuuccaucaugauugugaggcccagccauguggaacuaugaguccauuaaaccucuuuuuuaaaaaauaaauuaccuaguuucagguaugucuuuauaaauagccugaaaacagacuaauacaaaagggcagggagauagaaagguuggagucucuguucccagucucauuuuugcuacauggacuugguuguuugugauucucugguccuggcuccugucacacggccucucccuaccacuaaccucuucacugccagucgcugcucccccuccgugccccuucagggugguaacagcucccugcuguugcuagccccaggggacugcaccaucccuuguagggggaucuaugcaaacagucugugcaaauagucccuuuauucaacuccuccuccaauucccaguuugagugcaccaucucuuuccuacucagagcccaguuaagauauagagauguugcuugguucauugcuguguccccagcuccuagaagaauuuccagcacagaacaaccacuaaccauucaaccauuuauuuguugaaugaauaaauuaugaucccugaaggcggcaagccuugguuuuuuguuguuuuguuaaggacucacuggcauccucuuuauucagccuugcagcucggcuguuggaaaucacucaugaagaccauuccucccaccucaucuguccauguucagcaguccucaaaccucccuguucucauuuauuucagacaacaauuagacccuauuggaaaaauuuuucuucugcucuugcccuggguagguugcagggguggagggaaaaauaagugauacccuuagagaagcaucauuuuugauuucugaaaaccaauauuuuuccugccauucuucuuuucuuuacacccauuugucagacucagucuccuaaauuagugcuagagggugcuugcugaccaggguaauuccacucuaagaaaaaaaaaaaaaagcaaccaguaacagugagcuguuuagucuggggagccauggugcggucgcaccaaaggugcacaucuuuaggaguagccgucugagggcugcugggcauaaugaccagguggcagcauuccagccuuggaaaauguguaguauuuucucuccaggguuuugcagaaaugacacugucagagaaaacaaugauuuaauggccacaugacaggagccuuaagacuaaugguacccaacucagaaaaauguaggagacaacuggaaggcaauuacgaaacaguccgugccuacaacucagucauuaccaaccgagcauugcgaggaagccucucuccuuuggaaggucaaauucuuaugguuccaagugauuaggagcagagccggugcuggaaaacacaggguggauauuucuauggagaauucuccagaauuguguacaucacacagaguacuccauccuccuccccucuucccccucaacucucucucucucucucccucccucccccucugucucucucacacacacacacacacacacacacacacacacacacacacucuccaauuaaaauguuucagcucuuccacuuuccaaacccaguccucacaaagcuuuguuuacgcaggcuaggcaaagugacauugccuacuugacaaguagcuuuugauuaaaaacacugaacucugcccgaguaauugugccacacacaugaaaaucauuugaggaucugaagagaaguuccucuuugcccccaggaaaccugaaauauuguguuuuucuaaacaacaacaacaacaaaaaaaaccucugucuugcacgguuugaacaaaacuuacaucugugcauucuaguauuugcuagauuuuucuacaaugagcaugugggcuauuuuccaaacauuaucuuuuuaugacaaagcccuaaauucacucauuuguguugcuaaaaggacaaaugccauacauaaaaaagcacaaguuucucuuaauucucacccccugcccaucucccagcuccagagguaaaugcuuuuauguauaugaugugauuccucccacccccuuuuucuauagguaugaauguauauauauaugaaucuuuacacauuuuauuuuaaggauuauuuuguuuuucauaaaugggauuauaccauauguauuuauuucacaacuucuuaaaacuuaaaugucuuagagaucuuggagauguugggaucagcacauaaaaauuuaccuaauugcuuuuaacggcugccucaaauuccauaguguuacugaaucacaguuuauuucccuagguccccucugacgcacauuucagguuacucuuaaugucucacgauuacaugcaaugcuauaauaaaauacuuguacauugccuauuuggacacauaaggccccauuucuauaugggagagauaauuauaucaguuaagauacuuuuggcugcaaauaaaagaagaucccaguggcuaagcaauaaggguuuuauuuucucauguuaaggugaacucugaagguuagagcagcacaaaggugguuaauucaucggcucaaugucaucauccuggagccaggugcuuucuuuccaucuuucuggucugcuucucucagagaguugggaaugccucccccagagaucacaugauggcuggagauguucuaggugacaugugcagacaugccucuucagcaguccuuggauccccuuggccaggauugagcugcaaacucacacauacaccugccacuggcaagaggaaugagaugaccgugacugucauggaccaauugugauuccuucucuuguucuuggaggaagaaagugagaggaaacagauuuuauuaaucaaauaaaccuccagaaaauuuguaccaaaucacagccuacuugaauauccaaguaccaguuacuucgcaucuucauccacccuuuaauaaggcauuuaaguuucugccagugugaugggcaaagaggacauguuguuguuuucuuguaccuaccugauugucaagauugaggaucaucuauauauucauuguuuauuuauauuuucucuuuggagaauuaccuuauuuguauuauuugcccuauuuucuacuagguaguuugcucucuuuucauugauuugcaaaguuucuauauguacaucuuggaaacacauauaaucaagacauuuuaaaagguucuuaagaauaaacacuuaaauuauguaucuuuguucuuacuuugauucucaagugcuucuauaacaguuuggggagcagaagaaaauccauuucguggaauagguuauggugacaugcuuucuaaauggugugcuucagaacaaaaguuccuagacagauguuaaaaugcaacuggaaaacacugcacaaaauuuccuacuuuuagaguaucaccauguacaaacagcauagggaucagcucuguuuugaucaugaccacuaccuuucuugugaucucauaccaucauuugcccucucugagucuuacuucacucauuauaaaauaguccccuuucuuggcucuucccaugcucaugcacauucauggcuucccacaguagcaccuguggcucucugucuguggucuggggcaguucagaagggacaagaaaggcaaugccuuaaggagcaucccuuuaccaauggcagacaaaugauaacacauaaguaccucaguugccuugccuucagaugcaacaauucugagacaucuucuauaucaagagucaacaaacuacaguucaccagccaaaucuggcugaccacuuguuuuuauaaauaaaguuauacuggaacacagccacgcccauuucuuuacauauggucuaugguugccuucauacuacaagggcagaguuguacaagagacuguauacccccaaaagccuaguauuuaugguguggcccuuucuagacaaguuugcugacuccaacucuauauuauuccccuguggugccagcaggguugagccccaaguugcccacgguggucaccugcuugcucauuaacauaccuuccucuccuugucccacucuccuauggggguuucccaggaucaccucccaaauacacuacuugugcucacaaagcuguaacauacuagacaggcuuagaaaagaagcaaguagagugggaaauggcaggggauugucgaucaugguaagucugagccccugagccccagacccaaggcaucuuuaggguuagccccccuacccaccucccaucacuuccacaaaucaccaccaacacacaggcaugcacacacacacacauacacagagcaagcuugccauucauuuggguaguggcuuugcacacauuaccauuaguggcugaugaauugaaaacuaaauggaaaaugcaaauggaagacaaagaugacuuucucuucucugcaucaggaagacacccugacuccuggucaguguguggccacaugaaagaaguagacuuucuccagagggaaauaugucuguuuagucuguaaugaugcauauuuucauacauaaaauaaauaggucaucaaaucucucuccuaagggaggaagggcuccuaacaucucacuauuacauguaaugcuaccauaaugccauucucaaaucguaaaagacaaggcuucaauauaccucacaucuucccaccuccaggcauuugcacaagccauuccugccgcccagaacauucccuuaauaaacacacuuuuguccuucuuugggucuguuuagauacuacuucccaaagacaccuucccuaauccucccugcaggugcucccugucaguaagcagaucagggcccuaaaacacuguuuguugugcuuacuaaauuuauccugguacuuacuauaauaacuaaauaaauguuuguuuaaugucuuucucucccaccauucuauacaucacaucucuccuguuuacagucacagccccagugccugacauuuaguggauaaucaauauauuuuuuaaauagaugaaucagugaaugggugaaugaaugaaugaauggacaaaugaaugaauguggauggaccccucagagaguggucauucuuucaguauaaugaugccaagaugaguucuuugaugaccagaggaagcucucugcuuuucaaauucuaaucugcaaggaaucacuuggagauccuuguggaaaugcagauuugaauucagcagcucggaguagggcugagacuugcuuuucugacaagcccccaggugacacagaugcuucuaguucccgagccacacuuugaguagcaaggaguuagaugaucuuaagcaagaacaguggcaggugcauuuauuuuuaaagagcucauuccuuuugcccucauugacauuuauuuuuacaaaaguucuaaaaagcagcagugcuuccaggcggggcagccaugccacuuggcuuaauuuccugcuguuuaaccucaggccaccuagucagaccucaguacacauucaggauuuugugugaugccauuucucauuuuagguuaggucuuaaccacauuccucaaugaagcacccaguucugcaugacuuuacuuuuuauaaaaugugaggggaggauuugaggaugcugagaugaaccaaauucaagaagcaucagaaaauggacuguuacccacacgucucuguggcuauucugagcuccucuaagccacaguaggaccagcagcaccuacugucaccauucaugccagugugacuucuuuuuccaaguaugugucuauguguaugugugugugugucuuuucuuaaaaugccauccacgucugggugcuuucaggacuuauagaggacauucugagcugcagauccugaggacuucaacaauaaucaucaaauugcugaaguaccagacaauaccuuaaugucuuaggcauggauauaauguuagaacuugagcucuagccucagacugaucuggauuggagagucaccacccauaccucauagccaugugccuuugggcaaguuacuuggcccucuugggccucaguuucugccucugcacaaugacagcaauaauaaccucuaccggaaaggguuguugugaaugucaaacagaaaagugcauguaaugugcaugcugcagaguaaugugcaugucaugugaugcugcggugucuggcaccuagcaaaugagagcuaucguuagcgcuguuauuacuguuguuguugguacuccuagagaaagcuaaaagaauuuuguuguguagguugacagggcuuuucuguauuaggauuagcaaagguccaguaucuuuuucuuccuucugagcccugcaaaaaugcuuggucugaaguggccaccuucuggaagcuuucugcaguggggucccgcagcauaccagugaguuguguggcacgucugagugcucgagacagcuguucauucuauugcuuugcuccacugugcaauugggugugcaauauugcagaggucaggagccaaaacccaggagagggcucuggaaguauucagcaaucugugauuacaagaccagcuaacucaggccccccucaaucauaaguaacauaaacccuuucagagaucaagaaagggugauuuauucuagagaaagggguguccuguggaguucagauguaggagaugcugugaaaccucccaguguaguggucccaagaccuaggauaucacuggucuaggauauccaucacuucaucuuccccaaaauccacccucugcagcccagcagacauggaagaaggcagcuacucacagagacccuguuucucugagaacugccuccuguuggacuguagccagcuuugaacuaagugacacagcuccacucucuucaccucugcugugaggagaaguggacacuuaacccaagcuaggccaauaaguuucuuccugagaguuuggaauuauggcugaauuaguccuggcugguuuucucaucuguaaaauggugauaauaauaguaacauuuaccuaguagaguugugguggagaucaaaugagagaugccaugccaaguucuuacccaacgcagggugcauaauaagcacucaauaaaaugacuguuaugaucaugguuauccccaauaccaaacaccacagcauaaggccuagcacaaaguggugcucaauaaauauuuacgggaugaaugaaucaaucaaucagggaaugccauaggcugcagucagccaugcuaguugaugcucagccauggcaauguaugaaccacauguuuguacaaaaccucuuucuggagaacagaggacuuugccuccuaaacgaaaccagguugaacauccugacccugggucucguguuugugaggugcaaguacuauauaacaguuuuguggccaggugcaguggcuuacaccuguaaucccagcacuuugggaagccaaagcaggaggacugcuugagacaaggaguuugagaccacccugggcaacacggcaagaauccaucacuacaaaaauacaaaaaauuaaaaauaucagacagucaugguggcacacgccuauggucccaguuacuuagcaggcugaggugacagaaucacuugagcccaugagauugaggcugcagugaguuguaauugcaccacugcacuccagccugggugacagagcaagauccugucacaaaaaagaaagaauucugaggguugccagguacucaccauacauuuuacggcucauuaaaucucuaauuagacaaacucaaucguguguuuuuguuaaaaugagauuugggccauuucaaagauuucaucgugcaggaaauaugguuuaaguuuuccuuggaaagggaggagggggaaaaugcauuucacaauagcauccaagaguuccaaagcguauuucugauuuuauacuuccugcagucauucucucuuucacaaaugauuccuuguuuugcuuucgcugcucccgaauuguauuuauuuugucugcaucuccaccuacgcccuaggcucaaaaaugcacauccuggagauuuguaccugcauuaaacagggagcauguuuauauuuuuaaaauguagcugcaguaaacaacuuuugaaauguacauggaauaaaugcagacaaacaugcuuaaucaacucgcccuuggagagcaagacacagggaaagcuuugcaaaugaaauuuucucccagugguuuagaaaagagccuucaaaguggcaacucgugcccacaccuggacaggcuucaagaggaaagaaauaucagucuggagcuuccugcuuuugugugacguuuucagugaagggauagagcaaggaaauaaggauucauuuaauaaaugacacaaggucagaugaccucuucuggugcaacagggcuacaaugaagccaucagacuuuaaccagcaccuucaggaagugagcacguacacacgccauguuugguguuguaaaacaguguuuaacagcccugaucaucuugagcuuaagcauuuuagagucucaagaugcuggaacuaugacaggcccuuaauaggcccccagaaaauauuuguggaacuaauaaucaucaugcuagauaaaaaaugacagauuccauuuaccaauagcuugcuacaugccaggcauucuguguucacuaaguuuaauuguuacaacuguaccgcaaagcaaguauuguuauaagcaccuucaccaugguagaaaugagaacacagaggcucagagaagauaaaggacuuguccaaggucacuccacugggaagcagaagcuugaggauuugaaaccuaugucugucugauacuaaaauccgcauuauugucucuugucuccccaacgucucuccuuuuucuucuuaaaagcauuuucccuaguuccuucugccuguuacaaaggaaacgggguaauuucaugcuucaagagaucuacaugcuuagcguccacccaccaugugguaguccaggcaaggacauacuccgugccucuggcaaagcccaaggagaccucucacugccccccaggcauccccuaaaagcacaguugcacuuucuaguuacucccagaaugaauacccccauggaugcacagaaaacaguaauucucaugggugaccaaggcauggcaugcacgaccauaugggcaacuggucuccccaagacugaaugggaaaauugaauaucuuuguccuucauguccuuuuuuguccuugccaccuuccagcuguugcaucuccuguuaaauaacgucacuuuccuccaacuuucauuuagucaagcaacaaacacucacugaucccuuacaaggucagcucugaucucaggaucagaucccuaccugaauaggggcagaugcauaaaacaaguaacuuuagugcaugagcucaguguuccaagaaaagagacuugaucaauaugcucuggaaacacagagaagcaugacuaacucagccaguggagggagaauugaagaagggggugcuuacgaaggcuucauaauggugaggauacuuaaguugggucuugaaggaugaguaguuuuccaagugagagaagagagaaacagcauugccuacagaagguauaauguguuuccaggaguucagcguguuucagaaguacucagaguggcugcagaaaagaguguaucugggcagaggugcaaccaacagaugaaaagucaugaaugacucuauagaacacccugaagaauugaggcuuuccuuugugauccauggaagccacugaagggucuugagcaagagcauguguauuagugcauuauugcaccacuauaaagaaauaccugagacuggguaauuuacaaagaaaggugguuuaccuggcucacaguuccacaggcuguacaggaagcaugaugcuggcuucuggggaggccucaggaaacuuauaaccauggcagaaggcaaaggggaagcagacccgucuuaccaaauggggaagagagagaaagaguggaagugccacacacuuuuaaaagaccagaucuugugguaacucacuaucaugagaacggcaccagaggggaaauccacccucaugaaccaaucaccucccacuaggacccaacaacauugaggauuacaauuugacaugaaauuugggcagggacaaagacccaaaccauaucagcacgguaaugaguuucacucuauagaaagaugguacauuaguuuuuagggcugccauaaccaaugaucacaaauggguggcucaaaacagcagacauuuauucucucccagcucaggaggugagaaguccaaaaccaagaugucagcaggguuaguuucuucuggaagcucucauguuccaugucucucucccagcuucugguggcuccugcaauccuugguguuuguuggcuuguagccucaucacuccagucuccacuuccaucuucacauggcauucuccuccaucaugcauccuuuucuuucuuuuuuuuuuagauggagucucgcucuguugcccaggcugaagugcaguggcuugaucucaacucacugcaaccucugccucccggguucaagcgauuccucucccucagccucccaaguagcugggauuacaggcgcccaccaccucgccuggcuaauuuuuguauuuuuaguagagacugagucucaccauguuggccaggcuggugucgaacuccugaccucaagugauucccccgccucagccuccuaaaaugcugggacuacaagcgugagccaccaaaccuggccuuauccucuccuuuucuuauaaagacaccagccauuggacuuagggccuaaguuaguaugacuuuaucuugacuaauuacaucugcaaagguaacauauaaggucccauucuggguggaugugaguuucagaaggacacuauucaacccacuccagauuguauagaggugagaguggcagugggaaccuaggagaccagccagaaagccaucccaaaagaggaggaaugggucauggaugcagcaguggaacagggacccacuaucacaacaagggcuuuggugugggcccuuucccagaaagaagggggucauaaugacacagugagucccauuggaagagaccucaaagaucaaauugggccagacacaggagccaauaccuguaaucccagcacuuugagaggccaaggcaggaggaucacuugaggucaagaguucaagaccagccuagacaauauagcaagacccagucucuacaaaaaaauuuaaauaauuagacaagugucuggugugugccugugguccuagcuacucaagaugcugaggcaggaggaucacuugagcccagcagcuccaggcugcagugagcugugauaacacugcauccagaauugguagguucuuggucucgcugacuucaagaaugaagucacggacccucgcaguggguguuacauuucuuaaagaugguguguccagaguuuguuccuucagauguucagauguguccagaguuucuucuuucuaguggguucguggucucgcuggcuucaggagugaagcugcagaccuucacagugcauuuuacagcucuuaaaggcagggcaucuggaguuguucguuccuccccuccagaguuguucauuucucccugugaguucaugcucucgcuggcuucaggagugaagcugcagaccuucauggugagcauuacagcucauaaagguguugcaaacccaaagagugagcagcagcaagaguuauugccaacagcgaaaaaacaacacuuccaugaucugaaaagggaccugagccgguugccucuacuggcuccagcagccugcuuuuauucccuuaucuggcccuacccacacccugcugauuggcccauuuuacagagagcugauugguccguuuuacagagagcugauugguccauuuugauagagugcugauuggugcguuuacaaucccugaguuagacacagagugcugauuggugcauuugcaauccucuagcuagacauaaaaguucuccaaguccucaccagauuagcuagauacagagagcugauuggugcauccaugaaccccgagcuagacacagagugcugauuguugcauauacaaucuuccagcuagacauaaaaguucuccaaguccccacucaacucaggagcccagcuggcuucgccugguggaucuugcaaguggggcagggguggaguugccggccagucccaccccgcugccugcacuccucagcccuugggcggucaaugggaccggguaccacggagcagggggcagcgcccgucagggaggcuggguggggcaggguggggaaggggggagggaggggggagggggggagggggagggggggggggggagggagggcagaaaguggggcagggaggaagggggugggggaggaagggggcaggguggggaaggaagggggcggggaggaaggaagggggcugugugggagggggaggaaggggguggcguggggagugggaggaaggggcgguguggggggaugggaggaagggggcggcgggagggaggaaggggcagcggggggggaggaaggggguggggggagaggaaggggccgcggggggaggaagggggcgguguggggggaggaagggguggcagaggggaggaggaaggcggggggcucaggcauggcgggcugcagguccgagcccugcccuguggggagguggcugaggccuggcaagaauuugagugcggugcgggcaggccggcagugcugggggacccggcgcaaccucugcagcuccuggcccagaugcuaagcgcaucacugccaggcaccggcaccggccagccgcuccuagugcguggcccuccgagcuuacgcccacccggaacucgugcuggccugggagcauggcacgcagacucgguucccacccgugccucucccugcacgccuccccgcaagcagagggaaccagcuccagccucggccagcccugagaggggcucccacagugcagcucaggcugaagggcuccucaagcgcggccagaguaggcaccaaggccgaggaggcgccaagagugagggcugcuagcaccuuugucaccucucagcaccacugcucucuauccugggcagcagagcaaaacuccauuccuuuaaaaaaaucaaauugcucacuuuuccuuuucacugauaaaaguggucauggacacacuauuaaguggugaaacuagcauuuuacaauuagauaaucugucuugaggaucccuuuauagucuuaagauuguuuaaugcguacugacucuuuguaguaagguuuaguuuaggccuucaagagcuaaggaguuuauuggcagagcccagaauugucuuaacagacaacauuuauuaagcacacacuaaaugccagguacuaugugagguaccuagaauuuauuagcuguaauucucauaucucuaaaaagaaaggcaauauuaugaaugucuccuuuuuacagaugaggaaauugaugcauggggagguucuaacuugcccagagucacacagugaugacagugaccugcaauauagggccaugcaaugccaaaggaaguuucucaaacaaaaacuauggagaaaaaaaauauaggaugaagggcagugggguaugaauauuucaucaauucaagaggccccaguuuaucuugauccuaaggaagaagucuuugugucccuagcuuaggauaaagaaccagcucuggaagccuggaugacagacuggggucacccucuuaguucauggggugcucaaaaggagaugcacccaggacccagaugggcauccuccuguugaaagagggaccugggauccaacuuaauuaaucaucuucucacugccaagguuucccuugcccucccaucuguucuauucuccagggauuaagggaccuuuacaguuccagcucauucagaauaaaguuccuucaaaugaguggccaauuucuuuuuuuccuuugagccugacaugcggagccagcuguugacuuaggaaacucugccaacagugcgugucgggugcagaccucaucuggugucugcuugggauuuuccuuuuaauuauaauuauacuucaaagggaaucuggaacuugcagagccaaagaucaaagccucaagaggggcuacguucucccuaacaguccccaacagggcucugaagacaggggggaagggaaggauguaugugaugccaucagccuggcuaaccucagcccucccacaucgcacccuguguucauguggcugccacugggcauccagcuuagccaacuagucccuucaguguggccagaguaggaaauuaccuacgggguaugaucugaggauggagcagcauaguccacacuaaaacauaccccuacacaccaaaacuugcuacaugccuaauauuacaccacuugccaagcagcuuuuuagauuaaguaucgugcacuccaugcucugcuauuucaaggugaaaaugcuacuaagcuagugaugcuaugugucacucccaccuuaguauaaauuagccuacagguugguuuccuuuuuuuuuuuuuuuuuuuugagacggagucucacucugucgcccaggcuggagugcaguggcgcgaucucagcucacugcaaccuccgccuccgggguucacaccauucuccugccucagccucccgaguagcugggacuacaggcgccagccaccacgcccggcuaauuuuuuguauuuuuaguaaagacgggguuucaccguauuagccaggauggucucgaucuccugaccucgugauccacccgccuuggccucccaaagugccgggauuacaggcgugagccacugcgcccggcccgguugguuuccauaggucagagcagcaugaggauauuuagcacuggguggaggaagauaauugauggagacgaguaaauauuucaauaucgcuaaaaagggaaagaaaugaaggaaaccaacauguauuaagcaccuacugugugauagucuuucacauaugugauauuauuuguuuucuuagcaacccucuaaaguuggcauuaucaccuguauuuuguaguugucccucgccucccaguuggguuuaauccagugguucucagacuuuaacagccauaggaaugccugaaaguggagauuccuugguccacaccagagguucugguucaccuggucagaauguaguccaugaauuugcaggcguaauaagcucccaaaugaugcugcuggcauugguucauggaccacggcuugagcagcacuggauuuggccagucauagcuaucuuauuugcuucgccaacaacugguucgaaugauggccaucccggagagcccauuugggccaaugggugcaggaaagaagccuugacccugguugcugucagaagccacuuuacaaccaugaggggaagaugucuaaagaugaggcugauucugugggcaauucacucugugcagagcucagugacaugacagaccuucaaagucaacccugaaaucccaaauccuacucuguacuucuucuuacauggaguaauaaauuuccuuauguguaagcaacagugaguggaguuuccuguuacuuucagcucaaagacauuaucaacauucucagaugaagaaagaggggcuugguccaaggcccauggucacagagcugguuacccagguccgugugaugucaaguguccuuccaauuuaccacacugccugagagguuuucucuuccaauaccugaugugacuccccaucuacuuuggcacaagcauuugagaccagacccaucuaaucuccuaucaccaagagguucaggaucccauucauccauccaacuguccauccaucuguccauccauccauccuuucauucaucaagcauuuauccagcacuugcugcguaucaaauccuguacucaaggcuggggaucuacugcaagacaagacgcaaucuuggccccgaaggagcucagaucuagaggaagagacagcccgacaaucucagcaucucuuucuacguucaagacaagggcauugagcucagccuauggauguccagauguccaguuguuguagguuucuaagguguuggcagauaauuaaaacccagucuucuuuuguuugacucagauagauuuauccacuuuuggaagguugaauuuauuuuaacaucaguaaaccaauucaagauauccucaauaauggauaucauacaaauauucaaccaucacauuucucuguuuauagagcaucaaagugcacaguacauuguaaagcugcuaauuaauucuuguaacgcccuggugucaugagcaaaaggcagauaauaacccuauuuuaccagugggaccaauggccgcuguaauucagcaacuagccuguggucauguggcagaucaccugcauuuuauaccuucauuaacagcacagcuuauuaauuguaacaauuacauucacaauuaacauuuauugagagcccccauaaaccuggcucuguccuaagaacuuuauacacacaucacguccaucacuggaggugcagccucauguuccuuccucagacucaugaaaaaauaagaucucccugcagccagggagguggaauauucugauuggcugggccugcaugugauguuguguugauucuccaucacaagccuaugaaguaggcuuugugauuauucucaccuugcacacaaggaaacugaggcucaaagaguaaucuuaucugccaaagacccuggcuggugaacucaggucuguaugacuccaaaucccauacccugcccuuugacuuauugcaccugcugggugacauguuggaaggagaggaucguguauucuuguccugagucuuccauuccuuugcugugugacguuaggaaaauucuccagcuucucugagucuuagauugcacaucuguuggugaagcagagagaguacaagcuuuggagccaaagugcaguuuguguuugaaccccaccucuguuccuuacucugucauguaacuggaaauuaaccucucuggaccuguuuucucaucuguaaaauggagauaauagcaguccuaucccacaaaauauauugcaaggguaaauggaaauaauauguguaaaacuaaguggguagcacauaguaugcacuuagacacuuaguagguaaauggcagcuguuuuuagugugucugucaugugauggagguguuguguuggguaaucucucaacgcugaugaucucugauaauuuuuaaaugaaagaucucccauggauuuugguuuagccacagagaacuaguguaacucuccagggguguaguuugggguugucuugacaaaaauauuugcaauaugcuaacaaaauuguggucaaaucaagauccugcuaguugcaaaugauagaaaaccccaauucaauguggccuacgcaaaagagaaaacuaauuaucuaagauuaacaaaaaguccacaaauaaaccuagcuuuaggaauaaugaguuccaaguguucgaacauuaucuccagauacauacucuucuuucuucuguguugccuucauucucaggcaggcuuuaccaaguugauggccaagauagucgccaagagcucuaggcucacauucuuccaugggagcaaccccagcagaaagagaucuucucuuucccaagagcagcagcaaauguccugagacuaaauaccuugguuuuucuuugggucucagacucaugaaaaaauaagauccucccugcagccagggagguggaauauuuugauuggcugggccugcaucccguguucaccuccgaagccacauggauggaaggugagagaggaaggcucccauggggaguugacuggagcaucuaugccugggaggaaacuaguaccgucuagcugccagucugcagauuuccugggcuuggagucuaggagcauaacgucgagcuuuaaucaccaaguugcagauuuccugggcuugcaguccaagagcauaacauugggcuuuaaucacccagcuacaaauuggugucccacucccaaucacaguggccuggggagagucccagcagccacacucaaaccccucagccccaucuucccccugugcccucugcauaaaaucccagaucccagcugcugucacgaucaugacuggcccuuucuaccgcucccuuguuccucaccccuccccuccaccaacccuauugcuaugcuccagcuggacugagccaccuucacuaucaaguucucacucaccuccaucccgaucuuugcaaaugcuguccccucugccuggcacaucuuccuccuuccucuucuuuuauuuauuuuuucaauugaaaaaugaaaaauuguauauauuuauggcauacaacgugauguuuugauguauguauacauugugggaugauugaaucaagcuaauuaacauauccaucaccucacauacuaaucauuccucauccuuuagaacuguacucagaagucauuuccuuuaggccgggcacaguggcucaugccuagaaucccagcacuuuuggaggccgaggugggcagaucacuugaggucaggaguucgagaacagccuggccaacauggcgaaacucugucucuacuaaaaauacaaaaaaguuagcugggcaugguugcauaugccuguaaucucagcuacuugggaggcugaggcaggagaaucacuugaacccgggaggcugagauugcagugagccaagaucacgccacugcacuccagccugguugacagagugagauucugucuccaaaaaaaauaaaaagucauuuuguuuauccuucugacuguccuccacccuugcugggucaguugugugcucacaccuccagcucccucacucccaccacagcuacaucauaugauaucauaacugcuuaauuaucugccuaccucccccccaccacccugccaucaaugagacccugagagggaguuuggggguggguguguguuuccuagcucugagcugggacccccagaggggcucaggaagaccuuuuugaauggagaaauaucuggacagugaggaugauuuauugacaaguccacaggucagaagagcaaggagcaaggcaccaagugugagauggacuugagaagguccugguuaguugccaaagaccccaacagggaugaggacagguaggucugucagagguuaggcagauagggcacucuugaaucucagcucuagauaagaucuuaacccagcuccaaaaccaugacagaucuagagggucgugcccagcagggccccuuagagacaaagauccucaccacucccuccccaaaggcacauggagaugguuugaaagaaaucuuugcaguucccacaaaaagcuugugaucugcaaacaaaaaugcucccucaccuaccuuugaggcacuuggcucaccuccuucuaauuugcaugaugaaccugcuugggucucugauuaaccccaggaaagcaugaaaaugagcauuugacaucaucaagggcauccaugcuugcuccucuuuggagaaaggagcuccucuauucaggcuuucacguuugaaaauaauaagcaaguucagcucauuucuccaccccaggcugcaaacugcagccuucuccugucuccgugcacacccccaggaaccguguuugcuaacaaccaagaggaagguguuuugcuuuucaaacaagccugaaccccaauugguuucucagcgacuugauccucauugguggcaacugcgguuucucauccagcguuguuauugauuuggucauaaguaauuaaggagauaauucuuacucaauuacauuuccuugaauuuccugagguugcuaacucuguuccccggcuguauuuucuuuuccaaauuaauuuugucuugacucugaaaugagcauggauauuacaaggcuuguugugcuuguugauuuucacgguaacaaagucgggcucuguauuuuaacuccaacuagggcucucaaacucuguuaguuuuuagaaaauuaauguaaaacauucucagauuuaaaaaaaaccaaaaacaaauaucaucaaaaaucuucugcuguaaagcaggagucccucuucccugcccucuucucauccuugaugccaucccucagggcagccgugucuaacacuuuuugcuacuuccuccaaugacccgugccucuaaauuauauaaguuuuacguguauuucuuaguuuaugcauuuaaaacuugaauaauuuucugcugugaaagaugaggaucuaguuaccgcauccccacaccacuccccaccccuaacucccacccuccaaaaguagccuuaccuucagcuccccuagugguuaauucuguaauuaaaaaauauagaugaggcugggugugguggcucacgccuguaaucccagcacuuugggaggccaaggcaggcggauccccagagaucaggaguucgagaccagccugaccaacauagagaaacuccgcccuuacuaaaaauacaaaauuagcugggagugguggcacaugccuguaaucccagcuauucaggaggcugaggcaggagaaucgcuugaacccgggaggcagagauuguggugagcagagaucgugccauugcacuccagccugggcaacaagagggaaacucugucucaaaaaauauauauauauauagauauauauauauagagagagagagagagaguuggggucuucuugccucauucacccuagacagcgucuuugacuccuuacuuuguggaagagaugagggucucaucagcuccccuugcgucuuuauuacuauuuuuacauugucaagaucaauagcauucacauuccauacccauaauucaguuucccaggcuuugucucugaguugucuaaaaguugaaaaaucaacacauauugaaguuuuauuuucaucccuucauccacucacugaacaaauaacugccaagaagccacucuuuguuuggcauugugccugaaaccaaaaacacaaugugacaaggucauacuccucgcauacauugcaaugcuagaauccagaggaggagagagaaaacagcauuuacaauguaagaggaauagcugcuuaaaucagugguuuugaauauguuuaaaauaugaauacaaaacauaauaaaaagguaagcugaauauagcaaaaaaaaaaaaagguuuuaaauuggagcugcuugguuuucuuuuuacuucaugaauauaagccaagucuuggugcuccagccccacccacuuaccuacauacccccacugauccucaggcugaagccagagcaccagaggaugcaauacacuaggguuucucuacuuccuccagggacugagacauggugacaggcaucacggcugcauuuugguuucauguuuguaaaguuccuucaucagcagugagucuuuacagcauucaauguucauaacacgcuggcuggaaauaccacuuuagggacagcuaaggacaaauaucuucuugucaugagaggugccagaacagucaccacaaugccaguggggucagcagagaacaccgaggggacauccagggccauagggggguauauucugacugcccuuggcaugaaugucccauccaggugggguguguguacguaaauggagcauaacacuagaagccagguggccaagugcaguaggaaaauuaaaauuauaagaugauguaucuggccaggcacuguggcucacaccuauaaucccagcacuuugggaggccaaggcgggacaauuacuugaggcuaggaguucaacaucagccucggcaacauagugacaacucaccucuacaaaaaaaaagaaaagaaaagaaaagaaaaagaaauuuaauuagccaggcaugguggcacgugccuguggucccagcuacuugggagccucaggaaggaggaucacuugagcccgagaguucgagacugcagcgagcuaugaucaugccacugcacuccagucugggugacagagcaagacccugucucaaaaauaaauuaauuaauuacuaaaaauauguuguaucuauccaagcacacaugcaugcauauguaccaauuaagaaagcccgagauuguuguucuacuugcuuaccuuggaaacgacccaguaguuucuucacuuaaugaucaccacuggguucauuuccugacccuguaguuauaugcagucacucugccccuccaugccuugguaguggcuuuuuuuuaacccauaaaaugggcacuccagaagguguauuucuuauggcucuugcccaaacaguuagcaaauggcagagcugggauuuaaaaccaagucugucugauuaagucugugcuuuucaauacuacaaucuacugucuccugugguaguucaguuauggaaugaucuuguuuacaaccaagucaugcccaggccguggacaaaaaauuaaauuaaauuaaaaauaaaaagguuuucucugcuuuauuuuauuagaaauaaaaagguuuuuuuuaaaugcauaugggagccagcuaauggcucacacccugaaacagaccaacacauuuuucuugccaauaggggagacuguuauagucaaagaagagcuauuaauuuugugacuagccccuaaagagaaaguaaaugaguuuauguaacccaaaucaucaacuguuucuuguggagaguuuauuccuguauagcuguauuucaguuacauauuucuaugugacaaauuacucuaaaccuuagcagcuuaaggcaacaaacauugauuaucucacaaucucugugggucgggaaucuaggcauggcuuagcugggagccucugcuucaggaucuccugaggccacacugaagauggcagcugggccuacaguuauuucaagacucaacagggagacggcucacuccugagcucauacacuuggcuauuggcugguaucaggugcuuucuggcuguaggcuagagauguauuaggcuggugcaaacguaguugugguuucugccauuuaaaaguaauagcaagggcugggcgcaguggcucacaccuguaaucucagcacuuugggaggccgagguggguggaucacgaggucaggagaucgaaaccauccuggcuaacacggugaaacccugucucuacuaaaaaaaauacaaaaaauuagccaggcgugguggcgggcgccuguagucccagcuacuugggaggcugaggcaggagaauggugugaaccuggaggcagagcuugcagugagccgagaucaggccacugcacuccagccugggugacagagcgagacuccgucucaaaaaaaaaacaaagaguaauagcaauaaccgcaaugacauuggcaccaaccuaauaaguuucuugcuauguggaccucucccaaagagaagcucacaacuuggaagcugguuuuccccagaucaagagcaggugcccaagacagaagccauguuuauccuguaaccucaucucagaagggacauugcaucacuuuugccauguucuagucauuagaagugaguuacuagguucagcccaaccuccaggggaggagauuauacaagagugugaguaccaggagguggguaucaugggggauaucuuaagaggcugccuaccacagacuccgguguaggggaaagcaaaaccuagauccugaucaucgccaaccugggugcugggugccccgggaucuccaggcaaaauaaaaacacagcucuugucuuagcaacaguguugcucaaccucagcacucuugaaaguuuggagcugauacggcuuugugggggaagaaggacuguccuguauauuguaggauguuuagcagcaucaugggcaucuacuuacuagaugcaccaccccccaacccccagcaaguugugacagccaaaaagaacuucuguaacaccuugggaaguugccugguuaucuacugaaggucucccuugcaaugaggaagaggagguauugcagcuacuaggcagcagcaagaccuuaaugaaugacaucuuuauuguccccaaaauguacuccagcccucacaccaacaaacaauuaagaaaugcaaaaagauaaaugauuugagauuuugcaaacauagaagacugggauuucacucaauauccauuuucuguguucuaauaaaacuuuauuuacagaaacaggcaggcuuuuccguaucuucuugguccucuguguuccuugacaguuuccccgugugucagucuuuggccuucuaaucuucauaaucuuaguauccucuucuccccuccucccuccaaggccccccucucugucucugucugucugccucucucugugugucuccuucucacucuuucucucucucugcccucuuuucccaccucccucucugacaguuaauucaacacuccuuaccuuaacuuccaauuccauccucuucucagagcuccaauccaugcauuaaugacagccucuuagccaccacucuuguucccagauucagcuccaaagacucaagaguuuggcaucaaccugcuccagccuccuuauagucccacgauacucaauacccugacgcucuccaagauacauuguuaugucaggggaaaucaggacacaaacagugcuaccauguguauuugugugaaagguagaugcuaguguuggaaagagugugugugugugugugucugugugugugugugugugugguuuccaaaucucucuggaaggauacacaagaacuugauaacacuauucauuuccagggagggaaaugaaugguuugaggacaagguggaaguaauacauuuuaaaaagugauguaccuuuugauacauuuuuuuaaaccauuugaaaauacuacuugcuuuaaaaaaacuaaaguaauaaaaaaugaaaugacagaaaacucagugcuccaucuucaguccuucacugggcccucaccccuaagcugauuuugccgaaauggcuucucaacagcauuaccagcuucaggaauguucucuccugccucgugacaucaggaaaaccuucaucaccacaccccaauacacacacacacacaggcacacacacacaucccauacucugcauuccaaccauuccagcuccuucugguuccuucugucugaaacaccuauagggcagaaaaaguaaaacccuuuaccucacccaucacaguucuuggaugauauccccauaacaaaagacguauuaaugaaagaaaagcauaacaauuuuuuuugagacagagucucgcucugucacucgggcugcagugcgguggcgcgaucucagcucacugcagccucugccuccccagcucaagcaauucuccugccucagccuucugaguagcugggacuacaggcacgcaccacuacacucagcuaauuuuuguauuuuuuuuuaguagagacaggguuuugccauguuggcuaggcuggccucaagugauccccacaccucagccucccaaagugcugggauuacuggcaugagccacugcgcccggccacauuuauuuuuuuaaccgaaguuuuacauaacaugggagccuucagaaauggagacccaaagaccaagggaaaacuguguuuuuaugcuaagucugaugagaagaguggauaguuguagagaaacgugauuggacaaaaagggguguuaucuaaagguaguaaaccuaaggggaggugugcuuaggaaggcauguuuguucagauucuuuucugugucucuguaagacauuuuucccccagguaugggaccagaaacaugucacauagaaccaucaggauggaagggaggaggccagacaguagccuuucuagguuuuauggcuugcuuugggagagcgaaauucuaguuucugugagccagcuugggggugaaaagccucguucauguucugaacccgggaggcggaggcugcagugagccgagaucacaccacuggacuccagccugggcaacagagcgagacuccaucucaaaaaaagaaaaaaauuguuaugcuuuucucucauuaauaugucuuuuguuauggugaugucauccaagacccuugugaugggugagguaaaagguuuuacuuuuucugcccuauagguguuucagacagaaggaaccagacagagcugguucucaccuugggggugagaaauuccaguuucuaugaccuucucgggagagaaagaggagagguggaaagaaagucagagagaccuuguuucugagccuguucccaucucuuuccauccaaaauacuuagcaugccaaggcaccauguuuugggguaucauguucugagccccgauacacccuuucccccaaguuuuguguucagcacagucugaaucgcugccaacaacccuuccagcccccacacgguuugaugccugcacuuuccuacauuguaguuaagugucuccuacuagaccaccagaucccugaggaaaggauggccccuuguucagcaccacauccucagauauuuucuaacuccuaauagauauuuaagaaauaugugagcugcucuugccccucacugagccucaaaagguaauccauguaaauuuccaucgaauggcauccaggggacagcauuguagaauucauaucccagcaucucuggugucacacuaaagcucagcccaagagucaagcuucauccagccccaagcagcucuccugaaucuuggcucuuuucucuuucaccaguggcuuaagcucagcucugcuucugcucuucacauuaaaaaaaaaaaaugagguuaaaaguuauuagccaaugggaggcuguguuucuuuggaccuucaggggguucacuugauuguugcagagaugucaacuuuaucuucuuccagggagagagaaaacggauggaagccacuugggggcuuaaccaccaacacacauccuucuuaucaggacauuggcaauaugaaaggauacuuucuuaggucacucuuuguuucauuuauccaggaugaauugccaaauaaauuuuuucauuuccaagaaaggaaguaaacugugguguaauaugcaauaaacagagcccugcagccaacaggauacguuuaaacuucugguucuagcccucacucacucgcugggugaccucuggcaaguuauuuaacuucucugggucucgguucucuuaaucagaaaauagagauaaucaugcuaucaacuuuuggaguggcugugaauauuuaaugagaaaagacagguaaagccccccacccccccccacccccccaugcaggaaugguaauggggcacauugaugcugcuguuccuuacugggucuguggcagacauugcuaaucaaucacagauacuucuucugauaagacuggacuggaggacacuccagacagaaugacuacucguggguagauugaagcuagcgcucagauuggagcccauuugccaucucaagccucccgcauuuccagacacgccauuugcaagguucacgauacagaauagagugguugucacaucccggggcuccuguuuccugaagcuccuccaggacuuugaacagcagccgcuagcccaucguacagauucccauuagcucccagggucugacagcuggacugcuggccccucauaccuagucuuucaaaagagcuuaugagauuaaugcauuugauuaauuuuuuuaacuggguggauaacacauuggcuguuggcaugccagcucagucucagggcugcugggggcucauugaugcuggcagccaauuuccauuucaaucaagugagagaagagggaggcagagaaagagauuaaaagaaaccaggacuugauugaaagcuauggcaucuagcgccaccuacuguuauaucgcugcaucgcuacuuuugcugaccaucgggucacugacagucuugcucggcccuuaaggcaucgcggggggaacauuuucgugaucucacacaaguuauauuuuucauucauagcucauaauugauucaauguguauaaacuacagguacuccugguauagugagaguaauagugacauuuccuuggcuuguuuugguucacaaagcccuguguaccaagugggccucucagcauccucauggccccugcaugaagauuaggcagugccaggugggagcccggagguacacaagagaugacuuucuucgggucacgcagguguggugcauggagaggggauuccgacuccacauucuuuucuccugaauccgucccuuguccaccucugcucccccagcccaccuuggggccuggcuccucaagccccucagagagcaguccccacuccauaugugccagugcguaauggggauuuuacugaaggguucacagaagagagggagaagguuacauugcaccucacacaggaaaaaacaauaauacaguccuuuagcugcuuguggguucuuuucuggaugucaguucccccucccucaccucuucucccaggcccccuccuaacccugcacugucuaucacucugguuugcuuuuuuuuagaugguaucucacucugucacccaggcuggagugcaguggugcgaucuuggcuaaccacaaccccugccuccuggguucaagcgauucuucucccucagccucccaaguagcugggauuacaggcacgcaccaccacacccagcuacuucuuuucuuuguagaagagaggggauuucaccguguuggccaagccggucucuaacuccugaccucaagagaucugccugccgcaaccucccaaagugcugggauuacaggugugagccaccacgcccggccacucuugucuuuauuagcuggagccauccucacugugugucucccucaacccucuucauacucaccuuccuucucagcaaacccuucuuuaaaaacaggaaggauuuaagaaagaaaauaguggaauaaugucuuuccuuccaguucaaaggaugggaagacugaauuuucagggaggcuuaauggcugaggacucaaguuuuuugucuuguuuugguuuuuguuuuuauuucauuuuguuuuguuuuuagagacagaguuuuacucuguugcccaggcuggagugcaauggugcaaucauagcucaccacaaccucaaacucucgagcuuaagugauccuccugccucagccuccugaguagcaagggcuacaggugcaugccaccauguccagcuaauuguuuuguuuuuuguagagagagaggucucacuauguugcccaggcuggucucaaacgccuggccucaacugauccaucuugcccucccaaaguucugggauuacaggcaugagccaccacaccuggccugaaaccuaguuuuaaaugcaggaagaccaggguucucauccugguucugaccacugaccaauuguguaaccuugaacaacuucaucuauucuuccauuucuccuucuguaaaagggacaguuauuuuuuaauaaccaucucauugguuuguuggaagaaguaaaugagauugauaaugcaaaaugcuuagcacagugcugauguguagcaauucuucaauaauuugucaguuucggugacuuagccucaccuuuuuuuccacucacugauuaaagggagauuccauucacuuagacuaaaaugcaaauaguguaucucuccagaguugugcagcguccaaccugugcauccuuauaugacagccugccaggcuuacagagaccaaggaaugcaucacagcaaagaguuaaaggauaaaccacagcuaacaaauugaaagugaacugauagcacaaaagcauccuaggaaaaaagggcagcaggugcaaagacccugugaucagaaugagcaagacacuuaagggaggcucacuggcuagaccauagagaucaggacaguggagcaaugcaagaucacacugaaggcaggagcuagaucacagagcuguguaguucccaucaaggauuuuggacuuuagucuaaaaacaauaaggaaaauuuuaggcaauggagucaugggauugggugugcauuuuggaagggucagcuauguggacaauggacaaggaaaacaagaauggaggagagaggucaucggaggcugugucuguuguccagguggcuugcagcagcgugggaaugacacuggugggaagacaauggagggaaaagacuggagagcucucuaggaagcaaagucaacaacuugguaaauuagcucagggcuuaguaaacuuuuucuggaaagggccagaugguaacauucuaggcugugcagccucugaaauaacuacuaaacuucgcuguuauaacaggaaaacauccacagacaguaauaagcacaugggugugacugugcccaauaaaacuguaauauacaaaagccagcugcaggcuguaguuugcugaucccuggauuagauaaggggaggggaggguaucaaggauuggaggguacugagcucucccacuuccugucucugugaccuugaauaauugacuuaaccucucagauacuggguuuccuuuccaggaaaacaggaauaaggauuccuuauaggguuggcaugaggauuaaauaaggcaguguuggcgaggcguagugguucacgccuguaaucccagcauucuaggaggccaaggcaggcggaucaccugaggucaggaguucgagaccagccugaccaacauggagaaacccaucucuacuaaaaauacaaauuagccgggcgagguguugcaugccuguaaucccagcuacucaggaggcugaggcaggagaauugcuugaacccaggaggcagagguuacagugagccgagaucacaccauugcacuccagccugggaaacaagagcaagacucugucucaaauaauaaugauaauaauaauaaggcagugucugcugugggacaaacagggaggucucauucaugaacacacuccagugaggaauauccagcuacauucaaaauggccaucaaggguagaaaaugaaguucuuuauuacugaggcccuuacacaaagaacaaauagaacuuacacagaaaaauuggaaucuuuaggaaggggaaaaaaaucccugcugauuacagcuuuccucacacagcucaauagauuuuuuuuuacuucaaaacaacucuauaggugggaagagggcuccagccugaagcaggacugaagaacagauaaauugcauggcauuaaauagaaugcuuauuuugcugguuaucuuuuucuuucaggugcccugaguuuuuucaaaaauuuccccacaaaucaaggguugggccaggauuuagaauggagucuuuauaaagagauucccggccggucgacguggcucaugccuguaaucccagcacuuugggaggcugagaugggcagaucaccugaggccaggaguuugagaccagccugaccaacauggugaaaccccaucuauacaaaaaaauacaaaauuauucgggcaugguggcacaugccuguaauccuagcuacuugggaggcugaggcaggagaauugcuuaaaccuggaggcagaaguugcagugagccaagaucgcgccauugcacuccagccugggcaacaagagcgaaacucugucuaaaaaaaagaaaaaaagaacauucccaccccuccccucaucaaaguuuaacucaguaguguucucaauugagggugauucugcuucccagaggacacuuggcaaugucuggagacauuuuuauuguuguaacuugcaggagagaugcuacauuguaugauguacaagaaaaucccccacaacaaauagcgauuuggucccaaacuucagucauccugaggaagagagaucuuguuaaccagccugggauguugccuggaggaggaaaugguuuaucuuuacuuuuuggaauacaucagcaagauuuuucuuucuaccccccuuuuuccuuuuucucuuacuuuaucucuuuuauuggcuuuuggcugacaggcaggcauacaauccuccuucccagagcacccaauuuccuuuuauggaguuacuucugcucuauuagauacaaucaggcucugucccccuaguuauuuaacuaguaccugguccugagcaggugcauaguggccccagagagcccaguaaaggaagugguuaaggugugaccuuaauuaaguccucaagaagagguacugacauagccagggccucaacacuuagccaaaacaaacaaaucaaccaaaaaacuaugacagguggugacuuguagguucugcugggccacaauuucuccagccucaggggcauggguccuaccuuuguuucccaacuucauccaagcucccacccugaaugucagcaagaagcccagacccuuccuuuauucccaaagcacggcuuccauaaggcaguccugcuucacugacauuuacggaagacccaagcaaauuaacugcagcaaaggaaaaccugaaacugggguuucagucacuucauauuuuuucccuaacuuguaaaagauuguagaagauuccaaaccuacagaaaguuugcaaaaauaguacaacaggcagucaaauacccuuaacuuaaauucacaauguuaucuuuuugucauguuuuuaacauguuuccauauuuuucauauguauguauguaugcauacauguguguauauauguauguauguacuauauauauaauauguguguauauuuacaauuuuuuaagcugagccucuugaaagucaguuacagacacuucacaccuaaacacuucagcauguauuaccgaaggacauucuccuucauagucacaauacaguuaacacagaaauuucacauuaacccagugcuauuaucuuuuucuuucuuuuuccuuuucuuucuuucuuuuuuuuuuuuuuuuuuuuuuuuuuuuuuuuuuuuuuuuuuuuuugagauggggucucacucuguuccccaggcuggagugcaguggcgcaaucucaguucacugcagccucugccuccuggggucaagugauucuccugccucagccuccugaguagcugggacuacaggugcacgccaccacgcccagcuaauuuuuguauuuucaauagagacaggauuucaccauguuggucaggcuggucuccaacuccugaccucaggugauccacccaccucaaccucccaaagugcugggauuacaggcgugagccccaaugcuguuaucuaacauaaaguucaugugcagaugucccuaguuaucccagucaugcccuuuauagccuugucuccaguccagcauucaaucaagggaccaugcauuucauuuaguuguuguguccccuugguguccuagagaaacagaucuucugccuucuuccucuuuuaugacauuguuagaauacaaagagguguaucccuuggacuucucuccaagaaagaacuugccagcaggcggcacagguagcugagacucuccagcuguugacaccgccagcauccacagcagcuuucaugcagcggaagucagaagcuuccccagaaauuccccaucagugggcacuggccauuucugccuugugcuugggcucaaucaagcaaucuuugcucuggaucucccuguugcauuggcuggacucugucagaucugcaucauggucuagggcuccccugccaaaucccacuuccuccuccuuuucucuuucaugggcuuacccgcaaugagcauuuuguaguccuuucuccgugucugcuucccagaggccccaacagacacagacauugacaucuuuuaagaguccagaucaccuauuuuguaaaaugaccuucacuuuuuauuuuucugauugcuuucucaugauuagauucagauuggaccucuggggcaggacauguauguaggugauguaaccauguaggcgaugcugugcccuucccagugcaucacuucagguucaccugauaagaguuuguccugucauuggugaugcuaagcauagccaugaugguuaaagugguguccgccagaccucaccguuauauggguaucucguuuccuuuguaacgaaucauuaaccugugggguuaaaccuugagacugugaugcauucaucuucucauucauucagcaaugacagaaagaaugcagagccaggcccuguaccaugugcugaguaucagaagcuuccuucccagggaucauuguuccuucuccucuucuucccagaggacuccugcugcuuugucuccccuaaguucucaguagaggacuugcucgucuccccagaugacagucucuccuucuaccaccucucccugacaaucaaaauuuccuauaaaagaugcaaccugucuucaacaaggagagauguuaaauaauucuuuuuuuuuuuuuuuuuuuuuuuggagacagagucucgcucugucgccccaggcuggagugcaguggcacgaucucggcucacugcaaccuccgccuccuggguucacgccauucuccugccucagccucccgaguagcugggacuacaggcacccaccaccacaccuggguaauuuuuuguauuuuuaguagagauaggguuucaccguguuagccgggauggucucgaacuccugaccucgugauccacccgccucggccucccaaagugcugagauuacagguauaagccaccaugcccggccuguuaaguaauucuauaguauauuuccuauuucaguuugaaggaucuguguguggaugaggucacuaauucuggguaucucuauguggguagguacacaucuuacauucuuaugacaaaaaaaauaccucacucuccccaaaaggaacugccuaucaacaccauaaaaccaccaaaauggaguauuauucagcuacaaaaaaaagagugagauccaguuauuugcaacaacauggauggaacuggagaucauuauguuaaguguguuaagugaaacaagccagacacagaaagacaaacaucacauguucucacuuauuugugggaucuacaaaucaaaacaauugaacuaauggacauagguaguagaaggaugguuauuagaggcugggaaggauagugggggauggggggcagaaggugggaauggcuaacggguaccaaaaaaauagaaagaaugaauaagaccugcuauuugauagcacaacagguugacuauagucaauaauaacucacuuuuuaaaugacuaagaguauaauuggauuguuuguaacucaaaggauaaaugcuugaggggauagaugccccauucuccaugaugugcuuauuucacauuacaugccuguaucaaaacaacucauguauuccguaaauauaugcacuuauuauguacccacaaaaauaaaaaauaaaauauuaaaaccaccaaaaacuuaaacauccgugugcaagcuaaggucuccggguucauguguguacuccugccaugaucccgccuacucuguucuuuacagcuucuccauaaugagucugaaauuuguuaaucagcaagcucgcuucucagugcugucuuuucagccucccuuccccgcucaccccucgacggagcaucccagcuguuucccugaugucuguaucagcccgggcacauuuaacaggaauucacuuccaucuucaucuuauucuaggaaguagaucauguuuuaaggaauaacaaagaugaguucagaacauucuuucauaaaacacagagaacaacagauauuuagaaaauuggcuuuccggccaugaccuccaacaaaucauucugauuuucugccauauuaaauucuuuaugaugaaaucuaacaaaauucaguggaagaguuuuggagguaguaucuguaaaucaauagcuagcaaccgcuaccccucagguaguucccacuaugcaaaauagggcaaagugggaugggggugcagaauggaguagugaauaagaacacagucgucaaugucacuugaccaugaguucaaauccaggcuuugccacuuaauagcaagucaguuucaccuuuuuaagccucuauuugcuguccuauagaaugggaauaauaauauggcaaggacucaauggacucaucuauuucauauaagaaugcacuugggacagugcagagcacauaggagauuggcauuagucccauuucacagauggggauuggcauuaguucugguaggacuggcauuaguuccauuucacagauggggaaacugagacuggggaguaaaguuaccucacucaaggucacugaacuccugagugacagggccaggacucaaaccuaggucuuucugacagcaaacgucuuuccauccauucuugccacacuucacuucucagcugucagguuaaaccacaccacuucccgaugcuacuauuuaaacagccccagcacaugaauauuaaaugugaguauaucugccaagaaaaccauccccaucuaagaguccacuguuaguccaugcgugcuccaucccucccagaaccccaccuccauuuaccaccuuuuaaccugguacauuacacgacaucacaugguguuucugacgaucuugcucucaaaaacucauugggucgauaagagaaaggaugcuguucacacaugcuguaggaaaggugggcagggcagagacuugacuuuguuuucuaggaaacaaagaacggagucaucaccggugcucugcagagcaauggaaacacugaaagcucugaagccaauggcacauccaagggaagcaaagacagaaaaucaaaaucaacuguccccaagauggcuuuuaugcaaccagguugggagucaucacagagcaccaaacaaaggauaucugcagagacgguguauuaguccauucucacacugcuccaaagaaauaccugagacuggguaauuuauacagaaaagagguuuaauuggcucacaguuucgcaggcugcacaggaagcaugaugcuggcaucugguccuggggaggccucagggagcuuuuacucauggcagaaggcaaagugugagcaggcgucuuacauggcaggagcaggaccaagagggagaugggggaggugccacaaacuuuuaaacaaccagaucucacaagaaaucacuauugaaaggacagcaccaagggggcaugguguuaacccaugagaaaccacccccaugauccaaucaccucccacaaggacccaccuccagcauuaggaauuacauuucaacaugagauuuggguggagacacagauccaaaccguaucagauggugaugggguuuugcuugguuuuuauuuucuccuaauuuuuuuuaucuuuuccugauuuucuauuagguuggugcaaaacuaauuacgguuuuugccauuuuaauggcaaaugaauuuucggcauucauucaauggcaagugaauuucaauggcaaaaacugcaauuacuuuugcaccaacacaacauaacacaauguucauuaaugucaaaaccagauuaaaauauuaaauaugagguuguauuacaaauauguuaccgggguagggagacacaugaaugagugucagcaaggaguauaaagaccuaacaguaugggaaguagagcagguaaguuuugaugggaagggaguugaucuacaaagaucuggagaaauuuggagaaguaggaggguucugaauacccuagaaucgugauuuaugacaauuuuugggggggcgaggcgcaugaccacaauucuggauaugcauuuuagccauggaaaacucugggaaccucaggcauaagaucaaaaggaguauccaaaguuaucaucuguaaagggauccuugauuaacuuaaggggaggaccugcuuuauagucccaaaguggccuggggccaagacauuugcauaagguguacccauaauuacuugcuuucacucucauuuccauuuccugcucccaccgggggcugauccuugcaaacuacauuucccaggggcccuugcagcuggcuuccaaguagguucagccaauagcaggcaccaucaggaacugaagggugagaguuaagcagaagccagggcauuucaucccuucucucauucggcuuaugguggcaccucuagcuaaaacuacaucuccuccaugagucuagcuuaugccaaguggcccuauuccagggcuucugaaggccaccucuucuucccuuaauuccuccagcccuggagaugguagagguuuccuuuugcuaaucucuagcuugccucaucauuccuuaugugacuuuugagcucuuccagcaccuuuguaaccacuccccuguauuaaauucccuuuguugaacuaccugucaugaguucugauuuccugccuagacccugccugauccaguauguuaaaauaaacuauuagcuuacaucauuccagacucuuagaugacucaauuuaaauuggcauuaaacauuucuacuuugccugccuugagagaauuagucaaaauugcuuuacaaacaugaaaaacgcuauuauuuuauuaaaauuaaucuaugugaauuguagaaaaauuaggaaaaaagauaaccaaaacaaaaaauuaucguuuaauugccuauaauucaaaugcccugagauaacaucucuauuaacaauuuauuguauuuacuuccagcuuguuauauuaguacauauaugccuugucauaugucaauauuuuaaaaccuaauuuguaucagaucacauacauuucuggaaaugucuauagauuuuauaagcauaaaucuuagagcuucucuaugaucuacuaucuuuacguuuuguagcaugcauuuucaucugaaauuacauuccauuaccaccuuuccacauuagugaauaaacagccauagcagcacuaagugguagcaccaagacucaaaugcaucacauaccacugucuggauagaccaugauuuauccccacaaugccuauggugggacauuuagguauuuuucacuauuauucacacugcugugauaaacauccucggggauaaaucucuucauccuggcgacauaauuuccuuggcuggggcaagaggauauguauuucuaaagcuugucacacauaugucuaaauugcccucuagaaagguuguagagagagugauuuuugaauguuuuauaaacuuuuuaaucuacuauuuaacuuauuuaacuuauuaacuuuuaauuuaacuuauuauuuuucacuuaauaucaaaugauguuuguaaauguccugagaacuaguuauuucugcuggcuuauuauaauuuuaauuaaacaaaacuauaauuauaaaguuauaaucauaaaccuaccuuuauaauuauaaaauuauacuuugacagaaaugguuuccugagaauccauugaaaugcugacauaguugugaggcuugggggugcgugcaucucaugcugcuaaagucggugucaaguugaggacgcaauucaguaccaaucccagucaauacaaauccacucuuacacaaugaugugaauuccuggugcacaggcagcuaucauuaggugacauuugaaaaaaaaaaugcuugaauguuggacauuaucauaguuguuucaugaagaagguaaaauuuaggauguuuaggagagugguacagacaugaccguggcauaaaacaggguuucaaucauguguuuucaaauuaucuggcaggaaaauuucugaugugcuuauuuuuccuucauuuauaaauaugcuuaguucacagcaucuuuuuggaaaguuacuuugggccugcaggaaauauauaaugagguucuccaaaauaagugggauuagaaagacaggcaaccuuguuuucaaauauuugaucucaacauggccaaucucauugcuuucacuauaaaauacaccagaaugggggucaucugaucuugauaccucaaaagcaguguugggaaaagaaaaagaacuaguuaaaagaagucucagucucuuagcuguuuugccacucccaagagagggauguauuucagauagaauuuuguggcugcagguaacagaaaaccuaauuuaagcuguuauaaauaauaaaggaaauguucaugaaaagucaagauuccagugaagcuugaucaguucaacaaggcaccguggaacgaguuuuucucugacucucuucucugccuuuccuccauaucaucuuugcccaaggcuggcuacccucaugggcacgaaauggcugcaagcaacucgcaggggcucucugcuuccccauuucuagucaguaaggaaagagaacaucucugccugugcuucucagaagccccuagaaaaugcuugcaucucauuugcccaaacugggucacaugaccauccauaaacuaaccacuuugacaggggaugguuugugcuguuuggcuucagucauucagggccuccccugcugcugguaaccaugagcaucucccaagaugcaagugcugagugaaggaaaggcaaagggccuaaccagggaacuaacugguaucaacagggagggugaacagauguuguaugugugagacaaacgaauguucauuaugcaaaagcaugggaaaguacuccuagaguuccuuacaugccucaucagaggguggucucuccacccgcuucacccaucccucaagaugaacacugaugggucugccaucaauuuccagccaagggguugaggcccccugguauacugaaaugagcaagauaaaguaccuguaauucauuacuaagaauagccaaagagacaguuuuuaaauuauuucauuguuuccuauccaauuggccugauucaaagccauccauauguuuuguuuuguuuugcauccuuuauguuuugcuuucuuuucuuuuuucuuuuauuuuuauuuauuuuuguuuuguuuuguuuuuuugagagagggucucgcucugucaccaggcugcacugcaguggcgcgaucucaggugacagcagccuugaccucuugggcucaagcgauccuccuaccucagcuuccugagcagcugggauuacaggcaugcaccacacaugcuuggcuaauuuuuuuguauuuuuuguagagacaggguuuugucauguugcccugucuggucucaaauuccugagcucaagccauccucccgccucaaccucccaaaauccuaggauuacggacaugagccacugcgccuggccccacuuugucaagugggcaaguaauagcugcaguuacaaauacuuuguagaauugccauagacucuucacccuucaucugugcugccuuacaugggaacauguauuggccaacccaggagaaaaauggaaucaagcaggccagaagcaguuccuuccuccacuucaucucccacucugccucccacccaacucuuccacaagcaucauucaacuuugaaacaacaaugcuuuucaacuuucacuuuacacuucaaagccucagagcaguaggcaccauagcccaauuucauugauggugacugcagagaaaacacuuugccuccucccacacaucaauauugggauuucuguuagugagcagccaaccuguucucacccugccuucaaaaaacacucucaguacaauacuaccaaccagccuuugucaaauuucacuuugcuguuuacuuuuuaaaucuuuucucuuucauuauguaacuaauuaauauuuauugcaaaguuauaggaaaugcacaucagcuaagaaaaagaaauaaaaccugccauaaucucacccccagagaaaaucacugcauuuuggagcuaugucauuucauaucuuugauauguguauauccacacagaucauuuuucaaaaaccaaaauagaaucaugcuauaaauauuacuuuguaacaugucuuuugacucaaaaaaaucaaacaucuuuauauaucaauaaacauacuuacauuauguugccguuauacuuaauugcugcauuguauuccauuguguagauacaccauaauuauuuaaccugucuucuauugugagauguaaaguuguuuuccaauaguuugcuauuacaagcagcaugcuggugaacaguuuuguugaugaaucucuauguccaugaaaggauauuuccuuaggauucuugacagcagaguuguuggaucuaaggacaugcucauuucuaaagcaucugguaugcauugagaauugcccuucugaaaugccagcacaaaguauuuaccagauuuaucugagagcacccauuuucccauaauuucuaaguauuuuuuuauuuaaaaaaaauccuaaggugcaggaaaauuucaagacaagauaaucuagguaauauucugauuauuguuucuccaaacugcagguugagaaaaaugacuuuuauacuaaaauauaauuugccaaguaugauggcuugaaccuguaauccuaaccuuacuugggagacugaagcaagaggaucacuugggccgaggagcucgaggcugcagugagcugcacuccagccucagugacagugugauccugucucuaaaaaaaauaaauaaaaauauaauauaguuaauuuaucucucuucuuuauauugagcauguaucaacuucugaguaaugugagauuuccccuagguauagacaaggcaaauuaauagggagaaagaaaaacccacgaacaauuaucuggauaauucauucauaaaccuccgcuaugggagcaggaagagaggggaaguacauuugcaucuuuacauugacaagauucagcucuccaaaucaacugcuaaaaccaccaauaauaauuauuuuuaaugccuaauuuuuugcucuaaaguguaaugcuuauaguaguagcuuccauuuaucuaaugcuugcuaucagugaggaauuuagcaauuaauuuaauccucagaacagaguaggagugauuccccauucuacugaagaaauugaggcccaaauucuucagagagguugaguaauuuguucaaggucacacagcuggucaccagacagaaccagggucagggcucagguccaucugucuccaaaacccuuaccauguccacuguaucacacagcagcccccucuuuggugucaagguagacucugugcugcccaggacuccuuaaaccuagccauacaucucagagaaacccaugagccuccugugccuaucuccauuuggaagcauuguauuaacacuccuuuuauuuuaaccccuugucuucucaucaggucccagacaagccaaugaagagcaucaaguauauggacaaggaaauaauaaaccucaaaaaggaccuuauacgaagccggugagugagcccagcagggaaugauccauagacaacccaacaggcaugagcaggcuaugggguguugccuacaaguccuugcccagucccagcaucccccaauucugaacacuaagcagaagacuuacaggaggguaacccugggaggagcagagggcaggaucgcuuucucagcuggacuuuccagggaguacccaugccaugccagccuccagccgccuagaauucccucugcuuuucuuccuggaccugaauccaacucaagagaguguccccaugcuccagaaaaccuucccuuuuuuacuccagacacacgugaugauaccguggagucagagucguucucaaauucugguccuguuaccugcuagcugggaugcuggaggaguuauuuaaacucucugggacucuuuuucccuaucuguaaaaugagaauaauaggagguuguuagaagaaccgagggaaauaaagcagauaaagugucccucauauggccuugaauacagggcuguuccuaucuuuccucuccucacucccuauuccuuuccucccugaugacugaggcccaggaccauguuucagccaucucugucuagugagauggaauuuuuuucccuuaccccuuaacuguuuccugagaccuggaacaucccaagguaggauccuaaaaugagacuuuugguaaagcaacucaagacagaguaagagaugaagacucuuuuagcacaaaacacguaagaugugugcugagagggguaaucuagguagcggggaaguucuauugaucuuagacaucucccacucugagccagaugcagugagaggcaaagugagacacccucucccuucaccuccaucuucugaaagccacccuucuccaccacuaccggaaucuccacccugccccauccagcagcacaacuucauggaacugaugacugagcccaggaggacuccuggaagguagaggaagggaaaggaguuaaagggccuaggggagaggugaagagagugccccacugacugcaggggguggcugugucagcuauuggagggucucuagacacugucuagugaaauauaauuugagccuuguguguaauuuuaagcuucugaguagccacacuagaaaaaguaaauagaaacaggugaaaguaauucuaauaauauuuuuaacucaguaccuccaaaauauuaucauucaacauguaaucaguauuaaaaauguauugaugagaugcuuuucauuauguuuuuucauacaugaugaaaaguaaugaagggaugaaaaauaaugaaugaugaaagaucugggauguauuucauacuuagaacacgugucaauuugcaccaguaacauuucaagugcccaguaauugucauggacuaaauugugccccugccacacauacacacacacacacacacacacacacacauacacacacacacacauauuaauauguugaaacccuaagccccaauguaauuuuuuuggagauacaaccguuaaagaaacaaguaaggcuaaaagaagucaaaggguggagccuuaauccaaugugauuggugaaagaggaagcgacaucaggcauaagcacacagagaaaaggucacaugagacugggugugguggcucaagccuguaaucccagcacuuugggaggccaaggcaggcggaucacaaggucaggaaaucgagaccauccuggcuaacaugguacaacccugucucuacuaaaaauauaaaaaaauuagccgggcaugguggugggcgccuguagucccagcuacucgggaggcugaggcaggagaauagugugaacccaggaggcggaacuugcuuugagccgagaucaugccacugcacuccagccugggcaacacagcaagacucugucuccaaaaaaaaaaaaaagucacaugagucacaugaggacauagcaggaacucagccaucugcaagccuaggagagagaccucaggagaaaccgacccugcuggcaccugcaccuucagcuuccagccucuagaacugugagaaaauauaugucuguuguuuaagcugcucagggugugguauucuguuagggcggcuccagcagacuaauacguaagagacaauacauaagagucaaugcugggauguucuugcagagaaugauccagcucaaagaggccagcagggcucagucucauauuccuuugcagagcugagcucaaaggcagcauuugaacuuggaucuccaaauugagggccuagagccacaaggauccucuguuaguuucagacauacuggccucucuguaacugcccaguggauucaccuuacccgaauuuguaacugcccaguggguucaccuugccugcugccuagacagagccaauuuaucaagacaggggaauugcaauagagaaagaguaauucacgcagagccggcugugugagagauuaaaguuuuauuauaacugaaaucaguauccccgagcauaagggagucagaguuuuuaaggauaauuuggaggguggaggaaggccagugagucaggagugcugauuggcugggucagagaugaaaucacagggaacugaagcuauucucuugugcugagucaguucuuggguggggaccacaagauuagaugagccaguuuaucugucugcauggugccagcugauccaucaaguacaggguccgcaaaauaucucaagcacugaucuuagaagcgguuuagggagggucagaaucuugcagucuccagcugcaugacuccuaaaccauaauuucuaaucuucuggcuaguuuuuuaguccuacaaagacaaucuaguccccaggcaaaaaggagguuuguuuugagagagggcuguuaucgucauuguuuuuuguuuuucuguguuuguguuuguuuguuuguuuguuuuuuguuuugagacagagucucgcucuguugcccaggcuggcgugcaguggcacagucucagcucacugcaaccuccgccucccggguucacgccauucuccugccucagccuccugaguagcugggacuacaggagcccaccaccacgccuggcuaauuuuuuuguauuuuuaguagagacggaguuucaccacguuagccaggaugaucucgaucuccugaccuggugaucugcccgccucggccucccaaagugcugggauuacagguguaagccaccaugcccggcccuuuguuuuuaaaccauaaacuaaguuccuccaaaguuaguucagcuuacgcccaggaaugaacaaugacagcuuggagguuagaagcaagauggaguucguuaaaagucagauaucuuucauugucuguuacaauuuugcaaugacaguuucaucuacaguguuugaacccaaguuagagggcuuuugaggcugaugccuugggaaccuuggagccccagggacuggugacauguaggaucaagaagccaagagccaucugaguagggacagcaacuguggcaggcagcugagaaagaagauggcauggcgagggaugagccucccaaaagggaauugcacucuguuccacagcuuugcccagagauguuccaggcuucacaaggaauggugcagcagggacguuggaucagaagagagguuccaaauacagaauuucaugggcaucaaucagucauaacagacacuggccauacccaaccaucaugaccauguuaguucuuacuagcugaguauuaucagccuucagguagaugaggccaacuaagagccccagaugcaaagacaugucagaaucucuagagccugaggaaugagggucuccacaagaaucuguacacuguagacaaauggcuguugaugagauagacgccaauagaugccuugaccuagacuugacucagccuaaggagggcgacaaagcaguggcuugccagcuuguaacuagagcccacugcuaaauuuucaguggaaaauuauugaaccaauuauuaaacacagcuauuguuaaagauuaauuauauaaauguauaucuauaauugcaaaccgaucguuaaacacagcuauuauuagaaauuaauuacaugaauuuacaauuaaguacaauuaaauaaauucuauuaaagcacagguaauaaauacuuagaacucauaccuuccuaauuguuuuauacaguuugcuaaucucuaugcccuagaggcuaucaaugguuguaguaucuaugugguggaaauaguauauaaggagugcuacaacaaaucucuucccagcucuguguucacugacgucaccacuuugguagcucgaaagcaacuggugggaauaucugcaccacggugacaauauuugcaccguggaaaucagcaaacacuacaaaucagggcucaguucccccgacagagaguuguuaaacauucaccagcacaccacgggggacgugccccaagaacgacaaagguuccacuucccacagacccaguagaauagaggggauuaauuauuaauaaaaggugauacaggcaacaguuguucugccacucuucaguuggucagcugagucugucacucccaacagacgcauuaaauguuaaagcugagauuuaacguucugcucggacacccuuagccucucccacugccggacacaaaggagaauggggaaaaggccaaacagagaagccacaagcaagcaagaaagaaacgacaaugagauguuccaucuggccacacuucuggaucccaccaacauuaaggaaggaaucaggauuccccuucagaaggaaacaccauguuuuccaagggaagucaucucuccaaguggcacaaacucccugaccccauaucccaguauuaaaugaggcgaauuguuaacaaagaugauguugacuuuuccauccauuguuucuuaacuuuguuuccccuccuguuggagacuagcucaccuugagccaaacuauuuuacugucucuuggauuuuuguuuaauauuuuagcccucuuguaauucaauggcaccgucccugguuucauggccaauuuaaccugaugcuaaaaagaauaagauucuaacugcuuuccuccucgccuguuccgucagauguucaguggcacuaagcagcacccuaggcacaaacuuggugaauuucuagcggaaguugacaaucagggucucuuugcaugugcccaguucuuggcugacucuugaagugcgaugacguaccuuccugcaaaggugccagcgcuuuuuauugugaauguuuuaaggaaaauaaacaucucugcagugaaaacaacugcaauguugaacaugaagccgugauuggcaaaguuuaguuagguccaggcaauugcaaauaaacaaugaugaauuauccacucuccccuacccccagcaggguccaggugaugcacguguuuaaggggucugagacuuugcuuuccagcuguguuugguagacagcugaagcaaaguaauuagaaauaacaaagguggaauuuggggcagagaaagaagcuauucuuuuuuuuuggcagggggguuaggcacuucuucuugguacuucuuuagcccucuguacucauucauuuuuuuuugacaaauguuuauugaguaugagauaucaccagguguacaccaggcauugcuguauauauuggagaugaacaaaacagacaagacuccugucuuugaugaauaagagaugacgacuugcauuauaaugagguaaaaacaacaaucaaauuaacaaguaaauaagcagaauuugaagguggggaucuaaaaccaggugauguauaaauagugguguugaagaagcugcugcuuuagcuacagccaucagacaagaguuguuuauaaagggaacccugggcccaauaccugaauagugagaaagaaccaucccaauaaagacauagcagggugaaaggugguguauuucagagaacaauaaaugaauggguaccaaagucagaacaagcuggaaaugcuggaagaacugaggugagcuggguggccagagcagagugagagaggauaagagagacaagagauaaaauugaagaguuggguaagagcuggcucagcccacacgcugccuuguaggcugcgaugaaaaguauggguuugaaucuaagugccacaagaaccacaggagcauucugagcaagagauggauauaaucugauuuuuuaaaagagcaucacauccacugcauagaggcuauggugaaagaugacaauggcuucaaugagggaaacagcagugaacuggggagaaguggauggauucaggauuccuuuggagguagagccacaggacuggcuaauggauuggaugugggagccuaaggaaaaggcugcauugugcauccacauucuacaaugaccuguuuccaucucucacacuagcaugugagcgaucucacaguaggcaccaugucauguccacugucauggucccaagaaaguguuuauugaugggaugaauuaauuaucuuguccaucucuagaauuuaucaguugaaauaagggggaaggcuuauuagcuuaguagggaaagugaauaagugagggggcuuauaaauuaaacuguggguuaaucaagagauaagauagcuagcccauugcuuuaggccuuccaggugagccugauaacuucugccuuuuccacugccauucaaacaggaguguccacuuugacuuaucgaugacuggucuauggcuggaaggaggagguaguaauguugcccuacaaaagaauuaaccugucuugcaaauccccagggucuagcucagugcuuggcacagagugggcacuaaguaaauauucugaaguuuauauuuacauagcaucuuacaaucuuccccgaggcaggcaggaaaagucuuguugauuaauuccucaaaugagaaaauuaagauucagagaaguucagagaucuacucaaagucauuguaucggucagcuguugcugcauaacaaacuacccccaaaacucaguaacuuaaaacaaugagcauuuauuagugauuaugaggcuaugguuccacugggagguucuccagccucagaugggcucccuugugcaccuguaaucagcugaggaucagggaggugguuuugcugaucuuggcuggauucucucauauguuuggaggucagcuggcucuaggcaggucuaggauagucuugggcagaacaacauggucucuugcucucaaauaggucagcuaggacuuguaguccuaagaaagaaugaaaguaugugagaucuuuugagcuuuaaguuaggaacuggcaaaaugucacuucugccauauucuuguggccaaagcaagucacaaauccagaccaaguuaaagguggaaaaauagauucuacuucucagcgggaacagcugcaaauucacacuacaaaugauggagauuuggguccauuuuuucagucuaccacaaucauacagcuaauucugcacuggccuuggagacaugagcuagcaucauuagauaaucuguacaaaucagagucucacucuugggaauguaaaguggaaagcacaucauuuaagcagacagcagugggcacagagguugaaacacuaagagaaagggaugccagaggguccauggugagcuguuuggagccagagguuccagggaacaaugacuauaggugagcagaugcuuuaaauuaaggaaagauggagaagaagccaacuaggaaauuagagaacacagcaagcaaagagaagcaagcgaguccccuugagugaugccaauacuuuuuuuuuuuuuugagacagaguuucucuccuguugcccaggcuggagugcaauggcacgaucucggcucacugcaaccuccgccucccggguucaagcgauucuccugccucagccucccgaguagcugggauuacaggugugcaccaccuugcccagcuaauuuuuuguauuuuuaguagagauaggguuucaccauggccaggcuggucuugaacuccugaccucaggugaucuaccugccucggccucccagagugcugggauuacaggcaugagccacugugcccggccgagugauaccaauacuuuuaacugcauuacucaggucccugaagcuaucuucuauagaaaaucuccaguucuucucucugugaauuucugaucuuggauuuccaugagaccuuucauaucccuuaugacuccauuauguacucuuaaaauaaucaccucuccaguaggcuaguuugccaaccaaggagcccaacaaaaaugauuuccuuguucauaaagugcagagaaaucaagaagacauguggcacuuuuaucaucccaccagcccuauuucuugggcuucuuuuugcauuaauaguguuuaauaguguuaaucauggucacuuugagauaugguuugugucuuggcuggcagguagggugagcuucuccuaacuuuuuuugaaauaagaagggaaaaaacuaauaauugcauugaaacaaugcaaguucgaugacagucauguggcacauguaccccacuucucucuccugugcccagggcagacaucgcuaauggaucacagcacucuuuuauucgaacccagauuuucuaaaaaccuucucagccuagcauuccaggcagcuaccaccauggaguagaaugguuacaugggauuuaauuucuuugucaucuccaaauuagaaaucucaaaaggaaacuuugauaucuauaguggcaucuuauuaacucaaauugaggcuuggaguaugagggaccagcaggaggaacagaccucacccaaaucccuuuaugaaugaggcugcuuuuaagugaauuuaaguaguuggaaaaauuauuguugaucucaggcauuuacugaccgcucucagucgcuucugcaucucaucguucaacacucaggaugcgcacauccauagccaguagcccagaacuucauuuagaaguucaacccugguucuucccaccauucccuccccuagacuugagaccuugccucaaagccccaggauuguuuaagaucauggauuuauaaguuguucaauaucuuggaagcaggcaugguuaaggcuucugaaauguaucuugugaaucauucaaagaagaccuuaguccucuugagucacaucuuccucacacccugcagacagcaaguggccauuaacgagucacuaguuugucccauaaggacaaacacuugaccucauguucuuagcccagaacugguaaacacaacugcacaccccauggguagguugcugcuauggguuggagggaccugucucaaguuaauugcgguuuuaucaucuuggaugugacccagaggcccuaccuauuuuucucuguuucugguaucuucauguaucuuugacaccuguaguuaaccauaguuuuagggugaguuuuuuuucucugccuuucuuacacuacucucuccugaggguaaauaucuuuuuuauuccuuuccuugugucaaagucugccuuggagaccccaguaaaagagaauuuaacuagaagaccaugcuuucaaauuuaaccaucaaaaauauuuugaacuucugaaccuuuuguuacacagggcuuugcacaaaacuuuguuuuccaaaauucuuuuccagaugacaagcaaugugcucaguuuuauagccaggcuuggcaggcucacagagcauagucaaaagucuucuggcauuggagucagcuguggguucaaauccuaacucuuccaguuauuagcuggguggcuguacacaaaugaauucacuucucuagaccucaguuacuuuaucuauguuaugggagagagagauaacaagaucuauuccacacuacuguugggauuuuugagaacaauauggaugaggaauauaugacuagaccaauaaaaggaagucacugucuuuuuuaugcuagcugucuugaaaguaucugaaaauauucauggguggcaacaaagaacaugagcuaugcagacagagagacucaaccagacuccugucagcugggugaccuugggcuggucauuucaccucucugagccuuaguuucuccucuugggaugggacugugccuuccuacagggauuuuugugucugaauaaggacagaaugagauaauguacauaaaaacccccguucugcuucccuuucuuagauccuacaaugccuggagaacagagaugaggccaaggaauucagagcccaguagccccaccuaucuuuaauuaacuagaggacaucacuccagcaucuucugcucuccaggcuuccaugguccuggaccaugagaauacaugcuccucaucauugaagaugcaggaugagaucuuacucuguagaguacaaacaguauauacaucccuuuucugggcaaaaaaaaaaaaaaaaaaaaaaaagaguuagcucagucccugcauugcccuaggaaacacuuagcuacauggguccuuaggugaauuuauucuguugaucaaacuugugugugugugcacgugcaugcauacacacacacaugugagagacagaguguguguguuauccaaaguagacuccacacuauauguaacuccccuagaccuggaggggagaagggaguacccaggucagaauuugauucauuuacauccuuaauuuaccagugggagaguccagaucagcuacagucagaaaggaaauuucaggagauaaaaugcugacagcgaauggcaauugucccucuuuuaucauuuucaauauuguugcaacaaugcugaccucuguucucccaagucaugaacagagagagccaaugauuuaaagagaccaauuagauuuuagcuccauaagcaaacaggucaucuugcucaaagaaguuucccaguguauacugagcaggucaccuguccuacaaaaugcaccaugaagaaaaguguucuguagucacagauguuuaagaaaugcugugaacugcacccccaucccagagacucuuagugcacagugauauuuucaagcucaguaaaguccaauagcaaagaagccuacuuaaauauagguaguccagcauuuccuagucauuaaggcaugaccuccauuucuggccauauagccgacuagacaccuuggaugauucucccaaugagggaaaaauaacuacagggacauggaagaagcuggaagccaucauucucagcaaacacaggaauugaaagccaaacaccgcauguucucacucguaagagggaguugaacaaugagaacacauggacacagggaguggaacaccacacacuggggccugucgggggguggggggccggggauggagagcauuaggacaaauaccuaacgcaugcaggacuuaaaaccuagaugacagguugauaggugcagcaaaccaccauggcacauguauaccuauguaacaaaccugcacguucugcacauguaacccagaacugaaaauaaaauuaaaauaaaaaauaaaauccgaccgggcacgguggcucacgucuguaaucccagcacuuugggaggccgaggcgggcggauugugaggucaggagaucaagaccauccugccuaacacggcgaaacccagucucuacuaaaaauacaaaaaauuagcggggcaugguggcgggcaccuguagucccagcuacuugggaggcugaggcaggagaauggcguuaacccgggaaguggagcuugcagugagcugagaucgcgccacugcacuccagccugggugacagagugagacuccaucucaaaauaaauaaacaaauaaauguaaaauaaaauaaaaucugaauauaaaauccauugacauuuaguauguguuguaggauggguucccagggaaacggcaucugagauggaaguuugugugcagggguuuaccgggaaguagucucaggaucgacaccugugagggagugggaauacagaguggggcagaaggagaagguaaacugugauggagccacaaagagaccuuggccaaucccaagggcagcucugaagcuggauugcccuuuagagguguaccacacugagacacagcgaugaaaaagcugccuaauuucucugaucuccaaaguggagaaugcaaagcacucucucucccaaggcugugaugaggauuaaauaagcuaauacaugcaaagcacuuggaacaaugucugacacacgguaagugcuugguaaaugguggcuguguguauuacaucauucacguucccugaguggcugcaacuauuuuacaauaugaucaugaucucauuaauuucucccugaccccagcuguggggcugcaggcagagcucagcaccagguccaguguauucaccagauaccccauauucugaaacuuggagguccauguuuuagggacagcugaagcaaacaugauacagggcggggggagucaggauguucauaagcggaagcugugcaaaugcagcuguucaucugggauuuccauauuuauuuaauuuuaaaucucuuccuguugggauuguugaacaagccauuacacuaauggauguaaccacaggcuugcacgguaaagcaccaguucaccacuuagaguggacacuacacgcaauaagcucuauaauuuuuuugaacuuuuaauugaaauauaacauaaugcaggaaagcacacaaaucauucagcauccagcccaauacauuuucaugaaacaaacacacccauguaacccucaucagcaucagaagaaggaacauuaccaaggccucccaggcaaccuccucauguccccuuccagucucuaacaccccaaagaaaaucacucuccugacuucuaacauuuagauuuguuccucuugucuugagcuuuaaaucaauggaacuauucaguuagcacucuuauuguaccugguuucuuucacucaauauugucuuucugagauuuauccauauugucucuauuacuuggagucuguucucucucaguaucugcguaguauuuauugcgugaggauagcacaacuuauccacucuagcauugauggacauuugggucauuuccacuuuaaagccauuaugaauaaagcugcuaugaacacucuuauacuuuuuuuuugcugaacauauguacauacuucuuuucagaagauaccuaaaagugaaauaauuggcucauagaguuugcauaugcucagcuuuagaagauacugccaguuuuccaagcccauuuuuuuuaaaguuuaaaacgcacaaauaauacaaucuagaaaagcuagaaaauaucaauuaauauguauacauaaguaauaaaacuauccauaauuaccccaggcaggaauagccccuauuuuggcagcucaacuugcaacaauuuucuaugcauucauggauccacguguauuuuuuacagaaaaaaaacauuccguauagacuacuugcuuuuuuauuuagcaaaagauuaugagcaucuuucacagccucaauaaauguacagcuauaugugacuucauuucuuucaacucuuuaguauaaaaauguucaaauaucuacaaaggcagacaauaauauaacaaaugggccaggugcgguggcucaugccuguaaucccagcacuuugggaggcagagaggggguggaucgccuugagcccagaaguucgagaccagccugggcaacauggcgaaaccacgucucuaugaaaaagaauaauauaacaaacuccuaugcacccauugcucagaucaauaaucauaucauagccaaucugauuucauuuaugcauuauccucucucucauuauuuugaagcauuauaucauuuuaucuguaaauauuuuaaacaacuauuuagagaagauaaggacuguuuaaaaccauaacgaaaauaacauuauuauaucugaaaaaagucuuuacuauccaauauccacacaaacauaauaacuaucuuugcauggaugcauucuauuucauuguaagaauguagcauuauuuaccuaaccaguuuaaauuuuuaagcaugcagcuuuaagacucucaauacuuaacugaaguugucuaaauuuacacggugcuuccauugcugacaacuucauaaaugccugaaacaaaauaaacuuuucucauaagaaaugaaagaaaagccagaaauacgguguaaagaggcugaaaguacuucagacgugacuuuuugcucuucugacuuuagcguagucaucagcagcaaguaagcaguuuauggaaagcaaaaugaaaagagacaguguucaugaaaguaacucucccccuaaauuuacuggcaaugcccagcugagccacacagacagugccaacgugcaucaggaauaucacuuucuaccuguaggauucuuuauuuaaagucuuuguccuacucaguaacauccuaggcucagccuuuucuuuaauaccagcaacuucauuaaugauuguucugauggcuuuuacuccauugagcuaauugccaaugucuccaaucuauuugccuuuuucaauacagauggaaacuucuauuuuuccugaaaagacuguagccuuugaauacuucuuugucugggucuucucugucauauuaacugauauuuugcagucaugauuuugcuuaaaaguaaaauaaaauaaaguuauauuaaaaagccagaaaucucacaagcucaccaagcuaaccucagaacaccuguauaguucucaggaguaacaacugggaugcuagacgggaaauggccuugcagcccacuguggggaaagggacgugucugucacuuuuccaacccgcaaccuacaagaguucaaagucaugauaauaauaauaauaaaacagcaggcaguuuaaaccccauuguuuccaaauuauugcuuacaaauauauuucaacagguauuaauuuccucacggcucuauuccaaaguguaugaaaacaaaaacugucuuuaaaaccagcuucccaaucaccuaccugauuuaauguauucacaggcaauagaacaaaacauggcuuuuggagccagcaugaauccuggcucuaccaccuacuagcuuuuugaguauggaugaguuaccuaaucucucugagucucacugcccucaucuaugaaauggggacaauaauaaagucugccucacaggguugugaauuaaaugaguuaacaugcacauaccuggcacacagaugacauaaguguuacacacaggcacacauacacacacacauacaccaauaucucugaaggcucaauuccagcugcuuaacuaugccaucaggacucuguccacucugcaggugagauuuucuuauuaucugugcagggacccaaaguugucucauuccugucugaugggaaaaucagaugccagaaagcauacagcuaagaaacuuaagguucuauaguuuguuguuugccuugaaagacaaacagcuagauacuuuucagacaucguuuucaggauaacguuagguaacacaaugaaagcguuuagaauagaguugucacaguacguguuggcucuugucaucaucagaguucuucuuauuacuauuuauuagaaguagagccaauggcuugaaucaaugggaaaagaaaaggcuagauaagaguuaauuccuuuccuuucucauagucucgucacugggagaaaagugaauaagaacaucauaagggccauuucuuuuguaacaugaacugagcuacaaauucaagucucgcuucuuuuauuuuuccaguuagccauaggccauuacgugaauuauucaugggaagucuagagucucccucuaggagccucaucuuucccuugaauugucuaauaagcugaaguuuguuaucccacagaaaguuggcgcuguguccuccacugccauugcuucucauggccacaagguggcgcuguacaaaaacagguccuccaaggucuuagagaccacgcuggccacucuucucugacaucucgcugauccacaccaucaucgcucucagaacccagagcguuugauuaaauaccuucccccggacaaccaggcuaccuggacaagggaggcuaccuuuaggagcuaugggauaccuuaucccugcucgaucuaagggaaguugcucuaaugucuaaccaaagugauuuucuggcccuuucuugcugaaaaacuuacaggaagagcaaaauggcuuuuuuuuuucuauuaggugcccagauauaguacauaaagcauuuuaauagaugaacagugauguggaaggcaauguuuccccaaagugaaaauacccucaaccucaccacagcugcacuuuaccauacaacuggaauagaaagaucccuuaaaaauauacccgaacuuuaucuucccuaaauuucccaugaaaaugagaacaaagucaauaagaaugcccugaggccaggcgcgguggcucacgccuuuaaucccagcaauuugggaggccgagguggguggaucacuugaguccaggaguuugagaccagccuggucaacauggugaaaccccgucucuacuaaaaauacaaaaauuagccggguaugguggcacaugccuguagucccagcuacucgggaggcugaggugggagaaucgcuugaacccgggaugcagaggucgcagugagccgggaucacaccacugcacuccagccugagugacagagcgagacuccaucucaaaaaaaaaaaaaaaaaaaaaaaggaaugcucugagaagcauuuuucugcccugagcuaaaaaaaaaaaaaaaaugcaggacaaccaaaucaagcaggcugcaaaguguugagaacaauucuucaacaaguucccuuagguugcaucugaggcagacagaguuugggggucaggaaauucugaugucaucgugccugcagugucccauuuuuuaaaagugaauggccugacccuucagcaucuaugacuauguguuaagcuuuagaaauuauucaggguuggauuagcuucgaaagaguguuuccuggaauacuacucagccauaaaaaggaaugaauuaauggcaucugcagcaaccuggaugagauuugggacuauucuucgaaguggaguaacucaggaauggaaaaccaaauaucguguguucucaagcuaagcuaugaggacgcaaaggcauaagaacgauacaauggacuuuggggacuuggagggauggggacggggggugagggacaaaagacuacaaauauggugcaguguauacugcuuaggugauggaugcaccaaaaucucacagaucaccacuaaagaacuuacucauguaaccaaacacgaccuguacccuaauaacuuauggaaaaauuuaaaaauaauaaauaaauaguguuuccugacagaauaugggugcaaaguuaaagaaaccaaauagagcauuguuuugcaagacagucucaaaaaaaaagcuuacauaggaguccauuaaauaaagccauaucuaaacaacuaguuaaaacaggaaucugaaucucuauccuugcucugagacagcucaaaaugcacauuaacugaagagcaauuccuaaaucucaugaaccuuuccugaaggucuacuauuacacaagcacaaggauuggguggagaugggagcaguauauguucagggcaagacugcccuuuugcacaauuccagggggcaucauucacaauauaugcucaagggugaaugucgccacaauuuguagaguacaaugucaaugaugccccuggggccguacaacugaacagcccuuuauugguagcuauacaaagauaaaaauaaaagcuuaaagagcugggauggggagguuacagaaggaugugggaggaaggauacaggaagaaaaaaagggagagggagagggaggacgggagacagagagaaugaaucacaggccaaauuaugagucagagugucuacgaugguucacuggauauagcuuuaaaagcugugugugccuguguggauguguguguuuggguucauuuaccuuuuacuugcauggccccuguaaguuuuuuguuuuuguuuuuuuuuaauuuguacccuuuggauauuuuuggucuagaaaagauaauaggcaauaaucagauuuuuaaaaagucacagggaguugguggagauaucccagacggagaaagcaaucugcacaugauuacaggcaaggaccuggaaggcugggugccuucuacuaagcuccugcugugagucaggcacugggcuaggauugagguaaggucaucucaaaugugagaagaagacgagaggcgauagcuuaauccuggggaucaggcaguuaagggaauagcuuucauacugacacagcucagcaaacucuggaagaaaggaagagagcuggcccgugguccuggaaagagguuuuacaucugcugggaucccucugaauauaucgcagugaggacgagugucagguaaccaccccauguccaggaggcaaucaaaagcccucuuugcacggugacaggcaagacucaaguuguaaacucaaaagggaagcuuugacaacaccuccuugcaacugcauugcgccucagaccccucccacuuccccuuguacugaugcuuagugaaggagccauugugaauuccuaaggaguugugggucuccagcgagcagucccugccaucaaucaggcagaagaacaccgaucgaaccaucacaggcugguggucuugugccuuauuccauugucuguuguuuguccugaaauuauaaaccaggggguaauuuggaaauuguuggugugcccuggaaaaagccucucucccugcuaaugcauuuuucuauauccacaauggcagguccauaagagcaaucccucccauuccauuuagucauuaagcacaauagguaauaacagggauggcaggguggagcuugcauucucgaaaaaaacauauugaaccgguuuaucucagaacugaaaacugacugcugaacaacugcuaugcacaauacuuugcuucuguuuucucauguaggguagcugccugggugcugacagguggcaggaagucacaguggcuaagaaacuggcuccugagaaucgccugaacccgggagguggagguugcagugagcugagaucgcgccauugcacuccagcaugggcaacaagugaaacucugucucaaaagaaaaaaagaaagaaaagaaaguggcuacugagucuaauagaggcaaacaggcaaacucaucgaggcagagaguauaagaaugguugccgggguggggugggggagggauggaguggaauggggacauguuugucaaggguacacauuuucacuuaugcaagauaaauaaguucuggagcucuaauguacagcaugaugccuauaguaacaauacuuuacuguauacuugacauuugcuuagcagguagauccuauguugucuuaucaccaaaaaaaaaaaagguaacaaugacagcugauggauauauuaauuaucuugauuguggagauaaugucacaagguauacacauaugaaaucgucaagugguauaucuuaaauauaaacaaauuuauuuuaaagaggcgaugacuccaggauucagacagaccgaaauccaaauccuggcauugccaccuucucauagugugacuuugggcaaguggcuucaauccgugagccucaguuucuccaucuuugaaaugauagugucuaccuguagggcucuuguaggaauuacaugauguaacccaugugaggcuucagagaccugccugacacacagagagugagcuagaaacaguaacuaucaagagcaugauuuuccaagccugagcuuuccccagggcuuuugcccucgaagauauuuagcuucuucuacaccccucuaagacauaauuugcuucuaaauaugaugggguaaauagacaagaauggcgguggggaggggagggggucuggaagaggcgcauuagguuccuuagcaaggcagacuuggcaauauucucuuuccagugagcuucagaacucuuaauagcaguugccuagaaaccagagcuguggugggcuucugcugccuuccagaaaucacccuaauugggaugcauauagaacuguuuguugacacuuggcagguuuuuaucccucuucuuccagaagaaaugcaguccucuuacacagcguuacacaaacgcugacucacauuaauuaaacagaagcccugagccaaggcaccuuuuaaccacauagaagucaggcgguggggauugcagccuggucagcauccucuaauccauugaccauuuuagguugcugucacuguguuuccaagguauggggugacuuuuuggggggcaggcaggaugcuguguggccugagggucuauguguauguguauguauaugugaacaggucacaaaagcuugccaaguccaugagauucuaccgucaaucaaagcacaacaugugcacacuuguguaacuugauauuaaaugccagaucugccuucccuuugggggguuuaaacaccacuccuagucauguggcauaagguaggucagagacugcauuacaaaugaaagaaauaacuuuccugagaggcauguagggagcuuguuucauuugaucacuucuuccagaacacagcuauauucuaguuccuagcuggaaaaaaauauauauauuucaaaggcauccauuuaucucuauccuguuuggaucauucagcuucugcacauauaguccuauaaccugcuccauccaaagaaaaugcgaaugcaccacaucaguguaagaaggugccauuauuacaugccaaaaaaaaggcguguauuuaauuagcauuaaauucaagaauuucaaaugguuuaguuacucgugcaauagauauucuuuaaguagucucuaugugcuagucacugugccagguucugaggacgcaggaaagacugagaaauugcccugcauuuaaggagcucagucuaguggugggugugggaagggagagugcauggccagacaggucaaucagcagguucaugggagagaccaggggugucuaaccuagcccaggaaaagcagaaguaacuucugguggcgggggcgggcagguaaggcucauaccuaaucaaguucuaaaggaugaguugggaagaacuaaaaauagaucuaccauucaauccagcaaucccacuacuggguauacacccaaagaaaaauaaaucauuauuuuaaaaagauaccuucacucauauguuuauugcagcacuauuccccauaacaaagucaaggaaucaaccuaguguccaucaacagaugauuggaccaagaaaaugugguauacuacuuagccauaaaaaagaauggaaucaugucuuuugcagcaacaugaauggaacuggaggccauuaucuuaagugaaauaacucagaaacagaaagugaauuauugcguguucuuauuuacauuaagcuaaacaaugugcacacauguacauagagagcagaauaaugggcauuggagaccaggaagggugggagggugggaggagggcuagggaugagaaauuacuggguacaaugugcauuauucagugauggcuacauuaaaagcacagacuucauugauauauaugcaauacacccauguaacaaaaugauacuucuacccccuaaauccauuaaaauuuuuuaaaaauuuuuaaaauaaaggaugaguagaaguuugccagguggagaagagcagagcauucuaggcaggacaagcaaagguacugagaugaagaagugcauggcugugcagcagaauaucugguauugcuagagcaucaagagguuaaagacaugagaggccgggcgcaguggcucacgccuguaaucccagcacuuugggaggccgaggugggcggaucacaaggucaagagauggagaccaucuugggcaacauggugaaaccccaccucuacuaaaaauacaaaaauuagcuaggcuuugguggugcgugccuguagucccagcuacuugggaggcugaagcaggagaaucacuugaacccaggaggcggagguugcggugagcugaguucacgcgacugcacuccagccuggcgacagagcaagacuccaucucaaaaaaaaaaaaagagagagagagagagagauaagacaaauccagcucucacagagcccugcagccuggacugcagagucuggaaaggguguguacuauauagggaagcaucauugggagaaagaggucugaggcagggagaccaauuaagagggaguggcccuugugcaggggagagaugaugacagcuugauuuucgaacaaggcaaacugaauugaaaacuuuuguuacucagccccauggugggcagaguccugaaacaaagcaagguccagccaacgugaagggaggggaaccacugaaggacuuaaaacagggaugcauuuuuccacaagauguacaucugcaccuuuagggagauaauuggugcaagguggaagagcaaaaucauuuuggccauuacauugccaagaguuuugaauuccaaagccccagcuaaacauaucuguuuagcuguucaguuccuuaagagguguguagggugauaggggguuuagaacaaagugccuugcacuaggaauccagagacccccacccagccccaccccaaccccugcaccauuauuguccuaggucugccuguaauuugucaugugauaugucgccucucugggccucaguuuccccaucugcaaaaugggggcuuggggcuuuccccaagggucuuuucacuccaaaauucucagucuagcuucugauucaggucagaaaaauaaucccuaaugccaagccauggacaucaggaguggaagucuccggcccucaaaugccaucuagaauguagauucuuuggcggcaaaguccaaauccucucaauuuuuguaucuuuccucagcauggcacagcaccuuuuacacagucaguguccaauaaagauaucaggaaggaaggaauuaaaugaauugcauucaaaauuaggcagaacacauggaaaugggauuggcaagcagugaagagauuuagauuagauaaauacuuacugagaguacauuugugaaucaugagaaauguugccugaagauguuggucccuaaguuuagagauagauaagaauagaacuggcccucaccaagagaucaaauuaccaacaucaucuuuucuucuucacugaaucaacuagccauuugaucaaaaauagcauuagguccccacaaugcgccaaagggaugaggagagggguggaagaaugaguauaauauggugucugccuccaaggaauguaauuucuagagauucguuuagccaaaacucugaagcuacuuugcauagagauauagcuuuuuugcaucuuaauuucacucaucaccuacucaucuaugggcguauccuacacugaugagagggcuugcuuuucuaauuguggcccugacaauuagcaauaaugugauuaggugaaaagaaccaguccucccucuuuauaaagcaguuuugaauauccaauuuagaauuguacuuucucuuugcauggcauguuuuaagaccuuccaaacugcuuuugcaucuauuuucugauuuuuugucuuucacaacuacucagauaagacaauauuaucuugaagaauggcugagcgagacaggcuuaggcccgagaaccaguccagacucugcuccacccagacuggguaccuuugcauugaucaaaucacugaaccucuuagcauuucaguuuccacacaaugaaaugaggcuagcaacacuacugaggguugccuugaaggauuguuuucagaaguuaaagaaaucaguagcugcaaaagcuuucucacaguuacuggcacacgguaaugagucauauucuaguugugaugauggugguggaaauggcgauagugguggugaugguggagaugguaguaguaauaguuauucauuccuagauaacagaacagagugguucaugaaucugucuaaaucccacagcaauuuuuugguagaguuagaguuagaauuuggcuuguuuuuuuuuuguuuguuuguuuguuuuagauggacccucacucugucacgcaggcuggaguccagugacgugaucucggcucacugccaccuccaccucccugguucaagcaauuccccugccucaaccuccagaguagcugggauuacaggcacgcaccaccaugcccagcuaauuuuauuuuguauuuuuaguagagacgggguuucaccauguuggccagacuggucucgaacuccugaucucaggcaaucugcccaccucagccucccaaaguuuugggauuacaggcgugagccaccauacccagccagaacuuggcuuuuuaacugacauuaauguauaucccacuuuggccuaaacccuuagauuugauuguaauuuacuguuaucagcacugucuuccugugaaacauccuguguguucacaggcugugauaugggaucuucagauucuucuuuccauuucuuuauccuccccucuucccuccuccuccuuuucuuccaucgucauuuucuuuaaugaagaucugagauagagauuaaaucaaagaagaauuaagaaaagaaaaccauuuaaaauaauuagaaggcuucugcaugucauuuccuauccagcaaagcagagguuaauuccugggccccuuagcuuaauacauuucauuacuuacaugauaaccaagcauuuuuccuaccaccacuggcacaguggacucacagaccuuugugaauuacuucauaaggcaauuuacuaaauccccaaauaauuguaaucuaauuagacuguucuucccaucacccccagagaagagaaccuccuaggcucaccacuugaacuaagugccacuucccagaacucuguggggcuuacagccaaaccaccauccuggucaugugcaaagcaagaaaguuguaccagaaggcauucauggugaugacuacaaugaagaagaagaagaaagaagaaugagaaagaggagagggaagggaagaggagcaggaggagaaggaagaggaagaggaggaggaggagaagggaaaggggaagaaggaggaagagaagucgaugauaauuugaugauugugaugaugaugaugaugaugaugaugaaaaauaagaagaaaaaaaugauaauguuaccauguaucgaacagcuccagugugcuaggcaccauacuaauugccucucauauaugauuuucaacaaugucccaggauggcuauuaauguauccaaauuuuaaaggugaggaaaggacaucucaacgagguaagaugacucacagacauugagugauaaggaaaucauggccaguuaaaccuagaacagaccauuuccaaaaccaguguauuuuucucauguaauacuuuggaauuagccugccuguguuuaaauuccagugccaccucuuacuaacccuauggucagacuauuugacuucuuugagccuuaguuuccucaucagcaaaauggggauaauaguacuuacuucauaggauguugugaaaguuugaugagauaaugcauauaaagugcuuagcucagugccucacucaagccaucacuauagagagaaaccuccuguuucucucuaagugccaccacccccuccugucccagcccucauuucuuacaggcucagacucaccuguugccuauuuaccagcugcccuggacacgcucaguggagacucucccaggccaaauucucuugacagaguuucauguuucuaaguuuccuuguuacuacccaauuaucuaaaccagccucucccaauauccuuuucugguccauggccauugauuuagccaaggacaauagcauuuuaaaugugugaauugugauaguuuggucaagaaaaaagaaagaggcagagaaagagauauugucucuuggaacuguauucugcugcaugguagcagagcccugaaaucacuauggcuuaaacaaaauaaagaauuaccucccucacauaaaaaggguuuacauuuggaugaaggugaucuaguacugguauggcagcuuccuggucauccaguaccuggguuccuucuagguuuuauccaccauccuccguauuugcuuccaucugccagaauuccucaugcucagaaaauggcugcuggagcagcuucaggcaacagaaaggaacugaaaaaggggcuaacgggcauauguuacccagcuugccaauuuccuuuaaagaauuuucccagaagccucuuuaaaugacuuccacuuguaccucauuggccuagccuaucgggaaaggcagcugggaaauauaguuuuuguuuguggugguuguuguuugauuuugcuuugcuuugcugguuguuaaucuaggcauauugaugcccacgauaauguggucuauuacuaaagaagcuaggcaaguugauacuugguaggcaacuggcacuuucugucauugggagcaauagagagaaguagggaaggaaaaccaagugcugauagccuucuacaugccagagucuuacuucaaggagcccacagacaguaagaaaggcagacaagucaaucagcaaucaccauguagugugcugaguguaauaauaggaaguacauagguacaaggagcugugggugcacuugaccuagccuggaacugagaggagagaagggaagagguauugaaugaccaacaguugauaguuuuacccaaaccuugaaggacaaauagaaaucaagccaagugaagacaauggagaagaugcugcagagagaaagaaaagcaugugcaggcgggucacagugguucaugcuuauaauccuaaauuuuugggaggccaaggaaggaggaucacuugagcucaggaguuugaggcugcagugagcuaugauggcaccacugcacuccaguauggacaacagagcaagacucugucucugaaaaagaaagaaagaaggaaagaaagaaaagaaaagaaagaaagagugaaagaaagaaaaagaagaagaaaaacagaagaagaagaaaaggaggaggaaggagaagaagaaggaaggaaggaagaaaagaaaagggagggaaggaaggaaggaaaagaaaggaaagaaagaaggagggaggaaggaaggaggaaagaaagaaagagaaagagagagaaaggaaggaaggagggaggggagggagggagggagagagaaagagagagagaaagagaaagaaagaaagaaagaaagaaagaaagaaagaaagaaagaaagaaagaaagaaagaaagcaagcaagcaugugcaauuucaaggggguagagagaugcaaaggaauggcagggugaaugguuagagauaaaucccagaucuuagaggacauugcuaggaggagaaggaaggacucaggacuucacccugagaacaguaggaagccauuagaggauuuugagcauuaagauaggaaugaugagauuugccuuuucaaaaaagcccuggggcagccagguggccaauaggaaggaaaagaccuggugggaaacuaccuaaaguaaaugaugguuucuggcuagguuaaggaagagagucaacuaauauucagaaaauagaguugacaucacuucaugaucaauuaacuggauaugaaaggggucaaaagacacaaguguuacaggaccccaacacuuccuggggguuucugcacuacagucccuucauggucacuagaaagauguuacaugaaaggggucccaauccagaccccaagagaagguucuuggaucuugcacaagaaagaauucagggcaaguccauagcauaaagugaaagcaaguuuauuaauaaaguaaaggaauaaaaguaaagccccaagggcuaaugguugcccauuuuuaugguuauuuccugaugauaugcuaaacaagggguggauuauugaugccuccccuuuuuagaccauguaggguaacuuccugacauugccauggcauugguaaacugucauggcgcugacaggaguguagcagugaggacgaccagaggucacucuugucgccaucuugguuuuggugagauuuagcuggcuucuuuacugcaaccuguuuuauccgcaaggucuuuaugaucuguauuuugugccuaccuccuaucucauccagugacuuagaaugcuuuaacugucugggaaugcagcccaguaggucucagcaucauuuuaccuagccccauucaagauggaguugcucugguuuauacaccucugacacaagcaaucuuucuguucuacauuuggaacaaacuuguuuuugccacccuagagugauuucuaaacagcacacuuacccuuagccaaagaaacaccuuagguucuuccagcucaaacggaagucuucuaggugcaugugugcacuuugcucagacccaagaauuuugcaaaagugccagagagaauaaaacugaagcaacuaaagggacuucuccuccacugagagucaaauuuucugagcccuuauaaaaguuccaguagcaucuuucuuccauccaauuuaugaucaaaaagaacccauuaacgggucuuucucuuugggcugagucauucagaaaggagagaaauccaucugaaacuugaucugagaggugaaauccugacucagcaaauuucccauuguugggcauuacaauuagcaaaugacccagggauagcaaggagauguuuggaugugauuuaauaagaaugugguugcaauaagcacucagaauauguuugcaaucaauuugcuguauacacaauaugcuaccagagcaaucuuuuguguacguaguugaccuuuaucucuggcaaucuuguccuauaaagaagagugaaauccuccauugcaaaucauuagcacucaggaaauagcuuuaauuugcaugcugacaaagauauuaacuuggugguuggcgggggggagaauaauacaacacauccuuuugucugaaaggcaguucaaaaucuguguugugacuacaguugacugaaguucaauuacuguaauaaauguauuccaaauuucaucucaauugcauuugcauuuuaaugaaugauucucaccuucuugucaauuuggcagccaggcuagauuuauuaaguuauuguauaaacagggcauucuaaugcaggaauuuaaaugcaaaauauuugcuuggugcuuuugaacuggggcugcguuauuaauuugccucuauggguugccugaaaauucaagaacuuaaggaugguguuucagaucccuucauuccaucauuuuugcccucucuuccuccgaaaucaauaugucugggugggcugacagagcaaggccugagccagccagaugaagugggcuccccaagccuccagccucaaccaauugggaauaaacugauuuauuugcuauuauuugaaaacaguaaaauuuguuaagugaaaauuucccauguaggcaauucccuucugcaagagcaggacaucccugaaaucagauugccaugaguguuuguucaucuuaaugucauucugccuuucccgucaaagcacuccuggcuuuauagccccauauuucuuguagguagagcuggaaaauguaagugaaaaccagcuggauguagagccauaauaccauuaaaaguuuauuuuuauuuuuauuuuuuuuuaaguacaucugggcucuuaguuuuuaacacagugauuugugguaguuaaucccaugccccccauaauagaaagguugaacaugaguuucacucacugccucccaaaucuucaauacucugcaauuucuugugagguuccugagaagagggcugggaaggucuguuuugggugauguucaauccuaguuuucuuuagggcccuugggagggaggccgauucaggucaugggagauguauucaggcagagugcccucaagauaagaauguccaauagagagauuuguuuuguuuuuguuuuuguuuuuguuuuuguuuuugagacagaaucucacucugucacccaggcuagagugcaauggcaugaucucggcucacaguaaccuccaccuccuggguucaagcgauucucuugccucagccccccgaguagcuggaauuaaaggcacccaccaccaugcccagcuaauuuuuuguauuuuuaguagagacagaguuucaccauguuggucagucuggucucgaauuccugaccucagguaauccaccuccgucggccgcccaaagugaaccaaaguggauuacaggcgugaaccaccacacccggccaagagauucuuagagaacuucugagauuaacugauugcuagcauguggcagaguuuuaguucagacuugcaggaaggggacuagccuucuaguaaagccaacuggaagauuuuuuuucuggaaagaguuccuuucaauaguggggaaaagguauccagacaagugcaucucaaacuucaauguguacaugaauuacccgaggauccuguuaaaaugcagauucagauucaagaggucugggguggggcccaagauucugcaauucuaacccaaacugccuuugcaaaaauuaugacagugagaaaaaucugacauaggaaaauuaugacaauaaaagaaauuugaccuaacugauuccaucuugcuucuaaccuccaagaugcccuuguucauuccuggggauggaucuagguaaccauaguaggaauuuaguuucaaacaaagaugauuuggaaaacuagcaaauuagccacaagauuagaaauuauggcucuggagucauacagccagaggccacaagauuccugaccacccccauugcuccuauagauaacaacucuauuguaaaaccuaagacagguguucaagguauuuuacagacccugcauucugauggcccugcuugcacuacccagaccaguaaacugguucaucuggucuugugccccccaaccaggaacugacucagugcaagaagauaagcuucaacucccugugguuucaucuuggacccaaccaauuagcauuccccauucuuaagccccugcccaccaagcuaucauuaagaaauccuagacucugaauuuucagggaggcugauuugacuauaauaaaucacugugcuguccuuccacuuagcugacugcauuuauacaacuuuuucucuauugcaauaaugcuaucucaguaaaguggcuuuaucugugcaguggguaagaugaacccauggggcaauuacacaacaagcucucacgugaugcugaugcugcuggaccacacuuugauuuguaaggaacuagauagcaucaccugaaguaggagugguuaguuaauaguuaauaguuaauagucuuguuguaagucugucgggccagcaccacggguaaauccaaugcugcagaaaagacucuuaaucucacagagaauaucagaaaauugcucagauauuuuaucacaauugcuagauacuucucagaaggagcuguuaauuacaucaugcuccagguccuacuccaggccaucuuucuuaggucugaggcaacuucuuucuuaauacuauauuuuaucaugucuaagaagcacauuuuuugcacauuuuaucaucucugaacuuggaaugcaauguacaaucaugucuuaauuuaauugacauguguuuuuguguuuucuucuuugugguucauaaaauaauggugcauuuuacaauggaugaugcaccagucagcuauuuucaucaugaugcuguguaacaagcugcccccaaacucaaugauuuucaacacauauuucuuucuugcuccagccuucgcugagcuaggcuagaauugcuggguucagaaaggucuguucaaugucuucucacucuucuggguccguuguggauuuuguucacacggacccagcugagaaagcucauuuuauguguucauucaauucauaucugcuaauaucccaucgaccaaaggagacacauguccaaguccaaauucuggacacugagaaaauacaucccaacccugaauguaggggaugggagaggaagagaguauuugcucaauaaugaccuaaucugccacagauggugcuuuggauuggguaaaaacauggucuaaagggggaaaagguaagccauuuguuccuauucuacagaccuagaaaugaaaucugcaaaacaaacagcccagagguacauaaacucaaagccuuaaagcuuucuacugaacauaccuaugcuuggagcaugcaaauagagagagagaaauucuggaaucaacccuacugucuuccgaucucugcuuggccacauuccagcuguuaugaccaucauuuaccuaaccuuuucucuguuuucucaucuguaaaucacuccaacuucucaggacuguuaagcaagcugacgauaacaaccgcuucccauuauggagcccuauguacuagguacuacaguaaacucauuaucuuuacugucucauuuaauccucccaauagcccuuugagggaggaacuaauauuuuccccauuugaagaugaagggguugugauucagagagguuuaaaaccacccuaagggaaugaaaaaguagaguccagccagaggcaauccccucuaacaccuucccaucgcccauacugcuccucaaguccaaaggugcuuagaaaugaaaccuaggcuuccuuccuucugucccuuuggucugucuuggccaagcccugcugagaauacuccuauugcugcaguaagcauccucucaucagcucacacacagacucccauacagagaacauacguuccuuaauaauaacaacccacccucucccaugcacugguugagaagaaauuguauugcauagagaaaacuuuccauuuuauaaucugcuuuuuccuccucuugccugaugcaguuaauuauuuuacuccccaucguuccucuugugauguuagccaggggaguuuuacaucgcacaaagcagugagcaggaggccccaggugaguggauuuaaaggcgaaaacugcucuucccugcaaauagcucccuucacacaaauagccugguaaucagcaauaaugaugaagaaaauguagggaacacacggaauuaaaugagaauuugcuaaaauauuaagcguuuuuaaaugggccuccgcgguaucaagggagcacuucccaagcucguugaaugaacauccugcagccugaaguucccagaauagacuggugugucugacaugaaggcccagacccucccccuaaccacauucaucugucacucaggccuuuccagaagaucuggcagcuggacaucugacugccuugccugaagaggggcugaaauuccaccagaagauuugcuugcuagguuucucaaauuguccaacagugacugcccugucucuuucuguggaguuaauugauaagacaagcauuuaucacucuauuuguaucuagggguuugcuacagacuuggcuuuuuaccguaugcucccuguacagcuccuugaaagaagucucuuccuauuugcagcaccaggaacagcccagcaucuccuaaacagcuuuuuaaaaaucuucagccauuaggaaucacauuaggauuguguuuaccucuuugccucagccacuaggaugcucagggccaaauuuaugcaccagauuauguggcauggguuuuguuaccugucuuaccugauuuugguuuucuuguuuuuuucugccuucugccugucucacuuuaaaaaaaauuuucuuguuucuaauucuuuuuagaaugagagcaugaauaaguugaaaaaaaucucuuaccaacuuguuaauuacuacaaaaagguaaaugaccgagaugcagagguaaagacugagaauuuuuuuagagacaggauuucacugucacccaugcuggaaugcaauggcauggucauagcuuacugcauccucaaacuccuggcuuaagugauccuccugccucagccuuucaaguagcugggaccauuggcauaugcuaccaugcccaacuaacuucauuuauuuauuuauuuauuuauuuauuuauuuauuuauuuauuuauuuuugagacagagucuugcucucucgcccaggcuguagugcagugaugcgaugucagcucucuacaaccuccgccucccagguucaagugauucuugugccucagccuccugaguagcugguacuacaggcgcuugccaccacgcccagcuaauauuuguauuuuucguagagacaggguuucgccauguuggccaggcuggucucgaacuccugaccucaagugauccacccgccuuggccucccaaagugcugggauuacaagcaugagcugccacgccuagccucagugccuguucuguucucugccccuacagaccacagucugucucaggauccaacaggucacucugacagccuuccaauccaugagagaaucuggacaacagcaaaucccuggcaccuaccagucagugauaaaccacccaaguuaguccuugacccaguggcucauggaaacuucaagaucaaggcccaugcuggugggacuuccgaaaggacagagugaccagccacauccagaaacauccugaccaucuaccaaccagcgcagugcacagcugagcucuacagugaacucaccacuuggguucagaccucagcucugcuucuuuccagcucugugaccuugucuuuccugaccacaguuuccuuaucuucaaauggaagugauaauaauagcaccuaaaacacagagucauugugaggacaaauacauuaacacacgugcccaagaauggaaagaucaggagagugaggcacaaaacugcugguaagaagcacuaaggucuaccgcagacgcgaaaucccaacagugccgaguucaccuuaaaaagggcucuuaugugaaugcuuugcagcaucucaaguguacacuggaaacacuugagaagucucauugaaguccaguggcagagagggaccucuacagcucuguucuuauggcccugcacaugaagauguuagacugaguuauuagaaaugagcuucuuaauucaaaugguaaagucuauggccuccuggaguaggacccuggaguaaaggagucgagaggcaggugcccagaccaucacuguuaccugguucucccuaccuuuccagcuuaggacacacagcccacccuuccuucuuuccucucuuccuuucuuuuuuccucucucccuuccuuacuuccucuuuccuuccuucuuccuuuuuucuucccucccucccauuuucccuuccuuccucugcgccuggcccagagauuuauuuaauucguaauugguuaaaggagcaagaacuuuauucaaacacuuggaaucagcagaaaggaaagcugaaguuccuggggguuggacuucaauguaugaauuuggggaggacacaacugaauccauagcacacacauuucaggauccaguagguugcaguuucugcacaucaucacguaauauuuugccagaguuggguugcaagagcaaccccccccccacucuuccuuacuuccucuuuccuuccuucuuccuuuuuucuucccucccucccauuuucccuuccuuccuccuuccuucccuccccuuuccucuuccucccucccucccuuccaucuuuccuuucuucuuuuuccagagaagaaccuuucugucaaacaaaagucuuaaguagaacacuguaaacuaaaaauaaaauccuaagcccccuccaaccagcugaauagacccucucuuggccaagggaacccccgaaaaaccuuaaaaacugacuucuuggccaugacaagaugggaggucagacacaccucauuguacuccgucccuuuuggaaauuagccacaagagcugcccaccauuaauguuaaaauagagaucagaagacugaugaaacugacugacaguaagauaccaaauuauaaacaggaccuaaagcuacacuggacaaggauuaagucaugcagaacuacaggucacuccgauccaauguauuaugucuugcucuugcaacccaacucuggcaaaauauuacaugaugaugugcagaaacugcagccuacuggauccugaaauguguguguuauggauucaauuguguccuccccaaauucauacauugaaguccaacccccaggaacuucaacuuuccuuucugcugauuccaaguguuugaauaaaguucuugcuccuuuaaccaauuacgaauuaaauaaaucucugggccaggcgcgguggcucaugccuguaaucccagcacuuugggaggccgaggcggguggaucacgaggucaggagaucgagaccauccuggcuaacauggugaaaccccgucucuacuaaaaauacaaaaacaauuagccaggccugguggcgggcgccuguagucccagcuagucaggaggcugaggcgggagaauggcguggaacccgggaggcggagguugcagugagccgagaucgcaccacugcacuccagccugggugacagagugagacuccaucucaaaaaaauaaaaauaaaaaaauaaaucucugaacccaccuaugaccuauaagccucagcuuccagguaucccaccuuuuuuugggugaaaccaauguaaagccucuauguauugauuuaugacuuugacuguaacuucuacuucucuaaaauguauaaagcagaccgggcgaggugguucacaccuguaaucccagcacucugggaggccgaggcagguggaucaccucaggucagaaguucaagaccagccuugauaacauggugaaaccccgucucuacuaaaaauauaaaaacuagccaggcgugauggugggcaccuguaaucccagcuacucaggaggcugaggcaggagaauugcuugaacccaggagauggagguuagugugagcugacacggugccacugcacuccagccucagugacagagugagacuucaucucaaaaaaaaaaaaauguauaaaacagagcugcauucugacugccucugggccacuuacucaaggcuccuugggcuuguguuuucuccagaccauggccacucauacuggcauaaaccucuuuggaauauuuuacagaguuugguuuuauuuccaucaacaacaccaauuucuaaaacgugcaaagccaacauuuugguagcacacaucguauuauaugaugucauauaacauuuuauucaauggaaacgaaacuuuucuuaguuuaaaaucguacuugcucagagccuuugcacauguuguuccugcuacuggaauacucuucccccaacaaguaucugcaugguuuacucccuuaccuccuucacaucuuucugcaaacaucaccuucugagugaggguuucacugaccaucuuuuucuaaaugcacugacaccccucaucccuggcaucucgucccacuugccugcucuguuccuccauagcaguuggcacuuuggguaccauuuacuucuuaguuuugaaucugucuccacccucuggaauacgagcuucauaagggccagaacucuacagcuauuuuguuuacugcugcauccucaacacauagugcuuuguacguaauaagcauucaccaaauauuuguugaacauuuucauugaacgguugauaauggugcaguuauuuaggcaaacacacaaauuggaaauugggauuaauccguguaauaaagaaucugacuccauucuugauauuugacuacugauggauuucaagcuccaacacuccauccucacccaccacaccauucccuucugcccuauaucugggcaaguugauaagaaagcccaggugcacccuccuuugaugcuggugggaaguucaaaucaucuccaaauguggaaccacuaccucacccccuaaccaccauaaaaccccaagccacuggucccuuccugcucuuucaggcaguuugaagaccugcuugggagacuucccugcucuccccagaaaaucuaguuaugugaguaauaacccauuucauauucucuuggugugugcauuguguugagguaggaggugggacuuaacaccagaggugggccuuggacaccagaccaaagugagaacuagcuaaaacagggacagggaagaagcaccuuuccauaagauauguccaucaguuuaccauugccauggcaacacucugggaguuacugccccuuucuauggcaaugacacaaugacccaaaaguuaccaccuuuucccuagaaauuucugcauaaacuaccgcuuauucuacauguaauuaaaaguggguauaaauaugacugcaaaacugcccugagcugcugcucucagcacacugccugugggguggcccugcucugcaggugcagucauggagcaguaacaccgccucuucaauaaagcuguuuucuucuaccaccagcucacccuugauucuuuccugggugaagccaagcacccuccuaggcuaagccccaauuuugggcaugccugcccugcaucaguaucagucuugacuucugaacaaauuuucagugaagggucuguuacagauugaauguuuguguccccccaccaaauucauauguugaaauccuuacccaccucccaauaugauauuaggaguugaggccuuugggaggugauuagccuccaccuuugugaaugcgauuagugccccuauaaaagagacucuggagagcucucuagcucucuucccuccaugugaggcuucagugagaaaauggcagucuccaaccuggaagagggaccucaccagaacccaaccaugcuggcacccugaucuugggcuuccagccuccagaacugugagaaagaaguuucuguuguuuaagccacccagucuaugguauuuuuguaacagcagccaaagcagacugaaacagaguccaccccaucucuguaaaguggcaugacaaugaaaagcaguugcugucacaucagucucaccucccagguuauuucugcauuugcuuuguuugugcuacacagagaaaaauccucaugugugaaguuaagagguugcaaacgcuaacgguuuucuuuuuaucaaguucccuugcagcuucaggacucucaccaauucagaagcuugaaagcaaaauggaagcauauuuuuguuucaaacaugaauuccaccucauauucacugcucacauuccuaaacuuaaauauaaaagccaggcagccaggcacgguggcucaugccuguaaucccagcacuuugggaggccgaggugggugggucauaagaucaggaguucaagaccagccuggccaauauagugaaaccucgucucuacuaaaaauaaaaauaaaauaaauaaauaaauaaauuagccgggcaugguggcacaugccuguaaucccagcuacgcaggaggcugaggcaggagaauugcuugaacccaagagguggggguugcagugagccgagaucgcaccacuacacuccagccugggcgauagagcaagacgcugucuuaaaaaauaaaaauuuuuuaaaaaaaagccaggcaaaagcaccuauaacugacaauauggcauuacuaagugauaacagguuacccacucauuugcuuuugcacaauuuuauacauaagaaaacugagagauuauuuugcaaugacaagaacaugagcugagcagauaugacugauccuugccugcaacugacugucugggauggauauaugacauguggcauaaacauccaaaaaauuuuacaugagcugagaagcaggauuuaaauuuagaaaacauucagugguaaucuuccaggagcacauucauaaagagcaaaaauacagcauuuuauugagucuaaaccaccaucaaaucuaagauaugccacuaaaaagaaaaacuaaacaaugaaaagaauuuuauuuaaaaaauuuaacauaacaaaauaaaaacacugucaauuaaaauaagaugguucuuucuuaucacuuagaauuuuuauuuuguaaaaauauuuuaggccaggugcaguggcucaugcuuguaaucccagcauuuugggaggcugaggcaagaggaucacuugaggccaggaaugugagaccagcuugggcaacacagugagacccccaucucuacaaaaauuaaaauuuuuuuaaaaauuaaaaaauauauauauuauuuccuaauuuuuaagaaaagcuccuuuuuuaccuacuuaaauaauuuuuuaauauuccauuuauaucuauauauucuguucaaaccaaaaggaaaacacagguaaaauacauugguuaagguauuccucaaacuucuucacauucaaagcccaacucuucagaaucacucuuccacucagagucaacaauguccuguggaacauuucuuaagaggaugcuccucuguugucuccaagauuucuucccagcugcagacccaagucugaaaguuuuuauaauggcacuuucuugcuuuucaaaaaauuuuuugagauggagucucacucugucacucaggcuggagugcaguggcgugaucucagcuaacugcaaccuccgccuccuugcaaacuccgccucccggguuccagugauucucccucagccucccgaguagcugggauuagaggcacccgccaccacccuggcuaauuuuuguauuuucaguagaaaugggguuucaucauguuggccaggcuggucucaaacuccugaccucaagugauccacccgccccggccucccaaagugcugagauuauaggcaugaacaaccacaccaagccuacuuccuugauuuuauaagaauaugucaaagaaaaagacuuuucagacuucaaacuccugguccagugauuuauugcccagcgggggcaauugugcagucaggcuaccaggaguaacaaccaaauuuaaaccuauagaggccacaacaacugcaaagcaacugccacguagcuggcagugauugugaauggccaaugauuguaagaugcaguuucacgucaaggaaguugagaugcgaaaaaaugggccuuucagaauuagugaacacaggccgaugcaauagaaauguacaaaaugaauugaucuagcauauaacagaauguuuuguguuguggguguuguuaauagcuuuaauagcuguuaaugaaaacucagacauuugcagauuccugaagcauuuuuacguacaguccaagcaauucccaaauccaggcucacuuaagaacccaaggcccugcgccauguuuccugccugcauugucagcuuuagcucuagccacucuucugugcuccaguguuuuaaagauaguuauaguucccuaaagaggccaucaucagacucaccuuuuugcauuuacaccugauauuccauccacugguaugccaugucccacuuuguucuacuggugaauuccuacuuagccuaaauacuaccuccuccagaaagccuuccaagauuucucuagguuccuauagcccuuugguacauuagguugagaguaucuguuuguggguguucuuccuccaugacacugugaacuccuugggggguaaauguuuuaucuuauugcuuugugcagccccaguccccugaacuggucccuggaauagcagguucucagccaaggucagccagaggaaugaaugaaugaaauguuaucacuuagcugccacccaugugaugugauuugaaaaaugcuggaaaaucccgaccucccgccucccagcauauucccaauggacauuuguaagagucccccgaugaaaugaaaugaccuucauaacaccuuagcucgucuuagcaaauaagcaggggucaacuaaucauaugagucuggccauggcagcuggcugggaauauucccaugcaaaaccgagcacaagagagacaugagaggagaggaagaggccaccuucaaacagggaaagaaaauccuacuuucuccaggaagaggucuucagccucccccuagucucaauuaggugcccccuuccccaaagcccagaguccugccucucccauuacccugugcuauuauugacaucauguaucucucucucccucucuccuacugaaccaugaacccugagggacccaaugucuuguucaucacuguauccccaacagucaguacaauacccaacacacauugcuugcuuacuaggaauuuggagaacaaauaaaauugaugguugcuuauuaggaauuuggagaacaaauaaaacugaauuugagaaccaacauuuacaucuaggaacaaagugggcagacagaaagaaacauguagacaccucugcaucacuccuucuccaccacagggcugcuaacuccaaccccaaggugaagacuggcaaagcgcagggagguguguagcccaucacgacugagaaugucuucacaucaagccagcaucaagacaucugauuaggaaauagugguugaguuggcaugaaaagaauuaugaggucccaacauauguuauuugacacagcaagaacccacacauuaguacuugaacuucuguagcagucaugcugacagaugugagcauuuaggcaaaucaaagagagggcagccuuagccaggagccuaggcccuuuagugccugcuaugccauugauuuucauggaagagcccaucuucugugccaagcacuucacugcugaccccuucccaugcaugaugguaucugauccugcaggcugugaauuguuauguucauuccacagcaccuagcagacugccuggugcuguaagugggcacuccauaaacauuuguugagugaugggaugaugaaggaaaugaggcucagagagauucaaggacuuggccaaggucuuuaguacaagguggauccagaauucaaacucaggucuggcugagucuggaaaucuacaggugggaaggcuccugcccugcaggcacgagggcacgcucagagauuauuggucccaagacaauaagagucaacucaucuuuuuuuuaaauuugugucucccucuccucccucccucucucucucucucuuuccuuccuucccucucccucucucacucucuuucucuauuucuaccuguuucuuucucucuaucccucuuuaucucucuuuucucuuuccucucucucuuucuuucucuccuucucuuuccuucucucucuccacccucccaccuuccucccucucucccucuuccucccugcaugucuccagcuuuuugauccagucugugaagauaggccguggauauuuugcuauucugagggaagagacugcaaagaaaaagaagcaacaacaacuucagaaacugaaagaggaggaaagaaauaaauuccagccagccgaaaagaucucagaaauccacuauggggacaccuuauugagguaaguggaugcaguagcuguggcacugaagguuuugggaaugaccauugagagugaacccugccugguaaggucaagcgagggcagcuaucucagagcacgugccccuucucagccuggcaucuaacaccuucuuuagugugguccaaccaaccuugauagccucgcuuucugguauucgcuggaacaucuuccacuuaucacuaaccacccagcuuaaaugcugcucucuccgaauacuuccuggauuucaguccaaccaccuccugcacccauuugcacuccagguccccauaauacguguuuauaugcuaguuuuaguccacaucaguaucucuguuccauaccuucaguggcagccccagggccuggcucauuguccacagaaaccaggugcauaaaaaaugccuccuuuuuuuuuuuuuuuuuuuuuugauauggaaucucgcucuguugcccaggcuggagugcagcggcgugaucuuggcucacugcaaccucugccucccagguucaagcgauucuccugccucagccucccaaguagcugggauuacaggugcccaccaccacgccuggcuaauuuuuuuguauuuuuaauagagacgggguuucacuguguuggccaggcuggucucgaacugcugaccuuguggucugcccgccugagcuucccaaagugcugggauuacaagugugagccaccacgcccggccuccuuuuuuuguaaaggacuuuccccugguuggaaaaggacuaucaauagacugguccauuaugaaaugcccaugcauauaauaauaguaauaaccaaaauaacaauaaaaacagaugaugauguuuacugugugcuuaaugcacaccuauucggcuaaauuucaaaacauuccugagauaggugcuaucauuggccccauuuuagagauggagaaaugaggcuuagaaguuaacuaaucucccccaaggucaguaguuagaaagcagcucugagucccaaacuuaguggcaccaaaauccaucgacugcaccauuuggcguggacaaaauccugggauacuuugagcuugugcagacugaaugaggcacaaaccaaggauggaaaggaagugccaaggcagccagggaggaaaugcaggguagaaaaauggccugcagcuguagccacucuccugugagcgcagcuguugcaacccuagcuacauauuagaaucaucuggcaaguuuuuaaaaacaccacuguccaggucaguuacauuaggcucucuaauauacauuagcuguucauagauuaauuuuuuuuuauuucaauaguuuuuggggaacaggugguguuugguuacaugaauaaguucuccaguggugauuucugagauuauggugcacccaucacccaagcagugugcacuguacccaaugugcagucuuuuaucccucacccuccucccacccuucccccaggaguccccagaguccauuauaucauucuuuugccuuugcauccucauagcuuagcucccacuuaugaaugagaauauacgauguuugguuuuccauuccugaguuacuuuacuuagaauaauggucuccaacuccauccagauugcugaaaaugccauuauuuuguuucuuuuuauggcugagcaguauuccaugguguauauauauauguauauacauaccaccuuuucuuuauccacucauugauugaugggcauuuggacuaguucuauauuuuugcaauugugaauugugcugcuauaaacaugcaugugcaagugucuuuuucagacaaugacuucuuuuccucugaguagauacugaguagugggauugcuggaucaaaugguaguucuacuuuuaguucuuuaaggaaacuccauacuguuuuccacagugguuguacuaguuuacauucccgaaaaaaagugcucaacaucgcuaauuaucagggaaaugcaaaucaaaaccacaacgcaauaccaccuuacuccugcaaagaacggccauaauauaaaaaggaauagguguuggcuuggauauucauagaauuuuuuuaaguuccccuaagcgaauccagugugaagccacaguugagagccguuaggcuaaggcugccuucaggaauccaaacugccaggucauuugccaaaaaugaaauggaagccacgacagauacccacuuuccucugcaccauuucccaaauucuguucuugagaauguuaauuuacagaaugugaauaugugcuucuuauaaacaaggguccugucaauggaaucauauauuaugugacucuucugugucuggcuucuuucacuuauagugcauuugaaguucauccuaaacagagagcagauuguugguugccagaugcugggggcaggggaaaugggaagugaccacaugggucuggaguccccuuuugggagugaugaaaauguuuuguaccaagagguuaugguuguacaacauggugcaauguacuaaauaccacuacauucuacucuuuaaaacaguuaauuuuauguucugugacuuucaccuuaauaaauuuuucuucaggccaggcgugguggcucacaccuguaaucccagcacuuagggaggcugaggcaggaagaucacuugagcccaggaguucaagaccagcuugggcaacauagagagacuccaucucucuuuaaggaaaaaaaagaaaaauauauacaauuuuuucaaguagaacaaggguucuugucuaugaggccugggguauugagucagaggagaacaggaccucuuuaaagcccaggguuccaggugauggaugagaacccagacugcaagaccucauggagcugguauauuuccagucaccucccccagaaucauggcuguugggaucccagaauauuguggaaagggucucuucuuugacuccucauugguguagacccugggaucagcacaaauugugccuaccugaccaaacucaauggcacccauagauucugauacuccuagugacagacuggcagccuuucccuggaauaaagagaaggcaugaacucauggcucuuuuuucaggagcuaugcucagauugacaggcaaacccaaaaagcacuggggaaagauggugucuaugaaagacacuccuguaccuguuuaaauggcuugggugucuuguuccacuuguuuggauggaguuucucauccauggucguagaacgcaauucuccccucuccaauccauguuucagugugugagaaaugauuuauuuaaaguuuaauaaguuuaaauaugcaugagaucgcuccucuuguagacuuuggucugguuaugucuuaucugguagguucuaugaguuauacaaggcugguuauuaaaauaaaacuggaagucauuacagcaauguagccaucaaaugcgcgggugggaggguguuauaaaacagcauuaggagauugucuacacccagacaggguaguaguggugaaguacacaagccuuggaacccguuaggacuucccccauacaacuguuucacuuugaacaaaucccuguaccucucugagucuccuuuucuucacguacauaaauaaaugguaccaaacucccaagcuuauuaugaggauuaaaugaaaugauacuuagccuagagucuacguauaagacaugcucaguaauuguuccuauuaugacgcaauaaagugaguuugagcucucugagccucaguuaccuaaaauccuuaaauguauggcuaaaaaucuuaauuuccaugaaagcugaaaagcaucucacaucuaacagcaaugcuucuauagauaaaauuccaaucacaaaaguauaaaaaauacaaguuucauuuauaaauacuuuuuaaacaaaguauuugaucuugugcaucauaaaagcgaaaggaauuauuuucuccucucuggaucuaagaccauagaauacauucuuuuagacaaaaauuuuaagucugacaaacuaugcagggaaaaaaaaaucaagcacauccccaaagauuucugccugcaagcagucuuucccacugugcucagugaccucauuuuucagcugcagauucagcugaaaagguggaaaaaaaagugacggguaaaauuuguuuuauuauugugguugagagaagacauaaaaccagagauuagggauguaaaagcuggguuaauuuccacauauccuaaaccacuggaagcaugguugagccaguaagaaaaggucacagcaagguauuugcugugguuuucucagcucuaggauugaauaaagagucaguggaagugaacauuggaggacauagauucugguccuaauuuuuguuaacucugugauuccagaauuauccucaaauucccaggaggaagguaaaccccuaacgugugucccagcaucaucuccacuggcccccuccaucccauuccccacacuaagccccaagcuaagugaucuuuucaaaauauaaauugcacacagccuaacacccuccaugguugccauuccucacaggguaaacacaaaagucucagcagggguuccaaggcccuggauggucuagccuguggcuugccucuccagccccagcucauagccuccuuuuacucccucuacccagccacacucuccuacuuucuuacucaugacauggccuccucuacagagucuuuacacaugcuguucccucuggcuggaaggucuuucccuccuccauuuacccaguuaauuuccauucaaccuucagauuucagcucaauauuuacuucugcuacaguuacuauugccaugaacacccacucuaaaacuuauuaacucaagauaaucagaacuucuuucucucauaaaucugcaauuugaguaaggcucagaggggcagcucacaggacccauuuccaagacagcucacucacauugguggcaaguuguauuuggcugucaguucgugagcuugguuccuuucccugugggccuccucacaggcugccagcuuccccacagcauggcagcugaaugcugagugagcaucccaggacacaggaaggagagguugccaguuccuggugcccggaaucacaugacuucugacauauucuguuaggucagcuggucacagagccaaaugaacauagaccuaccucucgauuggagaaguuucaaagaauuugggggacauguuuugaaauuuccacaacuuccucaaggaaguacaguauucccugguuuccauuucagucaaauuuacuauucuaggcuauuaaagcacuuucuauuggaacacuuaucacaacuguguguuugguuguacccaucucccccacuagacucagcuucggaagaggagaggcugcaucuguuucauacauugcuguauuggcagcccccagcucagagaagagguucaauaauuauugguagaaaugaaugaaucagggaaccugucaaugauccaaucaaugaaaguacuuacacugcagcucagaaacuaaaaggccuucagguaacaggcagauggcaugaauuagaaagaaaggcagagagugagaacagggaugcuuguguuugggguaacugaagaagcacacaccucauucaaagcagucuguggcccaucauucuuguguagaaacacaggucccgaguggccagagcuuucaauuuuuugaaggccaaaguuuuuucauuuuuaugugacaucucccaauuuuaaaauacagacaauugauucaauugcacacacgcacacacacacacacucacagagagagagaggagagagagagagaaagagagagaaaaagagaguggauuaauuaaaauauaucugugggcugaauuuggccauggacagaaaaauauauaccccacagccaggugcaaugucucacgccuguaaucccagcacuuugggaggccaaggcagguggaucacuugaggacaggaguucaagaccagccuggccaacauagcaaaaccccaucucuacuuaaaauacaaaaaaguagccaggcaugguggcacaugccuguaaucccagcuacucgggaggcugaggcacgagaauugcuugaaccuaggaggcagagguugcagugagccaagaucacgccacugcacuccagccugggugacagugagauucugucucaaacaaacaaacuauauauaucauaugacucaagcaugacaacaaccacccccccccaaaaaaaauccuauuuucuauaacggaaaugauuugcucugcuguaauggugaaagaaaaaacaccuaaauaugguauuaaauugcuguuuccagaacacagcugaaaauauaccuugucuggcccuugaagcaaacauuuccaacccuaguauaauauacuaguaugccgcaugauuuaucuuguuuauucucuuggcucuucuagagauuauauacuccauaaggcagggacuuuuuuuuuuuuuuuuuuuuuugagacggagucucacucugucacccaggcuggagugcaauggcacgaucucagcucacugcaaccucugccucccggguucaagagauucuccugccucagccucccgaguagcugggacuacaggcacuugccaccacgcccagcuguuuuuguauuuuuaguagagacaggguuucaccguguuagccaggauggucuugaucuccugaccuugugauccacccgccucggccucccaaagugcugggauuacaggcaugagccacggcacccgaccgagggcagggacuuuuauaugcuuuguuaaggaacugcaucugaaacccucaucccuccagcagaaauuauuugccugauacauaguaaguguccagucauaucugccgaauagaccguggcaagagaagaagguguucaaagcuacugcucauuguucacauuguuucucugucugcuuguccuucagcacauaugaugaugagaaguugaagacacugggagcuagagucacacgucgcccauucacucccauccacagcugcaucauuucucccucgcuaaccgaggcucacguguaaguagucucaccuccagcucauuugcuuugcuagcuuauaaauugaagccgaacugaaaugacucaacgagcugucaugucaguagcuguuccuuuguccucuugaaagggacauggagccuggagcuggcaaagcuauuuggcauauaaaaauaacagaaaguagacacagugguuuacagcuaaguggcaaaucagcugggacugagucauuucauuucuugccaagccagacgcucuaaugucaaauaguuugcaaagccugauaaaaucugucuacagcccucaucgagugugugcgagaacaucucagccugugcucaggggcauguuuuccccaagacucaaggagcuguuucccagagaagcccauccaguuuucugaccugaggcaugaacucaucauuguguggugcaacaggaacuaaucaaccuuccaaagaacacucuugcuuucuaaagucuugaugucuuguuccccuugugucuauuccaaaucucaagcccaacuuuuucuuuuucaccaguuagcacuuuucagcuggaagauuucaggcacagggauacaagcuucugacuuuagggcaggguuuuucagccuugacaccgcugacauuuugagagaaauaauuaauucuuuguugugaaaggcuguccuguguauuguaggauguuuagccgcauccauggccucuacccacuagauaccaguguugacaaccaaaaaugucuccagacauuaccaaauguccccugggagcaaaagugcaugagcccccaccguacaucauacacacacacacacacacacacacacacacacacacacacacacacacacuccacauugagaaccacugcuuuagggcaauggauucauuuagagcugugauacaaugauuccagacuucucugucugcucauuugucaaauauuuauuaggcuucuacaguguucacagugauaauggccacuccucaucacucuguagcauuaucucacucaguccucucagccucccuguuguguagguguaucauuauccccucucugcagaugggaaagcagaagcucagagacauaaacucaccuauucagggucacagaggucaguguguugcugagucaggucggucugacugcaaagcccaagcuuucaucaccacacacuacauagaacauauaucccaaagccuugucuuuaaggagcucauaauauauuuggcaagccaaguuuccuauacuugaagaguaaaagaauacaagagugaaaucauaggauaagauggcaaacaaaagaaaaucacuaauaagaguacuuaguucaugaauggaagaugcaaaaaccaucaccaacaccaucaucaucaucaccaucauccucaucaccaucaucaccaucaccaucaucaucaucaucaccaucaccaucauuaucaccaucaucaucaccagcaucaucaucaucaccaucauccucaccaccauuaucaucaccaucauccucaccaccaccaucaucaccaccaucaucaucaccaucauccucaccaucaucaucaucaccaucaucaucaccaucaucaucaccaccaucgucaccaucauccucaccaccaucaucaccaccaucauccucaccaccaucaucacugucaucaucaccaucaccaucaucaucaccaccaucaucaccaccauccucaccaucaccaucaucaucaccaucaucaucaccaccaucaucaccaucaucaccaucaccaucauuaucaccaucaucaucaccagcaucaucaucaucaccaucguccucaccaccaucaucaucaucaccaucauccucaccaccaucaucaucaucaccaucaucaucaucaccaucaucaucaucacauuguguuggacacauccuuaucccucccuaauauuucagucauuaaugagcccuaucccacuccaucccaucccacugucccccuaccucucuuugauugguauuaugauuauaauauuccagcuggcagccuaagcuugauguucuuaaagcaucuccuugcaaaaauaggccuugcaauuucucaugaugucucuucaguacacuugcacuucugcccaucucucccauggacaagacuucugaaaccaauuggaauagaaccagugggcuuucacuugcaucugaaucgucugggggugggggagagcagggaggaaauguuucugagaaugcauauuccugagcccaauccacaauuuauuuggucugagccauugaggcuuacuuaaaucagcuaugaagagaguuucuuacccaucuucugucaaugucagaugggaaaacuaaagcccagaaagggggaagaaccugccaaaagucucacaacaggaaucuuuuuuuuuaauuuuuuuauuuccauagguuuuuggggaacaggugguguuugguuacaucauuucuuuaguggugauuugugagauuuuggugcacccaucaccugggccauauacacugcagccaauuuguagucuuuuaucccucaccuccuucccaccccuuucccuugaguccccaaaguccacugugucauucuuaugccuuugcaucaucauaccuuagcucuacuuaugagugagaacacaguauguuugguuuuccauuccugaguuacuucacuuagaauaauagucuucaaccucauccaaauugcugcaaauaccauaaauucacuccuuuauauggaugagcaguauuccaucauauauauauaguauauauauguauauauauauguauauauaguauauauauauguauauauguguguauauauauguauauauauguguguauauauaugauggaauacuacucauccauauauauauauauacacauauauacacacauauauauacauauauauacacauauauauacacacacacacacauacacacacacacacacacauauauauaugccacagcuucuuuauccacucauugauugauggccauuuggguugguuccacauuuuugcaauugcaaauucacaacaggaaucuugaucuccugacagcuaagucagaucuuuacaccagguuuguuacauaggcuauuacuauuauuauuauuauuauuaucacaguggaugugguucauauuuguauuggaccaggggucagcaaacuuuucuuuaaagggccagacaguaaaaauuuuaggcuuugcugaccaggugguauuccuugcaaccacuuaacuuugcuguugcagcaugaaaacuacaacaauggauguggcuauguuccaauaaaguuuuauuuacaaaaccaaaguggcaggcccacaggcuguaguuugcuguagucccuguccagcacugaaggcugccuuuucuuauccucagcuguucaaaggcucuggcugcauuugaugacuuuauuaguaagcuauggcuguauuacagaucaccucgacauggaguggcuuaaaacaacgauuuaguauugcuccuaagucuacaugucagcagggugguucugcuggucagguuggcucggcugaucuuggcuggaugugcuuauguguguacacccagcugaugggugagcuggagguuggcugaucucgaauggucucauucauaagucuugguuaguugguugguggccagggugacaugggugagaugcugaaugucucucaauacccagcaagcaaacucagacuuguucacauggcaagcagaaaggguuccaagaacaagauccuaaguacccaaagccccuugagggcaaugacagugaugaugauggugcuggugaugauuauugcauuuuccaucugugaacuaggcucagaaugaacacaguuacccucucaccacauuccacuggccaaagcaagucaccaggccagccuagauacaagaaguauggggaaagacuucccuucuuguuggggggaagcagcaaagucacaucccaaagugugcaaagcagagagggauggcauuguugucaucagucuaccaaaaggcaccagggcuggcccugccugauaauuccugaauuuucaguugucacaucagccaaugcggaucagagccuggucagucccuucagucccugugugaucgaucccaaaaguggcugauaauuccaaaucgacuguguagggaucaauucaaucauguaacaagagacugaccuuuaucuuuaaaaagggaagggaguggucucuaggaaugagaagcagccccucguuuuucccuccuagaugacugggcugugccccacagccuuuaaugagugauugggcagcaagggcaaugccugcaaccugugucgagauuugcccuuggcaaucagcacggggugcuuggaauggcuuugaaugcauuuuccaauuucucuuguaaaagaaaaaaaaaugcuuucuucucagagauguuuaugcccacuaggauucugguugguacaguaguuuuaauagagugagcuauucaggugugcugacugcuggcacucgcccggaguucugagcucagggacuucagaagcaggcuuuguguaacccuguucagcauuuucaccucuuauucccugcauuuaaaaaaauaaauguucucucuucuaauuugauaaaauccaagauacuaugcuaugaccugacacaugaucauuaugagaaaagaccgauuucuaucaagcaugcuucuggggacuuuuuuuuuuuuuuaauuuguuucacugcagauuagaagagcaaucaucagguuuagggcacuuuuuauaaacagagaaaaaggaccagaucuaucagaugaaacccuauucugaugaaaagggagucucuacccuguaacaagagacaacauccacauuuucauuaagagcacgaauucagaagccagacugccugggcucacauuccaacucugccauuugcugucuuuugugaccuuggauaagucacugaggcccuuuaugccucaguuuccucaucugcaaaacggggauaauaauaguaccuucuucacaggauuuuauaagaaugaacuuaguuaauggauauugggcacuuagaacaguggucuggcauagaguaaggacucuuaugggaaauauuuaccauuaguauuacuucguuguucuguuguuguuguuuuuguuacuacucuuuauuaucucaaugguucuguguauaagaauugugcucaaguacaggugcaguggcucacgucuguaaucccagcacuuugggaaacugaggcaggcggaucgcuugagcccaggaguuugagaccagccugggcaacauggcaaaaccccaucucuacaaaauacaaaaacugucugggcaggugucacaugccuguagucccagccacucagaagacugaaguaggaggaucgcuugugcccaggaggcagaggcugcagugugccaaaaucacgccaccgcacuccauccugggcaacagagugagacccugucucaaaaaaaauaaaaaaaaagaauugugcucaaguuaucaguucagaaaaauaucagaucugaaccaauucauucccaccauuuuccaucaguaacugaaaaaucuauugagcugacucugugcagagcacagagcacccugugguggacaggacucuguagguuguaggcucacggucuggaaagucaaguaaucagguaguuacagcagagcaggaacccaaaggugaggacagggaggacauauuguagggauggggaugcuuuagaaccuccuuagagugagcccagcccagacccagagcaaucaaggaaggcuuccggauggagaugagagcugaagcccaaucacugagagucaagaaggaagaggagcaggaauauguaucaggagcagggaacagugcuaagcacaucaccucacccucacucucgccuuuuaagagagguacugcaauuaccaccauuuuacagauaagaaaacugaggcucaaagaaguuaaguaauuuggccaaggccacagggccaguagauggcaaagcuagaaguuuaacauggauggugcaaagagcaagcauggugagcuugagugacugaguggauuuuugccaggcugcaggugguagcacaaggaacagacaggacaacuccaggcuggagaggcggacggggccucaugugugucaguggauuaguuugcuggggcugccauaguaaacuacuagacuggguggcuuaaagaacagaaacguauuuccucaugguucuggaggcugaaagcccaagaucaaggugcugucagcguugguuucucccaacccucucgagguuggaggaucgcucucucccugucuucucuguguccucauauggucuuuuucucagugcucgcagcccuggcgucucuuuaggcguccaaaucuccuccucuuauaaggacaccagucagauuagauuagggaccacccuaauggcuucauuuauaagugaauccacucuuuaaaggucccaucuccuaacacagucacacgcugagguacagagguucgaauuucaacaaaugaaucugguauguccacaauucagccaauuacaaauuauuuaggaaguuugaagauuuuaagcaagagagggagagggucagguuugcauccguuguugucaucugcagaaaugaaucugaugcucacaugccccgcuuccccuccaccaccuugugaccaagcagaccccaucucaccaauucacuuccuuuguucauuucccuccccaccccacauaucccaaagcccaggccugcaggggcuccaagcugcaaaacagaagaacccauaggccucucccccggccucucacaaccuccuaggguuauggggaggguauagugaggugcucauggcccagugccaggcauguggcacagcuagcugcugcuauugcuaaaugcuggacauggccuauguacccagaccuaccaaaaugcugucaccuguagggcccaagaagguguuaugggagaagaaagagacaauaacugaaaaggggucaggugcaauagcucauaccuauaaucccagagcuuugggaggccaaggcaggaggaccgcuggaggccaggaguuugacgcuagccuaggcaacguaggaaguccccaucucuacaaaaaaaaauaaaaauuagcugggcauggugaugcaugucuguagucccagcuacucuggaaacugaggcaggaggaucacuuaagcccaggaguuggaggcugcagccuggugacagaaugagagccugucucuuaaacaaauguuuuauuuaauaaaaaaaauugaaaaagcugugggcuuacaaguccuuuaaauuagaaguaaaggaauaguaggcgcuuaguagauaaucuguagaaggaaaagacuccagggaagaaaggaaagagaguuucucaugguaguuuuccaaagaccugguggauacagccacccuaguacacagaggugaggggaugggguagggcagggcuguuccccuucaagcuaagcaaaugcaugccucucaaggauuagccgggauaacccugggccagcuccacacuugagcccagggauuggguaucaccuucugaaguggugccuuccuggaaacagagaguagagauaccuuccugacccugaaaacaccaggccuaggaacccuggggaguguugaugagggcaggaugcaguuucagagaagagcaauuacacagguucuuaauggaggcaucuggcccauuaguguuaagaggagaaaucuugcggggagggggguggcuggccaggacuccaccuuguuuccaggaaaaaggcaggcagcagguuaacccucuccugaccucgcucuuggggugaccacugcaucagcuucaucagcaccuccucagagcccaggcccgugagagcacagacauggaguuaaauugacacugguucaaauucucacuaauccuagcagugugaccucaagucacucauugccccucucugagccucccaucccccauuguaaagaggaggugggagcgguauauuaccuaaaggauuguugugagcuuuuuuuuuuuuuuuuccgagaugaagucuugcucugucacccaggcuggagugcaguggcaugaucucggcucacugccaccuccgccucucaggcucaagcaauucuccugccuuagccucccgaguagcugggauuacaggggccugccaccgugcacagcuaauuuuuguauuuuuaauagagauggggguuucaccauguuggccaggcuggucuugaacuccugaccuaguaauccgccugccucagcuucccaaagugcugggauuacaagagugagccaccgugccuggccucguugugagcuuuaaaugagauacugagaaccaucucagucaccaacaggcucugugaccuuaagcaaagugauggcaccucucugagccucaguuuccccuucucuaaaaugugcauaauaauucauacuccagcagguuguaggaagaauuaaauaauguguauaaagugcccccaucaauaccugccuccuuguagguguuuaauacaaaguguccaaaaaaucagaaaauguaggugagacauaugugguuuuguuguuuaagacagucucacucugucacccagacuggcaugcaguggugugaccuuggcucacuacagccuugaccucccuggcucaagcgauccucuuaccccagccucccaaguagcagggaucacaggugcaugccaccacacccagcucauuuuuguauuuuuuguaggcuagucucaaacuccugagaucaagcaacccacccgccucagccucucaaagugcugggauuacacaaaugcgccaucauucccagccugagacauauuuuuaaacaguguuuuagugaauauuuucaaguaauaugcucuuuguguuuuucuucaaaacccagcuacauuuucaggcaaaggacucauaaauguaaagcaaugcaucccauuuuuaaucuggggggagaagaacaauuaauacacuaguuucccugaguuuccagacuuuuuacacacucuuaguuuauuuauuguacuuuuaucagauuaacaauuggacauacauaggaugcugauuuccuugaagccucucauuugccugagucaagacuuccagcugggggaccccuucuuguuucucucccugcuauauauacaaauucucaguaacuggcauuggauaaucucauuucaaaugggcucuaucaccuacuggccuggugaccuggcacaacuuccuaaaguccugugagccucugauuccucaucuguaaaaugggcuacagaauaucucaugggcccauugcaaaggccaaaugagaugauacaugcaaaauacuugcgcaugccuggagcauggugccugcucccucacugggagcaaguaccacuacuauuucuguggcuauuuuugcgaagaaaguuguucuaacaggaucccacuguguucccucucucugucuuugcagcgagccccucuuccgccagcucugugcucuccacuggcuucuggaggcccugacuauugaccacacccaccacaccaugaagccugugaucaccugcuggaacccaaaguaugccucagcccuucaacuugucuuagacuagcaguaggcugggcaguggggaagagauuccuguauguucuuccacucccuuugcuguuuuugguaggugggcuguuucaguuccucuucuaugugcucugugggaucugaacaggggagaacuagagacagcuuaugcagauucgugggagccgguugugugcaucuccuucccacaucucuucccaacuccacauucagugacaucacauggguagcuugaaaucagccagccacaugggaguauuuacaccacagaaauuggcaagcuauggaagcacaucacuggauccacagcuugacugcucuccaacucucuucuuggacugcgucucccuacacuauucuuuauucuucuuccuuuuccuccuccuuucccucccuuuuaaucuuucuuuucuuuuuguuuuuguuuuuauccuuucuuucaagguuguguuuuguuuugcuuuggucuuuuuguugcuuaauauacauugguggcuacuucuccacuuggacccaagggaauauuugguauucaguucccuggagcagcuggguuuguacaggcagaagcuccagaacauguugucuaggucaagagaagcguuagguguccgcaccagaggagagagcucacauaaaagcuuggacgccacuguugcaggaacagcauuguacacacagggcagaacaaagaacagacaggcauguaaaggcauugguucuuuaagaagggucagguuguuugcaagaagaggacaaacaaaaguaaagaacccugacuugaagaaucaguuuuucacugugaaaaucagaggcugaguuaaauaaaauaguuccccaccccccgugcuaacccaugcccucccauaguccugccucccagguggauccagucuuccucuucccaaaaccugagucuuuuuuuuuuuuagacagagucuugcucugucaccaggccagaguacggugacgcaaucucggcucacugcaaccuccaucucccggguucaagcgauucuccugccucagccucccgaguagcugggacuacagacaugcaccaccaugcccagcuaauuuuuguauuuuucguagagacgggguuucaccauguuggccaggauggucucaaucucuugaccucaugauccgccugccucggccucccaaaguauugggauuacaggcgugagccaccgcgcccggccaaacguuaagucuuaauuaacuucuuccucuugaagacauuuauuacccauccccuagaucuccuccacccccaagucaucucuuacaccaggacccagagaaacuaaccucaaaugcaaccagcaauaucaugcauccauugauagaucaguaacuccaaucaauucaguguuuuugguugggauaauuuuaaaacuacagucucuuuugauacaagugguugacagacuuuauuuuuuuaagcagcagaccucauuuuuuuuuaaauagaaaccucuguaauguaaaacagacuuuucuaaauggaaguucuucaugaagcaagagguuugggagccugggagaccugggaccccuccaacuuacuucuauccccaucacggcacccuaguuauuuccaaaaugucuuuguggcuuccagaauuuccuugaaaaccacagccuuaaaacauuuuucaugccuucuucuucuuuuuuuuuuuaaagagaugagggucuugcucuguugcccaggcuagaguacagugucacaaucauggcucaccacagccucgaacuccugggcucaaacaauccuccugccucagccucccagguagcuaguacuacaggugaaugccaccacaccugccaucauaccuggcuaauuguuuuuuaaguuuuuuagagauggugucuugcuauguugcccaggcuggugucuagcucaugcccucaagcaauccuccugccucagcaucccaaguagcugggauuacaggcuauuuauuuuucucuaaaauaaaacugcucaaguaauaagugaauacaauuuaugcuuauggaaaucuuucaaaaaauguauaaguauauaaaguaugaaagccuuuauucccucccugaaauccccuucuuaaagaaaacuccuuuuaaaagucuaugauauguccuuccaaaucuuucuaaugccuuccuuuuauaaacauaaacagucacauuuuuuaacagaaauaggaucauaucugcauauuguucucuacaugauuuuccccuuuacaauaaccaauaggcaucuuuccaugaugguauacacagguuuacacauucuuucaauggcagcagaauauucuaucauauggauggaauauacaccauuucuuuauuaacagacacugaggucauuucccaauuuuugacauuucaaguaguacuguguggaauauccuuacacaucucuuuuuguuuguuuguuuguuuuuguuuuuguuuuugagauggagucucgcucugucgcccaggcuggaguacaauggcgcgaucucggcucacugcaaccuccgccuccuggguucacgccauucuccugccucagccuccugagcagcugggacuacaggugcccgccaccacgcccggcuaauuuuuuguauuuuuaguggagacaggguuucaccauguuagccaggauggucucgaucuccugaccucgugaucugcccaccucagccucccaaagugcugggauuacaggcaugagccacugugcccggccccuuacacauaucuuuuaugcccaguuacaaguguuucuguuagcuggauuccgggaaggagaaucacuagguaaaagcaauaucuuuuuuuuuuuuuuccuuacuugauugcuuacauucuaagaaaaaggccucugagccagagggcuccugacagcauuucaucucccuaaacaaaccaccaacagcaacauuuuccuccuacaugugggcacccauucuccaaaacugagaaaagaacaucauguggaauuuggauugagaagagaaaaagggccauguuucuuuccuuugguugguuuuagaaaugugcucagaacgugaccaaaaauuguuaacugcaguaaaaagacguaguggucacauugagaguagcagauguucuaccaugacuuguaguggcagaauucuaucagcgcuccgaggaugcccagcucuauaaaaucagaaccugaaccagaccuagccaccugagguaaaaaaugcaguccaggaagauuaacauaggaagucacgguauuuguugggguuguuuuuucuagcugacuauuucuuccuggugggcauuuuaguuuagggucaaugacaaugcugguaaauguuuuaacaaccaguucucuaggaggugaagaacaaugauuugugacaaugccaauuuccacgguguaaauacucccaccguggcugauuucaaucuuaccaacaugguaucaccgaacuuggaguugggaagagagguacagaauccguucuuaugagccacuaugagccagcuccagcacaccacuguucgggauucauuuuuaaaaauuaugaaucuggggggcaguuuaaguucucuauaaaguauaagaaaacaccuuuucaguuauaagaaagcagaaagagcucuucucuucaacacuuaaucccuauuuaugacguuucacccuuaugcagcagugugaauuuccccaaaucuucaagugcauuuuuuuaaacccagagggauuagagugauuaagagcaaaggguuuagcaucagaugaacccagaugagucaaagcucugccacuuaauagcugugugaccuugggcaagucacuugacaucucuggcccucuguuucuucauugguuaaauguguuccugccucagaaguuauuguaagaauuaagcaaaaucaaguccauagaggauuuagccuaauaucugggaacacaaugaauguucauuaaauaacagcuauaaaauguaaaaaucccuauuuuaaagagaaguuagguguacgauuaucaguaccauugagacugaaggcuaggaaagaaaggaacuucugagcagaauuuuaccaacaggugagaccuauguucacugggugaacagacaaguaugcaaacagggaaaaaaggcuacagaagguugcccaaaaccuaguugcaaagauaaacaacccagguaaugagcccaagaagguaauaccuaaucuccaguucuccugacugugcuuuucugagucuccaucaucaagcaaccaguaucuccuguuacuaaagcauuuugacacuuaaacccugagcccugacacccaccgugcauuuuccaaaaggagauauccauccuuggggaccuguagaucccagaggcuccauuucaguuaggcauaaugacagcuguagacccaaucccucccccuuauggauuuuauaggaagaaagucggagugguucgauaccucaaugagggcuuucuacaggcagcaaaauuucacuaaccggcaguuacugugcugcaagcagaagaacaaucuuuguuaguugcaggaugaucucauauuuggauggauugguggauguuugggugaauggacagaugacagauuuuagggugucauuaugaguugcaucugagucucugcuuuauugagaaaaaaaaaaacuccucaacuucccaauuucaucauguggcaauuuaaacacauuaucacuaucauuucucagcauccuuguuaauuccacugcuaacaagagaguuuauuucaauugacaagaugaucggguccacaguagaaauugaaaccaacccuucaauaaugaaugugccaauuacguuucuccaagagauauaagccucuuuuuaggcaaaguaggaucugauuuuuucaugaaugcccauaaguauuuauucaaacccuuagggccaacugcauuucagaauucugaggguuuuuuuuguuuuguuuuguuuuguuuuugcauuuuaaaaaggaaauaugauacaugugccauauagaacaucacacucccagaggggccugucaucaaacacaauauuucugcagaaaacaaauaagugaauauuuaucuuaagugcauaacaaaggucaaaaaaaggccacuaacagccucccaucaguuucugucaugcuuugcuaccaaauaagccauuuaaauuguuuugguuuaaagacucuuuggauuuuggaauugguuaagugguugugaaccuguauugauuuuauucuuauuagagaccaaauuuccaagaaccaaccgaagaccuaccuagaaaugaguagacuuuuacagagucacagacaucagcuguggggaaauuugacaagcucuaaugcugccuccccuaccccuguggccaucuucccuaguuacaguggagaagaaacaggccagaccccuggccaaagaagggagugaagaguuaccuacuaaccuuccagcagguacagcacacaccucaaaggaguuguuccaacaggcucgaguccccagaguccugugcuuuccccuggugccacaggggcaguacaguugucuacgucuuauugcuucaggcuguccagagagacaccacugggcccacuguuuaguggggagaccaaguggguguaaucccuacgcuuacaauccugauucuuauaauccugacucuuguaauccuuacucuuaagagacaccagacauucaagggcugggcuguccaggcacaaaaaauccacccuuccuuuagaaauacacauaugaguaaaaggcaaccaaccacacuuugagguuucaaauaugacacaaacaucagccaggcgugguggcucaugccuguaaucccagcacuuugggaggccgaggugggcagaucaccugaggacaggaguucgagaccagccugacccacacggagaaaccccaucucuacuaaaaauacaaaauuagccaggcuugguggcacaugccuauaaucccagcuacuugggaaggcugaggcaagagaauugcuugaaccugggagguggaaguugcggugagccgagaucaugccauugcacuccagccugggcaacaaaagcaaaucuccgucucaaauaugacacaaacaucaaaauccaucuacuguuuuaugaugaaaauggcuggcacuugagugcuuucuaugucaagcacugcucuggguguauuaccucauuuaagccucauuccaacuuaccaauaaggaaacugaggcauagaaaauuaauuugcucaaaguugcacagcuagcaaaagguaaggcaggauucgaacccagguaaccuugcugcaaaguaugggugcuucacccccaaaugguuguuucucuguagguaaaucccaaagucuuuaaucaacuuagagaauaaucugaugccccgccucgaagaaaagaagaucuuauuacaaugugguacuuucugggaggccccaggauacaaaagggacucgacuuaccgagauguuaucacauauaaacugcaauuuucuuuuauaaaauaauuucaagugccauuuugcacauacuguuuugaaacuaaauuuuugcuguuugccuuaguauauaaggagcaucucuccagaucugaaccucugcuguggcguuuaucagcauacgaauguacugaaacauauuuaaccaauauuccaagaccuuuacgucuuuuccaaguuuuugcuuccaugaaauacugucgcaaucguucugagcagcacucauaauagcauuuuuaaaauuuaaauuguuuauauuuaaauuaguuuucccuuaucuugugguacuccuccccccacaaccaagaaaaucucacuuuccucaagccuggcuuuuccaggcacuagugggaauacugccgugaagaaaacagacaacaccccagcucucaggagcuuccauucuacagggggugagggaagcaacagaugauaaacaugcaauaaucaagauacuuugagauagcaaugugucaugaagaaauugaugggugaugugcuagugaugggcaggggaguuuuaaauugggucaucaaggaaagacucacucagacagugacauaugagugaaaucucugauuuccccugcucuccucuuugcacugauuuaauugcauggcuccuccacugugguacuccaguggacaucucuguggagugggagaauguggcaggaggaucagaucaucacucaggagguaggauggaaccaccugguccaggaaguccccagagcuuugaccucugcccccgcccugcugcagaaucagcagcucuuccccuccgucauggacauaugagcacguccuaaccuagccuacagcuuuccacccugggaagcagauguuuuaccccagaugggaguucagaaagagagcacgaaguauuugagaaaauugcucugaauugccacuguggauagacaucuucaagugacagccuggaacaaaaugugcuuggcggauauaguuaaaagagauuugacagugcucagcgcccuauucccuugauuucuggcaaauaggauccccuaggaagcuucagcaggggaaaauuacggucugaaaguuauagcuacaucucccccaaggaucugcccuaguacccuguugucuaccaucagcuccuccucuaagccacaguaaaucucuguugaaaagagaagguuauuguuguuaauagcugaacuguauucagcucucuguacacagcacccaugaagcccuuaauaagccccauuucuuuucaucuucacggcaauccuuugucauagcugcuauuauucccccauuuuacagaugaggacagugagguucagagagacuaaauuacuuacaccaagucacacauguaggaagcaguggggaagacagaggacucgaacagcugguccaaccuauuguuaaauucacucuuaaccacuaagauaacacuuuccuggccuugauacucggagacuugcccgaggucacacagacaguaaaucacaaggauauuaaaugggugagcuaaguaaguuaggcugccauaaugaacaacccccaaaucucagcaguuuaaggcaaaaaaagcuuguuccuuggcucaccuuucaaauccaacagggaggcucuacucuguaguuacucagggacucaugcugauagaagcuuccaccaucaacgaggcagaaaaaggaauccgaugacuucaggacuagcuauuaaaucaucuacccgaagucccacaugucacuuucacucauguauuuuugaacaaagcaagucacagugcuacacuugccuucagagagcagagaaggccuggaacuauuuggucgauggcacuaaugcuuaccccaccaggccagggggaaggaccaccaacccucucugcccuccuccacaagguaugcaauggaugaugcagcuuaggugguuuuauuuuuuucuuccuuccccuauugaucuuccuuuuuggguuauuugcuacugaaaaugaaacaucagaaagaccgauuccagcuaaccaggccuuuucuuuaucaauggguuugcaagagcaagggcuccgagcuuuuuaaggucugugggaaucuugcugcauuuugaacucauuuagccugcugcuugaagucgcaauagauuucaggucaucuuggaagucagcauuaguggaaaacuuccaucuucccgauuggaccugaauaguuaagauuuugaaagcuuugcugggaccagauuuaauuuuaaaaggggaaaggggguugcuuuugaacuucgagaagaaggcuggaggcucagcaggggcugcguuagcaaagggaaaugcgaaaagcccuguggucuugaaagaaaugcuccaaagugaaaaaaaaaaaacacuaaagcuuccagugggugaaccuuaaaucagacuucaaaagcacugcuaguuuaaauauuguuuauaggacugaaggauugcuccuucuucuggcuggauuuuaaauauccccuaauuugauuacucgggggagaggcaggcagaaccaacuuaaaugagcuucacuguuaauuauucagagggcuuuuuauuguguaaucaaacauaaagucuuacaaaaagcuuagaggcacauucucaccccaccucaccagcccgacuuccacuuugggucugugugcauuucuugugugguggcuguucgcugguagaucuucagcaaagucccacuggugaagagaggacacccccaacuccuuauuuggacugggaaaagccuuugauucugcuacucagaucuccaugccaugagaagucagccuuaaguuagguuuaucuugaucaccuuuugccuucuauaucugagcaccucccuucuacccacaaccaccagcacucagcagccccuaacaagccuagaccccugucauugucucccuaaaccaaagcaguucuguucauccucuuuuuuuuuucuuuuuuugagacggaguuucacucuugucccccaggcuggagugcaauggugcgaucucggcucacugcaaccuccgccucccagguucaagcgauucugcugccucagccuccagagcagcugggauuacaggugugcgccaccacaccuggcuaaauuuuuuuuguauuuuuaguagagacagaguuucaccauguuggccaggcuggucucgaacuucucaucucaguugaucugccugccuuggccucccaaagugcugggauuacaggcaugagcccgguucgucuucuuauuucaaguuccugcucucugcuaggcgagagcuagacaaauaauuaaaaggauccuugugauauaaaauucuuucugcaaagaaaaagggaauaaagaaacagauagguggauggaugaauggaugaaaagauauauauggacagagagauugauagaccaaucagucgaucaaucgauauguaaagguaguugagagaucacacguugagacucccugcuuucuuaucaguagagacccacuuccccauagccacaaguccaaaauccacaagcucugaaaacucaguuuuuucauaacucauuuggcagcaaaaucugacaggaaccaaucgaaguuggcagcaaaauuggacuugaagcuacuucuggucuuuauuucucccaccuaguguaaauauccauguguuucauugcagaaauauucauguauuugguuacaggaugcugucccuuuagcccccucagagggauuauguuaacauacaguauaugcagcauguuuccuuuccaaaaugccaaaauuauuaauuuggcaacaaaucuggucccacagauuucauacaaggaauuaugggugugucaccaacagaaccuacugggcuucagucuccuauccagaaaauucccaacccaugacaggaggauccagguuuuguggagccugaagcuuauuuaacuggggagagggcauuuuaagaaaaaaaaauacaaaauuacaauacaaaauuagguacaggauccuggaagagggacccacacuagugaggagcccugaagcuuuagcuucauucguuucacuguaaguaagugacuuaaacucccuuaguuuguuuucucaucugaaaaugggaugacaaugacuacaucacaagguuauagugauugagaugauacagacagaaggcacagaaagguguugcacacagugucguagagaacuuaugcccagucaaccuccaaucagugauuuucauugugcaauccacccccaucagccccacccucaaucccacccaguaauauucucugugugucucucagaaaugucccugaugguggaccccuugggcaacagaaaaagcaaagauuuagaaaugaacaugcuuuucaauucaccccucaggaguaaucgcagaccugcccaggauucuaggagaggaccgagucuaaaauacaaauagaugcaaaaaacaugcaaauauauaccaccucccuccuccacccaguaagcaaaagucucuccaaaccucgauuucacucaaaagagccagcuauggagaacuaucccccccauuucuucacaaguagaggagugggggaggaaauccuaacagagcccagccaccauuccuccucuauuuauugcauuucuuaaaagaacuuguaauaaaccaagacucuggaaacggaaaacucauuaagcuguuucucacucagggacccggguggaagcaagagcaccauuaaaaaaaucaauaaggacaaguccaugggacagaaaugggagcauuucaucacagcgccaaagguaaccaacaacacgcgacucaacccuuuggcuccuaggucccagcuuguguugaggaguauuuuugccagucuuuucucugaugggaauuuuuuuuuccuaguugguucucggagugaagggaagucagagccacaggcuguuggaugguuuuuguaaauuuuaauuaaaacaguuaucuagggauuauaggagaaaugacauuuggcuggacacuacauaauggggacaggagggggugcuaagcagcugcuuaacaagaugucaccagaaggaaauggacucaccucacucuaucuucuaaaucaauaacagucauuucuuucuccuucucccucccucccucgcuuccucccucaccgccccccacccccaccccgcuuuaacccagucagaaaauaaaagccaggcacacuagcucaugcuuguaaucccaaaggauugggaggccaaggcaggaggaucgcuugagcccaggaguuugagacgagccugggcaacauagcaagaccccgucuucacaaaaaauuuaaaaauuagcugggcauaguggugugcaccuguagucccagguauuagggaggcugaagugagaggaucauuuaagcccaggaauuggaggcugcagugagcuaugaucccaccacugcacuccagccucccaccugggcaagagagugagauccugucucuaagaaaaagaaaagacaaagugagugauucaacaaagauuuucuacaaacuagaaggugcaguuauuaagaggacaccaagauacagauucuuuuuacccaaaaguauuccuaacccaggaccucccaaacucaucuacucaauaaacaagccuaauaaucauaauaauaauaauggcaaaagguaauauugagauagguaaagguaauagagcacacaacuagagcguuugcugaaccuguccccuaaccuaugaaauggauauaaugcccuuuccugccuaccucacaacuuuagugaagaaucccaggaaauaaauauaaggcaaacacacuuugaaaaugugagaaugcuuagcauuacugugguuauguaaauuuuagaggccacuguucaacauaauuguaaaugggcuagguucugugcuaaggaagcuucuguaggaauauuauccaguuaugcccucuuaauaacccuauggggcacuauucuuacccccaggugagagaggagguauuugggggcucagagagguuaaguaacuuacguaagguuacccagcuggguacuggcagagccagaaguuaauucugggucuguuuauuaaacauaguuuauuaaacauauaaacaucaauagguuuauuaaacauauaaacauccaaugccuggucuuccugaccccaugauuauaguugccccucaugaagaauuucaccauuuucuuacucuuucaucagggugcuccuagauuuaagacgagccuugguuuuuauggcagaaaguugcuauggagauacagugugcauccgucuucagaaaugcacagaaaaagcagcaggagcuacaaaccuuuaaaaaaaguccuucagggauauucaccacuaaaauuggaggaggggagggggagaaugaauagcugugcuugaacucuugcaaaacugaauucaaguuugugggucaaauccugggcugcagcacguuccacucugggcaugggggagcacucaauuaggcugcaggagaccuggcucagccaugcugacucaguucacugugugaccucagacaaauccuuuccccuguucugggccucaguuugucuaccuauaaaaugaggacuuugaaggagggaauccaaccagcucccacaauacucuucuuuuccccugauacucuucuguaugucuaggcaguguucauaggggccaggcaaauuguguuauuaauaaaagaaaagaucaggcugagugugauacaguagggagugguggagucuguggcaaacuggagcacuccugcacagcuaaagggaagaaccucugugcagcuuuagcucauuuugccuugugagaaugggagcccagagcuuaucauuuucaaaagaaacaaaaaacuuacauuuuuauauaaaagucucccaauuuguaaaauccuggguagcuaaacaugucuccccaugggccaccagucugcaaccccuacuucacagaaaguguaaggaaccuuucagcaaauucuuuuccuccguugccaaaaaucagucccuacugagauggaacauagcaacugguuaacacaacugcugagugaaauauaaaaaauagagaagcagcauuuagggauuuaagucaauucagagagguucaguucaauaaaaggcaagccagugccugucacaucuucccccuacauuuuauuuuucugccaguuucaauuaaucacaagugucagcccuucacuuuggauuuccuggcuaggaugguuaauuaaauuuuaauuaauggcaacuuugggagcauaagaugaaauccuagcucaaggaagacaccccuggauauggaaggcucuucugaaauugucccaggcuauccccuagguuuuauaaaugaggaaacugaggcagggcagagugacauauucaaggccccccugagguacccugacucugacuccagugcucacugcaagauuccaagcugccucaugccaccaucuguccacccuucaaaaauuacauugauuuuacuaggcacagugguuuacaccuaugaucccagcacuuugggagaccaaggcgggcagauugcuugagcucaggaguucaagaccagccugggcaacauggugaaaccccaucucuaccaaaaauaacaacaacaacaaauuggccaggcaugguggugggcaccuguaauaccagcuacuugggaggccgaggcaggagaauagcucaaaccugggaggcagagguugcagugagccaagacugugccacugcacuccagccugggcaacagagucagacccugucaaauaaaaauaaaaauaaaaaaauuacguugaucugaagagccugguuccuagagucaggaauucauauuguucuagauaaaauggaaagaggcaacuucuacauguuucaucccugagcucugauaucaucucuccccagaaugacaaagaguagaggggccuucugucaguuuugcaagcucuugaccaguugcagugucaggacaacaggaucauuguaccaagcuccuaauuuaucaaaggagaggacaugccugcuuugggugcuuggcauuucuugaucagucauuuuguaacuugcauggccucuugaagaucugguuaaauccaguucaaauuccauuucuccagucuaucauauucugaagcauucugucguuuguacagaauuucacugaagauuugagagagaugaggcaggcacagggagagaucauauguuaaggcccacagccucucccuccucuuccccaaccuucucccucuccugugcaaccaagaaaucccuccccucuucuagugcaagaagguuccacccauagucagugcccuacaagguagccauucaaaauauugcuucugaucacauacaguggacucccugaaaugaauucugcugaauacaauucucuccacccugcgcaauguguauuaaauguugguguggucuucaaugcugucucuucucccuaucaccuuucccagggugucaaacacuacgaauuucaucuaaagaaaacaccagucuauccaucaagagcuuucauuguaaaugugcucagauaaaauuauuucuauuaagugaauauaaacuauagcccacucuguguugagcucuuucucuggggcaucugagggccuauucuucccccuuguaaaccuggcauuuuagaugucauaaagaaucauuagcaugggauaaagggcauuuucgaugucacugaaaaaaaacuuuugaaguauuuugaagccaggcauaguaaugagcuuuggcauuaaccuaacuuaggucugaauucugguucugcuauuuucuugcugugaccuugaggagguuaggaagccucgcugaaacuuggaucaugaguuauacgaggacauaaccccaaacagugcauucugaagugacaccaaucucacaggaagguacacacagacacacacacagacagucuguguguacucuuucuuacuccuuuccuucuaaaaauccacaggacuuucccuaccuaccucucaauuccuuccagaacuuaucauccaauucuccuagcccacuacaaccguggcuccucccccaagaaugccacugcaccagacaaaucugcuuccucccacucacauccuaaaugucaggccuacaauuucccuauucuguguucuuuagaaaaccuccaugauuacaaauuauucuuugaggcccaggugucaacugggggacuaggaaguguacacauggaauuuggagccaaaaccaagaugugguuaaaaaauuagacccauccucauacacaguuugaaaaucaacuccaauaguuauuacaaaagaaaagucaaaaccuguucugggccuugacaucaucauggaaaacacguuuggcuuccuauggugacuucuugggcaaccaugagcucguucaauagaauauacuccaccacauuugcuuuaaauaauacacauuuuaacauuaucucgauuugugacaaaaggucacuccagauccagaauauaucucaugguguuuggaaagagccagaaggaauucacagucagacccaggcuuugcuuuugucugcugucccuccccaccuuccuccuucccuccuuucuuucuuucuuccaucuuuuucccccuccuuccugaaaccucucuuucuucucuuuccuuuagaccaagaaauucaaaauucccacaaugcgagucaccaaccgcaaaccaagccggcgaggcuccacacucagucugagucgggccagugggggguccucuccccagagcagcaugaucucugugaacccuggcucggaugagcccccaagugugaacacccaggugaccagcagcaaggacauugaggacaaugagucaucuucaaccaagccagaugaagaaccucuguauaugaguaaguccuaccugagaucugacucaucuacccugacccuuugccuuuaagccagacaucaagaaacccuccugccucaaguccaccuccacucauuuaaaggugacaugggaucccgcauccuuguucaauuuccuuggaccucuuuguuuuccccaguggagaucagaaauauacuccauaacuuggguugccccaagccauuucuccuacagagacagccuguggucaccaacugcccuuuucuaauuuuaaaaauauuuuuauuuaggcugggcacuguggcucaugccuguaaucccagcacuuugggaagcugaggcaggcagaucauuugaggucaggaguuugagaccagccuggccaacauggugaaacccugucucuacugcaaaugcaaaaaucagcugggcgugauggcacacaucuguaguccaagcuacuuggaaggcugaggcaggagaaucacuuuaaccugggaggcgagguugcagugagcugagaucaugccacugcacuccagccugggccacagaggaagacuccaucucaaaaaaaagcauuuuuuuaaauuuagcccaguuuauacagaacauuaucauuucaauguguaaccaauguaaaaauuauuaaugagauauuuuauauccucuuuuauacugucuuugaaauucggugucuacuuuuuuaaacagcuuuauuauugagauauaauuuacauaccauaaaauucgcuuauuuuaaaugugcaauucagugauuuuuaguaaacuuggaguuguguaaccaucaccacaaucuaauuucagaacauuuccaaccaccugaaagaaaaccuucugcccuucuuacccagagcccccaggcaaccacaaacuugcuuucugucucuacugauuugucuuuucugaacauuuuauagauggaaguuguaccacucugugaucuucacccugaaaaagucuuuucaguggcucaaaauaugagggagacaagucccuuaaaaauauccaauuaggccaggcaugguggcucaugucuguaaucccagaacuuagggagauggaggugggcagaucgcuugaguucaggaguuugagaucagcuugggcaacguggugaaaccucaucucucaaaaaaaaaaaaaaaaaaaaaaaaauuagccaugcaugguggugugugccugugguuccaacuacucaggaggcugaggugggaggaucgcuugagccuaggacguaggggcugacgugagcugugauuugcuucuucacugcagccugggcaauggugcaagacccugucucaaaaagagaaaagaagagaagaagggaagggggaauggggaagggaaggaaaauaggaaaauucauugaaagcuaugagcccucacacaagaaaaaaauucaaacacacacauauacacaauuuugcacaauauuuugaguggggugcuguggaucucuacuagauagaaucaugacuggauuccauaagucacauaaaacauucauuuucagaacuuucuggcuugagcuuguauaguaaaaggagauaggaaaagcaagagaaggauccagaaggauucauacagaaagauggagaagguagaaagaagagaggguaagacagggacaugaaggaggaguggccuaccacaaaauucuugacucugaugcacgggacaucuuccugcuuccuccccaucugcuguguccccucagugguguccagcgacagaacugagacaacacuggcggccaguguucucucucacaccaucuggaaugccuguggcagccgaggcugggcugagugacaaggauugugugucgcauagauucaaggaggcgaaaaaggaggucaaggcagaccaagaaucuguguggggcccugauguucaaagauggaagugagcagaagugcaaaaguccacuggguggucaggguucagaguaaugacugccaacaggaaaaauccccaccgccccugccugucaacagggggcugggaaaggucccaagccccgaaaagcuguuuucugaacagaagaaguaguaucugagaugggaagaaacuaagauagaccaucagcagauaugcgauucuuauauauauauacguguauauauauacacauauauauacauauauacacauacauauauauacauauauacacauauauacauauauacacacauauauauacauauauauacacauauauauacacauauauauacauauauauauauauauauguauauauacacauauauauacauauauauauauauauauauauauuuuuuuuuuuuuuuucuagaaacagggucucacucuguugcccaggcuggaaugcaguggcauaaucauggcucacugcagccucaaacuccugggcucaaacaacccucccaccucagcuuccuggccacuuacggauuucuugauucuucuuucauuuaacacauacuuuuugagcaccuacugugcaccgaaaacugaguuacuugaguaccugcccuucccaaacuuaaauuuuagaagagacaaaugauaaauaagaaaucccuaggcuggguacaguggcucaugucugucauuccaauauuuugggaggccaaggcaggaggauggcuugaguccaggaauuugagaccagucugggcaaaauagugagaccccaucucuacauggaaaauuuuaaaaauuagccaggcaugguggcacaugccuguaguccuagcuacuugggaggcugaggucgggggaucacuugaguccaggauuucaagauugcagugaauuaugguugugccacugcacuccagccugggcaacagagugagaccaugucuauaaaaauaaaguaauaaagaagaaaguuauggcauggcaugguagcucacgccuguaaucccagcacuuugggagucugaggugggcuuaucaaaaggucaagagaucaagaccauccuggccaacggggugaaaucccaucucuacuaaaaauacaaaaauuagcugggcaugguggcaugugccuguagucccagcuacucaggaggcugaggcaggagaaucgcuugaacccuggaggcagagguuguagugagcugaaaucacaccacugcacuccagccuggcaacaaagcaagacucugucucaaaaaaaaaaaaggaaguuguaacuagcaaggcaguugcauauaguaugagcugggaagagaacaaaacagaaugcugggauagagagagaccguuggugggcauggagcuaaauuagcaagggugaucaagggagccucucucaggucugauguuugaacugagaccugaagaccugaagcugaggagggaggcaggggccagagcacgcagggccuuuguggagcaaguaagacuucagaauuauuccaggugcaagaggaaguaucuggaaaguuuucaguacaggagggacuagaccugaucuacuuuuccaagguguucuugugguuauugguguuauauccaugucuucauuuuuuuuuucaacucuaaaagcuuugcucuuaaauaagaagaguagagcgauagcccagcuucaaggccccaccccagucccagagcuugcccaugguucuccuggggcaaacugaacacuggcgcugguggcagaagggaguagcagaggaaggagacuuugcaaugaggggagggguaaauggagcaucucucuaggcaccugcaacacugcaggcauguccccaguggccaccuuccucucacauccaaucacucaccugcucugaucagugcugucuccuaaaacucccucaaacccuacccucuucacaccuauugcuuuugucuugaagauagaaaacuaggggcacauacggagauccucacacuuauguuuuguuuagcauacacaaaaauuuguguuuuuuugaaaaguagcugugacuuuuaaagauuaagauguuuuaccuaaaacaucugacuuuuuacaaacaaaacacucuuggccagauauggcagcucacacucguaauccuggcacuuugagaggucaagacaggaggaccacuugaggccaggaguucgagauuagccuggcugacauagccagaccccaucucuaaagauaaaauaaauuacuccuugugguaacagugggccugcaacccugaaugacaacaaucaacuggagcuuggucccuuuaaguaggguuuguguucuccaguuuuccacagucuucaucacucccuauugccccacuaauugcucugguuggcugagugugugaccauuuacuaucacauuugcccuauuuuuuucuuuagaaugaugaugaugaugaugaugaugaugauggugaugauaaaacuauaacuaacacuuaaaaguauuuuuguaucagcuccuuuguauguacauuaauucauuuaauccucacaagaacuucuucaugccuauucugcugaugagaacauuggggcacagagagguuaaguuauuugcccuaagucacaaagcuagugagugaugaagacauaauuugaacccaggaaaucuggcccucaagucagacuugauugcucugcuuuacccaagucuucaggaaaaaauaaaaaauaaacgauggaccaagagagcaaauugauuuuuuuuuacaucaacuugugucacucauuuuugguaccuggccccugaaggccaccugaguuuuggacuucuggucuagaaucucuucacuucucaccuagaaaacaacaacagccuccuaacuaguuucccugcuucuuguccugccuuuacccacuuacuuuucuccauguugagucagaagggacuuucuaaaugaaaaaucugauauaguucucucuagcucaacaucuuucaaugacucugccuuuucucuaauacguuaccucugaucuugccccaggcugcccaggucagcucuugcuaguucacaccuuagguggggcacuccaaccucaucaaaacacuuucuucuuuuuaaacaaugcacacucuuguaugacucucucuacuugaaaugccuguucaugcuugacccuucagucugguggacuccugcugaaccuucaagacccaguucaaauguucccuccucugugaagccuucucugauucacccagguuuccucuucucuugucucuuaguaguugguauuugcuuuuauugaauuauuaauuuuaacuuaaaaugcaucucacuguauccaguaggcccuucucauggcucaguacagagaccuaaaaagcaguggcuuaaaaaaagauaaaagcuuauuuuuuguacagauuaaagaagaucaguccagggcugguaagguggcuuccauagaucaucaggaauccuacuucccccacuuucuucugugucauccuuaacaucacuucauaauccacuauggcugccagaacuccagccgucacacucacauucuaggauggaagaaaaaggaaguaagcaaaguacgaaagugcccacucccagcugaguuuaagcaauccucucaggagccccauaccacacuucuacuaaaaucucauugcccagaacuuagucacagggcuaugcccagcugcaaaggauguugaaaaaaugagcuagcaaaugcuuccccuuguaugcauagaaagaaucacaguucaauuacuaagaaagaaggggaaaaggaaugugagcuccccacaagugugcaacaguaacaucuuauuuaccuucauccuagcacacaguaggaacacaaaaaugacugaaaaaaaaugaauuuccucugggaggaaaaguuugcuacuuuagccucccaaaccuuuuccuccauuuauaccuuaaccuccauccaauuugucacagccuugacaaaaguagauuaauuucccagccucucuugccuucuaaaaccuccucaaauugauucugaauucaggaguccuauucuaagagacauacuauuugaccaaggucuaauuuccaagguuucugcauaaugaagucuuuguugaugcaaaucacuggagacagcagguugcagccucuauggggaaugauccccuccccaaaucaauggcagggagauucccaagaaacaaaagcccaggcuacuccuccugcuggucuugaagcucugagucuuggaacuauuagaggagaaacucacuuaaauaauaacucaaaaacaugaguccuaugccaucucauguuucccuucaaaccagccccguacaacaaaaagacuuccucuauucccccuccccaaaaagaagaaauggauuuaggcauucaagggugagauucuuagacaggcugggcauggaagauggagaaaggaagucaggauuuuuuucucuggggauauaauuugacauuuggugcucuagaaggacugcuugaugugccaggucgcuguggucauuugcugauauccauauccacccaaccuuaggcuuguuugcuuaugaguuggggguaggagugguagagcagucagauguugcugcuugguucuaaagagaagggaagaaacuuggagaaccaaucacagcucccuugcuaauaggcuucuggacacacuccagagauucuaggaucuguggcucuagggaagguuggcaugacaagacaaaaauaaaggucaaguucagguuaaauggaaucaugcccacaaauugagagcuggaguagaaaauggcuuaaugcugacauuuaucacagccuagauggcuccaaagucacuaaggaaggcauucuuucccuagcacccaguaauugcauuaauaugcaaagguggauguacacaacacacaaauggucuugggaagcacugggcuucacgcuucccuuccagguauggcuuuugacgccugagcuugagccaacugcagguacccacuaaggaaugaggugucugcacugguauugucaucguucaucgauauccaaaucuaacucauagucccaaauccuuccuucuauuuccucccuaguuguucacuuuuacguuuagcaacuauugacugagaccccaugugcuaagcaugcugccaggugcuaucaauaaaaagacaaauaaaauguggccccugacaucaaggaacucacagccugaggagaagaccugcaagugaacagaaacuggcuaucacaugaaaucaaugcugugaugggggucagaaggacagugugcugcaggaguccacaggugggcacccuaccaggugcaauggauggagaugggaagauagcauucuuccagaaccccagaggagggaggaaaaugugauagaucuaucaaaagugcaugaaaccaacaucggccacacugcucucuguucugagauggugcaagccaccaauauuucccacaaagacagaaaauaaaaaucaaaaauuauuuuauccaguggagacagccaucuagcauauuuguucauuuugagaugcaaucagguugcaccacuaagaauauguguuuaaggcucucccuuugguugcucacguuccaguaguuggcugucauaguuuucuucuuaguuccugggauuauuuaaaaaccaucucaaaagucuccucucuuuuauuucuugacauaucucugaucuccaauggcucucugucuguguauuuucuccucuucucacuccaagucccuucuucccaauucuuguucauaaaucuggggagaaauucugguguagucacagucaucaagggacaaccucacacugugauguuucagcaccguggacagcuacaaacauuaggaaaaagcggucccaaagcucgugguuuuguaucaaagcagauuccacguuagggagugggaagaauugagauauccagggauuugcaaauauauauccacauaagacaggaccauucacuuccacucucccacuuuucuugaggcacguaacuuacuccaucucuauuucauuuuccaacuuuuuggagugucagugugugcguuuccuacagcugcuguaaaauuucugacaacagaaacuuauugucucacaguucuggauacuaaacauccaaaccaacauguccauagggccaugcaucuuccgaaauccauaggagagaauaguucucuccuuuucuggugggugcuggcaauccuuggcauuccuugguucauaaaugcaucacuugaaucuagagcccgugucaucacauagccaccuuuucccuauauaucucucuuuccuacuuauaaggacacuagucauuggauagaggguucaucauaccccaauaugaugucaccuugacuuaacuacaaucacgugucacauaacaauguuucagucaacaauggaccacauauacgacaguggucccauaagauuagagugaagcugaaaaauuccuauugccuaauauaucuuagccaucaugauaucauagcacacuauguuacucacaggucuguaaugaugcuggugucaauaaaccuacugcauuuuauacugcauauaaaaguauaacacaauuauauacaguacacaguacuguacuugauaacgaucaaaugacuaugguacugguuuauauaaguacuacacuuuauuuucuauuguaauuuuagaguguauuccuucuauuuauaaaaagaaagugaauugugaaacagcccuagguagauccuucaggagauaugccagaagaaggcauuguuaucaugggagaugacagcuccauguguguuacuuguuacugccucugaagaccuuacaggggacaagauguagaggugaaagacagcaauauugauaauccugacccuguguaggccuaggcuaaugcguguguuuguggcuuaguuuccuuuucuuuuuucuuuuuuuuuuuccugagacaaaguuucgcucauguugcccaggcuggagugcaguggcgcagucucgguuuacugcaaccuccaccucccagguuuaggugauuuuccugccucagccucccaagcagcugggauuacaggcaccugccaccacaucuggcuauuuuuuuuuuuuuuuuuguauuuuuaguagagacaggauuucaccauguuagccaggcuugaucuugaacucccaucaucaggugauccacccaccucagccucccaaagugcugggauuacaggcaugagccaccgcaucugcccuuaguuuuuaacaaaaauguuuuaaaaguaaaaaauuuuaaaaaauagaaaaaugcuuauagaacaaggauauuaaaaaagaaaacauuuuuuacagauauacaauguguuuguuuuaugcuaaguguuauuacaaaagagucaagaaauuuaaaaaauguaaagcuuauaaaguaaaaaaguacaguaagcuaaguuuaauuuauuauugaagaaagaaaaauauuuuuaguaaauuuacugcagccuaaguguacaguguuuauaaaguccacaguaauguccuaggccuucgaauucacucaccacucacucacugacucaccuagagcaauuuucaguccuggaagcuccauuuaugauaaguacccuauauagguguacuauuuuuuaucucauacucuauuuuggcuguaccuuuucuguuaucccuagauacacaaauacuuaacauuguguuauaauugccuucaguauucaguacaguaacaugcuguacagguuuguggccugggaaaaauaagcuguauauaccagguguauaguaagcuaugcccagguguauaguaagcuaugccaucuagguuugugggagugcacucuauaauguucacacaaugacaaaaucgccuaaugaugcauuucucaagauggguccccauuguuaaaugacacaauggucauuacaucugcagugacccuauuuccaaauaaggucaucgacugagguccuggugauuaggacuucagcauaucuuagcagagagggucacacaauucaacccauaacagucagguaugaauaaauauuuccauacuauacaaaaaucaacaauauucuuuuuuucugagacaagagucucacucugucguccaggcuggagagcaguggugugaucucggcucacugcagccuugacuucccaggcucaggugauucucccaccucagccuccugaguagcugggaauacaaguuuaccccaccaugccuagcuaaucuuuuuauauuuuuguuuuaguagaaauggugguuucuccauguugcccaggcuggccucgaacuccugaacucaagcaauccucccaccccggccucccaaagugcugagauuauaggugugagccacugcacccagccaaaaucaauauuaaauaugaaaauaaaagcuaggccaaggcaaggagggguggugggagcuguggggagcuagagagcagucgccuaucuaaaggcacguccagcaugcagcaggaaugggggcaguguagucccaucucagacuccuuucuagggaagcuggaggucuggauuuucaugugaaaucuuccaguguuaaaagauuggcauccacauggaaucaaauaaaacacauuuguaagcugaauucagccuguggauugcugguuuaaaacuucaggccuauggagaucagagaagguuuccugagcaagaugauuuauucucagcuuuggaaacaguucucucuggcugcaguagaguuuaagguggggaagggaagggagaugaaaugggggauaaaaagagaagcuggauccuggcaggccucacaggcuguguugaaagaauuuauuuauguuuuauuuuuuauuuuauuauuauuguuauuauuuugauucagagucuaacuguaucacccaggcuggagugcaguggcaugaucucggcucgcugcaaccucugccucucagguucaagcaauuuucaugccucagcccccugagaagcugaaauuacagacauccaccaccacgcccagcugauuuuuguauuuuuuguagagguaggguuucaccauguuggccaggcugguuucaaacuccuggccucaagugauccaccugccuugaccucucaaaguacuggcauuacaggcauuagccaaacguaacacagaaccacugauggguuuuaagcaggggcguggcauggucagauuugcaacaugcccaacacuaucagccaccucuucuggaccccaguggaaucucucuccagaucuccaacccucaggagcagaggugaccccaguuuggggggcugcacccuguucugcacaauccugucucagggguggcuucuggucaagggugaccucucauauucucaucagaucugcagaagcuccuggagaugguucgggaagaugcccggaggacagucacaauagaaaaugggaugcaaagaaaagcacccagguaugugcucuugacuccuggggcaaauaaagcuuagaauaauagcaaucacauuaacaguaguaguugccaacuguugagcauuuucucugugacaggcacugagcuguguuguuuauguguaucaccucucugaguucuuacaauaauccuacaagguagguacuauuaucuuuauuuuacaaaucaagaaaugaggcucagagagccuaugugacuaguucaaggucacucagcuagugaaugauaaggccaugacucuaaucuagaccuuucuuaccaauuuauuuuugucucugagacagggucucgcucuguugcccaagcugaagugcaguggcacaaucauagcucacugcagccuccaacuccuggacucaagugauccucccaacucagccucccacguagcugggacuacaggcacacaccaccacaucuggcuaauuuuuuuuuuauuauuauuuuguagagacagggucucgcuauacugcccaggcuggccucaaacucauggcuuaagugauccucccaccucggccucccaaaaugcugggauuacagaugugaaucaccauaccuggcaaauccagacauuucuaauuccaaaaaccauucucuuugccauucugccacacugcuucucaggaaucuucugguuauucauuccuccuuugagugaauauuuaugaacauguaugggcuguguacucauuauuauugugagaaguguccauuaaaggaaagcuugaaacugugagaacaaauaauaauggcauuugaccuagucuggguuggggauggggaucagagaaguuuccuccaaggaagaagcuuuaagcugagauuuggauaaagcauguaaaugagccagccugaugaggcuggcaugggcggguagggagguggggaagagaguauuauaggcagcacaugugcaaacguggucaaaagggaccacaacaccuucagggaacugaaaugcagccaaaaagggaugaaacucaaggauucugguuuuuauucuaagagcagcgggaauccuuugaaguuucaagccagcaaccgauaugauuagcucauaaggagguacuaucagacuugaaccuaagacauccgcuuucuggugggaagccucguccacagacuucugaccucuaaaagccccagagagcacacagccuagagccagagcucccuucccagguguggauuccuuugaguaagcaaauuccuuccugaaaauaaaugaggcacuagaagagguucaucaucaccuucagcccacugggaugccaacuaugacuuauugguuauuguuauuaccacaauuacaguucacugcgcacuuucacaugcaucacaccucgccucugcuugugaaugaugaauucgcuggcugcugccucaacucucauuggggcugcucuggaagguggcacuuggaggcacucagagacaaugcugacccauaaggcccccacugcugugccugauuuauaagcauuagagacagacaauaauaaugaagcaucagcucaaugaggcuccuuccuuuguaagaacccacagcacaagcacuggcuuuggagucagacugauguggauccaaaaccuauugcccuuggacaagucaucuagccuuucucuaaaccucuguuuucucaucuguaaaaugagauugugucgcaucaaagcuuggcuuuggaaccagacaaacuaaggucaggcuccauggccaugacuaauugccggguuauguugggcaaguugcuucaccucucugagucugauucucauucuguaaaaugaggcucauuagcagccaaucccaaaggguuguagugagaauaagauaauauuaucccuguaaaauauuacuaauguuauggaaauaacaucuaguucaaugaaacauuuuaagcacuuaaucagauaaugcauuuauuuaacauauuagcaugugccuggcauagaguaaguauucaauaaauggcagugagguuggugguggggauggugguggggacgguuguuacuuuuaucucacacauguugccccauggaaucuucuccugcugagacagguacauucaccauuaccaucaccccaucccauauaugucaaagagcaacaagcagugacuuccauaaggucuucaaagacaaaaccacucuagacccuggcucucaugagaccaucacauggccucugcuuucaauuuaaugauaaaauaaccaugguuacagagcaagaauguguugaaguuucccuuccucauuaauuccucugggaaaaaaaucucccuaaucuuuugcuaaggcagcagacauuaaagcuucaacgcagagcuacagagagacgguuaggaaaagcuggaaaagcugcagauucucuuuugccccucacuuuagaagcuggauuccuuucucacuuuagaucccaaaucugcucccaucaaggcugacaucgaacugaggggccugcagaaaucccuacaagccagcacauccagcccccagccucaaggccgggcugcccccuagccaucugaaaauacagcuuuucuuaaaaucugguagcagugucccugaugaucagaagcaguuaggauacuugugaaaaauacaaauuucuacgccuccucaucccagaauccacugaaucagaauauccagagguagugauauauaugugugugugugugugugugugugugugugugugcgcguguguguguguguauauauauauauauauuuuuuuuuuuuuuugacagagucaugcucuguuacccaggcuggagugcaguggugcgaucucggaucacugcaaccucugccucccugguucaagcgauucuuccaccucagccucccgaguaggugggauuacagacaugcaccaccacacucggcuaauuuuuauauuuuuaguagagacaggguuuugcaauguuggccaggcuggucuggaacuccugaccucaagugauccgcuugccuugcccucccaaagugcugggaucacaggugugaaccaugacgccuggccaguagcuauauuuuuuaaacaagcacuucaggugggcauuaugucacaguauuuugcuguaugguggggaauuuuaggagagagagagagagaguguguguguguguguguguguauaccugugugugugaucuaaaugcagcuucuggggccccccuccaggccuaauguauucaagucccaggaaauguggccgaggaaucuguauucauagcaaacucuccaggugagugcugugcucaguagagucugaagauucuugcucuagaaagagaauucccccuccucccacauguaguuacugcacaaaaucuucaugaauucagcgccuuguuaaaggacucauuuugccuugcagcaucuugucagugcugaaacaaaacaagaguaauucugcuuauaaggaaaugcagaccacucucaaaucaagguaggaaagccuggagccugcagcaggugccuccgaaggcagcccacacuuacaggggccacugcagggaugcuccuccccagaccauggaaagugggacaggaaagagggaacuuuuuccuucuuaugaccucacuagaaacaagccccuuuacugcagggccgggcgugggaauucagguauuucuccccaacaauuauauaccaucaaguuaaaaucuucuagucauggagaagugagguggggaggacgcgguacaagacuaugucucuuucucucuacuuggguaauuuauaauggaggagguggagaucuuaccccaauuuauuuguucauuuagagaauauucuuuuuuuuuuuuuuuuugagauggacucucacucugucacccaggcuggagugcaguggugugaucucggcugacugcaaccuccaucucuuggguucaagugauucuccugccucagccucccaagcagcugggauuacaggcaugcaccaccaugcccugcuaauuuuuguauuuuuaguagagacaggguuucaccacauuggccaggcuggucucaaacuccugaccucaagugauccaccucccuuggccuucuaaauacuggaauuacaggcaugagcccagcccacuuagagaauauucuuagauuccccaucugugccaguaacugcgcuagguuuggggaauucauuagcaaaugaaacaaacacaaacaaacacagccugcccucauggaucucugugucugggcugggguuauaaacuuuuaugugccauagacuccuugguagucugagaaaaucuauggacuccuuuaagaaaaaugcuuuuaaaugcguacuauacaguauaaaagaucacuaagaaauucguaguaaucuagauugcuauauuacaaucaaauuuggaauaugguaaucuaugcgugucuuucacaaugcguuauauaacaagacuuaacuccuguaauuuuggauuaguguugaguauaaaugauuuuucaaauuaucucucacaauuguaaugugauaggcaaauaccugcaauuuccauuuugguugaaaguuaguucaacuaaagaugcaacuuuuuucccaucugcauucauggaccccuugaauucuacccaugcucaagaauugcugaucuaaugggagagucaagcauuucucagauaauccuacagcuagccauaacaucaugacugugaaguguucugaaaaagaaguagggguguugggugcuaaccaacacugagucugauguuuaagcugagaacuucaggacaaaggagaauugacuaggcuaugaguuggaaaaggugggaaugcuguuccaagcagggggaauagugugugcaaagguccugcggcaggaggaagcuuaggcucaggggcuccaagcaaagaccagugcagcugaaacucaaagagggccagguggggggcacagagugagacaggcagacggguuuuuuguugcuuauuucugucucuugcuuaucacucccuaauaacaccacuuucuuuaccucccaccuccucccugaaucacugucaaagcucuugaaaagaagagagccaucuacaggaggaaggucagggccaccaugcucccccaaaggauucaucugcagggauuagggcagcugguuggaauccaaaaucaaggcuaucuggauauuguuaaugggggccugcuucuuacccaaguaggaugaggauuugccuacuaggccuaagaccuccaggucuaguccugugagcuucuggggaaaccagcaaaggcaggaccuuuucuauggggaggggucuggaaaauggccaggccugccugccuaaagaagucccaaaugccacagggcuagaagcaaaggguuacccacacaucauauuaaaaaggaaaacggucuuaccacucccucccucagagccacagauaaaguggucagacaguuuuccaagcauuuggaagaaagaaggggaaacagagucagagagaaggugcuagacaauggugcugaaagcccaagucccuaaacaaggauccuggagaaaggcaugaaggggguggugggcagggguaggggcucuucaucccccucuaggaagcuugcccaggcagagucacaggaggggguauccauacgaggauucagucauccacaccuagaaaugguuggauggcaugaugaguugaugggucacagaugaggaaacugaccauccagaagggagcugcuugcucacagacugacaagggguaaaauggguguugggcuucacuaaacugcaccugguccaguguuaaguguugggcauggagaggaguguggaaagguccuaagucaauucacccuccagacaaagagaacaguuuuacacaaaugaaacugagauccagaaaagacguaaucccgacaauaugcagaggcggaaggucaaaguuagacacaggagaguucagauauacaggacuugcuguggaccguaaggcaggguaggauuuaaauagguagaaaagaaacaaagaggacccuccaggcagggauauggcaugaggaaaggccaagaggugggaagaaauucauagaguucugugacuggugccuugauuagaaccaccucccaugccugaauccuggaagcuagcaggugccauggagcacugggggcacccuuuucuugaaaagcagacucugagcaacuugaaaccauccuuuuguguuucagugagagauccagcaguacaagugcagaaagccacauccaaccaguccagaagaagucuaaaaaguaagccaggagggcaauggaaggaaccacgcaagagggaauauggugaccacacccucuaucuucccagggguguagaaaugacccaaugcagaccagacucccuaaagccguagaugaugcugaaggacaagggaucccccagguuuagggacucauagucaagaagcugagcagcaaugcagacaauggcaagaaacuccuccgcugugccaggcaccaugaaaagcauucugucuucauuaccuugcuuguuccucaaaaccaauccuaugaggcaggaggacuaacccaucuuacaaaggagcaggcugaaaccuggccacgugaaaugucuugccugaggccacacagcuaagaaguggugaagcuggacuuugagccugaaucucccagcuccaaauuccaucucccguccuuaacauuugcugggcuccagugaccaguugucucacugugggcucauuuaauagggucugaacgaccauccugaugcuauugggaagaucuguccuuucuacauccagggagaugcuuagggaggcuccaggugagggcagagaacccagguggcuacagggagucccccaugcagagcaccuuggggcuaaggggggccagagugggacccagguuacuaggggacaucccugggcuccauuccccaagcccuucuuaucuguguccacagccgcacuaauugugacaucaacauccacuacaagagugggguguguaacaccaugagggccaaguuuuacagcguagcccaggaggcuggcuucugccugcaggacaagauggaaauccucaugaaguaagcgcacauauauauccauucauucaaacagcauucacuggguaccuacuauaugccugccaggugccaggugcuggggcuauaucacaaacaagaagaacuuguucucuguccucagggagcucacagucuucuggaaaauaugggcagaaacaaaauaacugcauccauaaauauauagguacaaauucuaaucauuguccuacaguaagagaacagggugcuaugagacagagauagagagcauagguaccuaaucuagauggggaaaucugggaagaccucucugaggaggugacuuuuagaugaguccugaaggaugaggaagagccagcagugugaugagaagguggaaugacauuccagguagaaggaaaagugcaugcaaagucccaaguccagaagggacauggagaauuugaagaggauggacaagugguagaugagggcugcaucacgcaagccacaaaugccagaguuaugaugcgggauuugaucuuaagagcaccagaaagccacugaaaguuuuucuucccuguucugauaacccaauaacuucugcccuuucuagcuuacuccuugacuccagagaccauccaucccgaugaaugcaucuauacaacaaaguuugcaucauagcccguugcacucucauuuucacagcacuaaugggcugaaugcucuggggcuaggguuggagaagacuaauccuugcccuuuccuucugggagcuaacaguccaguagggaagauggaaagguaaacaggaaaguagcacacaggggucuggauguugugggaggaagcagccugaacacaaaagggaugccccaccuggcccaggacagcccucagaaagguuuccuuggaggaaacagcaguuucuuuucuuuucuuuucuuuuuuuuuuuuuuuuuuugagacaggguuuugcucuguuacccaggcuggaguucaguggcaugaucauaccuuacugcagccucgagugauaaguuuuuugguuuuugguuuuugggguauuuuuacagauagggucuugcuauauuuuccaggcuggugucaaacuccuggccucaagcaguccucucaccuuggccucccaaaaugcuggguuugcaagcaugagccaccacacacagcuggaaacaauauuuucaguuuaauaaacauagaugauauuuccagggcacuuacuauguaccagucauggauguaagagcuuuguauuuauguaucauuuaaugcucacaacaauccuaugagguaggugcuaucauuaacuuauuuuguagaugauaaaagugagcucagagaugccucuugucaaagguucuccaauggcuaaguaguaaagcuagaauucaaacccaaagagucaugcugaacaacuuggaaaauauauuucaggaugucauccaugaaaacuucuucaaccuugcuagagaagccaauagucaaauucaggaaauacagacaacuccugcaagauucuauacaagaagaucauccccaagacacauaaucaucagguuuuccaaggucauaaugaagaauguuaaaggcagcuagagagaaagggcaggucaccaaaaaagggauccccauguggcuaacagcagaccucucagcugaaacccuguaagccagaagagacuggggggcuauauucaacauucuuaaagaaaaaaaucuucaacaaagaauuucauauccagacaaacuaagcuuccuaugugaaaaagaaauaagauccuuuucagauaagcaaauguugagggacuuaaucaccaccaaacuugccuuccaagaaaucuugaaaggagcacuaaauauagaaaggaaagacugcuaucagcuaauacaaauacacacaaaaauaccuagggaagugaaagaucucuacaaugagaauuacaaaacacugcucaaagaaaucaaagacacaaacaaauggaaaaacaucccaugcucaugaguaggaagaaucaauaucacuaaaauggcuauacugcccaaagcaauuuauagauucaauuauauuccuaucaaacuaccaaaaagauauucuucacagaacuagaaaaaaauauuuuaaaaauuauauggaaccaaaaaagagccugaauaaccaaggcaaucuuaagcaaaaagaacaaaacuggaggaaucacaucaccugaccucaaacuauacuacaaggugacagugaccaaaacagcaugauacugguacaaaaacaggcacauagacugauagaacagaacagagagcccagaguaaggcugcacauguauggccaucugaucuuugacaaaggugacaaaacaagcaauggggaaaaaacucucuauucaauaaauggugcugggauaacuggcuagccauaugcagaagauugaagcuagaccccucccuuacaccauaaauaaaaaucaacucaagauggauuaaagacuuaaauguaaaacccaaaacuauaaaaucccuggaagacaaccuaggcaauaccauccuggaccuaggaaugggcaaagauuuuaugacaaagacaccaaaagcaauugcaacaaaagcaaaaauugacaaaugggaucuaauugaacuuaagagcuuccgcccagcaaaagaugcuaucaaccgaguaaacugacaccccacagaaugggagaaaauauuugcaaacuaugcaucugacaaaggucuaauauccagcaucuauaaggaacuuaaagaaauuuacaagagaaaaacaacccauugaaaagugggcaaaggacaugaacagacacuuucuuaaaagaaggcauacauuguggccaagaagcauauuuuaaaaagcucaacaucacugaucauuagagaaaugcaaaucaaaaccacaaugagauaccaucucacuccagucagaaugacuauuauuaaaaagucaaaaaauaacagaugcuggugaggucauggagaaaaaggaauccuuauacacuguuggugggaguguaaauuaguucaaccauuguggaaagcaauauggcuauuccuuaaagagcuaaaagcagaacuuccauuuaauccagcaaucccauuacuggguauauacuacccaaaggaauauaaaucauccuaccauaaagacacaugcaugugaauguccacugcagcacuauucacaauagaaaggacacagaaucaaucuaaaugcccaucaaugacagacuggauaaaaaauugugguacauucauaccauggaauauuaugcagccauaaaaaagaaugagaucauguauuuuuggggaacauagauggagcugaaggcuaugauccuagcaaacuaacacaggaacagaaaaccaaauaccacauguucucacuuguaaguggaagcuaaaugauaagaauuuaugaacacaaagaaggaaacaacagacacuggagucuaccuugaggggggauggugggaggagggggaggagcaaaaaaauaacuauuggguacagagcuuaauaccugggugauguaguaauauguacaacaaacccccgugacacauguuuaucuauguaacaaaucuucacauguagccccaaaucuaaaacaaauuuuuaaaaagucaugcuggaaaaguaggguggaagggaguuucaaggaaaagcaacagauaggucccagaagucagaggggcacagagagccagggaacugccaguagucagguguggcuggggcauacaguguuugcaaggugaucagagagcuagagaagccagauuauaaaaggcugugauagcccagcuguggagguugagcuuuaucucagagacuuuguuuuuucuuucuuucuuucuuucuuuuuuuuuuuuuuuuuuuuuuuuuauugagauggagucucgcucugucgcccaggcuagagugcaguggcgcaaucucggcucacugcaagcuccgccuccuggguucacgccauucucccgccucagucucccgaguagcugggacuacaggcgcccgccaccacgcccggcuaauuuuuuuuuguauuuuuuuaguagagacgggguuucaccauguuagccaggauggugucgaucuccugaccucaugauccacccucccaaagugcugggauuacaggcaugauccacugcgcccggcaucucagagacuuugaucaugacccaaaggauaaaauucuggaagagaagggauggaaaggaugaggauaaagcuggaaaaugugggggcugaauaauuuagagccuuagagaagaauuuauucugaguaaacugaaaagcuauugaaagcuguaggcaguggggugacauggugauauuuauaauauaaagucucauuggagagacagaacauaggcacaagaugauaaggggaguggggaagagaggaaccagcacaaguuaacaccuacugugugucuggcaugaaucucaacaguuuacacacauuauaucauuuaauccucaccucuggaaaauaggaaucauuauuauuccccaucuuagagacugaaaagcuauguaaauacaaucagaaguaggaagagaaugaaagcuaauaaaaagugacuagauuuaacugugcuuaaguagugcuucaggaccuuggagagagcuguauccucuuguggcaaaagccagagccuaaguuaaagauuagcugacaggguuaagaaaagccucaugaaggaaaagguguuuaagucagaucucaaagggcagcuaagaugguuacaggaggaggggaucucauucuucucucucuuucucauacaaccuuguaggcgccaagaagagagagguauccagaaguuccgugcuuuuguccuugucucaaauuuucaaaaggacauagcaaaaaugagacaucacauaucuguaguaaaaggagaugcagaagaaauugcagaccacugguaaauauccuaagaaccagauaagauggucccuggaagagaacaggguguuguuauuacaagaucacuauugauuccacuguccuucaaggcauagagaggcauuacuccaaaacugucauuggccaucaacaggaucccccaccccccagaaacacuaaauccagagcacaaucaggcccaaaacuccugguuucugaaaucacagauaauccaacccauugcguucuccauauuuaccugcuguuugauucagacuugcaaauaaggacaaccuugccaggcccugugggacaggcagaugaggcauaucaaccugaaaauuucuacagauucugaggucuaugggggugaucacugcauccccccaaguaacguaaucccuaaaaagugcaaaaccaggcagucauauccuagaaacacugugccacagcauaagggugaugauaaguaacaacaaaaaaagcaacaugaauugagugauuacuggauggcagucacuacauaagcaauuuucauaaauuguccauuuuaucccccccaacaaaauaauccugaaagauacauauuaacccccauuucacaaacaaggaaacagagacucagagggguaaauucacuugucaaaggucacaccaucaguuaacuggugaauuuaggauucgaacuccugucuaaccucagucugugugcucauuugcaauacagaauuggaaucuacugaacuguggugucccgaaccccauccuagcagggugaauacacuaagauuuaagaguaagaugagaaaguaaaaaauguacccagaaucccuuccaugaguuuuauaaugugaaacaggaacuuacaagcaggucccuggagucuuugcagaguuguuggaacuucuacacauccucacaucccagaacaucacuuucucacaagcaaugucuggcccugaagauacaugagucuuuuaagagggacccucuuacgaaagggagaaaagggucuucugcaaacccucuucccucugugggagggaauuuggggggaggaggaaagguuguuaugaacuaacucacauaaagguauuacagaaggaaauuaaugcugguccucccacagugagauucagcccacaaaucuaaugguggaauuucugucauuauuaugggggaaguaauugcccuccauaguaacauuaaaaucaagucaaacaaaccacagcgucguaaggaugauguugaguuguaguuguucauucauccaauuacucauucaguuuuucaaaugauaguuauugagcaccuacuaugaguuaggcaguauucuagcagucugaauacugaauaacucagacaaguuuccucuucuccucaacgggacuuuauucuaaacaaggagacaggaaucaauauaauaaauauauauccuagaauauaaagcaguaugagaagcccaaaacauauaauggaugaucaguuacaucuucaaaauuuuccacaaugggcacauauauagcaaggggugagggaguuuuuuuuuuuuuaagagaucuaccagccuuaaaccugaucacaucugaaccaucuccuuagguuagaccuaagguagauuagaucaaguagguucuucaaggauggauuccaaaacuacucucacauucacauaacacugaaauacacaaagcuuugacccaaccuugcucauuaaucaaagagauagaaaauacacacacacaccgucgugugugagagccuccagcauccuaguagacaucccaaagauguguguacaucaacuccgaccugauuaacccucagaagagaaguuucagaucccaaaguccauuccuuucuucuaacauuucacauugucugauagaaaaauuacaaauacaucccuugaaaucacaccuuuguuuuauuuuuuaaugaaaugcaagucauucuccaucuuuuucuaccccuaaaaguaaagacaggccugaucugugggucacagaggaaaggucccuagauaaagaauacugcugcccuggagacaucacagagagcagaaagagaaaguggagauggauggccagaggugcucagaucuuccagcagcuuccuaacuuguccucuccuuuuggaauugaagguacuuugaucuguuguccaaacugccagaggaucuaaagaacuuccgccccgccaaaaagauccuggugaaacugcagaaguuuggagaaaaccuggacuugcggauucgaccccauguccuccugaaggugcugcaggaucugaggauuugggaacugugcuccccugacaucgcuguggcuauugagguaaacaccaccuccuuccccuccacaguguuucagguguccucauucaaucaccucucaacauucaggcacuguuuaagugcuggggacacaaaguccccugccuuuauggagcucauauucuaauaguagagggauugucccauuaccugguugcccaacuccaacugcaagggacauuauauucuauauaaaugguacccccuggaaacucagaggcuuugggguggcauaaaaaaugggcaguaauaaggaguccuuuaucuugcuacuaaaaguguacuccauggaccagcagcauggaccucaccugggugcuuguuagaaacgcagaauugcagguuucaagucaaucugccaacuccaaguuuauauuuuaaugggauuccaggugucuuguaugcacaauacaguuugagaagccccguauguaaguuagaagggaucuaccuuaacucaggcaacugggaaggugacuuuuaaggcaagaccagaaucaugagaagacggcaccaugaagagaaagggaaagagcagaucaagaagagaagacagugugugcaaagaucccaaagcagcacacgacuugacuuguuggaagaacucacuggcacucagugaguauggaaggaagcaggcaaggagugcauaguucccaggggauuggagaggucagucugugcaaaccuuugaaggucaagauaaaaauuuaggagccacuaaacaguuuuccauugucauucaccaccaucaccagaagaaguuccugguguuugucaaaaugcaucagcaauacaaggacuccacaguaagguguuagcagagguuaaugaagucacuucuuuaauuuuaucagacggcauaugugcauuuuaacagggccuucaacgccucccuccugguaaagaagugacucaaaaggucaaauucccaggccuugacaggcuauggagcguuugacauuuucauaccaggagggcccuuccacagaaugaccuggguguguuaaugagggcaagguuaggaguggaaggagggggaugaccuuguagacaaauucaaaugccaagacucuacuccccaugacccgugaggcuccuucaggaaagauucuagcagguuuggccaaaacuaacucuagggcaacuuccaccuucuauuuaccaguuaugggguccaacuuccacuugaaguuauggaggacuuugaaaagcuagucccugcauggguaagaagagggaguacuaggggcuccucuuuuauaugaggugaguucacagcccugacuaauaaaauuuagcaagcucuuuuccuagugagaacaucacagaacuauuauuauuauuauuauuauuauuauuauuauuaucauuauacuuuaaguucugggauacaugugcguaacgugaagguuuguuacauagguauacaugugucauggugguuuucugcacccaucaacccaucaucuacauuagguauuucuccuaaugcuaucccuccccuagacccccauccccugacaggccccagcuugugauguuucccuuccuguguccauguguucucauuguucaacucccacuuaugagugagaacauguguuugguuuucuguuccuguguuaauuugcugagaaugaugauuuccagcuucaucuaugucccugcaaaggacaugaacucauccuuuuuuauggcugcauaguauucuaugguguauaugugcaacauuuucuuuauccagucuaucauugaugggcauuuggguugguuccaagucuuugcuauugugaauagugcugcaguaaacauauguguacaugugucuuuauaguagaaagauuuauaauccuuuggguauacauccaguaaugggauugcuggaucaaaugguauuucuggcucuagauccuugaggaaucaccacucugucuuccaaaaugguugaacuaauuuacacucccaucaauaguguaaaagcauuccuauuucuccacauccucuccagcauuuauuguuuccugacuuuuuaaugaucgucauucuaacuggcaugagaugguaucucauugugguuuugauuugcaauuaucuaaugaccagugaugaugagccuuuuuucauuuguuuguuggcugcauaaaugucuucuuuugagaagugucuauucauauccuucaccuacuuuuugauggcguuguuuauuuuuuucuucuaaauuuguuuaaguuccuuguagauucuagauauuagcccuuugucagauggguagauugcaaaaauuuucucccauucuguagguugccuguucacuaugaugauaguuucuuuugcugugcagaagcucuuuaguuuaaucagaucccauuugucuauuuugccuuuuguugccauugcuuuugguguuuuagucaugaagucuuugcccaugccuauguccugaaugguacugccuagguuuucuucuaggguuuuuaugguuuuaggucuaacguuuaagucuuuaauccaucuugaauuaauuuuuguauaaguuguaaggaagggauccaguuucagcuuucuacauaagacuagccaguuuucccaucaccauuuauuaaacagggaauccuuuccccauugcuuguuuuugucagguuugucaaagaucagaugguuguagaugugugguguuuuuucugaggccucuguucuguuccauuggucuauaagucuguuuugguaccaguaccaugcaguuuugguuacuguagccuuguaguauaguuugaagucagguagugugaugccuccagcuuuguucuuuuugcuuaggauugacuugacaauacgggcucuuuuuugguuccauaugaauuuuaaaguaguuuuuuccaauuuugugaagaaagucauugguagcuugauggggauagcauugaaucuauaaauuaccuuggggaguacggccauuuucacaauauugauucuuccuauccaugagcauggaauauuuuuccauuuguuuguguccucuuuuauuucguugagcagugguuuguaguucuccuugaagagguccuucacaucccuuguaaguugguuuccuagguauuuuauucucuuuguagcaauugugaaugggaguucacccaugauuuggcucucugucuguuauugguauauaggaaugcuugugauuuuuccacauugauuuuguaucuugagacuuugcugaaguugcuuaucagcuuaaggagauuuugggcugagacaaugggguuuucuaaauauacaaucaugucaucugcaaauagggacauuuugacuuccucuuuuccuaagugaauacccuuuauuucuuucucuugccugauugaccuggccagaacuuccaacacuauguugaauaggaguggugagagacggcaucccugucuugugccaguuuucaaaaggaaugcuucccguuuuugcccauucaguaugauauuggcuguggguuugucauaaauagcucucauuauuuugagauacauuccaucaauacauaguuuauugagaguuuuuagcaugaagggcuguugaauuuugucaaaggccuuuucugcaucuauugagauaaucaugugguuuuugucgaugguucuguuuaugugauggauuacguuuauugauuugcauauguugaaccagccuugcaucccagggaugaagcugacuugaucgugguggauaagcuuuuugauuugcugcuggacucgguuugccaguauuuuauugaggacuuucacaucgauguucaucagggauauuggucuaaaaauucucuuuuuuuguuuugucucugucaggcuuugguaucaggaugauguuggccucauaaaaugaguuggggaggauucccucuuuuucuauugacuggaauaguuucagaaggaaugguaccagcuccucuuuguaccucugguagaauuuggcugugaauccguaugguccuggacuuuuuuucuugguaggcuauuaauuacugccucaauuucagagccuguuaucagucuauucagauucaauuucuuccugguuuagucuugacaggguguauguguccaggaauuuauccauuuuuucuagaucuucuaguuuauuugcgcagagguguuuaugguauucucugaugguaguuuguauuucugugggaucaguggugauauucccuuuaucauuuuuuauugcgucuauuugauucuucucucuuuucuucuuuguuacucuugcuagcagucuaucaauuuuguugaucuuuucaaaaaaccagcuccuggauucauugauuauuugaaggguuuuuugugucucuaucuccuucaguucugcucuaaucuuaguuauuucuugucuucugcuaguuuugaauuuguuugcucuugcuugucuaguucuuuucauugugauguuaggguguugauuuuagaucuuucuugccuucucuugugggcauuuagugcuauaaauuuucccucuacacacugcuuuaagugugucccagagauucaggcaccuugugucuuuguuuucauugguuucaaagaacaucuuuauuucugccuucauuucguuauguacccaguagucauucaggagcaggauguucaguuuccauguaguugugcaguuuugagugaguuucuuaauccugaauucuaauuugauugcacuguggucugagagacaguuuguuauaauuucugcucuuuuacauuugcugaggagugcuuuccuuccaacuauguggucaguuuuggaauaagugcgauguggugcuaagaagaaugucuauucuguugauuugggguggagaguucuguagaugucuauuaggucugcuuggugcagagcugaguucaaguccuggauauccuuguuaaacuucugucuccuugaucugucuaauauugacagugggguguuaaagucucccauuauuauuguguaggagucuaagucucuuuguaggucucuaaggccuugcuuuuugaaucugggugcuccuguauuuggugcaucuauauuuaggauaguuagcucuuccuguugaauugaucccuuuaccauuauguaauggccuucuuugucucuuuugaucuuuguugauuugaagucuguuuuaucagagacuagaauugcaaccccuccauuuuuugcuuuccauuugcuugguacaucuuccuccaucccuuuauuuugagccuaugugugucucugcacgugagaugggucuacugaauacagcauagugauggaucuugacucuucauccaauuugccagucugugucuuuuaauugggguauuuagcccauuuacguuuaagguuaauauugcuaugugugaauuugaucccgucauuaugauguuagcugguuauuuugcccauuagcugaugcaguuucuuccuagcaucgauggucuuuacaauuuggcauguuuuugcaguggcugguaccgguuguuccuuuuuauguuuagugcuuccuucaggcacuguuguaaggcaggccugguggugacaaaaaucucucaccauuugcuugucuguaaaggauuuuauuucuccuucacuuaugaagcuuaguuuggcuggauaugaaauucuggguugaaaauccuuuucuuuaagaaugcugaauauuggcccuuacucucuucuggcuuguagaguuucugcugagagauccacuguuagucugaugggcuuccuuuguggguaaccugaacuuucugacugcccuuaacauuuuuuccuucauuucaaccuugguaaaucugacaauuaugugucuugggcuugcucuucucaaggaguaucuuugugguguucucuguauuuugugaauuugaauguuggccugccuugcucgguuggggaaguucuccuggauaauauccugcagaauauuuuccaacuugguuccauucuccccaucacuuucagguacaccaaucaaacauaguuuuggucuuuucacauagucccauaugucuuggaggcuuuguucauuucuuuuuacucuuuucucuaaacuucucuucucacuuuauuucauuaauuugaucuucaaccacugauacccuuucuuccacuagauugaaucggcuacugaagcuugugaauucuucacguaguucuugugccuugguuuucagcuccaucaggucauuuaaggucuucucuucacuguuuauucuaguucgccauucgucuaaucuuuuuucaagguuuuuagcuuccuugcaauggguucaaacauccuccuuuagcuuggagaaguuuguuauuaccgaccuucugaagccuacuucugucagcucgucaaagucauucuccaucccgcuuuguuccauugcuggcaaggaguugcgauccuuuggaggagaagaggugcuccaguuuuuagaauuuucagcuuuucugcucugguuucuccccaccuuugugguuuuaucuaccuuuggucuuuguugguggugaccuacagaugggguuuugguguggauguccuuuuuguugauguugaugcuauuccuuucuguuuguuaguuuuccgucucacagucaggucucucagcugcaggucuguuggaguuugcuggagguccacuccagacccuguuugccuggguaucaccagcggaggcuguagaacagcaaauauugcugcuagauccuuccucuggaagcuucgucccaaaggggcgcccgccuguaugaggugucaguuggccccuacugggaggugucucccagugaagcuacaugggggucagggacccacuugaggaggcagucugucuguucucagagcucaaacaucaugcugggagaaccaguacucucuucagagcugucagacagggacguuuaagucugcagaaguaucugcugccuuuuguucagcuaugcccugcccccagagguggaaucuacagaggcaacaggccuugcugagcugugguggacuccacccaguucgagcuuccacggccacuuuguuuaccuacucaagccucagcaauggcggaugccccucccccugccaggcugcugccucacagguugaucucagacugcugcacuagcagugagcaaugcuccaugggcaugggaccugccgagccaggcgcauauaauuuccuggugugccauuuccuaagaccauuggaaaagcacaguauuugggcagaaguguccugauuuuccagguacagucugucccggcuucccuuggcuaggaaagggaaaacccccaaccccuugcacuuccugggugaggcgauacccugcccuguuucggcuugcccuccaugggcugcacccacuuuccaaccagucccaaugagaugaaccagguaccucaguuggaaaugcagaaaucaccugucuucugcaucgaucaugcugggagcugcagacuggagcuguuccuauucggccaucuuggaacagacuccuaaacugguuauucuaguuagcaauuccucuaaccuuuuuuagagguucuuggcuuccuugcauuggguuagaacaugcuccuuuagcucagaggaguuuguuaucauccaucuucugaagccuacuucugucaauuugucaaacucauucucugcccaguuuuguucccuugcuggugaggaacugugauccuuuggaggagaagaagcguucugguuuugggaauuuucagccuuuuugugcugguuuuuccucaucuucauggauuuaucuacuuuuggucucugauguuggugaccaucacaugggguuuuuguguggaugugcuuuuuguugauguugaugcuauuccuuucuguuuguuaguuuuccuucuaacagucagcccccucugcuucaggucugcuggaguuugcuggagguccacuccagacccuguuuuccuggguaucaccaguggaggcugcagaacagcaaagauugcugccuguuccuuccucuggaagcuucaucucagaggggcaccagccugaugccagccagagcucucccauaugaggugucugucaaccccuccugggaggugucucccagucaggagacauggcggucagggacccacuugaggcagucuguccuuuagcagagcuugagcgcugugcugggagauccacugcucucuucagagccggcaggcaggaauguuuaagucugcugaagcugcacccacaaccgccccuucucccaggugcucugucccagggagaugggaguuuuaucuauaagucccugacuggggcugcugccuuucuuucagagaugcccugcccagaaaggaggaaucuagagaggcaguuuggcuacaguggcuuugcugugggcucugcccaguuugaacuuucugguggcuuuguuuacacugugaggggaaaacugccuacccaaaccuccauaauggcggacgucccuccccccaccaaacuccaacaacccacgucgacuucagacugcugugcuggcggcaggaauuucaagccaguggaucuuagcuugcugggcuccguggaagugggauccagugagcuagaccacuuggcucccuggcuucagcccccuuuccaggggaguggcaguugucucucacuggcauuccaggugccacagggguauaagaaaaaaacuccugcagcuagcuuggugucugcccaaauggccacccaguuuugugcuuaaaacccaggguccugguuguguaggcacccaagggaaucuccuggucugcggguuguggagaccaugggaaaagcguaguaucugggccagaaugcacuguuccucacagcacagucccucacagcuucccuuggcuaggggagagaauuaucugaccccuugugcuuccugggugaggcaacaccccacccugcuucagcuugcccucugugcugcacccacugucuaaccagucccaaugagaugagccagguaccucagcuggaaaugcagaaaucacccaccuucuguguugaucucacugggagcugcagacuggagcuguuccuauucagccgucuugcuagccacccaacaucacagaauuucuaauaaucuggaugugggggucuacaugaaacucuuccuuuugugugucuuaaacccuuuccaggaaauuaagcccauagcugucaucaauucugaaacggauuuacaaaccaaaaacguuuaacaacaaaugacuguuugaaaagauauuaaggaguagaaaagaaagaaaaaugcagauagcugggacuuccuguccuccccaaauuuccuugcaucgauagcaacaagaaggggcuuaacauuagccugcugagccaggaagcuggaaagggguccucuucaccaaaggaccaccccaaucugaugcuccaagauuaugaaugcccaaaugguauuccuggggccaccagucucagucacaaaucuuccaggaucuugaggggagggagagaagguggagucuacuuuucagagcaaauucugagauugccacuaugucugccucacaguuugugcgagaacacaucauccauaugccucaagaggauuacaucagcuggcugcagagccggaucaacauacccauugggcccuacagcgcccugagguaggcugggccuggguugaccagcugucucaguggaggaguguuugccuauaucauguuccuguauccugccuguguuccugccuccugacuacccucauggaugcucuuuauggaugacccuuuacaguagggucaucuggagacugacuuccagcaacauuuuuagagggggauggccccgguggcccuccccucaauuccacaccccagacccaaccuaccagucucuguucuucaaugauccagccugacucuaccuacuuccucuucagauuccuucacccuauuuaccuuccucaaguacuggagaauaaaauugaacugaauguuuga

SEQ ID NO: 191512 - RNA, 206336 nt, Homo sapiens
ucaaacauucaguucaauuuuauucuccaguacuugaggaagguaaauagggugaaggaaucugaagaggaaguagguagagucaggcuggaucauugaagaacagagacugguagguugggucugggguguggaauugaggggagggccaccggggccaucccccucuaaaaauguugcuggaagucagucuccagaugacccuacuguaaagggucauccauaaagagcauccaugaggguagucaggaggcaggaacacaggcaggauacaggaacaugauauaggcaaacacuccuccacugagacagcuggucaacccaggcccagccuaccucagggcgcuguagggcccaauggguauguugauccggcucugcagccagcugauguaauccucuugaggcauauggaugauguguucucgcacaaacugugaggcagacauaguggcaaucucagaauuugcucugaaaaguagacuccaccuucucucccuccccucaagauccuggaagauuugugacugagacugguggccccaggaauaccauuugggcauucauaaucuuggagcaucagauuggggugguccuuuggugaagaggaccccuuuccagcuuccuggcucagcaggcuaauguuaagccccuucuuguugcuaucgaugcaaggaaauuuggggaggacaggaagucccagcuaucugcauuuuucuuucuuuucuacuccuuaauaucuuuucaaacagucauuuguuguuaaacguuuuugguuuguaaauccguuucagaauugaugacagcuaugggcuuaauuuccuggaaaggguuuaagacacacaaaaggaagaguuucauguagacccccacauccagauuauuagaaauucugugauguuggguggcuagcaagacggcugaauaggaacagcuccagucugcagcucccagugagaucaacacagaaggugggugauuucugcauuuccagcugagguaccuggcucaucucauugggacugguuagacagugggugcagcacagagggcaagcugaagcagggugggguguugccucacccaggaagcacaaggggucagauaauucucuccccuagccaagggaagcugugagggacugugcugugaggaacagugcauucuggcccagauacuacgcuuuucccauggucuccacaacccgcagaccaggagauucccuugggugccuacacaaccaggacccuggguuuuaagcacaaaacuggguggccauuugggcagacaccaagcuagcugcaggaguuuuuuucuuauaccccuguggcaccuggaaugccagugagagacaacugccacuccccuggaaagggggcugaagccagggagccaaguggucuagcucacuggaucccacuuccacggagcccagcaagcuaagauccacuggcuugaaauuccugccgccagcacagcagucugaagucgacguggguuguuggaguuugguggggggagggacguccgccauuauggagguuuggguaggcaguuuuccccucacaguguaaacaaagccaccagaaaguucaaacugggcagagcccacagcaaagccacuguagccaaacugccucucuagauuccuccuuucugggcagggcaucucugaaagaaaggcagcagccccagucagggacuuauagauaaaacucccaucucccugggacagagcaccugggagaaggggcgguugugggugcagcuucagcagacuuaaacauuccugccugccggcucugaagagagcaguggaucucccagcacagcgcucaagcucugcuaaaggacagacugccucaagugggucccugaccgccaugucuccugacugggagacaccucccaggagggguugacagacaccucauaugggagagcucuggcuggcaucaggcuggugccccucugagaugaagcuuccagaggaaggaacaggcagcaaucuuugcuguucugcagccuccacuggugauacccaggaaaacagggucuggaguggaccuccagcaaacuccagcagaccugaagcagagggggcugacuguuagaaggaaaacuaacaaacagaaaggaauagcaucaacaucaacaaaaagcacauccacacaaaaaccccaugugauggucaccaacaucagagaccaaaaguagauaaauccaugaagaugaggaaaaaccagcacaaaaaggcugaaaauucccaaaaccagaacgcuucuucuccuccaaaggaucacaguuccucaccagcaagggaacaaaacugggcagagaaugaguuugacaaauugacagaaguaggcuucagaagauggaugauaacaaacuccucugagcuaaaggagcauguucuaacccaaugcaaggaagccaagaaccucuaaaaaagguuagaggaauugcuaacuagaauaaccaguuuaggagucuguuccaagauggccgaauaggaacagcuccagucugcagcucccagcaugaucgaugcagaagacaggugauuucugcauuuccaacugagguaccugguucaucucauugggacugguuggaaagugggugcagcccauggagggcaagccgaaacagggcaggguaucgccucacccaggaagugcaagggguuggggguuuucccuuuccuagccaagggaagccgggacagacuguaccuggaaaaucaggacacuucugcccaaauacugugcuuuuccaauggucuuaggaaauggcacaccaggaaauuauaugcgccuggcucggcaggucccaugcccauggagcauugcucacugcuagugcagcagucugagaucaaccugugaggcagcagccuggcagggggaggggcauccgccauugcugaggcuugaguagguaaacaaaguggccguggaagcucgaacuggguggaguccaccacagcucagcaaggccuguugccucuguagauuccaccucugggggcagggcauagcugaacaaaaggcagcagauacuucugcagacuuaaacgucccugucugacagcucugaagagaguacugguucucccagcaugauguuugagcucugagaacagacagacugccuccucaagugggucccugacccccauguagcuucacugggagacaccucccaguaggggccaacugacaccucauacaggcgggcgccccuuugggacgaagcuuccagaggaaggaucuagcagcaauauuugcuguucuacagccuccgcuggugauacccaggcaaacagggucuggaguggaccuccagcaaacuccaacagaccugcagcugagagaccugacugugagacggaaaacuaacaaacagaaaggaauagcaucaacaucaacaaaaaggacauccacaccaaaaccccaucuguaggucaccaccaacaaagaccaaagguagauaaaaccacaaagguggggagaaaccagagcagaaaagcugaaaauucuaaaaacuggagcaccucuucuccuccaaaggaucgcaacuccuugccagcaauggaacaaagcgggauggagaaugacuuugacgagcugacagaaguaggcuucagaaggucgguaauaacaaacuucuccaagcuaaaggaggauguuugaacccauugcaaggaagcuaaaaaccuugaaaaaagauuagacgaauggcgaacuagaauaaacagugaagagaagaccuuaaaugaccugauggagcugaaaaccaaggcacaagaacuacgugaagaauucacaagcuucaguagccgauucaaucuaguggaagaaaggguaucagugguugaagaucaaauuaaugaaauaaagugagaagagaaguuuagagaaaagaguaaaaagaaaugaacaaagccuccaagacauaugggacuaugugaaaagaccaaaacuauguuugauugguguaccugaaagugauggggagaauggaaccaaguuggaaaauauucugcaggauauuauccaggagaacuuccccaaccgagcaaggcaggccaacauucaaauucacaaaauacagagaacaccacaaagauacuccuugagaagagcaagcccaagacacauaauugucagauuuaccaagguugaaaugaaggaaaaaauguuaagggcagucagaaaguucagguuacccacaaaggaagcccaucagacuaacaguggaucucucagcagaaacucuacaagccagaagagaguaagggccaauauucagcauucuuaaagaaaaggauuuucaacccagaauuucauauccagccaaacuaagcuucauaagugaaggagaaauaaaauccuuuacagacaagcaaauggugagagauuuuugucaccaccaggccugccuuacaacagugccugaaggaagcacuaaacauaaaaaggaacaaccgguaccagccacugcaaaaacaugccaaauuguaaagaccaucgaugcuaggaagaaacugcaucagcuaaugggcaaaauaaccagcuaacaucauaaugacgggaucaaauucacacauagcaauauuaaccuuaaacguaaaugggcuaaauaccccaauuaaaagacacagacuggcaaauuggaugaagagucaagauccaucacuaugcuguauucaguagacccaucucacgugcagagacacacauaggcucaaaauaaagggauggaggaagauguaccaagcaaauggaaagcaaaaaauggagggguugcaauucuagucucugauaaaacagacuucaaaucaacaaagaucaaaagagacaaagaaggccauuacauaaugguaaagggaucaauucaacaggaagagcuaacuauccuaaauauagaugcaccaaauacaggagcacccagauucaaaaagcaaggccuuagagaccuacaaagagacuuagacuccuacacaauaauaaugggagacuuuaacaccccacugucaauauuagacagaucaaggagacagaaguuuaacaaggauauccaggacuugaacucagcucugcaccaagcagaccuaauagacaucuacagaacucuccaccccaaaucaacagaauagacauucuucuuagcaccacaucgcacuuauuccaaaacugaccacauaguuggaaggaaagcacuccucagcaaauguaaaagagcagaaauuauaacaaacugucucucagaccacagugcaaucaaauuagaauucaggauuaagaaacucacucaaaacugcacaacuacauggaaacugaacauccugcuccugaaugacuacuggguacauaacgaaaugaaggcagaaauaaagauguucuuugaaaccaaugaaaacaaagacacaaggugccugaaucucugggacacacuuaaagcaguguguagagggaaaauuuauagcacuaaaugcccacaagagaaggcaagaaagaucuaaaaucaacacccuaacaucacaaugaaaagaacuagacaagcaagagcaaacaaauucaaaacuagcagaagacaagaaauaacuaagauuagagcagaacugaaggagauagagacacaaaaaacccuucaaauaaucaaugaauccaggagcugguuuuuugaaaagaucaacaaaauugauagacugcuagcaagaguaacaaagaagaaaagagagaagaaucaaauagacgcaauaaaaaaugauaaagggaauaucaccacugaucccacagaaauacaaacuaccaucagagaauaccauaaacaccucugcgcaaauaaacuagaagaucuagaaaaaauggauaaauuccuggacacauacacccugucaagacuaaaccaggaagaaauugaaucugaauagacugauaacaggcucugaaauugaggcaguaauuaauagccuaccaagaaaaaaaguccaggaccauacggauucacagccaaauucuaccagagguacaaagaggagcugguaccauuccuucugaaacuauuccagucaauagaaaaagagggaauccuccccaacucauuuuaugaggccaacaucauccugauaccaaagccugacagagacaaaacaaaaaaagagaauuuuuagaccaauaucccugaugaacaucgaugugaaaguccucaauaaaauacuggcaaaccgaguccagcagcaaaucaaaaagcuuauccaccacgaucaagucagcuucaucccugggaugcaaggcugguucaacauaugcaaaucaauaaacguaauccaucacauaaacagaaccaucgacaaaaaccacaugauuaucucaauagaugcagaaaaggccuuugacaaaauucaacagcccuucaugcuaaaaacucucaauaaacuauguauugauggaauguaucucaaaauaaugagagcuauuuaugacaaacccacagccaauaucauacugaaugggcaaaaacgggaagcauuccuuuugaaaacuggcacaagacagggaugccgucucucaccacuccuauucaacauaguguuggaaguucuggccaggucaaucaggcaagagaaagaaauaaaggguauucacuuaggaaaagaggaagucaaaaugucccuauuugcagaugacaugauuguauauuuagaaaaccccauugucucagcccaaaaucuccuuaagcugauaagcaacuucagcaaagucucaagauacaaaaucaauguggaaaaaucacaagcauuccuauauaccaauaacagacagagagccaaaucaugggugaacucccauucacaauugcuacaaagagaauaaaauaccuaggaaaccaacuuacaagggaugugaaggaccucuucaaggagaacuacaaaccacugcucaacgaaauaaaagaggacacaaacaaauggaaaaauauuccaugcucauggauaggaagaaucaauauugugaaaauggccguacuccccaagguaauuuauagauucaaugcuauccccaucaagcuaccaaugacuuucuucacaaaauuggaaaaaacuacuuuaaaauucauauggaaccaaaaaagagcccguauugucaagucaauccuaagcaaaaagaacaaagcuggaggcaucacacuaccugacuucaaacuauacuacaaggcuacaguaaccaaaacugcaugguacugguaccaaaacagacuuauagaccaauggaacagaacagaggccucagaaaaaacaccacacaucuacaaccaucugaucuuugacaaaccugacaaaaacaagcaauggggaaaggauucccuguuuaauaaauggugaugggaaaacuggcuagucuuauguagaaagcugaaacuggaucccuuccuuacaacuuauacaaaaauuaauucaagauggauuaaagacuuaaacguuagaccuaaaaccauaaaaacccuagaagaaaaccuaggcaguaccauucaggacauaggcaugggcaaagacuucaugacuaaaacaccaaaagcaauggcaacaaaaggcaaaauagacaaaugggaucugauuaaacuaaagagcuucugcacagcaaaagaaacuaucaucauagugaacaggcaaccuacagaaugggagaaaauuuuugcaaucuacccaucugacaaagggcuaauaucuagaaucuacaaggaacuuaaacaaauuuagaagaaaaaaauaaacaacgccaucaaaaaguaggugaaggauaugaauagacacuucucaaaagaagacauuuaugcagccaacaaacaaaugaaaaaaggcucaucaucacuggucauuagauaauugcaaaucaaaaccacaaugagauaccaucucaugccaguuagaaugacgaucauuaaaaagucaggaaacaauaaaugcuggagaggauguggagaaauaggaaugcuuuuacacuauugaugggaguguaaauuaguucaaccauuuuggaagacagaguggugauuccucaaggaucuagagccagaaauaccauuugauccagcaaucccauuacuggauguauacccaaaggauuauaaaucuuucuacuauaaagacacauguacacauauguuuacugcagcacuauucacaauagcaaagacuuggaaccaacccaaaugcccaucaaugauagacuggauaaagaaaauguugcacauauacaccauagaauacuaugcagccauaaaaaaggaugaguucauguccuuugcagggacauagaugaagcuggaaaucaucauucucagcaaauuaacacaggaacagaaaaccaaacacauguucucacucauaagugggaguugaacaaugagaacacauggacacaggaagggaaacaucacaagcuggggccugucaggggaugggggucuaggggagggauagcauuaggagaaauaccuaauguagaugauggguugaugggugcagaaaaccaccaugacacauguauaccuauguaacaaaccuucacguuacgcacauguaucccagaacuuaaaguauaaugauaauaauaauaauaauaauaauaauaauaauaauaguucugugauguucucacuaggaaaagagcuugcuaaauuuuauuagucagggcugugaacucaccucauauaaaagaggagccccuaguacucccucuucuuacccaugcagggacuagcuuuucaaaguccuccauaacuucaaguggaaguuggaccccauaacugguaaauagaagguggaaguugcccuagaguuaguuuuggccaaaccugcuagaaucuuuccugaaggagccucacgggucauggggaguagagucuuggcauuugaauuugucuacaaggucaucccccuccuuccacuccuaaccuugcccucauuaacacacccaggucauucuguggaagggcccuccugguaugaaaaugucaaacgcuccauagccugucaaggccugggaauuugaccuuuugagucacuucuuuaccaggagggaggcguugaaggcccuguuaaaaugcacauaugccgucugauaaaauuaaagaagugacuucauuaaccucugcuaacaccuuacuguggaguccuuguauugcugaugcauuuugacaaacaccaggaacuucuucuggugaugguggugaaugacaauggaaaacuguuuaguggcuccuaaauuuuuaucuugaccuucaaagguuugcacagacugaccucuccaauccccugggaacuaugcacuccuugccugcuuccuuccauacucacugagugccagugaguucuuccaacaagucaagucgugugcugcuuugggaucuuugcacacacugucuucucuucuugaucugcucuuucccuuucucuucauggugccgucuucucaugauucuggucuugccuuaaaagucaccuucccaguugccugaguuaagguagaucccuucuaacuuacauacggggcuucucaaacuguauugugcauacaagacaccuggaaucccauuaaaauauaaacuuggaguuggcagauugacuugaaaccugcaauucugcguuucuaacaagcacccaggugagguccaugcugcugguccauggaguacacuuuuaguagcaagauaaaggacuccuuauuacugcccauuuuuuaugccaccccaaagccucugaguuuccaggggguaccauuuauauagaauauaaugucccuugcaguuggaguugggcaaccagguaaugggacaaucccucuacuauuagaauaugagcuccauaaaggcaggggacuuuguguccccagcacuuaaacagugccugaauguugagaggugauugaaugaggacaccugaaacacuguggaggggaaggaggugguguuuaccucaauagccacagcgaugucaggggagcacaguucccaaauccucagauccugcagcaccuucaggaggacauggggucgaauccgcaaguccagguuuucuccaaacuucugcaguuucaccaggaucuuuuuggcggggcggaaguucuuuagauccucuggcaguuuggacaacagaucaaaguaccuucaauuccaaaaggagaggacaaguuaggaagcugcuggaagaucugagcaccucuggccauccaucuccacuuucucuuucugcucucugugaugucuccagggcagcaguauucuuuaucuagggaccuuuccucugugacccacagaucaggccugucuuuacuuuuagggguagaaaaagauggagaaugacuugcauuucauuaaaaaauaaaacaaaggugugauuucaagggauguauuuguaauuuuucuaucagacaaugugaaauguuagaagaaaggaauggacuuugggaucugaaacuucucuucugaggguuaaucaggucggaguugauguacacacaucuuugggaugucuacuaggaugcuggaggcucucacacacgacgguguguguguguauuuucuaucucuuugauuaaugagcaagguugggucaaagcuuuguguauuucaguguuaugugaaugugagaguaguuuuggaauccauccuugaagaaccuacuugaucuaaucuaccuuaggucuaaccuaaggagaugguucagaugugaucagguuuaaggcugguagaucucuuaaaaaaaaaaaaacucccucaccccuugcuauauaugugcccauuguggaaaauuuugaagauguaacugaucauccauuauauguuuugggcuucucauacugcuuuauauucuaggauauauauuuauuauauugauuccugucuccuuguuuagaauaaagucccguugaggagaagaggaaacuugucugaguuauucaguauucagacugcuagaauacugccuaacucauaguaggugcucaauaacuaucauuugaaaaacugaaugaguaauuggaugaaugaacaacuacaacucaacaucauccuuacgacgcugugguuuguuugacuugauuuuaauguuacuauggagggcaauuacuucccccauaauaaugacagaaauuccaccauuagauuugugggcugaaucucacugugggaggaccagcauuaauuuccuucuguaauaccuuuaugugaguuaguucauaacaaccuuuccuccuccccccaaauucccucccacagagggaagaggguuugcagaagacccuuuucucccuuucguaagagggucccucuuaaaagacucauguaucuucagggccagacauugcuugugagaaagugauguucugggaugugaggauguguagaaguuccaacaacucugcaaagacuccagggaccugcuuguaaguuccuguuucacauuauaaaacucauggaagggauucuggguacauuuuuuacuuucucaucuuacucuuaaaucuuaguguauucacccugcuaggaugggguucgggacaccacaguucaguagauuccaauucuguauugcaaaugagcacacagacugagguuagacaggaguucgaauccuaaauucaccaguuaacugauggugugaccuuugacaagugaauuuaccccucugagucucuguuuccuuguuugugaaauggggguuaauauguaucuuucaggauuauuuuguugggggggauaaaauggacaauuuaugaaaauugcuuauguagugacugccauccaguaaucacucaauucauguugcuuuuuuuguuguuacuuaucaucacccuuaugcuguggcacaguguuucuaggauaugacugccugguuuugcacuuuuuagggauuacguuacuuggggggaugcagugaucacccccauagaccucagaaucuguagaaauuuucagguugauaugccucaucugccugucccacagggccuggcaagguuguccuuauuugcaagucugaaucaaacagcagguaaauauggagaacgcaauggguuggauuaucugugauuucagaaaccaggaguuuugggccugauugugcucuggauuuaguguuucuggggggugggggauccuguugauggccaaugacaguuuuggaguaaugccucucuaugccuugaaggacaguggaaucaauagugaucuuguaauaacaacacccuguucucuuccagggaccaucuuaucugguucuuaggauauuuaccaguggucugcaauuucuucugcaucuccuuuuacuacagauaugugaugucucauuuuugcuauguccuuuugaaaauuugagacaaggacaaaagcacggaacuucuggauaccucucucuucuuggcgccuacaagguuguaugagaaagagagagaagaaugagauccccuccuccuguaaccaucuuagcugcccuuugagaucugacuuaaacaccuuuuccuucaugaggcuuuucuuaacccugucagcuaaucuuuaacuuaggcucuggcuuuugccacaagaggauacagcucucuccaagguccugaagcacuacuuaagcacaguuaaaucuagucacuuuuuauuagcuuucauucucuuccuacuucugauuguauuuacauagcuuuucagucucuaagauggggaauaauaaugauuccuauuuuccagaggugaggauuaaaugauauaauguguguaaacuguugagauucaugccagacacacaguagguguuaacuugugcugguuccucucuuccccacuccccuuaucaucuugugccuauguucugucucuccaaugagacuuuauauuauaaauaucaccaugucaccccacugccuacagcuuucaauagcuuuucaguuuacucagaauaaauucuucucuaaggcucuaaauuauucagcccccacauuuuccagcuuuauccucauccuuuccaucccuucucuuccagaauuuuauccuuugggucaugaucaaagucucugagaugccgggcgcaguggaucaugccuguaaucccagcacuuugggaggguggaucaugaggucaggagaucgacaccauccuggcuaacauggugaaaccccgucucuacuaaaaaaauacaaaaaaaaauuagccgggcgugguggcgggcgccuguagucccagcuacucgggagacugaggcgggagaauggcgugaacccaggaggcggagcuugcagugagccgagauugcgccacugcacucuagccugggcgacagagcgagacuccaucucaauaaaaaaaaaaaaaaaaaaaaaaaaagaaagaaagaaagaaagaaaaaacaaagucucugagauaaagcucaaccuccacagcugggcuaucacagccuuuuauaaucuggcuucucuagcucucugaucaccuugcaaacacuguaugccccagccacaccugacuacuggcaguucccuggcucucugugccccucugacuucugggaccuaucuguugcuuuuccuugaaacucccuuccacccuacuuuuccagcaugacuuuuuaaaaauuuguuuuagauuuggggcuacaugugaagauuuguuacauagauaaacaugugucacggggguuuguuguacauauuacuacaucacccagguauuaagcucuguacccaauaguuauuuuuuugcuccucccccuccucccaccauccccccucaagguagacuccagugucuguuguuuccuucuuuguguucauaaauucuuaucauuuagcuuccacuuacaagugagaacaugugguauuugguuuucuguuccuguguuaguuugcuaggaucauagccuucagcuccaucuauguuccccaaaaauacaugaucucauucuuuuuuauggcugcauaauauuccaugguaugaauguaccacaauuuuuuauccagucugucauugaugggcauuuagauugauucuguguccuuucuauugugaauagugcugcaguggacauucacaugcaugugucuuuaugguaggaugauuuauauuccuuuggguaguauauacccaguaaugggauugcuggauuaaauggaaguucugcuuuuagcucuuuaaggaauagccauauugcuuuccacaaugguugaacuaauuuacacucccaccaacaguguauaaggauuccuuuuucuccaugaccucaccagcaucuguuauuuuuugacuuuuuaauaauagucauucugacuggagugagaugguaucucauugugguuuugauuugcauuucucuaaugaucagugauguugagcuuuuuaaaauaugcuucuuggccacaauguaugccuucuuuuaagaaagugucuguucauguccuuugcccacuuuucaauggguuguuuuucucuuguaaauuucuuuaaguuccuuauagaugcuggauauuagaccuuugucagaugcauaguuugcaaauauuuucucccauucuguggggugucaguuuacucgguugauagcaucuuuugcugggcggaagcucuuaaguucaauuagaucccauuugucaauuuuugcuuuuguugcaauugcuuuuggugucuuugucauaaaaucuuugcccauuccuagguccaggaugguauugccuagguugucuuccagggauuuuauaguuuuggguuuuacauuuaagucuuuaauccaucuugaguugauuuuuauuuaugguguaagggaggggucuagcuucaaucuucugcauauggcuagccaguuaucccagcaccauuuauugaauagagaguuuuuuccccauugcuuguuuugucaccuuugucaaagaucagauggccauacaugugcagccuuacucugggcucucuguucuguucuaucagucuaugugccuguuuuuguaccaguaucaugcuguuuuggucacugucaccuuguaguauaguuugaggucaggugaugugauuccuccaguuuuguucuuuuugcuuaagauugccuugguuauucaggcucuuuuuugguuccauauaauuuuuaaaauauuuuuuucuaguucugugaagaauaucuuuuugguaguuugauaggaauauaauugaaucuauaaauugcuuugggcaguauagccauuuuagugauauugauucuuccuacucaugagcaugggauguuuuuccauuuguuugugucuuugauuucuuugagcaguguuuuguaauucucauuguagagaucuuucacuucccuagguauuuuuguguguauuuguauuagcugauagcagucuuuccuuucuauauuuagugcuccuuucaagauuucuuggaaggcaaguuugguggugauuaagucccucaacauuugcuuaucugaaaaggaucuuauuucuuuuucacauaggaagcuuaguuugucuggauaugaaauucuuuguugaagauuuuuuucuuuaagaauguugaauauagccccccagucucuucuggcuuacaggguuucagcugagaggucugcuguuagccacauggggaucccuuuuuuggugaccugcccuuucucucuagcugccuuuaacauucuucauuaugaccuuggaaaaccugaugauuaugugucuuggggaugaucuucuuguauagaaucuugcaggaguugucuguauuuccugaauuugacuauuggcuucucuagcaagguugaagaaguuuucauggaugacauccugaaauauauuuuccaaguuguucagcaugacucuuuggguuugaauucuagcuuuacuacuuagccauuggagaaccuuugacaagaggcaucucugagcucacuuuuaucaucuacaaaauaaguuaaugauagcaccuaccucauaggauuguugugagcauuaaaugauacauaaauacaaagcucuuacauccaugacugguacauaguaagugcccuggaaauaucaucuauguuuauuaaacugaaaauauuguuuccagcugugugugguggcucaugcuugcaaacccagcauuuugggaggccaaggugagaggacugcuugaggccaggaguuugacaccagccuggaaaauauagcaagacccuaucuguaaaaauaccccaaaaaccaaaaaccaaaaaacuuaucacucgaggcugcaguaagguaugaucaugccacugaacuccagccuggguaacagagcaaaacccugucucaaaaaaaaaaaaaaaaaaagaaaagaaaagaaaagaaacugcuguuuccuccaaggaaaccuuucugagggcuguccugggccagguggggcaucccuuuuguguucaggcugcuuccucccacaacauccagaccccugugugcuacuuuccuguuuaccuuuccaucuucccuacuggacuguuagcucccagaaggaaagggcaaggauuagucuucuccaacccuagccccagagcauucagcccauuagugcugugaaaaugagagugcaacgggcuaugaugcaaacuuuguuguauagaugcauucaucgggauggauggucucuggagucaaggaguaagcuagaaagggcagaaguuauuggguuaucagaacagggaagaaaaacuuucaguggcuuucuggugcucuuaagaucaaaucccgcaucauaacucuggcauuuguggcuugcgugaugcagcccucaucuaccacuuguccauccucuucaaauucuccaugucccuucuggacuugggacuuugcaugcacuuuuccuucuaccuggaaugucauuccaccuucucaucacacugcuggcucuuccucauccuucaggacucaucuaaaagucaccuccucagagaggucuucccagauuuccccaucuagauuagguaccuaugcucucuaucucugucucauagcacccuguucucuuacuguaggacaaugauuagaauuuguaccuauauauuuauggaugcaguuauuuuguuucugcccauauuuuccagaagacugugagcucccugaggacagagaacaaguucuucuuguuugugauauagccccagcaccuggcaccuggcaggcauauaguagguacccagugaaugcuguuugaaugaauggauauauaugugcgcuuacuucaugaggauuuccaucuuguccugcaggcagaagccagccuccugggcuacgcuguaaaacuuggcccucaugguguuacacaccccacucuuguaguggauguugaugucacaauuagugcggcuguggacacagauaagaagggcuuggggaauggagcccagggauguccccuaguaaccugggucccacucuggccccccuuagccccaaggugcucugcaugggggacucccuguagccaccuggguucucugcccucaccuggagccucccuaagcaucucccuggauguagaaaggacagaucuucccaauagcaucaggauggucguucagacccuauuaaaugagcccacagugagacaacuggucacuggagcccagcaaauguuaaggacgggagauggaauuuggagcugggagauucaggcucaaaguccagcuucaccacuucuuagcuguguggccucaggcaagacauuucacguggccagguuucagccugcuccuuuguaagauggguuaguccuccugccucauaggauugguuuugaggaacaagcaagguaaugaagacagaaugcuuuucauggugccuggcacagcggaggaguuucuugccauugucugcauugcugcucagcuucuugacuaugagucccuaaaccugggggaucccuuguccuucagcaucaucuacggcuuuagggagucuggucugcauugggucauuucuacaccccugggaagauagaggguguggucaccauauucccucuugcgugguuccuuccauugcccuccuggcuuacuuuuuagacuucuucuggacugguuggauguggcuuucugcacuuguacugcuggaucucucacugaaacacaaaaggaugguuucaaguugcucagagucugcuuuucaagaaaagggugcccccagugcuccauggcaccugcuagcuuccaggauucaggcaugggaggugguucuaaucaaggcaccagucacagaacucuaugaauuucuucccaccucuuggccuuuccucaugccauaucccugccuggaggguccucuuuguuucuuuucuaccuauuuaaauccuacccugccuuacgguccacagcaaguccuguauaucugaacucuccugugucuaacuuugaccuuccgccucugcauauugucgggauuacgucuuuucuggaucucaguuucauuuguguaaaacuguucucuuugucuggagggugaauugacuuaggaccuuuccacacuccucuccaugcccaacacuuaacacuggaccaggugcaguuuagugaagcccaacacccauuuuaccccuugucagucugugagcaagcagcucccuucuggauggucaguuuccucaucugugacccaucaacucaucaugccauccaaccauuucuagguguggaugacugaauccucguauggauacccccuccugugacucugccugggcaagcuuccuagagggggaugaagagccccuaccccugcccaccacccccuucaugccuuucuccaggauccuuguuuagggacuugggcuuucagcaccauugucuagcaccuucucucugacucuguuuccccuucuuucuuccaaaugcuuggaaaacugucugaccacuuuaucuguggcucugagggagggagugguaagaccguuuuccuuuuuaauaugauguguggguaacccuuugcuucuagcccuguggcauuugggacuucuuuaggcaggcaggccuggccauuuuccagaccccuccccauagaaaagguccugccuuugcugguuuccccagaagcucacaggacuagaccuggaggucuuaggccuaguaggcaaauccucauccuacuuggguaagaagcaggcccccauuaacaauauccagauagccuugauuuuggauuccaaccagcugcccuaaucccugcagaugaauccuuugggggagcaugguggcccugaccuuccuccuguagauggcucucuucuuuucaagagcuuugacagugauucagggaggaggugggagguaaagaaagugguguuauuagggagugauaagcaagagacagaaauaagcaacaaaaaacccgucugccugucucacucugugccccccaccuggcccucuuugaguuucagcugcacuggucuuugcuuggagccccugagccuaagcuuccuccugccgcaggaccuuugcacacacuauucccccugcuuggaacagcauucccaccuuuuccaacucauagccuagucaauucuccuuuguccugaaguucucagcuuaaacaucagacucaguguugguuagcacccaacaccccuacuucuuuuucagaacacuucacagucaugauguuauggcuagcuguaggauuaucugagaaaugcuugacucucccauuagaucagcaauucuugagcauggguagaauucaagggguccaugaaugcagaugggaaaaaaguugcaucuuuaguugaacuaacuuucaaccaaaauggaaauugcagguauuugccuaucacauuacaauugugagagauaauuugaaaaaucauuuauacucaacacuaauccaaaauuacaggaguuaagucuuguuauauaacgcauugugaaagacacgcauagauuaccauauuccaaauuugauuguaauauagcaaucuagauuacuacgaauuucuuagugaucuuuuauacuguauaguacgcauuuaaaagcauuuuucuuaaaggaguccauagauuuucucagacuaccaaggagucuauggcacauaaaaguuuauaaccccagcccagacacagagauccaugagggcaggcuguguuuguuuguguuuguuucauuugcuaaugaauuccccaaaccuagcgcaguuacuggcacagauggggaaucuaagaauauucucuaagugggcugggcucaugccuguaauuccaguauuuagaaggccaagggagguggaucacuugaggucaggaguuugagaccagccuggccaauguggugaaacccugucucuacuaaaaauacaaaaauuagcagggcaugguggugcaugccuguaaucccagcugcuugggaggcugaggcaggagaaucacuugaacccaagagauggagguugcagucagccgagaucacaccacugcacuccagccugggugacagagugagaguccaucucaaaaaaaaaaaaaaaaagaauauucucuaaaugaacaaauaaauugggguaagaucuccaccuccuccauuauaaauuacccaaguagagagaaagagacauagucuuguaccgcguccuccccaccucacuucuccaugacuagaagauuuuaacuugaugguauauaauuguuggggagaaauaccugaauucccacgcccggcccugcaguaaaggggcuuguuucuagugaggucauaagaaggaaaaaguucccucuuuccugucccacuuuccauggucuggggaggagcaucccugcaguggccccuguaagugugggcugccuucggaggcaccugcugcaggcuccaggcuuuccuaccuugauuugagaguggucugcauuuccuuauaagcagaauuacucuuguuuuguuucagcacugacaagaugcugcaaggcaaaaugaguccuuuaacaaggcgcugaauucaugaagauuuugugcaguaacuacaugugggaggagggggaauucucuuucuagagcaagaaucuucagacucuacugagcacagcacucaccuggagaguuugcuaugaauacagauuccucggccacauuuccugggacuugaauacauuaggccuggaggggggccccagaagcugcauuuagaucacacacacagguauacacacacacacacacacacacucucucucucucucuccuaaaauuccccaccauacagcaaaauacugugacauaaugcccaccugaagugcuuguuuaaaaaauauagcuacuggccaggcgucaugguucacaccugugaucccagcacuuugggagggcaaggcaagcggaucacuugaggucaggaguuccagaccagccuggccaacauugcaaaacccugucucuacuaaaaauauaaaaauuagccgagugugguggugcaugucuguaaucccaccuacucgggaggcugagguggaagaaucgcuugaaccagggaggcagagguugcagugauccgagaucgcaccacugcacuccagccuggguaacagagcaugacucugucaaaaaaaaaaaaaaauauauauauauauauacacacacacacacgcgcacacacacacacacacacacacacacacacacauauauaucacuaccucuggauauucugauucaguggauucugggaugaggaggcguagaaauuuguauuuuucacaaguauccuaacugcuucugaucaucagggacacugcuaccagauuuuaagaaaagcuguauuuucagauggcuagggggcagcccggccuugaggcugggggcuggaugugcuggcuuguagggauuucugcaggccccucaguucgaugucagccuugaugggagcagauuugggaucuaaagugagaaaggaauccagcuucuaaagugaggggcaaaagagaaucugcagcuuuuccagcuuuuccuaaccgucucucuguagcucugcguugaagcuuuaaugucugcugccuuagcaaaagauuagggagauuuuuuucccagaggaauuaaugaggaagggaaacuucaacacauucuugcucuguaaccaugguuauuuuaucauuaaauugaaagcagaggccaugugauggucucaugagagccagggucuagagugguuuugucuuugaagaccuuauggaagucacugcuuguugcucuuugacauauaugggauggggugaugguaauggugaauguaccugucucagcaggagaagauuccauggggcaacaugugugagauaaaaguaacaaccguccccaccaccauccccaccaccaaccucacugccauuuauugaauacuuacucuaugccaggcacaugcuaauauguuaaauaaaugcauuaucugauuaagugcuuaaaauguuucauugaacuagauguuauuuccauaacauuaguaauauuuuacagggauaauauuaucuuauucucacuacaacccuuugggauuggcugcuaaugagccucauuuuacagaaugagaaucagacucagagaggugaagcaacuugcccaacauaacccggcaauuagucauggccauggagccugaccuuaguuugucugguuccaaagccaagcuuugaugcgacacaaucucauuuuacagaugagaaaacagagguuuagagaaaggcuagaugacuuguccaagggcaauagguuuuggauccacaucagucugacuccaaagccagugcuugugcuguggguucuuacaaaggaaggagccucauugagcugaugcuucauuauuauugucugucucuaaugcuuauaaaucaggcacagcagugggggccuuaugggucagcauugucucugagugccuccaagugccaccuuccagagcagccccaaugagaguugaggcagcagccagcgaauucaucauucacaagcagaggcgaggugugaugcaugugaaagugcgcagugaacuguaauugugguaauaacaauaaccaauaagucauaguuggcaucccagugggcugaaggugaugaugaaccucuucuagugccucauuuauuuucaggaaggaauuugcuuacucaaaggaauccacaccugggaagggagcucuggcucuaggcugugugcucucuggggcuuuuagaggucagaagucuguggacgaggcuucccaccagaaagcggaugucuuagguucaagucugauaguaccuccuuaugagcuaaucauaucgguugcuggcuugaaacuucaaaggauucccgcugcucuuagaauaaaaaccagaauccuugaguuucaucccuuuuuggcugcauuucaguucccugaagguguuguggucccuuuugaccacguuugcacaugugcugccuauaauacucucuuccccaccucccuacccgcccaugccagccucaucaggcuggcucauuuacaugcuuuauccaaaucucagcuuaaagcuucuuccuuggaggaaacuucucugauccccauccccaacccagacuaggucaaaugccauuauuauuuguucucacaguuucaagcuuuccuuuaauggacacuucucacaauaauaaugaguacacagcccauacauguucauaaauauucacucaaaggaggaaugaauaaccagaagauuccugagaagcaguguggcagaauggcaaagagaaugguuuuuggaauuagaaaugucuggauuugccagguauggugauucacaucuguaaucccagcauuuugggaggccgaggugggaggaucacuuaagccaugaguuugaggccagccugggcaguauagcgagacccugucucuacaaaauaauaauaaaaaaaaaauuagccagaugugguggugugugccuguagucccagcuacgugggaggcugaguugggaggaucacuugaguccaggaguuggaggcugcagugagcuaugauugugccacugcacuucagcuugggcaacagagcgagacccugucucagagacaaaaauaaauugguaagaaaggucuagauuagagucauggccuuaucauucacuagcugagugaccuugaacuagucacauaggcucucugagccucauuucuugauuuguaaaauaaagauaauaguaccuaccuuguaggauuauuguaagaacucagagaggugauacacauaaacaacacagcucagugccugucacagagaaaaugcucaacaguuggcaacuacuacuguuaaugugauugcuauuauucuaagcuuuauuugccccaggagucaagagcacauaccugggugcuuuucuuugcaucccauuuucuauugugacuguccuccgggcaucuucccgaaccaucuccaggagcuucugcagaucugaugagaauaugagaggucacccuugaccagaagccaccccugagacaggauugugcagaacagggugcagccccccaaacuggggucaccucugcuccugaggguuggagaucuggagagagauuccacugggguccagaagagguggcugauaguguugggcauguugcaaaucugaccaugccacgccccugcuuaaaacccaucagugguucuguguuacguuuggcuaaugccuguaaugccaguacuuugagaggucaaggcagguggaucacuugaggccaggaguuugaaaccagccuggccaacauggugaaacccuaccucuacaaaaaauacaaaaaucagcugggcguggugguggaugucuguaauuucagcuucucagggggcugaggcaugaaaauugcuugaaccugagaggcagagguugcagcgagccgagaucaugccacugcacuccagccugggugauacaguuagacucugaaucaaaauaauaacaauaauaauaaaauaaaaaauaaaacauaaauaaauucuuucaacacagccugugaggccugccaggauccagcuucucuuuuuaucccccauuucaucucccuucccuuccccaccuuaaacucuacugcagccagagagaacuguuuccaaagcugagaauaaaucaucuugcucaggaaaccuucucugaucuccauaggccugaaguuuuaaaccagcaauccacaggcugaauucagcuuacaaauguguuuuauuugauuccauguggaugccaaucuuuuaacacuggaagauuucacaugaaaauccagaccuccagcuucccuagaaaggagucugagaugggacuacacugcccccauuccugcugcaugcuggacgugccuuuagauaggcgacugcucucuagcuccccacagcucccaccaccccuccuugccuuggccuagcuuuuauuuucauauuuaauauugauuuuggcugggugcaguggcucacaccuauaaucucagcacuuugggaggccggggugggaggauugcuugaguucaggaguucgaggccagccugggcaacauggagaaaccaccauuucuacuaaaacaaaaauauaaaaagauuagcuaggcauggugggguaaacuuguauucccagcuacucaggaggcugaggugggagaaucaccugagccugggaagucaaggcugcagugagccgagaucacaccacugcucuccagccuggacgacagagugagacucuugucucagaaaaaaagaauauuguugauuuuuguauaguauggaaauauuuauucauaccugacuguuauggguugaauugugugacccucucugcuaagauaugcugaaguccuaaucaccaggaccucagucgaugaccuuauuuggaaauagggucacugcagauguaaugaccauugugucauuuaacaauggggacccaucuugagaaaugcaucauuaggcgauuuugucauugugugaacauuauagagugcacucccacaaaccuagauggcauagcuuacuauacaccugggcauagcuuacuauacaccugguauauacagcuuauuuuucccaggccacaaaccuguacagcauguuacuguacugaauacugaaggcaauuauaacacaauguuaaguauuuguguaucuagggauaacagaaaagguacagccaaaauagaguaugagauaaaaaauaguacaccuauauaggguacuuaucauaaauggagcuuccaggacugaaaauugcucuaggugagucagugagugaguggugagugaauucgaaggccuaggacauuacuguggacuuuauaaacacuguacacuuaggcugcaguaaauuuacuaaaaauauuuuucuuucuucaauaauaaauuaaacuuagcuuacuguacuuuuuuacuuuauaagcuuuacauuuuuuaaauuucuugacucuuuuguaauaacacuuagcauaaaacaaacacauuguauaucuguaaaaaauguuuucuuuuuuaauauccuuguucuauaagcauuuuucuauuuuuuaaaauuuuuuacuuuuaaaacauuuuuguuaaaaacuaagggcagaugcgguggcucaugccuguaaucccagcacuuugggaggcugagguggguggaucaccugaugaugggaguucaagaucaagccuggcuaacauggugaaauccugucucuacuaaaaauacaaaaaaaaaaaaaaaaauagccagaugugguggcaggugccuguaaucccagcugcuugggaggcugaggcaggaaaaucaccuaaaccugggagguggagguugcaguaaaccgagacugcgccacugcacuccagccugggcaacaugagcgaaacuuugucucaggaaaaaaaaaaagaaaaaagaaaaggaaacuaagccacaaacacacgcauuagccuaggccuacacagggucaggauuaucaauauugcugucuuucaccucuacaucuuguccccuguaaggucuucagaggcaguaacaaguaacacacauggagcugucaucucccaugauaacaaugccuucuucuggcauaucuccugaaggaucuaccuagggcuguuucacaauucacuuucuuuuuauaaauagaaggaauacacucuaaaauuacaauagaaaauaaaguguaguacuuauauaaaccaguaccauagucauuugaucguuaucaaguacaguacuguguacuguauauaauuguguuauacuuuuauaugcaguauaaaaugcaguagguuuauugacaccagcaucauuacagaccugugaguaacauagugugcuaugauaucaugauggcuaagauauauuaggcaauaggaauuuuucagcuucacucuaaucuuaugggaccacugucguauaugugguccauuguugacugaaacauuguuaugugacacgugauuguaguuaagucaaggugacaucauauugggguaugaugaacccucuauccaaugacuaguguccuuauaaguaggaaagagagauauauagggaaaagguggcuaugugaugacacgggcucuagauucaagugaugcauuuaugaaccaaggaaugccaaggauugccagcacccaccagaaaaggagagaacuauucucuccuauggauuucggaagaugcauggcccuauggacauguugguuuggauguuuaguauccagaacugugagacaauaaguuucuguugucagaaauuuuacagcagcuguaggaaacgcacacacugacacuccaaaaaguuggaaaaugaaauagagauggaguaaguuacgugccucaagaaaagugggagaguggaagugaaugguccugucuuauguggauauauauuugcaaaucccuggauaucucaauucuucccacucccuaacguggaaucugcuuugauacaaaaccacgagcuuugggaccgcuuuuuccuaauguuuguagcuguccacggugcugaaacaucacagugugagguugucccuugaugacugugacuacaccagaauuucuccccagauuuaugaacaagaauugggaagaagggacuuggagugagaagaggagaaaauacacagacagagagccauuggagaucagagauaugucaagaaauaaaagagaggagacuuuugagaugguuuuuaaauaaucccaggaacuaagaagaaaacuaugacagccaacuacuggaacgugagcaaccaaagggagagccuuaaacacauauucuuaguggugcaaccugauugcaucucaaaaugaacaaauaugcuagauggcugucuccacuggauaaaauaauuuuugauuuuuauuuucugucuuugugggaaauauugguggcuugcaccaucucagaacagagagcaguguggccgauguugguuucaugcacuuuugauagaucuaucacauuuuccucccuccucugggguucuggaagaaugcuaucuucccaucuccauccauugcaccugguagggugcccaccuguggacuccugcagcacacuguccuucugacccccaucacagcauugauuucaugugauagccaguuucuguucacuugcaggucuucuccucaggcugugaguuccuugaugucaggggccacauuuuauuugucuuuuuauugauagcaccuggcagcaugcuuagcacauggggucucagucaauaguugcuaaacguaaaagugaacaacuagggaggaaauagaaggaaggauuugggacuaugaguuagauuuggauaucgaugaacgaugacaauaccagugcagacaccucauuccuuaguggguaccugcaguuggcucaagcucaggcgucaaaagccauaccuggaagggaagcgugaagcccagugcuucccaagaccauuuguguguuguguacauccaccuuugcauauuaaugcaauuacugggugcuagggaaagaaugccuuccuuagugacuuuggagccaucuaggcugugauaaaugucagcauuaagccauuuucuacuccagcucucaauuugugggcaugauuccauuuaaccugaacuugaccuuuauuuuugucuugucaugccaaccuucccuagagccacagauccuagaaucucuggaguguguccagaagccuauuagcaagggagcugugauugguucuccaaguuucuucccuucucuuuagaaccaagcagcaacaucugacugcucuaccacuccuacccccaacucauaagcaaacaagccuaagguuggguggauauggauaucagcaaaugaccacagcgaccuggcacaucaagcaguccuucuagagcaccaaaugucaaauuauauccccagagaaaaaaauccugacuuccuuucuccaucuuccaugcccagccugucuaagaaucucacccuugaaugccuaaauccauuucuucuuuuuggggagggggaauagaggaagucuuuuuguuguacggggcugguuugaagggaaacaugagauggcauaggacucauguuuuugaguuauuauuuaagugaguuucuccucuaauaguuccaagacucagagcuucaagaccagcaggaggaguagccugggcuuuuguuucuugggaaucucccugccauugauuuggggaggggaucauuccccauagaggcugcaaccugcugucuccagugauuugcaucaacaaagacuucauuaugcagaaaccuuggaaauuagaccuuggucaaauaguaugucucuuagaauaggacuccugaauucagaaucaauuugaggagguuuuagaaggcaagagaggcugggaaauuaaucuacuuuugucaaggcugugacaaauuggauggagguuaagguauaaauggaggaaaagguuugggaggcuaaaguagcaaacuuuuccucccagaggaaauucauuuuuuuucagucauuuuuguguuccuacugugugcuaggaugaagguaaauaagauguuacuguugcacacuuguggggagcucacauuccuuuuccccuucuuucuuaguaauugaacugugauucuuucuaugcauacaaggggaagcauuugcuagcucauuuuuucaacauccuuugcagcugggcauagcccugugacuaaguucugggcaaugagauuuuaguagaagugugguauggggcuccugagaggauugcuuaaacucagcugggagugggcacuuucguacuuugcuuacuuccuuuuucuuccauccuagaaugugagugugacggcuggaguucuggcagccauaguggauuaugaagugauguuaaggaugacacagaagaaagugggggaaguaggauuccugaugaucuauggaagccaccuuaccagcccuggacugaucuucuuuaaucuguacaaaaaauaagcuuuuaucuuuuuuuaagccacugcuuuuuaggucucuguacugagccaugagaagggccuacuggauacagugagaugcauuuuaaguuaaaauuaauaauucaauaaaagcaaauaccaacuacuaagagacaagagaagaggaaaccugggugaaucagagaaggcuucacagaggagggaacauuugaacugggucuugaagguucagcaggaguccaccagacugaagggucaagcaugaacaggcauuucaaguagagagagucauacaagagugugcauuguuuaaaaagaagaaaguguuuugaugagguuggagugccccaccuaaggugugaacuagcaagagcugaccugggcagccuggggcaagaucagagguaacguauuagagaaaaggcagagucauugaaagauguugagcuagagagaacuauaucagauuuuucauuuagaaagucccuucugacucaacauggagaaaaguaaguggguaaaggcaggacaagaagcagggaaacuaguuaggaggcuguuguuguuuucuaggugagaagugaagagauucuagaccagaaguccaaaacucagguggccuucaggggccagguaccaaaaaugagugacacaaguugauguaaaaaaaaaucaauuugcucucuugguccaucguuuauuuuuuauuuuuuccugaagacuuggguaaagcagagcaaucaagucugacuugagggccagauuuccuggguucaaauuaugucuucaucacucacuagcuuugugacuuagggcaaauaacuuaaccucucugugccccaauguucucaucagcagaauaggcaugaagaaguucuugugaggauuaaaugaauuaauguacauacaaaggagcugauacaaaaauacuuuuaaguguuaguuauaguuuuaucaucaccaucaucaucaucaucaucaucaucaucauucuaaagaaaaaaauagggcaaaugugauaguaaauggucacacacucagccaaccagagcaauuaguggggcaauagggagugaugaagacuguggaaaacuggagaacacaaacccuacuuaaagggaccaagcuccaguugauuguugucauucaggguugcaggcccacuguuaccacaaggaguaauuuauuuuaucuuuagagauggggucuggcuaugucagccaggcuaaucucgaacuccuggccucaagugguccuccugucuugaccucucaaagugccaggauuacgagugugagcugccauaucuggccaagaguguuuuguuuguaaaaagucagauguuuuagguaaaacaucuuaaucuuuaaaagucacagcuacuuuucaaaaaaacacaaauuuuuguguaugcuaaacaaaacauaagugugaggaucuccguaugugccccuaguuuucuaucuucaagacaaaagcaauaggugugaagaggguaggguuugagggaguuuuaggagacagcacugaucagagcaggugagugauuggaugugagaggaagguggccacuggggacaugccugcaguguugcaggugccuagagagaugcuccauuuaccccuccccucauugcaaagucuccuuccucugcuacucccuucugccaccagcgccaguguucaguuugccccaggagaaccaugggcaagcucugggacugggguggggccuugaagcugggcuaucgcucuacucuucuuauuuaagagcaaagcuuuuagaguugaaaaaaaaaaugaagacauggauauaacaccaauaaccacaagaacaccuuggaaaaguagaucaggucuagucccuccuguacugaaaacuuuccagauacuuccucuugcaccuggaauaauucugaagucuuacuugcuccacaaaggcccugcgugcucuggccccugccucccuccucagcuucaggucuucaggucucaguucaaacaucagaccugagagaggcucccuugaucacccuugcuaauuuagcuccaugcccaccaacggucucucucuaucccagcauucuguuuuguucucuucccagcucauacuauaugcaacugccuugcuaguuacaacuuccuuuuuuuuuuuugagacagagucuugcuuuguugccaggcuggagugcaguggugugauuucagcucacuacaaccucugccuccaggguucaagcgauucuccugccucagccuccugaguagcugggacuacaggcacaugccaccaugcccagcuaauuuuuguauuuuuaguagagaugggauuucaccccguuggccaggauggucuugaucucuugaccuuuugauaagcccaccucagacucccaaagugcugggauuacaggcgugagcuaccaugccaugccauaacuuucuucuuuauuacuuuauuuuuauagacauggucucacucuguugcccaggcuggagugcaguggcacaaccauaauucacugcaaucuugaaauccuggacucaagugaucccccgaccucagccucccaaguagcuaggacuacaggcaugugccaccaugccuggcuaauuuuuaaaauuuuccauguagagauggggucucacuauuuugcccagacuggucucaaauuccuggacucaagccauccuccugccuuggccucccaaaauauuggaaugacagacaugagccacuguacccagccuagggauuucuuauuuaucauuugucucuucuaaaauuuaaguuugggaagggcagguacucaaguaacucaguuuucggugcacaguaggugcucaaaaaguauguguuaaaugaaagaagaaucaagaaauccguaaguggccaggaagcugaggugggaggguuguuugagcccaggaguuugaggcugcagugagccaugauuaugccacugcauuccagccugggcaacagagugagacccuguuucuagaaaaaaaaaaaaaaaauauauauauauauauauauauauguauauauauguguauauauacauauauauauauauauauguauauauauguguauauauauguguauauauauguauauauauguguguauauauguauauauguguauauauguauauauauguauguguauauauguauauauauguguauauauauacacguauauauauauaagaaucgcauaucugcugauggucuaucuuaguuucuucccaucucagauacuacuucuucuguucagaaaacagcuuuucggggcuugggaccuuucccagcccccuguugacaggcaggggcgguggggauuuuuccuguuggcagucauuacucugaacccugaccacccaguggacuuuugcacuucugcucacuuccaucuuugaacaucagggccccacacagauucuuggucugccuugaccuccuuuuucgccuccuugaaucuaugcgacacacaauccuugucacucagcccagccucggcugccacaggcauuccagauggugugagagagaacacuggccgccaguguugucucaguucugucgcuggacaccacugaggggacacagcagauggggaggaagcaggaagaugucccgugcaucagagucaagaauuuugugguaggccacuccuccuucaugucccugucuuacccucucuucuuucuaccuucuccaucuuucuguaugaauccuucuggauccuucucuugcuuuuccuaucuccuuuuacuauacaagcucaagccagaaaguucugaaaaugaauguuuuaugugacuuauggaauccagucaugauucuaucuaguagagauccacagcaccccacucaaaauauugugcaaaauuguguauauguguguguuugaauuuuuuucuugugugagggcucauagcuuucaaugaauuuuccuauuuuccuucccuuccccauucccccuucccuucuucucuucuuuucucuuuuugagacagggucuugcaccauugcccaggcugcagugaagaagcaaaucacagcucacgucagccccuacguccuaggcucaagcgauccucccaccucagccuccugaguaguuggaaccacaggcacacaccaccaugcauggcuaauuuuuuuuuuuuuuuuuuuuuuuuugagagaugagguuucaccacguugcccaagcugaucucaaacuccugaacucaagcgaucugcccaccuccaucucccuaaguucugggauuacagacaugagccaccaugccuggccuaauuggauauuuuuaagggacuugucucccucauauuuugagccacugaaaagacuuuuucagggugaagaucacagagugguacaacuuccaucuauaaaauguucagaaaagacaaaucaguagagacagaaagcaaguuugugguugccugggggcucuggguaagaagggcagaagguuuucuuucaggugguuggaaauguucugaaauuagauuguggugaugguuacacaacuccaaguuuacuaaaaaucacugaauugcacauuuaaaauaagcgaauuuuaugguauguaaauuauaucucaauaauaaagcuguuuaaaaaaguagacaccgaauuucaaagacaguauaaaagaggauauaaaauaucucauuaauaauuuuuacauugguuacacauugaaaugauaauguucuguauaaacugggcuaaauuuaaaaaaaugcuuuuuuuugagauggagucuuccucuguggcccaggcuggagugcaguggcaugaucucagcucacugcaaccucgccucccagguuaaagugauucuccugccucagccuuccaaguagcuuggacuacagaugugugccaucacgcccagcugauuuuugcauuugcaguagagacaggguuucaccauguuggccaggcuggucucaaacuccugaccucaaaugaucugccugccucagcuucccaaagugcugggauuacaggcaugagccacagugcccagccuaaauaaaaauauuuuuaaaauuagaaaagggcaguuggugaccacaggcugucucuguaggagaaauggcuuggggcaacccaaguuauggaguauauuucugaucuccacuggggaaaacaaagagguccaaggaaauugaacaaggaugcgggaucccaugucaccuuuaaaugaguggagguggacuugaggcaggaggguuucuugaugucuggcuuaaaggcaaagggucaggguagaugagucagaucucagguaggacuuacucauauacagagguucuucaucuggcuugguugaagaugacucauuguccucaauguccuugcugcuggucaccuggguguucacacuugggggcucauccgagccaggguucacagagaucaugcugcucuggggagaggaccccccacuggcccgacucagacugaguguggagccucgccggcuugguuugcgguuggugacucgcauugugggaauuuugaauuucuuggucuaaaggaaagagaagaaagagagguuucaggaaggagggggaaaaagauggaagaaagaaagaaaggagggaaggaggaagguggggagggacagcagacaaaagcaaagccugggucugacugugaauuccuucuggcucuuuccaaacaccaugagauauauucuggaucuggagugaccuuuugucacaaaucgagauaauguuaaaauguguauuauuuaaagcaaaugugguggaguauauucuauugaacgagcucaugguugcccaagaagucaccauaggaagccaaacguguuuuccaugaugaugucaaggcccagaacagguuuugacuuuucuuuuguaauaacuauuggaguugauuuucaaacuguguaugaggaugggucuaauuuuuuaaccacaucuugguuuuggcuccaaauuccauguguacacuuccuagucccccaguugacaccugggccucaaagaauaauuuguaaucauggagguuuucuaaagaacacagaauagggaaauuguaggccugacauuuaggaugugagugggaggaagcagauuugucuggugcaguggcauucuugggggaggagccacgguuguagugggcuaggagaauuggaugauaaguucuggaaggaauugagagguagguagggaaaguccuguggauuuuuagaaggaaaggaguaagaaagaguacacacagacugucugugugugugucuguguguaccuuccugugagauuggugucacuucagaaugcacuguuugggguuauguccucguauaacucaugauccaaguuucagcgaggcuuccuaaccuccucaaggucacagcaagaaaauagcagaaccagaauucagaccuaaguuagguuaaugccaaagcucauuacuaugccuggcuucaaaauacuucaaaaguuuuuuuucagugacaucgaaaaugcccuuuaucccaugcuaaugauucuuuaugacaucuaaaaugccagguuuacaagggggaagaauaggcccucagaugccccagagaaagagcucaacacagagugggcuauaguuuauauucacuuaauagaaauaauuuuaucugagcacauuuacaaugaaagcucuugauggauagacugguguuuucuuuagaugaaauucguaguguuugacacccugggaaaggugauagggagaagagacagcauugaagaccacaccaacauuuaauacacauugcgcaggguggagagaauuguauucagcagaauucauuucagggaguccacuguaugugaucagaagcaauauuuugaauggcuaccuuguagggcacugacuauggguggaaccuucuugcacuagaagaggggagggauuucuugguugcacaggagagggagaagguuggggaagaggagggagaggcugugggccuuaacauaugaucucucccugugccugccucaucucucucaaaucuucagugaaauucuguacaaacgacagaaugcuucagaauaugauagacuggagaaauggaauuugaacuggauuuaaccagaucuucaagaggccaugcaaguuacaaaaugacugaucaagaaaugccaagcacccaaagcaggcauguccucuccuuugauaaauuaggagcuugguacaaugauccuguuguccugacacugcaacuggucaagagcuugcaaaacugacagaaggccccucuacucuuugucauucuggggagagaugauaucagagcucagggaugaaacauguagaaguugccucuuuccauuuuaucuagaacaauaugaauuccugacucuaggaaccaggcucuucagaucaacguaauuuuuuuauuuuuauuuuuauuugacagggucugacucuguugcccaggcuggagugcaguggcacagucuuggcucacugcaaccucugccucccagguuugagcuauucuccugccucggccucccaaguagcugguauuacaggugcccaccaccaugccuggccaauuuguuguuguuguuauuuuugguagagaugggguuucaccauguugcccaggcuggucuugaacuccugagcucaagcaaucugcccgccuuggucucccaaagugcugggaucauagguguaaaccacugugccuaguaaaaucaauguaauuuuugaaggguggacagaugguggcaugaggcagcuuggaaucuugcagugagcacuggagucagagucaggguaccucaggggggccuugaauaugucacucugcccugccucaguuuccucauuuauaaaaccuaggggauagccugggacaauuucagaagagccuuccauauccaggggugucuuccuugagcuaggauuucaucuuaugcucccaaaguugccauuaauuaaaauuuaauuaaccauccuagccaggaaauccaaagugaagggcugacacuugugauuaauugaaacuggcagaaaaauaaaauguagggggaagaugugacaggcacuggcuugccuuuuauugaacugaaccucucugaauugacuuaaaucccuaaaugcugcuucucuauuuuuuauauuucacucagcaguuguguuaaccaguugcuauguuccaucucaguagggacugauuuuuggcaacggaggaaaagaauuugcugaaagguuccuuacacuuucugugaaguagggguugcagacugguggcccauggggagacauguuuagcuacccaggauuuuacaaauugggagacuuuuauauaaaaauguaaguuuuuuguuucuuuugaaaaugauaagcucugggcucccauucucacaaggcaaaaugagcuaaagcugcacagagguucuucccuuuagcugugcaggagugcuccaguuugccacagacuccaccacucccuacuguaucacacucagccugaucuuuucuuuuauuaauaacacaauuugccuggccccuaugaacacugccuagacauacagaagaguaucaggggaaaagaagaguauugugggagcugguuggauucccuccuucaaaguccucauuuuauagguagacaaacugaggcccagaacaggggaaaggauuugucugaggucacacagugaacugagucagcauggcugagccaggucuccugcagccuaauugagugcucccccaugcccagaguggaacgugcugcagcccaggauuugacccacaaacuugaauucaguuuugcaagaguucaagcacagcuauucauucucccccuccccuccuccaauuuuaguggugaauaucccugaaggacuuuuuuuaaagguuuguagcuccugcugcuuuuucugugcauuucugaagacggaugcacacuguaucuccauagcaacuuucugccauaaaaaccaaggcucgucuuaaaucuaggagcacccugaugaaagaguaagaaaauggugaaauucuucaugaggggcaacuauaaucauggggucaggaagaccaggcauuggauguuuauauguuuaauaaaccuauugauguuuauauguuuaauaaacuauguuuaauaaacagacccagaauuaacuucuggcucugccaguacccagcuggguaaccuuacguaaguuacuuaaccucucugagcccccaaauaccuccucucucaccuggggguaagaauagugccccauaggguuauuaagagggcauaacuggauaauauuccuacagaagcuuccuuagcacagaaccuagcccauuuacaauuauguugaacaguggccucuaaaauuuacauaaccacaguaaugcuaagcauucucacauuuucaaaguguguuugccuuauauuuauuuccugggauucuucacuaaaguugugagguaggcaggaaagggcauuauauccauuucauagguuaggggacagguucagcaaacgcucuaguugugugcucuauuaccuuuaccuaucucaauauuaccuuuugccauuauuauuauuaugauuauuaggcuuguuuauugaguagaugaguuugggagguccuggguuaggaauacuuuuggguaaaaagaaucuguaucuugguguccucuuaauaacugcaccuucuaguuuguagaaaaucuuuguugaaucacucacuuugucuuuucuuuuucuuagagacaggaucucacucucuugcccaggugggaggcuggagugcaguggugggaucauagcucacugcagccuccaauuccugggcuuaaaugauccucucacuucagccucccuaauaccugggacuacaggugcacaccacuaugcccagcuaauuuuuaaauuuuuugugaagacggggucuugcuauguugcccaggcucgucucaaacuccugggcucaagcgauccuccugccuuggccucccaauccuuugggauuacaagcaugagcuagugugccuggcuuuuauuuucugacuggguuaaagcgggguggggguggggggcggugagggaggaagcgagggagggagggagaaggagaaagaaaugacuguuauugauuuagaagauagagugaggugaguccauuuccuucuggugacaucuuguuaagcagcugcuuagcacccccuccuguccccauuauguaguguccagccaaaugucauuucuccuauaaucccuagauaacuguuuuaauuaaaauuuacaaaaaccauccaacagccuguggcucugacuucccuucacuccgagaaccaacuaggaaaaaaaaauucccaucagagaaaagacuggcaaaaauacuccucaacacaagcugggaccuaggagccaaaggguugagucgcguguuguugguuaccuuuggcgcugugaugaaaugcucccauuucugucccauggacuuguccuuauugauuuuuuuaauggugcucuugcuuccacccgggucccugagugagaaacagcuuaaugaguuuuccguuuccagagucuugguuuauuacaaguucuuuuaagaaaugcaauaaauagaggaggaaugguggcugggcucuguuaggauuuccucccccacuccucuacuugugaagaaaugggggggauaguucuccauagcuggcucuuuugagugaaaucgagguuuggagagacuuuugcuuacuggguggaggagggaggugguauauauuugcauguuuuuugcaucuauuuguauuuuagacucgguccucuccuagaauccugggcaggucugcgauuacuccugaggggugaauugaaaagcauguucauuucuaaaucuuugcuuuuucuguugcccaagggguccaccaucagggacauuucugagagacacacagagaauauuacugggugggauugaggguggggcugauggggguggauugcacaaugaaaaucacugauuggagguugacugggcauaaguucucuacgacacugugugcaacaccuuucugugccuucugucuguaucaucucaaucacuauaaccuugugauguagucauugucaucccauuuucagaugagaaaacaaacuaagggaguuuaagucacuuacuuacagugaaacgaaugaagcuaaagcuucagggcuccucacuagugugggucccucuuccaggauccuguaccuaauuuuguauuguaauuuuguauuuuuuuuucuuaaaaugcccucuccccaguuaaauaagcuucaggcuccacaaaaccuggauccuccugucauggguugggaauuuucuggauaggagacugaagcccaguagguucuguuggugacacacccauaauuccuuguaugaaaucugugggaccagauuuguugccaaauuaauaauuuuggcauuuuggaaaggaaacaugcugcauauacuguauguuaacauaaucccucugagggggcuaaagggacagcauccuguaaccaaauacaugaauauuucugcaaugaaacacauggauauuuacacuaggugggagaaauaaagaccagaaguagcuucaaguccaauuuugcugccaacuucgauugguuccugucagauuuugcugccaaaugaguuaugaaaaaacugaguuuucagagcuuguggauuuuggacuuguggcuauggggaagugggucucuacugauaagaaagcagggagucucaacgugugaucucucaacuaccuuuacauaucgauugaucgacugauuggucuaucaaucucucuguccauauauaucuuuucauccauucauccauccaccuaucuguuucuuuauucccuuuuucuuugcagaaagaauuuuauaucacaaggauccuuuuaauuauuugucuagcucucgccuagcagagagcaggaacuugaaauaagaagacgaaccgggcucaugccuguaaucccagcacuuugggaggccaaggcaggcagaucaacugagaugagaaguucgagaccagccuggccaacauggugaaacucugucucuacuaaaaauacaaaaaaaauuuagccaggugugguggcgcacaccuguaaucccagcugcucuggaggcugaggcagcagaaucgcuugaaccugggaggcggagguugcagugagccgagaucgcaccauugcacuccagccugggggacaagagugaaacuccgucucaaaaaaagaaaaaaaaaagaggaugaacagaacugcuuugguuuagggagacaaugacaggggucuaggcuuguuaggggcugcugagugcuggugguuguggguagaagggaggugcucagauauagaaggcaaaaggugaucaagauaaaccuaacuuaaggcugacuucucauggcauggagaucugaguagcagaaucaaaggcuuuucccaguccaaauaaggaguuggggguguccucucuucaccagugggacuuugcugaagaucuaccagcgaacagccaccacacaagaaaugcacacagacccaaaguggaagucgggcuggugagguggggugagaaugugccucuaagcuuuuuguaagacuuuauguuugauuacacaauaaaaagcccucugaauaauuaacagugaagcucauuuaaguugguucugccugccucucccccgaguaaucaaauuaggggauauuuaaaauccagccagaagaaggagcaauccuucaguccuauaaacaauauuuaaacuagcagugcuuuugaagucugauuuaagguucacccacuggaagcuuuaguguuuuuuuuuuuucacuuuggagcauuucuuucaagaccacagggcuuuucgcauuucccuuugcuaacgcagccccugcugagccuccagccuucuucucgaaguucaaaagcaacccccuuuccccuuuuaaaauuaaaucuggucccagcaaagcuuucaaaaucuuaacuauucagguccaaucgggaagauggaaguuuuccacuaaugcugacuuccaagaugaccugaaaucuauugcgacuucaagcagcaggcuaaaugaguucaaaaugcagcaagauucccacagaccuuaaaaagcucggagcccuugcucuugcaaacccauugauaaagaaaaggccugguuagcuggaaucggucuuucugauguuucauuuucaguagcaaauaacccaaaaaggaagaucaauaggggaaggaagaaaaaaauaaaaccaccuaagcugcaucauccauugcauaccuuguggaggagggcagagaggguuggugguccuucccccuggccuggugggguaagcauuagugccaucgaccaaauaguuccaggccuucucugcucucugaaggcaaguguagcacugugacuugcuuuguucaaaaauacaugagugaaagugacaugugggacuucggguagaugauuuaauagcuaguccugaagucaucggauuccuuuuucugccucguugaugguggaagcuucuaucagcaugagucccugaguaacuacagaguagagccucccuguuggauuugaaaggugagccaaggaacaagcuuuuuuugccuuaaacugcugagauuuggggguuguucauuauggcagccuaacuuacuuagcucacccauuuaauauccuugugauuuacugucugugugaccucgggcaagucuccgaguaucaaggccaggaaaguguuaucuuagugguuaagagugaauuuaacaauagguuggaccagcuguucgaguccucugucuuccccacugcuuccuacaugugugacuugguguaaguaauuuagucucucugaaccucacuguccucaucuguaaaaugggggaauaauagcagcuaugacaaaggauugccgugaagaugaaaagaaauggggcuuauuaagggcuucaugggugcuguguacagagagcugaauacaguucagcuauuaacaacaauaaccuucucuuuucaacagagauuuacuguggcuuagaggaggagcugaugguagacaacaggguacuagggcagauccuugggggagauguagcuauaacuuucagaccguaauuuuccccugcugaagcuuccuaggggauccuauuugccagaaaucaagggaauagggcgcugagcacugucaaaucucuuuuaacuauauccgccaagcacauuuuguuccaggcugucacuugaagaugucuauccacaguggcaauucagagcaauuuucucaaauacuucgugcucucuuucugaacucccaucugggguaaaacaucugcuucccaggguggaaagcuguaggcuagguuaggacgugcucauauguccaugacggaggggaagagcugcugauucugcagcagggcgggggcagaggucaaagcucuggggacuuccuggaccaggugguuccauccuaccuccugagugaugaucugauccuccugccacauucucccacuccacagagauguccacuggaguaccacaguggaggagccaugcaauuaaaucagugcaaagaggagagcaggggaaaucagagauuucacucauaugucacugucugagugagucuuuccuugaugacccaauuuaaaacuccccugcccaucacuagcacaucacccaucaauuucuucaugacacauugcuaucucaaaguaucuugauuauugcauguuuaucaucuguugcuucccucacccccuguagaauggaagcuccugagagcugggguguugucuguuuucuucacggcaguauucccacuagugccuggaaaagccaggcuugaggaaagugagauuuucuugguuguggggggaggaguaccacaagauaagggaaaacuaauuuaaauauaaacaauuuaaauuuuaaaaaugcuauuaugagugcugcucagaacgauugcgacaguauuucauggaagcaaaaacuuggaaaagacguaaaggucuuggaauauugguuaaauauguuucaguacauucguaugcugauaaacgccacagcagagguucagaucuggagagaugcuccuuauauacuaaggcaaacagcaaaaauuuaguuucaaaacaguaugugcaaaauggcacuugaaauuauuuuauaaaagaaaauugcaguuuauaugugauaacaucucgguaagucgagucccuuuuguauccuggggccucccagaaaguaccacauuguaauaagaucuucuuuucuucgaggcggggcaucagauuauucucuaaguugauuaaagacuuugggauuuaccuacagagaaacaaccauuugggggugaagcacccauacuuugcagcaagguuaccuggguucgaauccugccuuaccuuuugcuagcugugcaacuuugagcaaauuaauuuucuaugccucaguuuccuuauugguaaguuggaaugaggcuuaaaugagguaauacacccagagcagugcuugacauagaaagcacucaagugccagccauuuucaucauaaaacaguagauggauuuugauguuugugucauauuugagacggagauuugcuuuuguugcccaggcuggagugcaauggcaugaucucggcucaccgcaacuuccaccucccagguucaagcaauucucuugccucagccuucccaaguagcugggauuauaggcaugugccaccaagccuggcuaauuuuguauuuuuaguagagaugggguuucuccgugugggucaggcuggucucgaacuccuguccucaggugaucugcccaccucggccucccaaagugcugggauuacaggcaugagccaccacgccuggcugauguuugugucauauuugaaaccucaaagugugguugguugccuuuuacucauauguguauuucuaaaggaaggguggauuuuuugugccuggacagcccagcccuugaaugucuggugucucuuaagaguaaggauuacaagagucaggauuauaagaaucaggauuguaagcguagggauuacacccacuuggucuccccacuaaacagugggcccaguggugucucucuggacagccugaagcaauaagacguagacaacuguacugccccuguggcaccaggggaaagcacaggacucuggggacucgagccuguuggaacaacuccuuugaggugugugcuguaccugcuggaagguuaguagguaacucuucacucccuucuuuggccaggggucuggccuguuucuucuccacuguaacuagggaagauggccacagggguaggggaggcagcauuagagcuugucaaauuuccccacagcugaugucugugacucuguaaaagucuacucauuucuagguaggucuucgguugguucuuggaaauuuggucucuaauaagaauaaaaucaauacagguucacaaccacuuaaccaauuccaaaauccaaagagucuuuaaaccaaaacaauuuaaauggcuuauuugguagcaaagcaugacagaaacugaugggaggcuguuaguggccuuuuuuugaccuuuguuaugcacuuaagauaaauauucacuuauuuguuuucugcagaaauauuguguuugaugacaggccccucugggagugugauguucuauauggcacauguaucauauuuccuuuuuaaaaugcaaaaacaaaacaaaacaaaacaaaaaaaacccucagaauucugaaaugcaguuggcccuaaggguuugaauaaauacuuaugggcauucaugaaaaaaucagauccuacuuugccuaaaaagaggcuuauaucucuuggagaaacguaauuggcacauucauuauugaaggguugguuucaauuucuacuguggacccgaucaucuugucaauugaaauaaacucucuuguuagcaguggaauuaacaaggaugcugagaaaugauagugauaauguguuuaaauugccacaugaugaaauugggaaguugaggaguuuuuuuuuuucucaauaaagcagagacucagaugcaacucauaaugacacccuaaaaucugucaucuguccauucacccaaacauccaccaauccauccaaauaugagaucauccugcaacuaacaaagauuguucuucugcuugcagcacaguaacugccgguuagugaaauuuugcugccuguagaaagcccucauugagguaucgaaccacuccgacuuucuuccuauaaaauccauaagggggagggauugggucuacagcugucauuaugccuaacugaaauggagccucugggaucuacagguccccaaggauggauaucuccuuuuggaaaaugcacggugggugucagggcucaggguuuaagugucaaaaugcuuuaguaacaggagauacugguugcuugaugauggagacucagaaaagcacagucaggagaacuggagauuagguauuaccuucuugggcucauuaccuggguuguuuaucuuugcaacuagguuuugggcaaccuucuguagccuuuuuucccuguuugcauacuugucuguucacccagugaacauaggucucaccuguugguaaaauucugcucagaaguuccuuucuuuccuagccuucagucucaaugguacugauaaucguacaccuaacuucucuuuaaaauagggauuuuuacauuuuauagcuguuauuuaaugaacauucauuguguucccagauauuaggcuaaauccucuauggacuugauuuugcuuaauucuuacaauaacuucugaggcaggaacacauuuaaccaaugaagaaacagagggccagagaugucaagugacuugcccaaggucacacagcuauuaaguggcagagcuuugacucaucuggguucaucugaugcuaaacccuuugcucuuaaucacucuaaucccucuggguuuaaaaaaaugcacuugaagauuuggggaaauucacacugcugcauaagggugaaacgucauaaauagggauuaaguguugaagagaagagcucuuucugcuuucuuauaacugaaaagguguuuucuuauacuuuauagagaacuuaaacugccccccagauucauaauuuuuaaaaaugaaucccgaacaguggugugcuggagcuggcucauaguggcucauaagaacggauucuguaccucucuucccaacuccaaguucggugauaccauguugguaagauugaaaucagccacggugggaguauuuacaccguggaaauuggcauugucacaaaucauuguucuucaccuccuagagaacugguuguuaaaacauuuaccagcauugucauugacccuaaacuaaaaugcccaccaggaagaaauagucagcuagaaaaaacaaccccaacaaauaccgugacuuccuauguuaaucuuccuggacugcauuuuuuaccucagguggcuaggucugguucagguucugauuuuauagagcugggcauccucggagcgcugauagaauucugccacuacaagucaugguagaacaucugcuacucucaaugugaccacuacgucuuuuuacugcaguuaacaauuuuuggucacguucugagcacauuucuaaaaccaaccaaaggaaagaaacauggcccuuuuucucuucucaauccaaauuccacaugauguucuuuucucaguuuuggagaaugggugcccacauguaggaggaaaauguugcuguuggugguuuguuuagggagaugaaaugcugucaggagcccucuggcucagaggccuuuuucuuagaauguaagcaaucaaguaaggaaaaaaaaaaaaaagauauugcuuuuaccuagugauucuccuucccggaauccagcuaacagaaacacuuguaacugggcauaaaagauauguguaaggggccgggcacaguggcucaugccuguaaucccagcacuuugggaggcugaggugggcagaucacgaggucaggagaucgagaccauccuggcuaacauggugaaacccugucuccacuaaaaauacaaaaaauuagccgggcgugguggcgggcaccuguagucccagcugcucaggaggcugaggcaggagaauggcgugaacccaggaggcggagguugcagugagccgagaucgcgccauuguacuccagccugggcgacagagcgagacuccaucucaaaaacaaaaacaaaaacaaacaaacaaacaaaaagagauguguaaggauauuccacacaguacuacuugaaaugucaaaaauugggaaaugaccucagugucuguuaauaaagaaaugguguauauuccauccauaugauagaauauucugcugccauugaaagaauguguaaaccuguguauaccaucauggaaagaugccuauugguuauuguaaaggggaaaaucauguagagaacaauaugcagauaugauccuauuucuguuaaaaaaugugacuguuuauguuuauaaaaggaaggcauuagaaagauuuggaaggacauaucauagacuuuuaaaaggaguuuucuuuaagaaggggauuucagggagggaauaaaggcuuucauacuuuauauacuuauacauuuuuugaaagauuuccauaagcauaaauuguauucacuuauuacuugagcaguuuuauuuuagagaaaaauaaauagccuguaaucccagcuacuugggaugcugaggcaggaggauugcuugagggcaugagcuagacaccagccugggcaacauagcaagacaccaucucuaaaaaacuuaaaaaacaauuagccagguaugauggcaggugugguggcauucaccuguaguacuagcuaccugggaggcugaggcaggaggauuguuugagcccaggaguucgaggcuguggugagccaugauugugacacuguacucuagccugggcaacagagcaagacccucaucucuuuaaaaaaaaaaagaagaagaaggcaugaaaaauguuuuaaggcugugguuuucaaggaaauucuggaagccacaaagacauuuuggaaauaacuagggugccgugauggggauagaaguaaguuggaggggucccaggucucccaggcucccaaaccucuugcuucaugaagaacuuccauuuagaaaagucuguuuuacauuacagagguuucuauuuaaaaaaaaaugaggucugcugcuuaaaaaaauaaagucugucaaccacuuguaucaaaagagacuguaguuuuaaaauuaucccaaccaaaaacacugaauugauuggaguuacugaucuaucaauggaugcaugauauugcugguugcauuugagguuaguuucucuggguccugguguaagagaugacuuggggguggaggagaucuaggggauggguaauaaaugucuucaagaggaagaaguuaauuaagacuuaacguuuggccgggcgcgguggcucacgccuguaaucccaauacuuugggaggccgaggcaggcggaucaugaggucaagagauugagaccauccuggccaacauggugaaaccccgucucuacgaaaaauacaaaaauuagcugggcaugguggugcaugucuguagucccagcuacucgggaggcugaggcaggagaaucgcuugaacccgggagauggagguugcagugagccgagauugcgucaccguacucuggccuggugacagagcaagacucugucuaaaaaaaaaaaagacucagguuuugggaagaggaagacuggauccaccugggaggcaggacuaugggagggcauggguuagcacgggggguggggaacuauuuuauuuaacucagccucugauuuucacagugaaaaacugauucuucaagucaggguucuuuacuuuuguuuguccucuucuugcaaacaaccugacccuucuuaaagaaccaaugccuuuacaugccugucuguucuuuguucugcccuguguguacaaugcuguuccugcaacaguggcguccaagcuuuuaugugagcucucuccucuggugcggacaccuaacgcuucucuugaccuagacaacauguucuggagcuucugccuguacaaacccagcugcuccagggaacugaauaccaaauauucccuuggguccaaguggagaaguagccaccaauguauauuaagcaacaaaaagaccaaagcaaaacaaaacacaaccuugaaagaaaggauaaaaacaaaaacaaaaagaaaagaaagauuaaaagggagggaaaggaggaggaaaaggaagaagaauaaagaauaguguagggagacgcaguccaagaagagaguuggagagcagucaagcuguggauccagugaugugcuuccauagcuugccaauuucugugguguaaauacucccauguggcuggcugauuucaagcuacccaugugaugucacugaauguggaguugggaagagaugugggaaggagaugcacacaaccggcucccacgaaucugcauaagcugucucuaguucuccccuguucagaucccacagagcacauagaagaggaacugaaacagcccaccuaccaaaaacagcaaagggaguggaagaacauacaggaaucucuuccccacugcccagccuacugcuagucuaagacaaguugaagggcugaggcauacuuuggguuccagcaggugaucacaggcuucauggugugguggguguggucaauagucagggccuccagaagccaguggagagcacagagcuggcggaagaggggcucgcugcaaagacagagagagggaacacagugggauccuguuagaacaacuuucuucgcaaaaauagccacagaaauaguagugguacuugcucccagugagggagcaggcaccaugcuccaggcaugcgcaaguauuuugcauguaucaucucauuuggccuuugcaaugggcccaugagauauucuguagcccauuuuacagaugaggaaucagaggcucacaggacuuuaggaaguugugccaggucaccaggccaguaggugauagagcccauuugaaaugagauuauccaaugccaguuacugagaauuuguauauauagcagggagagaaacaagaaggggucccccagcuggaagucuugacucaggcaaaugagaggcuucaaggaaaucagcauccuauguauguccaauuguuaaucugauaaaaguacaauaaauaaacuaagaguguguaaaaagucuggaaacucagggaaacuaguguauuaauuguucuucuccccccagauuaaaaaugggaugcauugcuuuacauuuaugaguccuuugccugaaaauguagcuggguuuugaagaaaaacacaaagagcauauuacuugaaaauauucacuaaaacacuguuuaaaaauaugucucaggcugggaaugauggcgcauuuguguaaucccagcacuuugagaggcugaggcggguggguugcuugaucucaggaguuugagacuagccuacaaaaaauacaaaaaugagcugggugugguggcaugcaccugugaucccugcuacuugggaggcugggguaagaggaucgcuugagccagggaggucaaggcuguagugagccaaggucacaccacugcaugccagucugggugacagagugagacugucuuaaacaacaaaaccacauaugucucaccuacauuuucugauuuuuuggacacuuuguauuaaacaccuacaaggaggcagguauugaugggggcacuuuauacacauuauuuaauucuuccuacaaccugcuggaguaugaauuauuaugcacauuuuagagaaggggaaacugaggcucagagaggugccaucacuuugcuuaaggucacagagccuguuggugacugagaugguucucaguaucucauuuaaagcucacaacgaggccaggcacgguggcucacucuuguaaucccagcacuuugggaagcugaggcaggcggauuacuaggucaggaguucaagaccagccuggccaacauggugaaacccccaucucuauuaaaaauacaaaaauuagcugugcacgguggcaggccccuguaaucccagcuacucgggaggcuaaggcaggagaauugcuugagccugagaggcggagguggcagugagccgagaucaugccacugcacuccagccugggugacagagcaagacuucaucucggaaaaaaaaaaaaaaaagcucacaacaauccuuuagguaauauaccgcucccaccuccucuuuacaaugggggaugggaggcucagagaggggcaaugagugacuugaggucacacugcuaggauuagugagaauuugaaccagugucaauuuaacuccaugucugugcucucacgggccugggcucugaggaggugcugaugaagcugaugcaguggucaccccaagagcgaggucaggagaggguuaaccugcugccugccuuuuuccuggaaacaagguggaguccuggccagccaccccccuccccgcaagauuucuccucuuaacacuaaugggccagaugccuccauuaagaaccuguguaauugcucuucucugaaacugcauccugcccucaucaacacuccccaggguuccuaggccugguguuuucagggucaggaagguaucucuacucucuguuuccaggaaggcaccacuucagaaggugauacccaaucccugggcucaaguguggagcuggcccaggguuaucccggcuaauccuugagaggcaugcauuugcuuagcuugaaggggaacagcccugcccuaccccauccccucaccucuguguacuaggguggcuguauccaccaggucuuuggaaaacuaccaugagaaacucucuuuccuuucuucccuggagucuuuuccuucuacagauuaucuacuaagcgccuacuauuccuuuacuucuaauuuaaaggacuuguaagcccacagcuuuuucaauuuuuuuuauuaaauaaaacauuuguuuaagagacaggcucucauucugucaccaggcugcagccuccaacuccugggcuuaagugauccuccugccucaguuuccagaguagcugggacuacagacaugcaucaccaugcccagcuaauuuuuauuuuuuuuuguagagauggggacuuccuacguugccuaggcuagcgucaaacuccuggccuccagcgguccuccugccuuggccucccaaagcucugggauuauagguaugagcuauugcaccugaccccuuuucaguuauugucucuuucuucucccauaacaccuucuugggcccuacaggugacagcauuuugguaggucuggguacauaggccauguccagcauuuagcaauagcagcagcuagcugugccacaugccuggcacugggccaugagcaccucacuauacccuccccauaacccuaggagguugugagaggccgggggagaggccuauggguucuucuguuuugcagcuuggagccccugcaggccugggcuuugggauaugugggguggggagggaaaugaacaaaggaagugaauuggugagauggggucugcuuggucacaaggugguggaggggaagcggggcaugugagcaucagauucauuucugcagaugacaacaacggaugcaaaccugacccucucccucucuugcuuaaaaucuucaaacuuccuaaauaauuuguaauuggcugaauuguggacauaccagauucauuuguugaaauucgaaccucuguaccucagcgugugacuguguuaggagaugggaccuuuaaagaguggauucacuuauaaaugaagccauuaggguggucccuaaucuaaucugacugguguccuuauaagaggaggagauuuggacgccuaaagagacgccagggcugcgagcacugagaaaaagaccauaugaggacacagagaagacagggagagagcgauccuccaaccucgagaggguugggagaaaccaacgcugacagcaccuugaucuugggcuuucagccuccagaaccaugaggaaauacguuucuguucuuuaagccacccagucuaguaguuuacuauggcagccccagcaaacuaauccacugacacacaugaggccccguccgccucuccagccuggaguuguccugucuguuccuugugcuaccaccugcagccuggcaaaaauccacucagucacucaagcucaccaugcuugcucuuugcaccauccauguuaaacuucuagcuuugccaucuacuggcccuguggccuuggccaaauuacuuaacuucuuugagccucaguuuucuuaucuguaaaauggugguaauugcaguaccucucuuaaaaggcgagagugagggugaggugaugugcuuagcacuguucccugcuccugauacauauuccugcuccucuuccuucuugacucucagugauugggcuucagcucucaucuccauccggaagccuuccuugauugcucugggucugggcugggcucacucuaaggagguucuaaagcauccccaucccuacaauauguccucccuguccucaccuuuggguuccugcucugcuguaacuaccugauuacuugacuuuccagaccgugagccuacaaccuacagaguccuguccaccacagggugcucugugcucugcacagagucagcucaauagauuuuucaguuacugauggaaaauggugggaaugaauugguucagaucugauauuuuucugaacugauaacuugagcacaauucuuuuuuuuuauuuuuuuugagacagggucucacucuguugcccaggauggagugcgguggcgugauuuuggcacacugcagccucugccuccugggcacaagcgauccuccuacuucagucuucugaguggcugggacuacaggcaugugacaccugcccagacaguuuuuguauuuuguagagaugggguuuugccauguugcccaggcuggucucaaacuccugggcucaagcgauccgccugccucaguuucccaaagugcugggauuacagacgugagccacugcaccuguacuugagcacaauucuuauacacagaaccauugagauaauaaagaguaguaacaaaaacaacaacaacagaacaacgaaguaauacuaaugguaaauauuucccauaagaguccuuacucuaugccagaccacuguucuaagugcccaauauccauuaacuaaguucauucuuauaaaauccugugaagaagguacuauuauuauccccguuuugcagaugaggaaacugaggcauaaagggccucagugacuuauccaaggucacaaaagacagcaaauggcagaguuggaaugugagcccaggcagucuggcuucugaauucgugcucuuaaugaaaauguggauguugucucuuguuacaggguagagacucccuuuucaucagaauaggguuucaucugauagaucugguccuuuuucucuguuuauaaaaagugcccuaaaccugaugauugcucuucuaaucugcagugaaacaaauuaaaaaaaaaaaaaaguccccagaagcaugcuugauagaaaucggucuuuucucauaaugaucaugugucaggucauagcauaguaucuuggauuuuaucaaauuagaagagagaacauuuauuuuuuuaaaugcagggaauaagaggugaaaaugcugaacaggguuacacaaagccugcuucugaagucccugagcucagaacuccgggcgagugccagcagucagcacaccugaauagcucacucuauuaaaacuacuguaccaaccagaauccuagugggcauaaacaucucugagaagaaagcauuuuuuuuucuuuuacaagagaaauuggaaaaugcauucaaagccauuccaagcaccccgugcugauugccaagggcaaaucucgacacagguugcaggcauugcccuugcugcccaaucacucauuaaaggcuguggggcacagcccagucaucuaggagggaaaaacgaggggcugcuucucauuccuagagaccacucccuucccuuuuuaaagauaaaggucagucucuuguuacaugauugaauugaucccuacacagucgauuuggaauuaucagccacuuuugggaucgaucacacagggacugaagggacugaccaggcucugauccgcauuggcugaugugacaacugaaaauucaggaauuaucaggcagggccagcccuggugccuuuugguagacugaugacaacaaugccaucccucucugcuuugcacacuuugggaugugacuuugcugcuuccccccaacaagaagggaagucuuuccccauacuucuuguaucuaggcuggccuggugacuugcuuuggccaguggaauguggugagaggguaacuguguucauucugagccuaguucacagauggaaaaugcaauaaucaucaccagcaccaucaucaucacugucauugcccucaaggggcuuuggguacuuaggaucuuguucuuggaacccuuucugcuugccaugugaacaagucugaguuugcuugcuggguauugagagacauucagcaucucacccaugucacccuggccaccaaccaacuaaccaagacuuaugaaugagaccauucgagaucagccaaccuccagcucacccaucagcuggguguacacacauaagcacauccagccaagaucagccgagccaaccugaccagcagaaccacccugcugacauguagacuuaggagcaauacuaaaucguuguuuuaagccacuccaugucgaggugaucuguaauacagccauagcuuacuaauaaagucaucaaaugcagccagagccuuugaacagcugaggauaagaaaaggcagccuucagugcuggacagggacuacagcaaacuacagccugugggccugccacuuugguuuuguaaauaaaacuuuauuggaacauagccacauccauuguuguaguuuucaugcugcaacagcaaaguuaagugguugcaaggaauaccaccuggucagcaaagccuaaaauuuuuacugucuggcccuuuaaagaaaaguuugcugaccccugguccaauacaaauaugaaccacauccacugugauaauaauaauaauaauaauaguaauagccuauguaacaaaccugguguaaagaucugacuuagcugucaggagaucaagauuccuguugugaauuugcaauugcaaaaauguggaaccaacccaaauggccaucaaucaaugaguggauaaagaagcuguggcauauauauauguguguguguguguguguauguguguguguguguauauauauguguauauauauguauauauauguguguauauauguguauauauauauauauggaugaguaguauuccaucauauauauacacacauauauauacauauauauacacacauauauacauauauauauacuauauauacauauauauauacauauauauacuauauauauaugauggaauacugcucauccauauaaaggagugaauuuaugguauuugcagcaauuuggaugagguugaagacuauuauucuaagugaaguaacucaggaauggaaaaccaaacauacuguguucucacucauaaguagagcuaagguaugaugaugcaaaggcauaagaaugacacaguggacuuuggggacucaagggaaaggggugggaaggaggugagggauaaaagacuacaaauuggcugcaguguauauggcccaggugaugggugcaccaaaaucucacaaaucaccacuaaagaaaugauguaaccaaacaccaccuguuccccaaaaaccuauggaaauaaaaaaauuaaaaaaaaagauuccuguugugagacuuuuggcagguucuucccccuuucugggcuuuaguuuucccaucugacauugacagaagauggguaagaaacucucuucauagcugauuuaaguaagccucaauggcucagaccaaauaaauuguggauugggcucaggaauaugcauucucagaaacauuuccucccugcucucccccacccccagacgauucagaugcaagugaaagcccacugguucuauuccaauugguuucagaagucuuguccaugggagagaugggcagaagugcaaguguacugaagagacaucaugagaaauugcaaggccuauuuuugcaaggagaugcuuuaagaacaucaagcuuaggcugccagcuggaauauuauaaucauaauaccaaucaaagagagguagggggacagugggaugggauggagugggauagggcucauuaaugacugaaauauuagggagggauaaggauguguccaacacaaugugaugaugaugauggugaugaugaugauggugaugaugaugaugguggugaggaugauggugaugaugaugaugguggugaggacgauggugaugaugaugaugcuggugaugaugauggugauaaugauggugauggugaugauggugaugaugguggugaugaugauggugaugaugauggugauggugaggaugguggugaugaugguggugaugaugauggugauggugaugaugacagugaugaugguggugaggaugaugguggugaugaugguggugaggaugauggugacgaugguggugaugaugauggugaugaugauggugaugaugaugauggugaggaugauggugaugaugaugguggugaugauggugguggugaggaugauggugaugauaaugguggugaggaugauggugaugaugaugaugcuggugaugaugauggugauaaugauggugauggugaugaugaugaugauggugauggugaugauggugaugaggaugauggugaugaugaugaugguguuggugaugguuuuugcaucuuccauucaugaacuaaguacucuuauuagugauuuucuuuuguuugccaucuuauccuaugauuucacucuuguauucuuuuacucuucaaguauaggaaacuuggcuugccaaauauauuaugagcuccuuaaagacaaggcuuugggauauauguucuauguaguguguggugaugaaagcuugggcuuugcagucagaccgaccugacucagcaacacacugaccucugugacccugaauaggugaguuuaugucucugagcuucugcuuucccaucugcagagaggggauaaugauacaccuacacaacagggaggcugagaggacugagugagauaaugcuacagagugaugaggaguggccauuaucacugugaacacuguagaagccuaauaaauauuugacaaaugagcagacagagaagucuggaaucauuguaucacagcucuaaaugaauccauugcccuaaagcagugguucucaauguggaguguguguguguguguguguguguguguguguguguguguguguguguguaugauguacggugggggcucaugcacuuuugcucccaggggacauuugguaaugucuggagacauuuuugguugucaacacugguaucuaguggguagaggccauggaugcggcuaaacauccuacaauacacaggacagccuuucacaacaaagaauuaauuauuucucucaaaaugucagcggugucaaggcugaaaaacccugcccuaaagucagaagcuuguaucccugugccugaaaucuuccagcugaaaagugcuaacuggugaaaaagaaaaaguugggcuugagauuuggaauagacacaaggggaacaagacaucaagacuuuagaaagcaagaguguucuuuggaagguugauuaguuccuguugcaccacacaaugaugaguucaugccucaggucagaaaacuggaugggcuucucugggaaacagcuccuugagucuuggggaaaacaugccccugagcacaggcugagauguucucgcacacacucgaugagggcuguagacagauuuuaucaggcuuugcaaacuauuugacauuagagcgucuggcuuggcaagaaaugaaaugacucagucccagcugauuugccacuuagcuguaaaccacugugucuacuuucuguuauuuuuauaugccaaauagcuuugccagcuccaggcuccaugucccuuucaagaggacaaaggaacagcuacugacaugacagcucguugagucauuucaguucggcuucaauuuauaagcuagcaaagcaaaugagcuggaggugagacuacuuacacgugagccucgguuagcgagggagaaaugaugcagcuguggaugggagugaaugggcgacgugugacucuagcucccagugucuucaacuucucaucaucauaugugcugaaggacaagcagacagagaaacaaugugaacaaugagcaguagcuuugaacaccuucuucucuugccacggucuauucggcagauaugacuggacacuuacuauguaucaggcaaauaauuucugcuggagggaugaggguuucagaugcaguuccuuaacaaagcauauaaaagucccugcccucggucgggugccguggcucaugccuguaaucccagcacuuugggaggccgaggcggguggaucacaaggucaggagaucaagaccauccuggcuaacacggugaaacccugucucuacuaaaaauacaaaaacagcugggcgugguggcaagugccuguagucccagcuacucgggaggcugaggcaggagaaucucuugaacccgggaggcagagguugcagugagcugagaucgugccauugcacuccagccugggugacagagugagacuccgucucaaaaaaaaaaaaaaaaaaaaaagucccugccuuauggaguauauaaucucuagaagagccaagagaauaaacaagauaaaucaugcggcauacuaguauauuauacuaggguuggaaauguuugcuucaagggccagacaagguauauuuucagcuguguucuggaaacagcaauuuaauaccauauuuagguguuuuuucuuucaccauuacagcagagcaaaucauuuccguuauagaaaauaggauuuuuuuugggggggggugguuguugucaugcuugagucauaugauauauauaguuuguuuguuugagacagaaucucacugucacccaggcuggagugcaguggcgugaucuuggcucacugcaaccucugccuccuagguucaagcaauucucgugccucagccucccgaguagcugggauuacaggcaugugccaccaugccuggcuacuuuuuuguauuuuaaguagagaugggguuuugcuauguuggccaggcuggucuugaacuccuguccucaagugauccaccugccuuggccucccaaagugcugggauuacaggcgugagacauugcaccuggcugugggguauauauuuuucuguccauggccaaauucagcccacagauauauuuuaauuaauccacucucuuuuucucucucuuucucucucucucuccucucucucucugugagugugugugugugugcgugugugcaauugaaucaauugucuguauuuuaaaauugggagaugucacauaaaaaugaaaaaacuuuggccuucaaaaaauugaaagcucuggccacucgggaccuguguuucuacacaagaaugaugggccacagacugcuuugaaugaggugugugcuucuucaguuaccccaaacacaagcaucccuguucucacucucugccuuucuuucuaauucaugccaucugccuguuaccugaaggccuuuuaguuucugagcugcaguguaaguacuuucauugauuggaucauugacagguucccugauucauucauuucuaccaauaauuauugaaccucuucucugagcugggggcugccaauacagcaauguaugaaacagaugcagccucuccucuuccgaagcugagucuagugggggagauggguacaaccaaacacacaguugugauaaguguuccaauagaaagugcuuuaauagccuagaauaguaaauuugacugaaauggaaaccagggaauacuguacuuccuugaggaaguuguggaaauuucaaaacaugucccccaaauucuuugaaacuucuccaaucgagagguaggucuauguucauuuggcucugugaccagcugaccuaacagaauaugucagaagucaugugauuccgggcaccaggaacuggcaaccucuccuuccuguguccugggaugcucacucagcauucagcugccaugcuguggggaagcuggcagccugugaggaggcccacagggaaaggaaccaagcucacgaacugacagccaaauacaacuugccaccaaugugagugagcugucuuggaaauggguccugugagcugccccucugagccuuacucaaauugcagauuuaugagagaaagaaguucugauuaucuugaguuaauaaguuuuagaguggguguucauggcaauaguaacuguagcagaaguaaauauugagcugaaaucugaagguugaauggaaauuaacuggguaaauggaggagggaaagaccuuccagccagagggaacagcauguguaaagacucuguagaggaggccaugucaugaguaagaaaguaggagaguguggcuggguagagggaguaaaaggaggcuaugagcuggggcuggagaggcaagccacaggcuagaccauccagggccuuggaaccccugcugagacuuuuguguuuacccugugaggaauggcaaccauggaggguguuaggcugugugcaauuuauauuuugaaaagaucacuuagcuuggggcuuaguguggggaaugggauggagggggccaguggagaugaugcugggacacacguuagggguuuaccuuccuccugggaauuugaggauaauucuggaaucacagaguuaacaaaaauuaggaccagaaucuauguccuccaauguucacuuccacugacucuuuauucaauccuagagcugagaaaaccacagcaaauaccuugcugugaccuuuucuuacuggcucaaccaugcuuccagugguuuaggauauguggaaauuaacccagcuuuuacaucccuaaucucugguuuuaugucuucucucaaccacaauaauaaaacaaauuuuacccgucacuuuuuuuuccaccuuuucagcugaaucugcagcugaaaaaugaggucacugagcacagugggaaagacugcuugcaggcagaaaucuuuggggaugugcuugauuuuuuuuucccugcauaguuugucagacuuaaaauuuuugucuaaaagaauguauucuauggucuuagauccagagaggagaaaauaauuccuuucgcuuuuaugaugcacaagaucaaauacuuuguuuaaaaaguauuuauaaaugaaacuuguauuuuuuauacuuuugugauuggaauuuuaucuauagaagcauugcuguuagaugugagaugcuuuucagcuuucauggaaauuaagauuuuuagccauacauuuaaggauuuuagguaacugaggcucagagagcucaaacucacuuuauugcgucauaauaggaacaauuacugagcaugucuuauacguagacucuaggcuaaguaucauuucauuuaauccucauaauaagcuugggaguuugguaccauuuauuuauguacgugaagaaaaggagacucagagagguacagggauuuguucaaagugaaacaguuguaugggggaaguccuaacggguuccaaggcuuguguacuucaccacuacuacccugucuggguguagacaaucuccuaaugcuguuuuauaacacccucccacccgcgcauuugauggcuacauugcuguaaugacuuccaguuuuauuuuaauaaccagccuuguauaacucauagaaccuaccagauaagacauaaccagaccaaagucuacaagaggagcgaucucaugcauauuuaaacuuauuaaacuuuaaauaaaucauuucucacacacugaaacauggauuggagaggggagaauugcguucuacgaccauggaugagaaacuccauccaaacaaguggaacaagacacccaagccauuuaaacagguacaggagugucuuucauagacaccaucuuuccccagugcuuuuuggguuugccugucaaucugagcauagcuccugaaaaaagagccaugaguucaugccuucucuuuauuccagggaaaggcugccagucugucacuaggaguaucagaaucuaugggugccauugaguuuggucagguaggcacaauuugugcugaucccagggucuacaccaaugaggagucaaagaagagacccuuuccacaauauucugggaucccaacagccaugauucugggggaggugacuggaaauauaccagcuccaugaggucuugcagucuggguucucauccaucaccuggaacccugggcuuuaaagagguccuguucuccucugacucaauaccccaggccucauagacaagaacccuuguucuacuugaaaaaauuguauauauuuuucuuuuuuuuccuuaaagagagauggagucucucuauguugcccaagcuggucuugaacuccugggcucaagugaucuuccugccucagccucccuaagugcugggauuacaggugugagccaccacgccuggccugaagaaaaauuuauuaaggugaaagucacagaacauaaaauuaacuguuuuaaagaguagaauguagugguauuuaguacauugcaccauguuguacaaccauaaccucuugguacaaaacauuuucaucacucccaaaaggggacuccagacccauguggucacuucccauuuccccugcccccagcaucuggcaaccaacaaucugcucucuguuuaggaugaacuucaaaugcacuauaagugaaagaagccagacacagaagagucacauaauauaugauuccauugacaggacccuuguuuauaagaagcacauauucacauucuguaaauuaacauucucaagaacagaauuugggaaauggugcagaggaaaguggguaucugucguggcuuccauuucauuuuuggcaaaugaccuggcaguuuggauuccugaaggcagccuuagccuaacggcucucaacuguggcuucacacuggauucgcuuaggggaacuuaaaaaaauucuaugaauauccaagccaacaccuauuccuuuuuauauuauggccguucuuugcaggaguaaggugguauugcguugugguuuugauuugcauuucccugauaauuagcgauguugagcacuuuuuuucgggaauguaaacuaguacaaccacuguggaaaacaguauggaguuuccuuaaagaacuaaaaguagaacuaccauuugauccagcaaucccacuacucaguaucuacucagaggaaaagaagucauugucugaaaaagacacuugcacaugcauguuuauagcagcacaauucacaauugcaaaaauauagaacuaguccaaaugcccaucaaucaaugaguggauaaagaaaaggugguauguauauacauauauauauacaccauggaauacugcucagccauaaaaagaaacaaaauaauggcauuuucagcaaucuggauggaguuggagaccauuauucuaaguaaaguaacucaggaauggaaaaccaaacaucguauauucucauucauaagugggagcuaagcuaugaggaugcaaaggcaaaagaaugauauaauggacucuggggacuccugggggaagggugggaggagggugagggauaaaagacugcacauuggguacagugcacacugcuugggugaugggugcaccauaaucucagaaaucaccacuggagaacuuauucauguaaccaaacaccaccuguuccccaaaaacuauugaaauaaaaaaaaauuaaucuaugaacagcuaauguauauuagagagccuaauguaacugaccuggacagugguguuuuuaaaaacuugccagaugauucuaauauguagcuaggguugcaacagcugcgcucacaggagaguggcuacagcugcaggccauuuuucuacccugcauuuccucccuggcugccuuggcacuuccuuuccauccuugguuugugccucauucagucugcacaagcucaaaguaucccaggauuuuguccacgccaaauggugcagucgauggauuuuggugccacuaaguuugggacucagagcugcuuucuaacuacugaccuugggggagauuaguuaacuucuaagccucauuucuccaucucuaaaauggggccaaugauagcaccuaucucaggaauguuuugaaauuuagccgaauaggugugcauuaagcacacaguaaacaucaucaucuguuuuuauuguuauuuugguuauuacuauuauuauaugcaugggcauuucauaauggaccagucuauugauaguccuuuuccaaccaggggaaaguccuuuacaaaaaaaggaggccgggcgugguggcucacacuuguaaucccagcacuuugggaagcucaggcgggcagaccacaaggucagcaguucgagaccagccuggccaacacagugaaaccccgucucuauuaaaaauacaaaaaaauuagccaggcgugguggugggcaccuguaaucccagcuacuugggaggcugaggcaggagaaucgcuugaaccugggaggcagagguugcagugagccaagaucacgccgcugcacuccagccugggcaacagagcgagauuccauaucaaaaaaaaaaaaaaaaaaaaaaggaggcauuuuuuaugcaccugguuucuguggacaaugagccaggcccuggggcugccacugaagguauggaacagagauacugauguggacuaaaacuagcauauaaacacguauuauggggaccuggagugcaaaugggugcaggaggugguuggacugaaauccaggaaguauucggagagagcagcauuuaagcugggugguuagugauaaguggaagauguuccagcgaauaccagaaagcgaggcuaucaagguugguuggaccacacuaaagaagguguuagaugccaggcugagaaggggcacgugcucugagauagcugcccucgcuugaccuuaccaggcaggguucacucucaauggucauucccaaaaccuucagugccacagcuacugcauccacuuaccucaauaagguguccccauaguggauuucugagaucuuuucggcuggcuggaauuuauuucuuuccuccucuuucaguuucugaaguuguuguugcuucuuuuucuuugcagucucuucccucagaauagcaaaauauccacggccuaucuucacagacuggaucaaaaagcuggagacaugcagggaggaagagggagagagggaggaaggugggaggguggagagagagaaggaaagagaaggagagaaagaaagagagagaggaaagagaaaagagagauaaagagggauagagagaaagaaacagguagaaauagagaaagagagugagagagggagagggaaggaaggaaagagagagagagagagggagggaggagagggagacacaaauuuaaaaaaaagaugaguugacucuuauugucuugggaccaauaaucucugagcgugcccucgugccugcagggcaggagccuucccaccuguagauuuccagacucagccagaccugaguuugaauucuggauccaccuuguacuaaagaccuuggccaaguccuugaaucucucugagccucauuuccuucaucaucccaucacucaacaaauguuuauggagugcccacuuacagcaccaggcagucugcuaggugcuguggaaugaacauaacaauucacagccugcaggaucagauaccaucaugcaugggaaggggucagcagugaagugcuuggcacagaagaugggcucuuccaugaaaaucaauggcauagcaggcacuaaagggccuaggcuccuggcuaaggcugcccucucuuugauuugccuaaaugcucacaucugucagcaugacugcuacagaaguucaaguacuaauguguggguucuugcugugucaaauaacauauguugggaccucauaauucuuuucaugccaacucaaccacuauuuccuaaucagaugucuugaugcuggcuugaugugaagacauucucagucgugaugggcuacacaccucccugcgcuuugccagucuucaccuugggguuggaguuagcagcccugugguggagaaggagugaugcagaggugucuacauguuucuuucugucugcccacuuuguuccuagauguaaauguugguucucaaauucaguuuuauuuguucuccaaauuccuaauaagcaaccaucaauuuuauuuguucuccaaauuccuaguaagcaagcaauguguguuggguauuguacugacuguuggggauacagugaugaacaagacauugggucccucaggguucaugguucaguaggagagagggagagagagauacaugaugucaauaauagcacaggguaaugggagaggcaggacucugggcuuuggggaagggggcaccuaauugagacuagggggaggcugaagaccucuuccuggagaaaguaggauuuucuuucccuguuugaagguggccucuuccucuccucucaugucucucuugugcucgguuuugcaugggaauauucccagccagcugccauggccagacucauaugauuaguugaccccugcuuauuugcuaagacgagcuaagguguuaugaaggucauuucauuucaucgggggacucuuacaaauguccauugggaauaugcugggaggcgggaggucgggauuuuccagcauuuuucaaaucacaucacauggguggcagcuaagugauaacauuucauucauucauuccucuggcugaccuuggcugagaaccugcuauuccagggaccaguucaggggacuggggcugcacaaagcaauaagauaaaacauuuaccccccaaggaguucacagugucauggaggaagaacacccacaaacagauacucucaaccuaauguaccaaagggcuauaggaaccuagagaaaucuuggaaggcuuucuggaggagguaguauuuaggcuaaguaggaauucaccaguagaacaaagugggacauggcauaccaguggauggaauaucagguguaaaugcaaaaaggugagucugaugauggccucuuuagggaacuauaacuaucuuuaaaacacuggagcacagaagaguggcuagagcuaaagcugacaaugcaggcaggaaacauggcgcagggccuuggguucuuaagugagccuggauuugggaauugcuuggacuguacguaaaaaugcuucaggaaucugcaaaugucugaguuuucauuaacagcuauuaaagcuauuaacaacacccacaacacaaaacauucuguuauaugcuagaucaauucauuuuguacauuucuauugcaucggccuguguucacuaauucugaaaggcccauuuuuucgcaucucaacuuccuugacgugaaacugcaucuuacaaucauuggccauucacaaucacugccagcuacguggcaguugcuuugcaguuguuguggccucuauagguuuaaauuugguuguuacuccugguagccugacugcacaauugcccccgcugggcaauaaaucacuggaccaggaguuugaagucugaaaagucuuuuucuuugacauauucuuauaaaaucaaggaaguaggcuuggugugguuguucaugccuauaaucucagcacuuugggaggccggggcggguggaucacuugaggucaggaguuugagaccagccuggccaacaugaugaaaccccauuucuacugaaaauacaaaaauuagccagggugguggcgggugccucuaaucccagcuacucgggaggcugagggagaaucacuggaacccgggaggcggaguuugcaaggaggcggagguugcaguuagcugagaucacgccacugcacuccagccugagugacagagugagacuccaucucaaaaaauuuuuugaaaagcaagaaagugccauuauaaaaacuuucagacuugggucugcagcugggaagaaaucuuggagacaacagaggagcauccucuuaagaaauguuccacaggacauuguugacucugaguggaagagugauucugaagaguugggcuuugaaugugaagaaguuugaggaauaccuuaaccaauguauuuuaccuguguuuuccuuuugguuugaacagaauauauagauauaaauggaauauuaaaaaauuauuuaaguagguaaaaaaggagcuuuucuuaaaaauuaggaaauaauauauauauuuuuuaauuuuuaaaaaaauuuuaauuuuuguagagaugggggucucacuguguugcccaagcuggucucacauuccuggccucaagugauccucuugccucagccucccaaaaugcugggauuacaagcaugagccacugcaccuggccuaaaauauuuuuacaaaauaaaaauucuaagugauaagaaagaaccaucuuauuuuaauugacaguguuuuuauuuuguuauguuaaauuuuuuaaauaaaauucuuuucauuguuuaguuuuucuuuuuaguggcauaucuuagauuugauggugguuuagacucaauaaaaugcuguauuuuugcucuuuaugaaugugcuccuggaagauuaccacugaauguuuucuaaauuuaaauccugcuucucagcucauguaaaauuuuuuggauguuuaugccacaugucauauauccaucccagacagucaguugcaggcaaggaucagucauaucugcucagcucauguucuugucauugcaaaauaaucucucaguuuucuuauguauaaaauugugcaaaagcaaaugaguggguaaccuguuaucacuuaguaaugccauauugucaguuauaggugcuuuugccuggcuuuuuuuuaaaaaauuuuuauuuuuuaagacagcgucuugcucuaucgcccaggcuggaguguaguggugcgaucucggcucacugcaacccccaccucuuggguucaagcaauucuccugccucagccuccugcguagcugggauuacaggcaugugccaccaugcccggcuaauuuauuuauuuauuuauuuuauuuuuauuuuuaguagagacgagguuucacuauauuggccaggcuggucuugaacuccugaucuuaugacccacccaccucggccucccaaagugcugggauuacaggcaugagccaccgugccuggcugccuggcuuuuauauuuaaguuuaggaaugugagcagugaauaugagguggaauucauguuugaaacaaaaauaugcuuccauuuugcuuucaagcuucugaauuggugagaguccugaagcugcaagggaacuugauaaaaagaaaaccguuagcguuugcaaccucuuaacuucacacaugaggauuuuucucuguguagcacaaacaaagcaaaugcagaaauaaccugggaggugagacugaugugacagcaacugcuuuucauugucaugccacuuuacagagaugggguggacucuguuucagucugcuuuggcugcuguuacaaaaauaccauagacuggguggcuuaaacaacagaaacuucuuucucacaguucuggaggcuggaagcccaagaucagggugccagcaugguuggguucuggugaggucccucuuccagguuggagacugccauuuucucacugaagccucacauggagggaagagagcuagagagcucuccagagucucuuuuauaggggcacuaaucgcauucacaaagguggaggcuaaucaccucccaaaggccucaacuccuaauaucauauugggagguggguaaggauuucaacauaugaauuugguggggggacacaaacauucaaucuguaacagacccuucacugaaaauuuguucagaagucaagacugauacugaugcagggcaggcaugcccaaaauuggggcuuagccuaggagggugcuuggcuucacccaggaaagaaucaagggugagcuggugguagaagaaaacagcuuuauugaagaggcgguguuacugcuccaugacugcaccugcagagcagggccaccccacaggcagugugcugagagcagcagcucagggcaguuuugcagucauauuuauacccacuuuuaauuacauguagaauaagcgguaguuuaugcagaaauuucuagggaaaaggugguaacuuuugggucauugugucauugccauagaaaggggcaguaacucccagaguguugccauggcaaugguaaacugauggacauaucuuauggaaaggugcuucuucccugucccuguuuuagcuaguucucacuuuggucugguguccaaggcccaccucugguguuaagucccaccuccuaccucaacacaaugcacacaccaagagaauaugaaauggguuauuacucacauaacuagauuuucuggggagagcagggaagucucccaagcaggucuucaaacugccugaaagagcaggaagggaccaguggcuugggguuuuauggugguuagggggugagguagugguuccacauuuggagaugauuugaacuucccaccagcaucaaaggagggugcaccugggcuuucuuaucaacuugcccagauauagggcagaagggaaugguguggugggugaggauggaguguuggagcuugaaauccaucaguagucaaauaucaagaauggagucagauucuuuauuacacggauuaaucccaauuuccaauuuguguguuugccuaaauaacugcaccauuaucaaccguucaaugaaaauguucaacaaauauuuggugaaugcuuauuacguacaaagcacuauguguugaggaugcagcaguaaacaaaauagcuguagaguucuggcccuuaugaagcucguauuccagaggguggagacagauucaaaacuaagaaguaaaugguacccaaagugccaacugcuauggaggaacagagcaggcaagugggacgagaugccagggaugaggggugucagugcauuuagaaaaagauggucagugaaacccucacucagaaggugauguuugcagaaagaugugaaggagguaagggaguaaaccaugcagauacuuguugggggaagaguauuccaguagcaggaacaacaugugcaaaggcucugagcaaguacgauuuuaaacuaagaaaaguuucguuuccauugaauaaaauguuauaugacaucauauaauacgaugugugcuaccaaaauguuggcuuugcacguuuuagaaauugguguuguugauggaaauaaaaccaaacucuguaaaauauuccaaagagguuuaugccaguaugaguggccauggucuggagaaaacacaagcccaaggagccuugaguaaguggcccagaggcagucagaaugcagcucuguuuuauacauuuuuuuuuuuuugagaugaagucucacucugucacugaggcuggagugcaguggcaccgugucagcucacacuaaccuccaucuccuggguucaagcaauucuccugccucagccuccugaguagcugggauuacaggugcccaccaucacgccuggcuaguuuuuauauuuuuaguagagacgggguuucaccauguuaucaaggcuggucuugaacuucugaccugaggugauccaccugccucggccucccagagugcugggauuacaggugugaaccaccucgcccggucugcuuuauacauuuuagagaaguagaaguuacagucaaagucauaaaucaauacauagaggcuuuacauugguuucacccaaaaaaaggugggauaccuggaagcugaggcuuauaggucauagguggguucagagauuuauuuuuuuauuuuuauuuuuuugagauggagucucacucugucacccaggcuggagugcaguggugcgaucucggcucacugcaaccuccgccucccggguuccacgccauucucccgccucagccuccugacuagcugggacuacaggcgcccgccaccaggccuggcuaauuguuuuuguauuuuuaguagagacgggguuucaccauguuagccaggauggucucgaucuccugaccucgugauccacccgccucggccucccaaagugcugggauuacaggcaugagccaccgcgccuggcccagagauuuauuuaauucguaauugguuaaaggagcaagaacuuuauucaaacacuuggaaucagcagaaaggaaaguugaaguuccuggggguuggacuucaauguaugaauuuggggaggacacaauugaauccauaacacacacauuucaggauccaguaggcugcaguuucugcacaucaucauguaauauuuugccagaguuggguugcaagagcaagacauaauacauuggaucggagugaccuguaguucugcaugacuuaauccuuguccaguguagcuuuagguccuguuuauaauuugguaucuuacugucagucaguuucaucagucuucugaucucuauuuuaacauuaauggugggcagcucuuguggcuaauuuccaaaagggacggaguacaaugaggugugucugaccucccaucuugucauggccaagaagucaguuuuuaagguuuuucggggguucccuuggccaagagagggucuauucagcugguuggagggggcuuaggauuuuauuuuuaguuuacaguguucuacuuaagacuuuuguuugacagaaagguucuucucuggaaaaagaagaaaggaaagauggaagggagggagggaggaagaggaaaggggagggaaggaaggaggaaggaagggaaaaugggagggagggaagaaaaaaggaagaaggaaggaaagaggaaguaaggaagagugggggggggguugcucuugcaacccaacucuggcaaaauauuacgugaugaugugcagaaacugcaaccuacuggauccugaaaugugugugcuauggauucaguuguguccuccccaaauucauacauugaaguccaacccccaggaacuucagcuuuccuuucugcugauuccaaguguuugaauaaaguucuugcuccuuuaaccaauuacgaauuaaauaaaucucugggccaggcgcagaggaaggaagggaaaaugggagggagggaagaaaaaaggaagaaggaaggaaagaggaaguaaggaagggagagaggaaaaaagaaaggaagagaggaaagaaggaagggugggcuguguguccuaagcuggaaagguagggagaaccagguaacagugauggucugggcaccugccucucgacuccuuuacuccaggguccuacuccaggaggccauagacuuuaccauuugaauuaagaagcucauuucuaauaacucagucuaacaucuucaugugcagggccauaagaacagagcuguagaggucccucucugccacuggacuucaaugagacuucucaaguguuuccaguguacacuugagaugcugcaaagcauucacauaagagcccuuuuuaaggugaacucggcacuguugggauuucgcgucugcgguagaccuuagugcuucuuaccagcaguuuugugccucacucuccugaucuuuccauucuugggcacguguguuaauguauuuguccucacaaugacucuguguuuuaggugcuauuauuaucacuuccauuugaagauaaggaaacuguggucaggaaagacaaggucacagagcuggaaagaagcagagcugaggucugaacccaaguggugaguucacuguagagcucagcugugcacugcgcugguugguagauggucaggauguuucuggauguggcuggucacucuguccuuucggaagucccaccagcaugggccuugaucuugaaguuuccaugagccacugggucaaggacuaacuugggugguuuaucacugacugguaggugccagggauuugcuguuguccagauucucucauggauuggaaggcugucagagugaccuguuggauccugagacagacuguggucuguaggggcagagaacagaacaggcacugaggcuaggcguggcagcucaugcuuguaaucccagcacuuugggaggccaaggcggguggaucacuugaggucaggaguucgagaccagccuggccaacauggcgaaacccugucucuacgaaaaauacaaauauuagcugggcgugguggcaagcgccuguaguaccagcuacucaggaggcugaggcacaagaaucacuugaaccugggaggcggagguuguagagagcugacaucgcaucacugcacuacagccugggcgagagagcaagacucugucucaaaaauaaauaaauaaauaaauaaauaaauaaauaaauaaauaaauaaaugaaguuaguugggcaugguagcauaugccaauggucccagcuacuugaaaggcugaggcaggaggaucacuuaagccaggaguuugaggaugcaguaagcuaugaccaugccauugcauuccagcaugggugacagugaaauccugucucuaaaaaaauucucagucuuuaccucugcaucucggucauuuaccuuuuuguaguaauuaacaaguugguaagagauuuuuuucaacuuauucaugcucucauucuaaaaagaauuagaaacaagaaaauuuuuuuuaaagugagacaggcagaaggcagaaaaaaacaagaaaaccaaaaucagguaagacagguaacaaaacccaugccacauaaucuggugcauaaauuuggcccugagcauccuaguggcugaggcaaagagguaaacacaauccuaaugugauuccuaauggcugaagauuuuuaaaaagcuguuuaggagaugcugggcuguuccuggugcugcaaauaggaagagacuucuuucaaggagcuguacagggagcauacgguaaaaagccaagucuguagcaaaccccuagauacaaauagagugauaaaugcuugucuuaucaauuaacuccacagaaagagacagggcagucacuguuggacaauuugagaaaccuagcaagcaaaucuucugguggaauuucagccccucuucaggcaaggcagucagauguccagcugccagaucuucuggaaaggccugagugacagaugaaugugguuagggggagggucugggccuucaugucagacacaccagucuauucugggaacuucaggcugcaggauguucauucaacgagcuugggaagugcucccuugauaccgcggaggcccauuuaaaaacgcuuaauauuuuagcaaauucucauuuaauuccguguguucccuacauuuucuucaucauuauugcugauuaccaggcuauuugugugaagggagcuauuugcagggaagagcaguuuucgccuuuaaauccacucaccuggggccuccugcucacugcuuugugcgauguaaaacuccccuggcuaacaucacaagaggaacgauggggaguaaaauaauuaacugcaucaggcaagaggaggaaaaagcagauuauaaaauggaaaguuuucucuaugcaauacaauuucuucucaaccagugcaugggagaggguggguuguuauuauuaaggaacguauguucucuguaugggagucugugugugagcugaugagaggaugcuuacugcagcaauaggaguauucucagcagggcuuggccaagacagaccaaagggacagaaggaaggaagccuagguuucauuucuaagcaccuuuggacuugaggagcaguaugggcgaugggaagguguuagaggggauugccucuggcuggacucuacuuuuucauucccuuagggugguuuuaaaccucucugaaucacaaccccuucaucuucaaauggggaaaauauuaguuccucccucaaagggcuauugggaggauuaaaugagacaguaaagauaaugaguuuacuguaguaccuaguacauagggcuccauaaugggaagcgguuguuaucgucagcuugcuuaacaguccugagaaguuggagugauuuacagaugagaaaacagagaaaagguuagguaaaugauggucauaacagcuggaauguggccaagcagagaucggaagacaguaggguugauuccagaauuucucucucucuauuugcaugcuccaagcauagguauguucaguagaaagcuuuaaggcuuugaguuuauguaccucugggcuguuuguuuugcagauuucauuucuaggucuguagaauaggaacaaauggcuuaccuuuucccccuuuagaccauguuuuuacccaauccaaagcaccaucuguggcagauuaggucauuauugagcaaauacucucuuccucucccauccccuacauucaggguugggauguauuuucucaguguccagaauuuggacuuggacaugugucuccuuuggucgaugggauauuagcagauaugaauugaaugaacacauaaaaugagcuuucucagcuggguccgugugaacaaaauccacaacggacccagaagagugagaagacauugaacagaccuuucugaacccagcaauucuagccuagcucagcgaaggcuggagcaagaaagaaauauguguugaaaaucauugaguuugggggcagcuuguuacacagcaucaugaugaaaauagcugacuggugcaucauccauuguaaaaugcaccauuauuuuaugaaccacaaagaagaaaacacaaaaacacaugucaauuaaauuaagacaugauuguacauugcauuccaaguucagagaugauaaaaugugcaaaaaaugugcuucuuagacaugauaaaauauaguauuaagaaagaaguugccucagaccuaagaaagauggccuggaguaggaccuggagcaugauguaauuaacagcuccuucugagaaguaucuagcaauugugauaaaauaucugagcaauuuucugauauucucugugagauuaagagucuuuucugcagcauuggauuuacccguggugcuggcccgacagacuuacaacaagacuauuaacuauuaacuauuaacuaaccacuccuacuucaggugaugcuaucuaguuccuuacaaaucaaagugugguccagcagcaucagcaucacgugagagcuuguuguguaauugccccauggguucaucuuacccacugcacagauaaagccacuuuacugagauagcauuauugcaauagagaaaaaguuguauaaaugcagucagcuaaguggaaggacagcacagugauuuauuauagucaaaucagccucccugaaaauucagagucuaggauuucuuaaugauagcuuggugggcaggggcuuaagaauggggaaugcuaauugguuggguccaagaugaaaccacagggaguugaagcuuaucuucuugcacugagucaguuccugguuggggggcacaagaccagaugaaccaguuuacuggucuggguagugcaagcagggccaucagaaugcagggucuguaaaauaccuugaacaccugucuuagguuuuacaauagaguuguuaucuauaggagcaauggggguggucaggaaucuuguggccucuggcuguaugacuccagagccauaauuucuaaucuuguggcuaauuugcuaguuuuccaaaucaucuuuguuugaaacuaaauuccuacuaugguuaccuagauccauccccaggaaugaacaagggcaucuuggagguuagaagcaagauggaaucaguuaggucaaauuucuuuuauugucauaauuuuccuaugucagauuuuucucacugucauaauuuuugcaaaggcaguuuggguuagaauugcagaaucuugggccccaccccagaccucuugaaucugaaucugcauuuuaacaggauccucggguaauucauguacacauugaaguuugagaugcacuugucuggauaccuuuuccccacuauugaaaggaacucuuuccagaaaaaaaaucuuccaguuggcuuuacuagaaggcuaguccccuuccugcaagucugaacuaaaacucugccacaugcuagcaaucaguuaaucucagaaguucucuaagaaucucuuggccggguguggugguucacgccuguaauccacuuugguucacuuugggcggccgacggagguggauuaccugaggucaggaauucgagaccagacugaccaacauggugaaacucugucucuacuaaaaauacaaaaaauuagcugggcaugguggugggugccuuuaauuccagcuacucggggggcugaggcaagagaaucgcuugaacccaggagguggagguuacugugagccgagaucaugccauugcacucuagccugggugacagagugagauucugucucaaaaacaaaaacaaaaacaaaaacaaaaacaaaacaaaucucucuauuggacauucuuaucuugagggcacucugccugaauacaucucccaugaccugaaucggccucccucccaagggcccuaaagaaaacuaggauugaacaucacccaaaacagaccuucccagcccucuucucaggaaccucacaagaaauugcagaguauugaagauuugggaggcagugagugaaacucauguucaaccuuucuauuauggggggcaugggauuaacuaccacaaaucacuguguuaaaaacuaagagcccagauguacuuaaaaaaaaauaaaaauaaaaauaaacuuuuaaugguauuauggcucuacauccagcugguuuucacuuacauuuuccagcucuaccuacaagaaauauggggcuauaaagccaggagugcuuugacgggaaaggcagaaugacauuaagaugaacaaacacucauggcaaucugauuucagggauguccugcucuugcagaagggaauugccuacaugggaaauuuucacuuaacaaauuuuacuguuuucaaauaauagcaaauaaaucaguuuauucccaauugguugaggcuggaggcuuggggagcccacuucaucuggcuggcucaggccuugcucugucagcccacccagacauauugauuucggaggaagagagggcaaaaaugauggaaugaagggaucugaaacaccauccuuaaguucuugaauuuucaggcaacccauagaggcaaauuaauaacgcagccccaguucaaaagcaccaagcaaauauuuugcauuuaaauuccugcauuagaaugcccuguuuauacaauaacuuaauaaaucuagccuggcugccaaauugacaagaaggugagaaucauucauuaaaaugcaaaugcaauugagaugaaauuuggaauacauuuauuacaguaauugaacuucagucaacuguagucacaacacagauuuugaacugccuuucagacaaaaggauguguuguauuauucucccccccgccaaccaccaaguuaauaucuuugucagcaugcaaauuaaagcuauuuccugagugcuaaugauuugcaauggaggauuucacucuucuuuauaggacaagauugccagagauaaaggucaacuacguacacaaaagauugcucugguagcauauuguguauacagcaaauugauugcaaacauauucugagugcuuauugcaaccacauucuuauuaaaucacauccaaacaucuccuugcuaucccugggucauuugcuaauuguaaugcccaacaaugggaaauuugcugagucaggauuucaccucucagaucaaguuucagauggauuucucuccuuucugaaugacucagcccaaagagaaagacccguuaauggguucuuuuugaucauaaauuggauggaagaaagaugcuacuggaacuuuuauaagggcucagaaaauuugacucucaguggaggagaagucccuuuaguugcuucaguuuuauucucucuggcacuuuugcaaaauucuugggucugagcaaagugcacacaugcaccuagaagacuuccguuugagcuggaagaaccuaagguguuucuuuggcuaaggguaagugugcuguuuagaaaucacucuaggguggcaaaaacaaguuuguuccaaauguagaacagaaagauugcuugugucagagguguauaaaccagagcaacuccaucuugaauggggcuagguaaaaugaugcugagaccuacugggcugcauucccagacaguuaaagcauucuaagucacuggaugagauaggagguaggcacaaaauacagaucauaaagaccuugcggauaaaacagguugcaguaaagaagccagcuaaaucucaccaaaaccaagauggcgacaagagugaccucuggucguccucacugcuacacuccugucagcgccaugacaguuuaccaaugccauggcaaugucaggaaguuacccuacauggucuaaaaaggggaggcaucaauaauccaccccuuguuuagcauaucaucaggaaauaaccauaaaaaugggcaaccauuagcccuuggggcuuuacuuuuauuccuuuacuuuauuaauaaacuugcuuucacuuuaugcuauggacuugcccugaauucuuucuugugcaagauccaagaaccuucucuuggggucuggauugggaccccuuucauguaacaucuuucuagugaccaugaagggacuguagugcagaaacccccaggaaguguugggguccuguaacacuugugucuuuugaccccuuucauauccaguuaauugaucaugaagugaugucaacucuauuuucugaauauuaguugacucucuuccuuaaccuagccagaaaccaucauuuacuuuagguaguuucccaccaggucuuuuccuuccuauuggccaccuggcugccccagggcuuuuuugaaaaggcaaaucucaucauuccuaucuuaaugcucaaaauccucuaauggcuuccuacuguucucagggugaaguccugaguccuuccuucuccuccuagcaauguccucuaagaucugggauuuaucucuaaccauucacccugccauuccuuugcaucucucuacccccuugaaauugcacaugcuugcuugcuuucuuucuuucuuucuuucuuucuuucuuucuuucuuucuuucuuucuuucuuucuuucucuuucucucucucuuucucucucccucccucccuccccucccuccuuccuuccuuucucucucuuucucuuucuuucuuuccuccuuccuuccucccuccuucuuucuuuccuuucuuuuccuuccuuccuucccucccuuuucuuuucuuccuuccuuccuucuucuucuccuuccuccuccuuuucuucuucuucuguuuuucuucuucuuuuucuuucuuucacucuuucuuucuuuucuuuucuuucuuuccuucuuucuuucuuuuucagagacagagucuugcucuguuguccauacuggagugcaguggugccaucauagcucacugcagccucaaacuccugagcucaagugauccuccuuccuuggccucccaaaaauuuaggauuauaagcaugaaccacugugacccgccugcacaugcuuuucuuucucucugcagcaucuucuccauugucuucacuuggcuugauuucuauuuguccuucaagguuuggguaaaacuaucaacuguuggucauucaauaccucuucccuucucuccucucaguuccaggcuaggucaagugcacccacagcuccuuguaccuauguacuuccuauuauuacacucagcacacuacauggugauugcugauugacuugucugccuuucuuacugucugugggcuccuugaaguaagacucuggcauguagaaggcuaucagcacuugguuuuccuucccuacuucucucuauugcucccaaugacagaaagugccaguugccuaccaaguaucaacuugccuagcuucuuuaguaauagaccacauuaucgugggcaucaauaugccuagauuaacaaccagcaaagcaaagcaaaaucaaacaacaaccaccacaaacaaaaacuauauuucccagcugccuuucccgauaggcuaggccaaugagguacaaguggaagucauuuaaagaggcuucugggaaaauucuuuaaaggaaauuggcaagcuggguaacauaugcccguuagccccuuuuucaguuccuuucuguugccugaagcugcuccagcagccauuuucugagcaugaggaauucuggcagauggaagcaaauacggaggaugguggauaaaaccuagaaggaacccagguacuggaugaccaggaagcugccauaccaguacuagaucaccuucauccaaauguaaacccuuuuuaugugagggagguaauucuuuauuuuguuuaagccauagugauuucagggcucugcuaccaugcagcagaauacaguuccaagagacaauaucucuuucucugccucuuucuuuuuucuugaccaaacuaucacaauucacacauuuaaaaugcuauuguccuuggcuaaaucaauggccauggaccagaaaaggauauugggagaggcugguuuagauaauuggguaguaacaaggaaacuuagaaacaugaaacucugucaagagaauuuggccugggagagucuccacugagcguguccagggcagcugguaaauaggcaacaggugagucugagccuguaagaaaugagggcugggacaggagggggugguggcacuuagagagaaacaggagguuucucucuauagugauggcuugagugaggcacugagcuaagcacuuuauaugcauuaucucaucaaacuuucacaacauccuaugaaguaaguacuauuauccccauuuugcugaugaggaaacuaaggcucaaagaagucaaauagucugaccauaggguuaguaagagguggcacuggaauuuaaacacaggcaggcuaauuccaaaguauuacaugagaaaaauacacugguuuuggaaauggucuguucuagguuuaacuggccaugauuuccuuaucacucaaugucugugagucaucuuaccucguugagauguccuuuccucaccuuuaaaauuuggauacauuaauagccauccugggacauuguugaaaaucauauaugagaggcaauuaguauggugccuagcacacuggagcuguucgauacaugguaacauuaucauuuuuuucuucuuauuuuucaucaucaucaucaucaucaucaucacaaucaucaaauuaucaucgacuucucuuccuccuucuuccccuuucccuucuccuccuccuccucuuccucuuccuucuccuccugcuccucuucccuucccucuccucuuucucauucuucuuucuucuucuucuucauuguagucaucaccaugaaugccuucugguacaacuuucuugcuuugcacaugaccaggauggugguuuggcuguaagccccacagaguucugggaaguggcacuuaguucaaguggugagccuaggagguucucuucucugggggugaugggaagaacagucuaauuagauuacaauuauuuggggauuuaguaaauugccuuaugaaguaauucacaaaggucugugaguccacugugccaguggugguaggaaaaaugcuugguuaucauguaaguaaugaaauguauuaagcuaaggggcccaggaauuaaccucugcuuugcuggauaggaaaugacaugcagaagccuucuaauuauuuuaaaugguuuucuuuucuuaauucuucuuugauuuaaucucuaucucagaucuucauuaaagaaaaugacgauggaagaaaaggaggaggagggaagaggggaggauaaagaaauggaaagaagaaucugaagaucccauaucacagccugugaacacacaggauguuucacaggaagacagugcugauaacaguaaauuacaaucaaaucuaaggguuuaggccaaagugggauauacauuaaugucaguuaaaaagccaaguucuggcuggguaugguggcucacgccuguaaucccaaaacuuugggaggcugaggugggcagauugccugagaucaggaguucgagaccagucuggccaacauggugaaaccccgucucuacuaaaaauacaaaauaaaauuagcugggcaugguggugcgugccuguaaucccagcuacucuggagguugaggcaggggaauugcuugaaccagggagguggagguggcagugagccgagaucacgucacuggacuccagccugcgugacagagugaggguccaucuaaaacaaacaaacaaacaaaaaaaaaacaagccaaauucuaacucuaacucuaccaaaaaauugcugugggauuuagacagauucaugaaccacucuguucuguuaucuaggaaugaauaacuauuacuacuaccaucuccaccaucaccaccacuaucgccauuuccaccaccaucaucacaacuagaauaugacucauuaccgugugccaguaacugugagaaagcuuuugcagcuacugauuucuuuaacuucugaaaacaauccuucaaggcaacccucaguaguguugcuagccucauuucauuguguggaaacugaaaugcuaagagguucagugauuugaucaaugcaaagguacccagucuggguggagcagagucuggacugguucucgggccuaagccugucucgcucagccauucuucaagauaauauugucuuaucugaguaguugugaaagacaaaaaaucagaaaauagaugcaaaagcaguuuggaaggucuuaaaacaugccaugcaaagagaaaguacaauucuaaauuggauauucaaaacugcuuuauaaagagggaggacugguucuuuucaccuaaucacauuauugcuaauugucagggccacaauuagaaaagcaagcccucucaucaguguaggauacgcccauagaugaguaggugaugagugaaauuaagaugcaaaaaagcuauaucucuaugcaaaguagcuucagaguuuuggcuaaacgaaucucuagaaauuacauuccuuggaggcagacaccauauuauacucauucuuccaccccucuccucaucccuuuggcgcauuguggggaccuaaugcuauuuuugaucaaauggcuaguugauucagugaagaagaaaagaugauguugguaauuugaucucuuggugagggccaguucuauucuuaucuaucucuaaacuuagggaccaacaucuucaggcaacauuucucaugauucacaaauguacucucaguaaguauuuaucuaaucuaaaucucuucacugcuugccaaucccauuuccauguguucugccuaauuuugaaugcaauucauuuaauuccuuccuuccugauaucuuuauuggacacugacuguguaaaaggugcugugccaugcugaggaaagauacaaaaauugagaggauuuggacuuugccgccaaagaaucuacauucuagauggcauuugagggccggagacuuccacuccugauguccauggcuuggcauuagggauuauuuuucugaccugaaucagaagcuagacugagaauuuuggagugaaaagacccuuggggaaagccccaagcccccauuuugcagauggggaaacugaggcccagagaggcgacauaucacaugacaaauuacaggcagaccuaggacaauaauggugcagggguugggguggggcugggugggggucucuggauuccuagugcaaggcacuuuguucuaaacccccuaucacccuacacaccucuuaaggaacugaacagcuaaacagauauguuuagcuggggcuuuggaauucaaaacucuuggcaauguaauggccaaaaugauuuugcucuuccaccuugcaccaauuaucucccuaaaggugcagauguacaucuuguggaaaaaugcaucccuguuuuaaguccuucagugguuccccucccuucacguuggcuggaccuugcuuuguuucaggacucugcccaccauggggcugaguaacaaaaguuuucaauucaguuugccuuguucgaaaaucaagcugucaucaucucuccccugcacaagggccacucccucuuaauuggucucccugccucagaccucuuucucccaaugaugcuucccuauauaguacacacccuuuccagacucugcaguccaggcugcagggcucugugagagcuggauuugucuuaucucucucucucucucucuuuuuuuuuuuuugagauggagucuugcucugucgccaggcuggagugcagucgcgugaacucagcucaccgcaaccuccgccuccuggguucaagugauucuccugcuucagccucccaaguagcugggacuacaggcacgcaccaccaaagccuagcuaauuuuuguauuuuuaguagaggugggguuucaccauguugcccaagauggucuccaucucuugaccuugugauccgcccaccucggccucccaaagugcugggauuacaggcgugagccacugcgcccggccucucaugucuuuaaccucuugaugcucuagcaauaccagauauucugcugcacagccaugcacuucuucaucucaguaccuuugcuuguccugccuagaaugcucugcucuucuccaccuggcaaacuucuacucauccuuuauuuuaaaaauuuuuaaaaaauuuuaauggauuuaggggguagaaguaucauuuuguuacauggguguauugcauauauaucaaugaagucugugcuuuuaauguagccaucacugaauaaugcacauuguacccaguaauuucucaucccuagcccuccucccacccucccacccuuccuggucuccaaugcccauuauucugcucucuauguacaugugugcacauuguuuagcuuaauguaaauaagaacacgcaauaauucacuuucuguuucugaguuauuucacuuaagauaauggccuccaguuccauucauguugcugcaaaagacaugauuccauucuuuuuuauggcuaaguaguauaccacauuuucuugguccaaucaucuguugauggacacuagguugauuccuugacuuuguuauggggaauagugcugcaauaaacauaugagugaagguaucuuuuuaaaauaaugauuuauuuuucuuuggguguauacccaguagugggauugcuggauugaaugguagaucuauuuuuaguucuucccaacucauccuuuagaacuugauuagguaugagccuuaccugcccgcccccgccaccagaaguuacuucugcuuuuccugggcuagguuagacaccccuggucucucccaugaaccugcugauugaccugucuggccaugcacucucccuucccacacccaccacuagacugagcuccuuaaaugcagggcaauuucucagucuuuccugcguccucagaaccuggcacagugacuagcacauagagacuacuuaaagaauaucuauugcacgaguaacuaaaccauuugaaauucuugaauuuaaugcuaauuaaauacacgccuuuuuuuuggcauguaauaauggcaccuucuuacacugauguggugcauucgcauuuucuuuggauggagcagguuauaggacuauaugugcagaagcugaaugauccaaacaggauagagauaaauggaugccuuugaaauauauauauuuuuuuccagcuaggaacuagaauauagcuguguucuggaagaagugaucaaaugaaacaagcucccuacaugccucucaggaaaguuauuucuuucauuuguaaugcagucucugaccuaccuuaugccacaugacuaggagugguguuuaaaccccccaaagggaaggcagaucuggcauuuaauaucaaguuacacaagugugcacauguugugcuuugauugacgguagaaucucauggacuuggcaagcuuuugugaccuguucacauauacauacacauacacauagacccucaggccacacagcauccugccugccccccaaaaagucaccccauaccuuggaaacacagugacagcaaccuaaaauggucaauggauuagaggaugcugaccaggcugcaauccccaccgccugacuucuaugugguuaaaaggugccuuggcucagggcuucuguuuaauuaaugugagucagcguuuguguaacgcuguguaagaggacugcauuucuucuggaagaagagggauaaaaaccugccaagugucaacaaacaguucuauaugcaucccaauuagggugauuucuggaaggcagcagaagcccaccacagcucugguuucuaggcaacugcuauuaagaguucugaagcucacuggaaagagaauauugccaagucugccuugcuaaggaaccuaaugcgccucuuccagacccccuccccuccccaccgccauucuugucuauuuaccccaucauauuuagaagcaaauuaugucuuagagggguguagaagaagcuaaauaucuucgagggcaaaagcccuggggaaagcucaggcuuggaaaaucaugcucuugauaguuacuguuucuagcucacucucugugugucaggcaggucucugaagccucacauggguuacaucauguaauuccuacaagagcccuacagguagacacuaucauuucaaagauggagaaacugaggcucacggauugaagccacuugcccaaagucacacuaugagaagguggcaaugccaggauuuggauuucggucugucugaauccuggagucaucgccucuuuaaaauaaauuuguuuauauuuaagauauaccacuugacgauuucauauguguauaccuugugacauuaucuccacaaucaagauaauuaauauauccaucagcugucauuguuaccuuuuuuuuuuuuggugauaagacaacauaggaucuaccugcuaagcaaaugucaaguauacaguaaaguauuguuacuauaggcaucaugcuguacauuagagcuccagaacuuauuuaucuugcauaagugaaaauguguacccuugacaaacauguccccauuccacuccaucccucccccaccccaccccggcaaccauucuuauacucucugccucgaugaguuugccuguuugccucuauuagacucaguagccacuuucuuuucuuucuuuuuuucuuuugagacagaguuucacuuguugcccaugcuggagugcaauggcgcgaucucagcucacugcaaccuccaccucccggguucaggcgauucucaggagccaguuucuuagccacugugacuuccugccaccugucagcacccaggcagcuacccuacaugagaaaacagaagcaaaguauugugcauagcaguuguucagcagucaguuuucaguucugagauaaaccgguucaauauguuuuuuucgagaaugcaagcuccacccugccaucccuguuauuaccuauugugcuuaaugacuaaauggaaugggagggauugcucuuauggaccugccauuguggauauagaaaaaugcauuagcagggagagaggcuuuuuccagggcacaccaacaauuuccaaauuacccccugguuuauaauuucaggacaaacaacagacaauggaauaaggcacaagaccaccagccugugaugguucgaucgguguucuucugccugauugauggcagggacugcucgcuggagacccacaacuccuuaggaauucacaauggcuccuucacuaagcaucaguacaaggggaagugggaggggucugaggcgcaaugcaguugcaaggagguguugucaaagcuucccuuuugaguuuacaacuugagucuugccugucaccgugcaaagagggcuuuugauugccuccuggacauggggugguuaccugacacucguccucacugcgauauauucagagggaucccagcagauguaaaaccucuuuccaggaccacgggccagcucucuuccuuucuuccagaguuugcugagcugugucaguaugaaagcuauucccuuaacugccugauccccaggauuaagcuaucgccucucgucuucuucucacauuugagaugaccuuaccucaauccuagcccagugccugacucacagcaggagcuuaguagaaggcacccagccuuccagguccuugccuguaaucaugugcagauugcuuucuccgucugggauaucuccaccaacucccugugacuuuuuaaaaaucugauuauugccuauuaucuuuucuagaccaaaaauauccaaaggguacaaauuaaaaaaaaacaaaaacaaaaaacuuacaggggccaugcaaguaaaagguaaaugaacccaaacacacacauccacacaggcacacacagcuuuuaaagcuauauccagugaaccaucguagacacucugacucauaauuuggccugugauucauucucucugucucccguccucccucucccucucccuuuuuuucuuccuguauccuuccucccacauccuucuguaaccuccccaucccagcucuuuaagcuuuuauuuuuaucuuuguauagcuaccaauaaagggcuguucaguuguacggccccaggggcaucauugacauuguacucuacaaauuguggcgacauucacccuugagcauauauugugaaugaugcccccuggaauugugcaaaagggcagucuugcccugaacauauacugcucccaucuccacccaauccuugugcuuguguaauaguagaccuucaggaaagguucaugagauuuaggaauugcucuucaguuaaugugcauuuugagcugucucagagcaaggauagagauucagauuccuguuuuaacuaguuguuuagauauggcuuuauuuaauggacuccuauguaagcuuuuuuuuugagacugucuugcaaaacaaugcucuauuugguuucuuuaacuuugcacccauauucugucaggaaacacuauuuauuuauuauuuuuaaauuuuuccauaaguuauuaggguacaggucguguuugguuacaugaguaaguucuuuaguggugaucugugagauuuuggugcauccaucaccuaagcaguauacacugcaccauauuuguagucuuuugucccucaccccccguccccaucccuccaaguccccaaaguccauuguaucguucuuaugccuuugcguccucauagcuuagcuugagaacacacgauauuugguuuuccauuccugaguuacuccacuucgaagaauagucccaaaucucauccagguugcugcagaugccauuaauucauuccuuuuuauggcugaguaguauuccaggaaacacucuuucgaagcuaauccaacccugaauaauuucuaaagcuuaacacauagucauagaugcugaagggucaggccauucacuuuuaaaaaaugggacacugcaggcacgaugacaucagaauuuccugacccccaaacucugucugccucagaugcaaccuaagggaacuuguugaagaauuguucucaacacuuugcagccugcuugauuugguuguccugcauuuuuuuuuuuuuuuuagcucagggcagaaaaaugcuucucagagcauuccuuuuuuuuuuuuuuuuuuuuuuugagauggagucucgcucugucacucaggcuggagugcaguggugugaucccggcucacugcgaccucugcaucccggguucaagcgauucucccaccucagccucccgaguagcugggacuacaggcaugugccaccauacccggcuaauuuuuguauuuuuaguagagacgggguuucaccauguugaccaggcuggucucaaacuccuggacucaagugauccacccaccucggccucccaaauugcugggauuaaaggcgugagccaccgcgccuggccucagggcauucuuauugacuuuguucucauuuucaugggaaauuuagggaagauaaaguucggguauauuuuuaagggaucuuucuauuccaguuguaugguaaagugcagcuguggugagguugaggguauuuucacuuuggggaaacauugccuuccacaucacuguucaucuauuaaaaugcuuuauguacuauaucugggcaccuaauagaaaaaaaaaagccauuuugcucuuccuguaaguuuuucagcaagaaagggccagaaaaucacuuugguuagacauuagagcaacuucccuuagaucgagcagggauaagguaucccauagcuccuaaagguagccucccuuguccagguagccugguuguccgggggaagguauuuaaucaaacgcucuggguucugagagcgaugaugguguggaucagcgagaugucagagaagaguggccagcguggucucuaagaccuuggaggaccuguuuuuguacagcgccaccuuguggccaugagaagcaauggcaguggaggacacagcgccaacuuucugugggauaacaaacuucagcuuauuagacaauucaagggaaagaugaggcuccuagagggagacucuagacuucccaugaauaauucacguaauggccuauggcuaacuggaaaaauaaaagaagcgagacuugaauuuguagcucaguucauguuacaaaagaaauggcccuuaugauguucuuauucacuuuucucccagugacgagacuaugagaaaggaaaggaauuaacucuuaucuagccuuuucuuuucccauugauucaagccauuggcucuacuucuaauaaauaguaauaagaagaacucugaugaugacaagagccaacacguacugugacaacucuauucuaaacgcuuucauuguguuaccuaacguuauccugaaaacgaugucugaaaaguaucuagcuguuugucuuucaaggcaaacaacaaacuauagaaccuuaaguuucuuagcuguaugcuuucuggcaucugauuuucccaucagacaggaaugagacaacuuugggucccugcacagauaauaagaaaaucucaccugcagaguggacagaguccugauggcauaguuaagcagcuggaauugagccuucagagauauugguguauguguguguguaugugugccuguguguaacacuuaugucaucugugugccagguaugugcauguuaacucauuuaauucacaacccugugaggcagacuuuauuauuguccccauuucauagaugagggcagugagacucagagagauuagguaacucauccauacucaaaaagcuaguaggugguagagccaggauucaugcuggcuccaaaagccauguuuuguucuauugccugugaauacauuaaaucagguaggugauugggaagcugguuuuaaagacaguuuuuguuuucauacacuuuggaauagagccgugaggaaauuaauaccuguugaaauauauuuguaagcaauaauuuggaaacaaugggguuuaaacugccugcuguuuuauuauuauuauuaucaugacuuugaacucuuguagguugcggguuggaaaagugacagacacgucccuuuccccacagugggcugcaaggccauuucccgucuagcaucccaguuguuacuccugagaacuauacagguguucugagguuagcuuggugagcuugugagauuucuggcuuuuuaauauaacuuuauuuuauuuuacuuuuaagcaaaaucaugacugcaaaauaucaguuaauaugacagagaagacccagacaaagaaguauucaaaggcuacagucuuuucaggaaaaauagaaguuuccaucuguauugaaaaaggcaaauagauuggagacauuggcaauuagcucaauggaguaaaagccaucagaacaaucauuaaugaaguugcugguauuaaagaaaaggcugagccuaggauguuacugaguaggacaaagacuuuaaauaaagaauccuacagguagaaagugauauuccugaugcacguuggcacugucuguguggcucagcugggcauugccaguaaauuuagggggagaguuacuuucaugaacacugucucuuuucauuuugcuuuccauaaacugcuuacuugcugcugaugacuacgcuaaagucagaagagcaaaaagucacgucugaaguacuuucagccucuuuacaccguauuucuggcuuuucuuucauuucuuaugagaaaaguuuauuuuguuucaggcauuuaugaaguugucagcaauggaagcaccguguaaauuuagacaacuucaguuaaguauugagagucuuaaagcugcaugcuuaaaaauuuaaacugguuagguaaauaaugcuacauucuuacaaugaaauagaaugcauccaugcaaagauaguuauuauguuuguguggauauuggauaguaaagacuuuuuucagauauaauaauguuauuuucguuaugguuuuaaacaguccuuaucuucucuaaauaguuguuuaaaauauuuacagauaaaaugauauaaugcuucaaaauaaugagagagaggauaaugcauaaaugaaaucagauuggcuaugauaugauuauugaucugagcaaugggugcauaggaguuuguuauauuauucuuuuucauagagacgugguuucgccauguugcccaggcuggucucgaacuucugggcucaaggcgauccacccccucucugccucccaaagugcugggauuacaggcaugagccaccgcaccuggcccauuuguuauauuauugucugccuuuguagauauuugaacauuuuuauacuaaagaguugaaagaaaugaagucacauauagcuguacauuuauugaggcugugaaagaugcucauaaucuuuugcuaaauaaaaaagcaaguagucuauacggaauguuuuuuuucuguaaaaaauacacguggauccaugaaugcauagaaaauuguugcaaguugagcugccaaaauaggggcuauuccugccugggguaauuauggauaguuuuauuacuuauguauacauauuaauugauauuuucuagcuuuucuagauuguauuauuugugcguuuuaaacuuuaaaaaaaaugggcuuggaaaacuggcaguaucuucuaaagcugagcauaugcaaacucuaugagccaauuauuucacuuuuagguaucuucugaaaagaaguauguacauauguucagcaaaaaaaaaguauaagaguguucauagcagcuuuauucauaauggcuuuaaaguggaaaugacccaaauguccaucaaugcuagaguggauaaguugugcuauccucacgcaauaaauacuacgcagauacugagagagaacagacuccaaguaauagagacaauauggauaaaucucagaaagacaauauugagugaaagaaaccagguacaauaagagugcuaacugaauaguuccauugauuuaaagcucaagacaagaggaacaaaucuaaauguuagaagucaggagagugauuuucuuugggguguuagagacuggaaggggacaugaggagguugccugggaggccuugguaauguuccuucuucugaugcugaugaggguuacauggguguguuuguuucaugaaaauguauugggcuggaugcugaaugauuugugugcuuuccugcauuauguuauauuucaauuaaaaguucaaaaaaauuauagagcuuauugcguguaguguccacucuaaguggugaacuggugcuuuaccgugcaagccugugguuacauccauuaguguaauggcuuguucaacaaucccaacaggaagagauuuaaaauuaaauaaauauggaaaucccagaugaacagcugcauuugcacagcuuccgcuuaugaacauccugacuccccccgcccuguaucauguuugcuucagcugucccuaaaacauggaccuccaaguuucagaauaugggguaucuggugaauacacuggaccuggugcugagcucugccugcagccccacagcuggggucagggagaaauuaaugagaucaugaucauauuguaaaauaguugcagccacucagggaacgugaaugauguaauacacacagccaccauuuaccaagcacuuaccgugugucagacauuguuccaagugcuuugcauguauuagcuuauuuaauccucaucacagccuugggagagagagugcuuugcauucuccacuuuggagaucagagaaauuaggcagcuuuuucaucgcugugucucagugugguacaccucuaaagggcaauccagcuucagagcugcccuugggauuggccaaggucucuuuguggcuccaucacaguuuaccuucuccuucugccccacucuguauucccacucccucacaggugucgauccugagacuacuucccgguaaaccccugcacacaaacuuccaucucagaugccguuucccugggaacccauccuacaacacauacuaaaugucaauggauuuuauauucagauuuuauuuuauuuuacauuuauuuguuuauuuauuuugagauggagucucacucugucacccaggcuggagugcaguggcgcgaucucagcucacugcaagcuccacuucccggguuaacgccauucuccugccucagccucccaaguagcugggacuacaggugcccgccaccaugccccgcuaauuuuuuguauuuuuaguagagacuggguuucgccguguuaggcaggauggucuugaucuccugaccucacaauccgcccgccucggccucccaaagugcugggauuacagacgugagccaccgugcccggucggauuuuauuuuuuauuuuaauuuuauuuucaguucuggguuacaugugcagaacgugcagguuuguuacauagguauacaugugccauggugguuugcugcaccuaucaaccugucaucuagguuuuaaguccugcaugcguuagguauuuguccuaaugcucuccauccccggccccccaccccccgacaggccccagugugugguguuccacucccuguguccauguguucucauuguucaacucccucuuacgagugagaacaugcgguguuuggcuuucaauuccuguguuugcugagaaugauggcuuccagcuucuuccaugucccuguaguuauuuuucccucauugggagaaucauccaaggugucuagucggcuauauggccagaaauggaggucaugccuuaaugacuaggaaaugcuggacuaccuauauuuaaguaggcuucuuugcuauuggacuuuacugagcuugaaaauaucacugugcacuaagagucucugggaugggggugcaguucacagcauuucuuaaacaucugugacuacagaacacuuuucuucauggugcauuuuguaggacaggugaccugcucaguauacacugggaaacuucuuugagcaagaugaccuguuugcuuauggagcuaaaaucuaauuggucucuuuaaaucauuggcucucucuguucaugacuugggagaacagaggucagcauuguugcaacaauauugaaaaugauaaaagagggacaauugccauucgcugucagcauuuuaucuccugaaauuuccuuucugacuguagcugaucuggacucucccacugguaaauuaaggauguaaaugaaucaaauucugaccuggguacucccuucuccccuccaggucuaggggaguuacauauaguguggagucuacuuuggauaacacacacacucugucucucacauguguguguguaugcaugcacgugcacacacacacaaguuugaucaacagaauaaauucaccuaaggacccauguagcuaaguguuuccuagggcaaugcagggacugagcuaacucuuuuuuuuuuuuuuuuuuuuuuuugcccagaaaagggauguauauacuguuuguacucuacagaguaagaucucauccugcaucuucaaugaugaggagcauguauucucaugguccaggaccauggaagccuggagagcagaagaugcuggagugauguccucuaguuaauuaaagauagguggggcuacugggcucugaauuccuuggccucaucucuguucuccaggcauuguaggaucuaagaaagggaagcagaacggggguuuuuauguacauuaucucauucuguccuuauucagacacaaaaaucccuguaggaaggcacagucccaucccaagaggagaaacuaaggcucagagaggugaaaugaccagcccaaggucacccagcugacaggagucugguugagucucucugucugcauagcucauguucuuuguugccacccaugaauauuuucagauacuuucaagacagcuagcauaaaaaagacagugacuuccuuuuauuggucuagucauauauuccucauccauauuguucucaaaaaucccaacaguaguguggaauagaucuuguuaucucucucucccauaacauagauaaaguaacugaggucuagagaagugaauucauuuguguacagccacccagcuaauaacuggaagaguuaggauuugaacccacagcugacuccaaugccagaagacuuuugacuaugcucugugagccugccaagccuggcuauaaaacugagcacauugcuugucaucuggaaaagaauuuuggaaaacaaaguuuugugcaaagcccuguguaacaaaagguucagaaguucaaaauauuuuugaugguuaaauuugaaagcauggucuucuaguuaaauucucuuuuacuggggucuccaaggcagacuuugacacaaggaaaggaauaaaaaagauauuuacccucaggagagaguaguguaagaaaggcagagaaaaaaaacucacccuaaaacuaugguuaacuacaggugucaaagauacaugaagauaccagaaacagagaaaaauagguagggccucugggucacauccaagaugauaaaaccgcaauuaacuugagacaggucccuccaacccauagcagcaaccuacccauggggugugcaguuguguuuaccaguucugggcuaagaacaugaggucaaguguuuguccuuaugggacaaacuagugacucguuaauggccacuugcugucugcagggugugaggaagaugugacucaagaggacuaaggucuucuuugaaugauucacaagauacauuucagaagccuuaaccaugccugcuuccaagauauugaacaacuuauaaauccaugaucuuaaacaauccuggggcuuugaggcaaggucucaagucuaggggagggaauggugggaagaaccaggguugaacuucuaaaugaaguucugggcuacuggcuauggaugugcgcauccugaguguugaacgaugagaugcagaagcgacugagagcggucaguaaaugccugagaucaacaauaauuuuuccaacuacuuaaauucacuuaaaagcagccucauucauaaagggauuugggugaggucuguuccuccugcuggucccucauacuccaagccucaauuugaguuaauaagaugccacuauagauaucaaaguuuccuuuugagauuucuaauuuggagaugacaaagaaauuaaaucccauguaaccauucuacuccauggugguagcugccuggaaugcuaggcugagaagguuuuuagaaaaucuggguucgaauaaaagagugcugugauccauuagcgaugucugcccugggcacaggagagagaagugggguacaugugccacaugacugucaucgaacuugcauuguuucaaugcaauuauuaguuuuuucccuucuuauuucaaaaaaaguuaggagaagcucacccuaccugccagccaagacacaaaccauaucucaaagugaccaugauuaacacuauuaaacacuauuaaugcaaaaagaagcccaagaaauagggcuggugggaugauaaaagugccacaugucuucuugauuucucugcacuuuaugaacaaggaaaucauuuuuguugggcuccuugguuggcaaacuagccuacuggagaggugauuauuuuaagaguacauaauggagucauaagggauaugaaaggucucauggaaauccaagaucagaaauucacagagagaagaacuggagauuuucuauagaagauagcuucagggaccugaguaaugcaguuaaaaguauugguaucacucggccgggcacaguggcucaugccuguaaucccagcacucugggaggccgaggcagguagaucaccugaggucaggaguucaagaccagccuggccauggugaaacccuaucucuacuaaaaauacaaaaaauuagcugggcaagguggugcacaccuguaaucccagcuacucgggaggcugaggcaggagaaucgcuugaacccgggaggcggagguugcagugagccgagaucgugccauugcacuccagccugggcaacaggagagaaacucugucucaaaaaaaaaaaaaaguauuggcaucacucaaggggacucgcuugcuucucuuugcuugcuguguucucuaauuuccuaguuggcuucuucuccaucuuuccuuaauuuaaagcaucugcucaccuauagucauuguucccuggaaccucuggcuccaaacagcucaccauggacccucuggcaucccuuucucuuaguguuucaaccucugugcccacugcugucugcuuaaaugaugugcuuuccacuuuacauucccaagagugagacucugauuuguacagauuaucuaaugaugcuagcucaugucuccaaggccagugcagaauuagcuguaugauugugguagacugaaaaaauggacccaaaucuccaucauuuguagugugaauuugcagcuguucccgcugagaaguagaaucuauuuuuccaccuuuaacuuggucuggauuugugacuugcuuuggccacaagaauauggcagaagugacauuuugccaguuccuaacuuaaagcucaaaagaucucacauacuuucauucuuucuuaggacuacaaguccuagcugaccuauuugagagcaagagaccauguuguucugcccaagacuauccuagaccugccuagagccagcugaccuccaaacauaugagagaauccagccaagaucagcaaaaccaccucccugauccucagcugauuacaggugcacaagggagcccaucugaggcuggagaaccucccaguggaaccauagccucauaaucacuaauaaaugcucauuguuuuaaguuacugaguuuuggggguaguuuguuaugcagcaacagcugaccgauacaaugacuuugaguagaucucugaacuucucugaaucuuaauuuucucauuugaggaauuaaucaacaagacuuuuccugccugccucggggaagauuguaagaugcuauguaaauauaaacuucagaauauuuacuuagugcccacucugugccaagcacugagcuagacccuggggauuugcaagacagguuaauucuuuuguagggcaacauuacuaccuccuccuuccagccauagaccagucaucgauaagucaaaguggacacuccuguuugaauggcaguggaaaaggcagaaguuaucaggcucaccuggaaggccuaaagcaaugggcuagcuaucuuaucucuugauuaacccacaguuuaauuuauaagcccccucacuuauucacuuucccuacuaagcuaauaagccuucccccuuauuucaacugauaaauucuagagauggacaagauaauuaauucaucccaucaauaaacacuuucuugggaccaugacaguggacaugacauggugccuacugugagaucgcucacaugcuagugugagagauggaaacaggucauuguagaauguggaugcacaaugcagccuuuuccuuaggcucccacauccaauccauuagccaguccuguggcucuaccuccaaaggaauccugaauccauccacuucuccccaguucacugcuguuucccucauugaagccauugucaucuuucaccauagccucuaugcaguggaugugaugcucuuuuaaaaaaucagauuauauccaucucuugcucagaaugcuccugugguucuuguggcacuuagauucaaacccauacuuuucaucgcagccuacaaggcagcgugugggcugagccagcucuuacccaacucuucaauuuuaucucuugucucucuuauccucucucacucugcucuggccacccagcucaccucaguucuuccagcauuuccagcuuguucugacuuugguacccauucauuuauuguucucugaaauacaccaccuuucacccugcuaugucuuuauugggaugguucuuucucacuauucagguauugggcccaggguucccuuuauaaacaacucuugucugauggcuguagcuaaagcagcagcuucuucaacaccacuauuuauacaucaccugguuuuagauccccaccuucaaauucugcuuauuuacuuguuaauuugauuguuguuuuuaccucauuauaaugcaagucgucaucucuuauucaucaaagacaggagucuugucuguuuuguucaucuccaauauauacagcaaugccugguguacaccuggugauaucucauacucaauaaacauuugucaaaaaaaaaugaaugaguacagagggcuaaagaaguaccaagaagaagugccuaaccccccugccaaaaaaaaagaauagcuucuuucucugccccaaauuccaccuuuguuauuucuaauuacuuugcuucagcugucuaccaaacacagcuggaaagcaaagucucagaccccuuaaacacgugcaucaccuggacccugcuggggguaggggagaguggauaauucaucauuguuuauuugcaauugccuggaccuaacuaaacuuugccaaucacggcuucauguucaacauugcaguuguuuucacugcagagauguuuauuuuccuuaaaacauucacaauaaaaagcgcuggcaccuuugcaggaagguacgucaucgcacuucaagagucagccaagaacugggcacaugcaaagagacccugauugucaacuuccgcuagaaauucaccaaguuugugccuagggugcugcuuagugccacugaacaucugacggaacaggcgaggaggaaagcaguuagaaucuuauucuuuuuagcaucagguuaaauuggccaugaaaccagggacggugccauugaauuacaagagggcuaaaauauuaaacaaaaauccaagagacaguaaaauaguuuggcucaaggugagcuagucuccaacaggaggggaaacaaaguuaagaaacaauggauggaaaagucaacaucaucuuuguuaacaauucgccucauuuaauacugggauauggggucagggaguuugugccacuuggagagaugacuucccuuggaaaacaugguguuuccuucugaaggggaauccugauuccuuccuuaauguuggugggauccagaaguguggccagauggaacaucucauugucguuucuuucuugcuugcuuguggcuucucuguuuggccuuuuccccauucuccuuuguguccggcagugggagaggcuaaggguguccgagcagaacguuaaaucucagcuuuaacauuuaaugcgucuguugggagugacagacucagcugaccaacugaagaguggcagaacaacuguugccuguaucaccuuuuauuaauaauuaauccccucuauucuacugggucugugggaaguggaaccuuugucguucuuggggcacgucccccguggugugcuggugaauguuuaacaacucucugucgggggaacugagcccugauuuguaguguuugcugauuuccacggugcaaauauugucaccguggugcagauauucccaccaguugcuuucgagcuaccaaaguggugacgucagugaacacagagcugggaagagauuuguuguagcacuccuuauauacuauuuccaccacauagauacuacaaccauugauagccucuagggcauagagauuagcaaacuguauaaaacaauuaggaagguaugaguucuaaguauuuauuaccugugcuuuaauagaauuuauuuaauuguacuuaauuguaaauucauguaauuaauuucuaauaauagcuguguuuaacgaucgguuugcaauuauagauauacauuuauauaauuaaucuuuaacaauagcuguguuuaauaauugguucaauaauuuuccacugaaaauuuagcagugggcucuaguuacaagcuggcaagccacugcuuugucgcccuccuuaggcugagucaagucuaggucaaggcaucuauuggcgucuaucucaucaacagccauuugucuacaguguacagauucuuguggagacccucauuccucaggcucuagagauucugacaugucuuugcaucuggggcucuuaguuggccucaucuaccugaaggcugauaauacucagcuaguaagaacuaacauggucaugaugguuggguauggccagugucuguuaugacugauugaugcccaugaaauucuguauuuggaaccucucuucugauccaacgucccugcugcaccauuccuugugaagccuggaacaucucugggcaaagcuguggaacagagugcaauucccuuuugggaggcucaucccucgccaugccaucuucuuucucagcugccugccacaguugcugucccuacucagauggcucuuggcuucuugauccuacaugucaccagucccuggggcuccaagguucccaaggcaucagccucaaaagcccucuaacuuggguucaaacacuguagaugaaacugucauugcaaaauuguaacagacaaugaaagauaucugacuuuuaacgaacuccaucuugcuucuaaccuccaagcugucauuguucauuccugggcguaagcugaacuaacuuuggaggaacuuaguuuaugguuuaaaaacaaagggccgggcaugguggcuuacaccuguaaucccagcacuuugggaggccgaggcgggcagaucaccaggucaggagaucgagaucauccuggcuaacguggugaaacuccgucucuacuaaaaauacaaaaaaauuagccaggcgugguggugggcuccuguagucccagcuacucaggaggcugaggcaggagaauggcgugaacccgggaggcggagguugcagugagcugagacugugccacugcacgccagccugggcaacagagcgagacucugucucaaaacaaaaaacaaacaaacaaacaaacacaaacacagaaaaacaaaaaacaaugacgauaacagcccucucucaaaacaaaccuccuuuuugccuggggacuagauugucuuuguaggacuaaaaaacuagccagaagauuagaaauuaugguuuaggagucaugcagcuggagacugcaagauucugacccucccuaaaccgcuucuaagaucagugcuugagauauuuugcggacccuguacuugauggaucagcuggcaccaugcagacagauaaacuggcucaucuaaucuugugguccccacccaagaacugacucagcacaagagaauagcuucaguucccugugauuucaucucugacccagccaaucagcacuccugacucacuggccuuccuccacccuccaaauuauccuuaaaaacucugacucccuuaugcucggggauacugauuucaguuauaauaaaacuuuaaucucucacacagccggcucugcgugaauuacucuuucucuauugcaauuccccugucuugauaaauuggcucugucuaggcagcaggcaaggugaacccacugggcaguuacaaauucggguaaggugaauccacugggcaguuacagagaggccaguaugucugaaacuaacagaggauccuuguggcucuaggcccucaauuuggagauccaaguucaaaugcugccuuugagcucagcucugcaaaggaauaugagacugagcccugcuggccucuuugagcuggaucauucucugcaagaacaucccagcauugacucuuauguauugucucuuacguauuagucugcuggagccgcccuaacagaauaccacacccugagcagcuuaaacaacagacauauauuuucucacaguucuagaggcuggaagcugaaggugcaggugccagcagggucgguuucuccugaggucucucuccuaggcuugcagauggcugaguuccugcuauguccucaugugacucaugugacuuuuuuuuuuuuuuggagacagagucuugcuguguugcccaggcuggagugcaguggcaugaucucggcucaaagcaaguuccgccuccuggguucacacuauucuccugccucagccucccgaguagcugggacuacaggcgcccaccaccaugcccggcuaauuuuuuuauauuuuuaguagagacaggguuguaccauguuagccaggauggucucgauuuccugaccuugugauccgccugccuuggccucccaaagugcugggauuacaggcuugagccaccacacccagucucaugugaccuuuucucugugugcuuaugccugaugucgcuuccucuuucaccaaucacauuggauuaaggcuccacccuuugacuucuuuuagccuuacuuguuucuuuaacgguuguaucuccaaaaaaauuacauuggggcuuaggguuucaacauauuaauauguguguguguguguauguguguguguguguguguguguguguguauguguggcaggggcacaauuuaguccaugacaauuacugggcacuugaaauguuacuggugcaaauugacacguguucuaaguaugaaauacaucccagaucuuucaucauucauuauuuuucaucccuucauuacuuuucaucauguaugaaaaaacauaaugaaaagcaucucaucaauacauuuuuaauacugauuacauguugaaugauaauauuuuggagguacugaguuaaaaauauuauuagaauuacuuucaccuguuucuauuuacuuuuucuaguguggcuacucagaagcuuaaaauuacacacaaggcucaaauuauauuucacuagacagugucuagagacccuccaauagcugacacagccacccccugcagucaguggggcacucucuucaccucuccccuaggcccuuuaacuccuuucccuuccucuaccuuccaggaguccuccugggcucagucaucaguuccaugaaguugugcugcuggauggggcaggguggagauuccgguagugguggagaaggguggcuuucagaagauggaggugaagggagagggugucucacuuugccucucacugcaucuggcucagagugggagaugucuaagaucaauagaacuuccccgcuaccuagauuaccccucucagcacacaucuuacguguuuugugcuaaaagagucuucaucucuuacucugucuugaguugcuuuaccaaaagucucauuuuaggauccuaccuugggauguuccaggucucaggaaacaguuaagggguaagggaaaaaaauuccaucucacuagacagagauggcugaaacaugguccugggccucagucaucagggaggaaaggaauagggagugaggagaggaaagauaggaacagcccuguauucaaggccauaugagggacacuuuaucugcuuuauuucccucgguucuucuaacaaccuccuauuauucucauuuuacagauagggaaaaagagucccagagaguuuaaauaacuccuccagcaucccagcuagcagguaacaggaccagaauuugagaacgacucugacuccacgguaucaucacgugugucuggaguaaaaaagggaagguuuucuggagcauggggacacucucuugaguuggauucagguccaggaagaaaagcagagggaauucuaggcggcuggaggcuggcauggcauggguacucccuggaaaguccagcugagaaagcgauccugcccucugcuccucccaggguuacccuccuguaagucuucugcuuaguguucagaauugggggaugcugggacugggcaaggacuuguaggcaacaccccauagccugcucaugccuguuggguugucuauggaucauucccugcugggcucacucaccggcuucguauaagguccuuuuugagguuuauuauuuccuuguccauauacuugaugcucuucauuggcuugucugggaccugaugagaagacaagggguuaaaauaaaaggaguguuaauacaaugcuuccaaauggagauaggcacaggaggcucauggguuucucugagauguauggcuagguuuaaggaguccugggcagcacagagucuaccuugacaccaaagagggggcugcugugugauacaguggacaugguaaggguuuuggagacagauggaccugagcccugacccugguucugucuggugaccagcugugugaccuugaacaaauuacucaaccucucugaagaauuugggccucaauuucuucaguagaauggggaaucacuccuacucuguucugaggauuaaauuaauugcuaaauuccucacugauagcaagcauuagauaaauggaagcuacuacuauaagcauuacacuuuagagcaaaaaauuaggcauuaaaaauaauuauuauuggugguuuuagcaguugauuuggagagcugaaucuugucaauguaaagaugcaaauguacuuccccucucuuccugcucccauagcggagguuuaugaaugaauuauccagauaauuguucguggguuuuucuuucucccuauuaauuugccuugucuauaccuaggggaaaucucacauuacucagaaguugauacaugcucaauauaaagaagagagauaaauuaacuauauuauauuuuuauuuauuuuuuuuagagacaggaucacacugucacugaggcuggagugcagcucacugcagccucgagcuccucggcccaagugauccucuugcuucagucucccaaguaagguuaggauuacagguucaagccaucauacuuggcaaauuauauuuuaguauaaaagucauuuuucucaaccugcaguuuggagaaacaauaaucagaauauuaccuagauuaucuugucuugaaauuuuccugcaccuuaggauuuuuuuuaaauaaaaaaauacuuagaaauuaugggaaaaugggugcucucagauaaaucugguaaauacuuugugcuggcauuucagaagggcaauucucaaugcauaccagaugcuuuagaaaugagcauguccuuagauccaacaacucugcugucaagaauccuaaggaaauauccuuucauggacauagagauucaucaacaaaacuguucaccagcaugcugcuuguaauagcaaacuauuggaaaacaacuuuacaucucacaauagaagacagguuaaauaauuaugguguaucuacacaauggaauacaaugcagcaauuaaguauaacggcaacauaauguaaguauguuuauugauauauaaagauguuugauuuuuuugagucaaaagacauguuacaaaguaauauuuauagcaugauucuauuuugguuuuugaaaaaugaucuguguggauauacacauaucaaagauaugaaaugacauagcuccaaaaugcagugauuuucucugggggugagauuauggcagguuuuauuucuuuuucuuagcugaugugcauuuccuauaacuuugcaauaaauauuaauuaguuacauaaugaaagagaaaagauuuaaaaaguaaacagcaaagugaaauuugacaaaggcugguugguaguauuguacugagaguguuuuuugaaggcagggugagaacagguuggcugcucacuaacagaaaucccaauauugaugugugggaggaggcaaaguguuuucucugcagucaccaucaaugaaauugggcuauggugccuacugcucugaggcuuugaaguguaaagugaaaguugaaaagcauuguuguuucaaaguugaaugaugcuuguggaagaguugggugggaggcagagugggagaugaaguggaggaaggaacugcuucuggccugcuugauuccauuuuucuccuggguuggccaauacauguucccauguaaggcagcacagaugaagggugaagagucuauggcaauucuacaaaguauuuguaacugcagcuauuacuugcccacuugacaaaguggggccaggcgcaguggcucauguccguaauccuaggauuuugggagguugaggcgggaggauggcuugagcucaggaauuugagaccagacagggcaacaugacaaaacccugucucuacaaaaaauacaaaaaaauuagccaagcauguguggugcaugccuguaaucccagcugcucaggaagcugagguaggaggaucgcuugagcccaagaggucaaggcugcugucaccugagaucgcgccacugcagugcagccuggugacagagcgagacccucucucaaaaaaacaaaacaaaacaaaaauaaauaaaaauaaaagaaaaaagaaaagaaagcaaaacauaaaggaugcaaaacaaaacaaaacauauggauggcuuugaaucaggccaauuggauaggaaacaaugaaauaauuuaaaaacugucucuuuggcuauucuuaguaaugaauuacagguacuuuaucuugcucauuucaguauaccagggggccucaaccccuuggcuggaaauugauggcagacccaucaguguucaucuugagggaugggugaagcggguggagagaccacccucugaugaggcauguaaggaacucuaggaguacuuucccaugcuuuugcauaaugaacauucguuugucucacacauacaacaucuguucacccucccuguugauaccaguuaguucccugguuaggcccuuugccuuuccuucacucagcacuugcaucuugggagaugcucaugguuaccagcagcaggggaggcccugaaugacugaagccaaacagcacaaaccauccccugucaaagugguuaguuuauggauggucaugugacccaguuugggcaaaugagaugcaagcauuuucuaggggcuucugagaagcacaggcagagauguucucuuuccuuacugacuagaaauggggaagcagagagccccugcgaguugcuugcagccauuucgugcccaugaggguagccagccuugggcaaagaugauauggaggaaaggcagagaagagagucagagaaaaacucguuccacggugccuuguugaacugaucaagcuucacuggaaucuugacuuuucaugaacauuuccuuuauuauuuauaacagcuuaaauuagguuuucuguuaccugcagccacaaaauucuaucugaaauacaucccucucuugggaguggcaaaacagcuaagagacugagacuucuuuuaacuaguucuuuuucuuuucccaacacugcuuuugagguaucaagaucagaugacccccauucugguguauuuuauagugaaagcaaugagauuggccauguugagaucaaauauuugaaaacaagguugccugucuuucuaaucccacuuauuuuggagaaccucauuauauauuuccugcaggcccaaaguaacuuuccaaaaagaugcugugaacuaagcauauuuauaaaugaaggaaaaauaagcacaucagaaauuuuccugccagauaauuugaaaacacaugauugaaacccuguuuuaugccacggucaugucuguaccacucuccuaaacauccuaaauuuuaccuucuucaugaaacaacuaugauaauguccaacauucaagcauuuuuuuuuucaaaugucaccuaaugauagcugccugugcaccaggaauucacaucauuguguaagaguggauuuguauugacugggauugguacugaauugcguccucaacuugacaccgacuuuagcagcaugagaugcacgcacccccaagccucacaacuaugucagcauuucaauggauucucaggaaaccauuucugucaaaguauaauuuuauaauuauaaagguagguuuaugauuauaacuuuauaauuauaguuuuguuuaauuaaaauuauaauaagccagcagaaauaacuaguucucaggacauuuacaaacaucauuugauauuaagugaaaaauaauaaguuaaauuaaaaguuaauaaguuaaauaaguuaaauaguagauuaaaaaguuuauaaaacauucaaaaaucacucucucuacaaccuuucuagagggcaauuuagacauaugugugacaagcuuuagaaauacauauccucuugccccagccaaggaaauuaugucgccaggaugaagagauuuauccccgaggauguuuaucacagcagugugaauaauagugaaaaauaccuaaaugucccaccauaggcauuguggggauaaaucauggucuauccagacagugguaugugaugcauuugagucuuggugcuaccacuuagugcugcuauggcuguuuauucacuaauguggaaaggugguaauggaauguaauuucagaugaaaaugcaugcuacaaaacguaaagauaguagaucauagagaagcucuaagauuuaugcuuauaaaaucuauagacauuuccagaaauguaugugaucugauacaaauuagguuuuaaaauauugacauaugacaaggcauauauguacuaauauaacaagcuggaaguaaauacaauaaauuguuaauagagauguuaucucagggcauuugaauuauaggcaauuaaacgauaauuuuuuguuuugguuaucuuuuuuccuaauuuuucuacaauucacauagauuaauuuuaauaaaauaauagcguuuuucauguuuguaaagcaauuuugacuaauucucucaaggcaggcaaaguagaaauguuuaaugccaauuuaaauugagucaucuaagagucuggaaugauguaagcuaauaguuuauuuuaacauacuggaucaggcagggucuaggcaggaaaucagaacucaugacagguaguucaacaaagggaauuuaauacaggggagugguuacaaaggugcuggaagagcucaaaagucacauaaggaaugaugaggcaagcuagagauuagcaaaaggaaaccucuaccaucuccagggcuggaggaauuaagggaagaagagguggccuucagaagcccuggaauagggccacuuggcauaagcuagacucauggaggagauguaguuuuagcuagaggugccaccauaagccgaaugagagaagggaugaaaugcccuggcuucugcuuaacucucacccuucaguuccugauggugccugcuauuggcugaaccuacuuggaagccagcugcaagggccccugggaaauguaguuugcaaggaucagcccccggugggagcaggaaauggaaaugagagugaaagcaaguaauuauggguacaccuuaugcaaaugucuuggccccaggccacuuugggacuauaaagcagguccuccccuuaaguuaaucaaggaucccuuuacagaugauaacuuuggauacuccuuuugaucuuaugccugagguucccagaguuuuccauggcuaaaaugcauauccagaauuguggucaugcgccucgcccccccaaaaauugucauaaaucacgauucuaggguauucagaacccuccuacuucuccaaauuucuccagaucuuuguagaucaacucccuucccaucaaaacuuaccugcucuacuucccauacuguuaggucuuuauacuccuugcugacacucauucaugugucucccuaccccgguaacauauuuguaauacaaccucauauuuaauauuuuaaucugguuuugacauuaaugaacauuguguuauguuguguuggugcaaaaguaauugcaguuuuugccauugaaauucacuugccauugaaugaaugccgaaaauucauuugccauuaaaauggcaaaaaccguaauuaguuuugcaccaaccuaauagaaaaucaggaaaagauaaaaaaaauuaggagaaaauaaaaaccaagcaaaaccccaucaccaucugauacgguuuggaucugugucuccacccaaaucucauguugaaauguaauuccuaaugcuggagguggguccuugugggaggugauuggaucaugggggugguuucucauggguuaacaccaugcccccuuggugcuguccuuucaauagugauuucuugugagaucugguuguuuaaaaguuuguggcaccucccccaucucccucuugguccugcuccugccauguaagacgccugcucacacuuugccuucugccaugaguaaaagcucccugaggccuccccaggaccagaugccagcaucaugcuuccugugcagccugcgaaacugugagccaauuaaaccucuuuucuguauaaauuacccagucucagguauuucuuuggagcagugugagaauggacuaauacaccgucucugcagauauccuuuguuuggugcucugugaugacucccaaccugguugcauaaaagccaucuuggggacaguugauuuugauuuucugucuuugcuucccuuggaugugccauuggcuucagagcuuucaguguuuccauugcucugcagagcaccggugaugacuccguucuuuguuuccuagaaaacaaagucaagucucugcccugcccaccuuuccuacagcaugugugaacagcauccuuucucuuaucgacccaaugaguuuuugagagcaagaucgucagaaacaccaugugaugucguguaauguaccagguuaaaaggugguaaauggaggugggguucugggagggauggagcacgcauggacuaacaguggacucuuagauggggaugguuuucuuggcagauauacucacauuuaauauucaugugcuggggcuguuuaaauaguagcaucgggaaguggugugguuuaaccugacagcugagaagugaaguguggcaagaauggauggaaagacguuugcugucagaaagaccuagguuugaguccuggcccugucacucaggaguucagugaccuugagugagguaacuuuacuccccagucucaguuuccccaucugugaaauggaacuaaugccaguccuaccagaacuaaugccaauccccaucugugaaaugggacuaaugccaaucuccuaugugcucugcacugucccaagugcauucuuauaugaaauagaugaguccauugaguccuugccauauuauuauucccauucuauaggacagcaaauagaggcuuaaaaaggugaaacugacuugcuauuaaguggcaaagccuggauuugaacucauggucaagugacauugacgacuguguucuuauucacuacuccauucugcacccccaucccacuuugcccuauuuugcauagugggaacuaccugagggguagcgguugcuagcuauugauuuacagauacuaccuccaaaacucuuccacugaauuuuguuagauuucaucauaaagaauuuaauauggcagaaaaucagaaugauuuguuggaggucauggccggaaagccaauuuucuaaauaucuguuguucucuguguuuuaugaaagaauguucugaacucaucuuuguuauuccuuaaaacaugaucuacuuccuagaauaagaugaagauggaagugaauuccuguuaaaugugcccgggcugauacagacaucagggaaacagcugggaugcuccgucgaggggugagcggggaagggaggcugaaaagacagcacugagaagcgagcuugcugauuaacaaauuucagacucauuauggagaagcuguaaagaacagaguaggcgggaucauggcaggaguacacacaugaacccggagaccuuagcuugcacacggauguuuaaguuuuuggugguuuuaauauuuuauuuuuuauuuuuguggguacauaauaagugcauauauuuacggaauacaugaguuguuuugauacaggcauguaaugugaaauaagcacaucauggagaauggggcaucuauccccucaagcauuuauccuuugaguuacaaacaauccaauuauacucuuagucauuuaaaaagugaguuauuauugacuauagucaaccuguugugcuaucaaauagcaggucuuauucauucuuucuauuuuuuugguacccguuagccauucccaccuucugccccccaucccccacuauccuucccagccucuaauaaccauccuucuacuaccuauguccauuaguucaauuguuuugauuuguagaucccacaaauaagugagaacaugugauguuugucuuucugugucuggcuuguuucacuuaacacacuuaacauaaugaucuccaguuccauccauguuguugcaaauaacuggaucucacucuuuuuuuuguagcugaauaauacuccauuuuggugguuuuaugguguugauaggcaguuccuuuuggggagagugagguauuuuuuuugucauaagaauguaagauguguaccuacccacauagagauacccagaauuagugaccucauccacacacagauccuucaaacugaaauaggaaauauacuauagaauuacuuaacaggccgggcaugguggcuuauaccuguaaucucagcacuuugggaggccgaggcggguggaucacgaggucaggaguucgagaccaucccggcuaacacggugaaacccuaucucuacuaaaaauacaaaaaauuacccaggugugguggugggugccuguagucccagcuacucgggaggcugaggcaggagaauggcgugaacccaggaggcggagguugcagugagccgagaucgugccacugcacuccagccuggggcgacagagcgagacucugucuccaaaaaaaaaaaaaaaaaaaaaaagaauuauuuaacaucucuccuuguugaagacagguugcaucuuuuauaggaaauuuugauugucagggagaggugguagaaggagagacugucaucuggggagacgagcaaguccucuacugagaacuuaggggagacaaagcagcaggaguccucugggaagaagaggagaaggaacaaugaucccugggaaggaagcuucugauacucagcacaugguacagggccuggcucugcauucuuucugucauugcugaaugaaugagaagaugaaugcaucacagucucaagguuuaaccccacagguuaaugauucguuacaaaggaaacgagauacccauauaacggugaggucuggcggacaccacuuuaaccaucauggcuaugcuuagcaucaccaaugacaggacaaacucuuaucaggugaaccugaagugaugcacugggaagggcacagcaucgccuacaugguuacaucaccuacauacauguccugccccagagguccaaucugaaucuaaucaugagaaagcaaucagaaaaauaaaaagugaaggucauuuuacaaaauaggugaucuggacucuuaaaagaugucaaugucugugucuguuggggccucugggaagcagacacggagaaaggacuacaaaaugcucauugcggguaagcccaugaaagagaaaaggaggaggaagugggauuuggcaggggagcccuagaccaugaugcagaucugacagaguccagccaaugcaacagggagauccagagcaaagauugcuugauugagcccaagcacaaggcagaaauggccagugcccacugauggggaauuucuggggaagcuucugacuuccgcugcaugaaagcugcuguggaugcuggcggugucaacagcuggagagucucagcuaccugugccgccugcuggcaaguucuuucuuggagagaaguccaagggauacaccucuuuguauucuaacaaugucauaaaagaggaagaaggcagaagaucuguuucucuaggacaccaaggggacacaacaacuaaaugaaaugcauggucccuugauugaaugcuggacuggagacaaggcuauaaagggcaugacugggauaacuagggacaucugcacaugaacuuuauguuagauaacagcauuggggcucacgccuguaaucccagcacuuugggagguugagguggguggaucaccugaggucaggaguuggagaccagccugaccaacauggugaaauccugucucuauugaaaauacaaaaauuagcugggcgugguggcgugcaccuguagucccagcuacucaggaggcugaggcaggagaaucacuugaccccaggaggcagaggcugcagugaacugagauugcgccacugcacuccagccuggggaacagagugagaccccaucucaaaaaaaaaaaaaaaaaaaaaaaaaaaaaaaaaaaaaaaaaaaaaagaaagaaagaaaaggaaaaagaaagaaaaagauaauagcacuggguuaaugugaaauuucuguguuaacuguauugugacuaugaaggagaauguccuucgguaauacaugcugaaguguuuaggugugaagugucuguaacugacuuucaagaggcucagcuuaaaaaauuguaaauauacacacauauuauauauauaguacauacauacauauauacacacauguaugcauacauacauacauaugaaaaauauggaaacauguuaaaaacaugacaaaaagauaacauugugaauuuaaguuaaggguauuugacugccuguuguacuauuuuugcaaacuuucuguagguuuggaaucuucuacaaucuuuuacaaguuagggaaaaaauaugaagugacugaaaccccaguuucagguuuuccuuugcugcaguuaauuugcuugggucuuccguaaaugucagugaagcaggacugccuuauggaagccgugcuuugggaauaaaggaagggucugggcuucuugcugacauucagggugggagcuuggaugaaguugggaaacaaagguaggacccaugccccugaggcuggagaaauuguggcccagcagaaccuacaagucaccaccugucauaguuuuuugguugauuuguuuguuuuggcuaaguguugaggcccuggcuaugucaguaccucuucuugaggacuuaauuaaggucacaccuuaaccacuuccuuuacugggcucucuggggccacuaugcaccugcucaggaccagguacuaguuaaauaacuagggggacagagccugauuguaucuaauagagcagaaguaacuccauaaaaggaaauugggugcucugggaaggaggauuguaugccugccugucagccaaaagccaauaaaagagauaaaguaagagaaaaaggaaaaagggggguagaaagaaaaaucuugcugauguauuccaaaaaguaaagauaaaccauuuccuccuccaggcaacaucccaggcugguuaacaagaucucucuuccucaggaugacugaaguuugggaccaaaucgcuauuuguugugggggauuuucuuguacaucauacaauguagcaucucuccugcaaguuacaacaauaaaaaugucuccagacauugccaaguguccucugggaagcagaaucacccucaauugagaacacuacugaguuaaacuuugaugaggggaggggugggaauguucuuuuuuucuuuuuuuuagacagaguuucgcucuuguugcccaggcuggagugcaauggcgcgaucuuggcucacugcaacuucugccuccagguuuaagcaauucuccugccucagccucccaaguagcuaggauuacaggcaugugccaccaugcccgaauaauuuuguauuuuuuuguauagaugggguuucaccauguuggucaggcuggucucaaacuccuggccucaggugaucugcccaucucagccucccaaagugcugggauuacaggcaugagccacgucgaccggccgggaaucucuuuauaaagacuccauucuaaauccuggcccaacccuugauuuguggggaaauuuuugaaaaaacucagggcaccugaaagaaaaagauaaccagcaaaauaagcauucuauuuaaugccaugcaauuuaucuguucuucaguccugcuucaggcuggagcccucuucccaccuauagaguuguuuugaaguaaaaaaaaaucuauugagcugugugaggaaagcuguaaucagcagggauuuuuuuccccuuccuaaagauuccaauuuuucuguguaaguucuauuuguucuuuguguaagggccucaguaauaaagaacuucauuuucuacccuugauggccauuuugaauguagcuggauauuccucacuggaguguguucaugaaugagaccucccuguuugucccacagcagacacugccuuauuauuauuaucauuauuauuugagacagagucuugcucuuguuucccaggcuggagugcaauggugugaucucggcucacuguaaccucugccuccuggguucaagcaauucuccugccucagccuccugaguagcugggauuacaggcaugcaacaccucgcccggcuaauuuguauuuuuaguagagauggguuucuccauguuggucaggcuggucucgaacuccugaccucaggugauccgccugccuuggccuccuagaaugcugggauuacaggcgugaaccacuacgccucgccaacacugccuuauuuaauccucaugccaacccuauaaggaauccuuauuccuguuuuccuggaaaggaaacccaguaucugagagguuaagucaauuauucaaggucacagagacaggaagugggagagcucaguacccuccaauccuugauacccuccccuccccuuaucuaauccagggaucagcaaacuacagccugcagcuggcuuuuguauauuacaguuuuauugggcacagucacacccaugugcuuauuacugucuguggauguuuuccuguuauaacagcgaaguuuaguaguuauuucagaggcugcacagccuagaauguuaccaucuggcccuuuccagaaaaaguuuacuaagcccugagcuaauuuaccaaguuguugacuuugcuuccuagagagcucuccagucuuuucccuccauugucuucccaccagugucauucccacgcugcugcaagccaccuggacaacagacacagccuccgaugaccucucuccuccauucuuguuuuccuuguccauuguccacauagcugacccuuccaaaaugcacacccaaucccaugacuccauugccuaaaauuuuccuuauuguuuuuagacuaaaguccaaaauccuugaugggaacuacacagcucugugaucuagcuccugccuucagugugaucuugcauugcuccacuguccugaucucuauggucuagccagugagccucccuuaagugucuugcucauucugaucacagggucuuugcaccugcugcccuuuuuuccuaggaugcuuuugugcuaucaguucacuuucaauuuguuagcugugguuuauccuuuaacucuuugcugugaugcauuccuuggucucuguaagccuggcaggcugucauauaaggaugcacagguuggacgcugcacaacucuggagagauacacuauuugcauuuuagucuaagugaauggaaucucccuuuaaucagugaguggaaaaaaaggugaggcuaagucaccgaaacugacaaauuauugaagaauugcuacacaucagcacugugcuaagcauuuugcauuaucaaucucauuuacuucuuccaacaaaccaaugagaugguuauuaaaaaauaacugucccuuuuacagaaggagaaauggaagaauagaugaaguuguucaagguuacacaauuggucaguggucagaaccaggaugagaacccuggucuuccugcauuuaaaacuagguuucaggccaggugugguggcucaugccuguaaucccagaacuuugggagggcaagauggaucaguugaggccaggcguuugagaccagccugggcaacauagugagaccucucucucuacaaaaaacaaaacaauuagcuggacaugguggcaugcaccuguagcccuugcuacucaggaggcugaggcaggaggaucacuuaagcucgagaguuugagguuguggugagcuaugauugcaccauugcacuccagccugggcaacagaguaaaacucugucucuaaaaacaaaacaaaaugaaauaaaaacaaaaaccaaaacaagacaaaaaacuugaguccucagccauuaagccucccugaaaauucagucuucccauccuuugaacuggaaggaaagacauuauuccacuauuuucuuucuuaaauccuuccuguuuuuaaagaaggguuugcugagaaggaaggugaguaugaagaggguugagggagacacacagugaggauggcuccagcuaauaaagacaagaguggccgggcgugguggcucacaccuguaaucccagcacuuugggagguugcggcaggcagaucucuugaggucaggaguuagagaccggcuuggccaacacggugaaauccccucucuucuacaaagaaaagaaguagcugggugugguggugcgugccuguaaucccagcuacuugggaggcugagggagaagaaucgcuugaacccaggaggcagggguugugguuagccaagaucgcaccacugcacuccagccugggugacagagugagauaccaucuaaaaaaaagcaaaccagagugauagacagugcaggguuaggagggggccugggagaagaggugagggagggggaacugacauccagaaaagaacccacaagcagcuaaaggacuguauuauuguuuuuuccugugugaggugcaauguaaccuucucccucucuucugugaacccuucaguaaaauccccauuacgcacuggcacauauggaguggggacugcucucugaggggcuugaggagccaggccccaaggugggcugggggagcagagguggacaagggacggauucaggagaaaagaauguggagucggaauccccucuccaugcaccacaccugcgugacccgaagaaagucaucucuuguguaccuccgggcucccaccuggcacugccuaaucuucaugcaggggccaugaggaugcugagaggcccacuugguacacagggcuuugugaaccaaaacaagccaaggaaaugucacuauuacucucacuauaccaggaguaccuguaguuuauacacauugaaucaauuaugagcuaugaaugaaaaauauaacuugugugagaucacgaaaauguuccccccgcgaugccuuaagggccgagcaagacugucagugacccgauggucagcaaaaguagcgaugcagcgauauaacaguagguggcgcuagaugccauagcuuucaaucaaguccugguuucuuuuaaucucuuucucugccucccucuucucucacuugauugaaauggaaauuggcugccagcaucaaugagcccccagcagcccugagacugagcuggcaugccaacagccaauguguuauccacccaguuaaaaaaauuaaucaaaugcauuaaucucauaagcucuuuugaaagacuagguaugaggggccagcaguccagcugucagacccugggagcuaaugggaaucuguacgaugggcuagcggcugcuguucaaaguccuggaggagcuucaggaaacaggagccccgggaugugacaaccacucuauucuguaucgugaaccuugcaaauggcgugucuggaaaugcgggaggcuugagauggcaaaugggcuccaaucugagcgcuagcuucaaucuacccacgaguagucauucugucuggaguguccuccaguccagucuuaucagaagaaguaucugugauugauuagcaaugucugccacagacccaguaaggaacagcagcaucaaugugccccauuaccauuccugcauggggggguggggggggguggggggcuuuaccugucuuuucucauuaaauauucacagccacuccaaaaguugauagcaugauuaucucuauuuucugauuaagagaaccgagacccagagaaguuaaauaacuugccagaggucacccagcgagugagugagggcuagaaccagaaguuuaaacguauccuguuggcugcagggcucuguuuauugcauauuacaccacaguuuacuuccuuucuuggaaaugaaaaaauuuauuuggcaauucauccuggauaaaugaaacaaagagugaccuaagaaaguauccuuucauauugccaauguccugauaagaaggauguguguuggugguuaagcccccaaguggcuuccauccguuuucucucucccuggaagaagauaaaguugacaucucugcaacaaucaagugaacccccugaagguccaaagaaacacagccucccauuggcuaauaacuuuuaaccucauuuuuuuuuuuuaaugugaagagcagaagcagagcugagcuuaagccacuggugaaagagaaaagagccaagauucaggagagcugcuuggggcuggaugaagcuugacucuugggcugagcuuuagugugacaccagagaugcugggauaugaauucuacaaugcuguccccuggaugccauucgauggaaauuuacauggauuaccuuuugaggcucagugaggggcaagagcagcucacauauuucuuaaauaucuauuaggaguuagaaaauaucugaggauguggugcugaacaaggggccauccuuuccucagggaucugguggucuaguaggagacacuuaacuacaauguaggaaagugcaggcaucaaaccgugugggggcuggaaggguuguuggcagcgauucagacugugcugaacacaaaacuugggggaaaggguguaucggggcucagaacaugauaccccaaaacauggugccuuggcaugcuaaguauuuuggauggaaagagaugggaacaggcucagaaacaaggucucucugacuuucuuuccaccucuccucuuucucucccgagaaggucauagaaacuggaauuucucacccccaaggugagaaccagcucugucugguuccuucugucugaaacaccuauagggcagaaaaaguaaaaccuuuuaccucacccaucacaagggucuuggaugacaucaccauaacaaaagacauauuaaugagagaaaagcauaacaauuuuuuucuuuuuuugagauggagucucgcucuguugcccaggcuggaguccaguggugugaucucggcucacugcagccuccgccucccggguucagaacaugaacgaggcuuuucacccccaagcuggcucacagaaacuagaauuucgcucucccaaagcaagccauaaaaccuagaaaggcuacugucuggccuccucccuuccauccugaugguucuaugugacauguuucuggucccauaccugggggaaaaaugucuuacagagacacagaaaagaaucugaacaaacaugccuuccuaagcacaccuccccuuagguuuacuaccuuuagauaacaccccuuuuuguccaaucacguuucucuacaacuauccacucuucucaucagacuuagcauaaaaacacaguuuucccuuggucuuugggucuccauuucugaaggcucccauguuauguaaaacuucgguuaaaaaaauaaauguggccgggcgcaguggcucaugccaguaaucccagcacuuugggaggcugagguguggggaucacuugaggccagccuagccaacauggcaaaacccugucucuacuaaaaaaaaauacaaaaauuagcugaguguaguggugcgugccuguagucccagcuacucagaaggcugaggcaggagaauugcuugagcuggggaggcagaggcugcagugagcugagaucgcgccaccgcacugcagcccgagugacagagcgagacucugucucaaaaaaaauuguuaugcuuuucuuucauuaauacgucuuuuguuauggggauaucauccaagaacugugaugggugagguaaaggguuuuacuuuuucugcccuauagguguuucagacagaaggaaccagaaggagcuggaaugguuggaaugcagaguaugggaugugugugugugccuguguguguguguguauugggguguggugaugaagguuuuccugaugucacgaggcaggagagaacauuccugaagcugguaaugcuguugagaagccauuucggcaaaaucagcuuaggggugagggcccagugaaggacugaagauggagcacugaguuuucugucauuucauuuuuuauuacuuuaguuuuuuuaaagcaaguaguauuuucaaaugguuuaaaaaaauguaucaaaagguacaucacuuuuuaaaauguauuacuuccaccuuguccucaaaccauucauuucccucccuggaaaugaauaguguuaucaaguucuuguguauccuuccagagagauuuggaaaccacacacacacacacacacagacacacacacacacacacucuuuccaacacuagcaucuaccuuucacacaaauacacaugguagcacuguuuguguccugauuuccccugacauaacaauguaucuuggagagcgucaggguauugaguaucgugggacuauaaggaggcuggagcagguugaugccaaacucuugagucuuuggagcugaaucugggaacaagagugguggcuaagaggcugucauuaaugcauggauuggagcucugagaagaggauggaauuggaaguuaagguaaggaguguugaauuaacugucagagagggaggugggaaaagagggcagagagagagaaagagugagaaggagacacacagagagaggcagacagacagagacagagaggggggccuuggagggaggaggggagaagaggauacuaagauuaugaagauuagaaggccaaagacugacacacggggaaacugucaaggaacacagaggaccaagaagauacggaaaagccugccuguuucuguaaauaaaguuuuauuagaacacagaaaauggauauugagugaaaucccagucuucuauguuugcaaaaucucaaaucauuuaucuuuuugcauuucuuaauuguuuguuggugugagggcuggaguacauuuuggggacaauaaagaugucauucauuaaggucuugcugcugccuaguagcugcaauaccuccucuuccucauugcaagggagaccuucaguagauaaccaggcaacuucccaagguguuacagaaguucuuuuuggcugucacaacuugcuggggguugggggguggugcaucuaguaaguagaugcccaugaugcugcuaaacauccuacaauauacaggacaguccuucuucccccacaaagccguaucagcuccaaacuuucaagagugcugagguugagcaacacuguugcuaagacaagagcuguguuuuuauuuugccuggagaucccggggcacccagcacccagguuggcgaugaucaggaucuagguuuugcuuuccccuacaccggagucugugguaggcagccucuuaagauaucccccaugauacccaccuccugguacucacacucuuguauaaucuccuccccuggagguugggcugaaccuaguaacucacuucuaaugacuagaacauggcaaaagugaugcaaugucccuucugagaugagguuacaggauaaacauggcuucugucuugggcaccugcucuugaucuggggaaaaccagcuuccaaguugugagcuucucuuugggagagguccacauagcaagaaacuuauuagguuggugccaaugucauugcgguuauugcuauuacucuuuguuuuuuuuuugagacggagucucgcucugucacccaggcuggagugcaguggccugaucucggcucacugcaagcucugccuccagguucacaccauucuccugccucagccucccaaguagcugggacuacaggcgcccgccaccacgccuggcuaauuuuuuguauuuuuuuuaguagagacaggguuucaccguguuagccaggaugguuucgaucuccugaccucgugauccacccaccucggccucccaaagugcugagauuacaggugugagccacugcgcccagcccuugcuauuacuuuuaaauggcagaaaccacaacuacguuugcaccagccuaauacaucucuagccuacagccagaaagcaccugauaccagccaauagccaaguguaugagcucaggagugagccgucucccuguugagucuugaaauaacuguaggcccagcugccaucuucaguguggccucaggagauccugaagcagaggcucccagcuaagccaugccuagauucccgacccacagagauugugagauaaucaauguuuguugccuuaagcugcuaagguuuagaguaauuugucacauagaaauauguaacugaaauacagcuauacaggaauaaacucuccacaagaaacaguugaugauuuggguuacauaaacucauuuacuuucucuuuaggggcuagucacaaaauuaauagcucuucuuugacuauaacagucuccccuauuggcaagaaaaauguguuggucuguuucagggugugagccauuagcuggcucccauaugcauuuaaaaaaaaccuuuuuauuucuaauaaaauaaagcagagaaaaccuuuuuauuuuuaauuuaauuuaauuuuuuguccacggccugggcaugacuugguuguaaacaagaucauuccauaacugaacuaccacaggagacaguagauuguaguauugaaaagcacagacuuaaucagacagacuugguuuuaaaucccagcucugccauuugcuaacuguuugggcaagagccauaagaaauacaccuucuggagugcccauuuuauggguuaaaaaaaagccacuaccaaggcauggaggggcagagugacugcauauaacuacagggucaggaaaugaacccaguggugaucauuaagugaagaaacuacugggucguuuccaagguaagcaaguagaacaacaaucucgggcuuucuuaauugguacauaugcaugcaugugugcuuggauagauacaacauauuuuuaguaauuaauuaauuuauuuuugagacagggucuugcucugucacccagacuggagugcaguggcaugaucauagcucgcugcagucucgaacucucgggcucaagugauccuccuuccugaggcucccaaguagcugggaccacaggcacgugccaccaugccuggcuaauuaaauuucuuuuucuuuucuuuucuuuucuuuuuuuuuguagaggugaguugucacuauguugccgaggcugauguugaacuccuagccucaaguaauugucccgccuuggccucccaaagugcugggauuauaggugugagccacagugccuggccagauacaucaucuuauaauuuuaauuuuccuacugcacuuggccaccuggcuucuaguguuaugcuccauuuacguacacacaccccaccuggaugggacauucaugccaagggcagucagaauauaccccccuauggcccuggauguccccucgguguucucugcugaccccacuggcauuguggugacuguucuggcaccucucaugacaagaagauauuuguccuuagcugucccuaaagugguauuuccagccagcguguuaugaacauugaaugcuguaaagacucacugcugaugaaggaacuuuacaaacaugaaaccaaaaugcagccgugaugccugucaccaugucucagucccuggaggaaguagagaaacccuaguguauugcauccucuggugcucuggcuucagccugaggaucaguggggguauguagguaaguggguggggcuggagcaccaagacuuggcuuauauucaugaaguaaaaagaaaaccaagcagcuccaauuuaaaaccuuuuuuuuuuuuugcuauauucagcuuaccuuuuuauuauguuuuguauucauauuuuaaacauauucaaaaccacugauuuaagcagcuauuccucuuacauuguaaaugcuguuuucucucuccuccucuggauucuagcauugcaauguaugcgaggaguaugaccuugucacauuguguuuuugguuucaggcacaaugccaaacaaagaguggcuucuuggcaguuauuuguucagugaguggaugaagggaugaaaauaaaacuucaauauguguugauuuuucaacuuuuagacaacucagagacaaagccugggaaacugaauuauggguauggaaugugaaugcuauugaucuugacaauguaaaaauaguaauaaagacgcaaggggagcugaugagacccucaucucuuccacaaaguaaggagucaaagacgcugucuagggugaaugaggcaagaagaccccaacucucucucucucucucuauauauauauaucuauauauauauauauuuuuugagacagaguuucccucuuguugcccaggcuggagugcaauggcacgaucucugcucaccacaaucucugccucccggguucaagcgauucuccugccucagccuccugaauagcugggauuacaggcaugugccaccacucccagcuaauuuuguauuuuuaguaagggcggaguuucucuauguuggucaggcuggucucgaacuccugaucucuggggauccgccugccuuggccucccaaagugcugggauuacaggcgugagccaccacacccagccucaucuauauuuuuuaauuacagaauuaaccacuaggggagcugaagguaaggcuacuuuuggagggugggaguuagggguggggagugguguggggaugcgguaacuagauccucaucuuucacagcagaaaauuauucaaguuuuaaaugcauaaacuaagaaauacacguaaaacuuauauaauuuagaggcacgggucauuggaggaaguagcaaaaaguguuagacacggcugcccugagggauggcaucaaggaugagaagagggcagggaagagggacuccugcuuuacagcagaagauuuuugaugauauuuguuuuugguuuuuuuuaaaucugagaauguuuuacauuaauuuucuaaaaacuaacagaguuugagagcccuaguuggaguuaaaauacagagcccgacuuuguuaccgugaaaaucaacaagcacaacaagccuuguaauauccaugcucauuucagagucaagacaaaauuaauuuggaaaagaaaauacagccggggaacagaguuagcaaccucaggaaauucaaggaaauguaauugaguaagaauuaucuccuuaauuacuuaugaccaaaucaauaacaacgcuggaugagaaaccgcaguugccaccaaugaggaucaagucgcugagaaaccaauugggguucaggcuuguuugaaaagcaaaacaccuuccucuugguuguuagcaaacacgguuccugggggugugcacggagacaggagaaggcugcaguuugcagccugggguggagaaaugagcugaacuugcuuauuauuuucaaacgugaaagccugaauagaggagcuccuuucuccaaagaggagcaagcauggaugcccuugaugaugucaaaugcucauuuucaugcuuuccugggguuaaucagagacccaagcagguucaucaugcaaauuagaaggaggugagccaagugccucaaagguaggugagggagcauuuuuguuugcagaucacaagcuuuuugugggaacugcaaagauuucuuucaaaccaucuccaugugccuuuggggagggaguggugaggaucuuugucucuaaggggcccugcugggcacgacccucuagaucugucaugguuuuggagcuggguuaagaucuuaucuagagcugagauucaagagugcccuaucugccuaaccucugacagaccuaccuguccucaucccuguuggggucuuuggcaacuaaccaggaccuucucaaguccaucucacacuuggugccuugcuccuugcucuucugaccuguggacuugucaauaaaucauccucacuguccagauauuucuccauucaaaaaggucuuccugagccccucugggggucccagcucagagcuaggaaacacacacccacccccaaacucccucucagggucucauugauggcaggguggugggggggagguaggcagauaauuaagcaguuaugauaucauaugauguagcuguggugggagugagggagcuggaggugugagcacacaacugacccagcaaggguggaggacagucagaaggauaaacaaaaugacuuuuuauuuuuuuuggagacagaaucucacucugucaaccaggcuggagugcaguggcgugaucuuggcucacugcaaucucagccucccggguucaagugauucuccugccucagccucccaaguagcugagauuacaggcauaugcaaccaugcccagcuaacuuuuuuguauuuuuaguagagacagaguuucgccauguuggccaggcuguucucgaacuccugaccucaagugaucugcccaccucggccuccaaaagugcugggauucuaggcaugagccacugugcccggccuaaaggaaaugacuucugaguacaguucuaaaggaugaggaaugauuaguaugugaggugauggauauguuaauuagcuugauucaaucaucccacaauguauacauacaucaaaacaucacguuguaugccauaaauauauacaauuuuucauuuuucaauugaaaaaauaaauaaaagaagaggaaggaggaagaugugccaggcagaggggacagcauuugcaaagaucgggauggaggugagugagaacuugauagugaagguggcucaguccagcuggagcauagcaauaggguugguggaggggaggggugaggaacaagggagcgguagaaagggccagucaugaucgugacagcagcugggaucugggauuuuaugcagagggcacagggggaagauggggcugagggguuugaguguggcugcugggacucuccccaggccacugugauugggagugggacaccaauuuguagcugggugauuaaagcccaauguuaugcucuuggacugcaagcccaggaaaucugcaacuuggugauuaaagcucgacguuaugcuccuagacuccaagcccaggaaaucugcagacuggcagcuagacgguacuaguuuccucccaggcauagaugcuccagucaacuccccaugggagccuuccucucucaccuuccauccauguggcuucggaggugaacacgggaugcaggcccagccaaucaaaauauuccaccucccuggcugcagggaggaucuuauuuuuucaugagucugagacccaaagaaaaaccaagguauuuagucucaggacauuugcugcugcucuugggaaagagaagaucucuuucugcugggguugcucccauggaagaaugugagccuagagcucuuggcgacuaucuuggccaucaacuugguaaagccugccugagaaugaaggcaacacagaagaaagaagaguauguaucuggagauaauguucgaacacuuggaacucauuauuccuaaagcuagguuuauuuguggacuuuuuguuaaucuuagauaauuaguuuucucuuuugcguaggccacauugaauugggguuuucuaucauuugcaacuagcaggaucuugauuugaccacaauuuuguuagcauauugcaaauauuuuugucaagacaaccccaaacuacaccccuggagaguuacacuaguucucuguggcuaaaccaaaauccaugggagaucuuucauuuaaaaauuaucagagaucaucagcguugagagauuacccaacacaacaccuccaucacaugacagacacacuaaaaacagcugccauuuaccuacuaagugucuaagugcauacuaugugcuacccacuuaguuuuacacauauuauuuccauuuacccuugcaauauauuuugugggauaggacugcuauuaucuccauuuuacagaugagaaaacagguccagagagguuaauuuccaguuacaugacagaguaaggaacagaggugggguucaaacacaaacugcacuuuggcuccaaagcuuguacucucucugcuucaccaacagaugugcaaucuaagacucagagaagcuggagaauuuuccuaacgucacacagcaaaggaauggaagacucaggacaagaauacacgauccucuccuuccaacaugucacccagcaggugcaauaagucaaagggcaggguaugggauuuggagucauacagaccugaguucaccagccagggucuuuggcagauaagauuacucuuugagccucaguuuccuugugugcaaggugagaauaaucacaaagccuacuucauaggcuugugauggagaaucaacacaacaucacaugcaggcccagccaaucagaauauuccaccucccuggcugcagggagaucuuauuuuuucaugagucugaggaaggaacaugaggcugcaccuccagugauggacgugauguguguauaaaguucuuaggacagagccagguuuaugggggcucucaauaaauguuaauugugaauguaauuguuacaauuaauaagcugugcuguuaaugaagguauaaaaugcaggugaucugccacaugaccacaggcuaguugcugaauuacagcggccauuggucccacugguaaaauaggguuauuaucugccuuuugcucaugacaccagggcguuacaagaauuaauuagcagcuuuacaauguacugugcacuuugaugcucuauaaacagagaaaugugaugguugaauauuuguaugauauccauuauugaggauaucuugaauugguuuacugauguuaaaauaaauucaaccuuccaaaaguggauaaaucuaucugagucaaacaaaagaagacuggguuuuaauuaucugccaacaccuuagaaaccuacaacaacuggacaucuggacauccauaggcugagcucaaugcccuugucuugaacguagaaagagaugcugagauugucgggcugucucuuccucuagaucugagcuccuucggggccaagauugcgucuugucuugcaguagauccccagccuugaguacaggauuugauacgcagcaagugcuggauaaaugcuugaugaaugaaaggauggauggauggacagauggauggacaguuggauggaugaaugggauccugaaccucuuggugauaggagauuagaugggucuggucucaaaugcuugugccaaaguagauggggagucacaucagguauuggaagagaaaaccucucaggcagugugguaaauuggaaggacacuugacaucacacggaccuggguaaccagcucugugaccaugggccuuggaccaagccccucuuucuucaucugagaauguugauaaugucuuugagcugaaaguaacaggaaacuccacucacuguugcuuacacauaaggaaauuuauuacuccauguaagaagaaguacagaguaggauuugggauuucaggguugacuuugaaggucugucaugucacugagcucugcacagagugaauugcccacagaaucagccucaucuuuagacaucuuccccucaugguuguaaaguggcuucugacagcaaccagggucaaggcuucuuuccugcacccauuggcccaaaugggcucuccgggauggccaucauucgaaccaguuguuggcgaagcaaauaagauagcuaugacuggccaaauccagugcugcucaagccgugguccaugaaccaaugccagcagcaucauuugggagcuuauuacgccugcaaauucauggacuacauucugaccaggugaaccagaaccucugguguggaccaaggaaucuccacuuucaggcauuccuauggcuguuaaagucugagaaccacuggauuaaacccaacugggaggcgagggacaacuacaaaauacaggugauaaugccaacuuuagaggguugcuaagaaaacaaauaauaucacauaugugaaagacuaucacacaguaggugcuuaauacauguugguuuccuucauuucuuucccuuuuuagcgauauugaaauauuuacucgucuccaucaauuaucuuccuccacccagugcuaaauauccucaugcugcucugaccuauggaaaccaaccgggccgggcgcaguggcucacgccuguaaucccggcacuuugggaggccaaggcggguggaucacgaggucaggagaucgagaccauccuggcuaauacggugaaaccccgucuuuacuaaaaauacaaaaaauuagccgggcgugguggcuggcgccuguagucccagcuacucgggaggcugaggcaggagaauggugugaaccccggaggcggagguugcagugagcugagaucgcgccacugcacuccagccugggcgacagagugagacuccgucucaaaaaaaaaaaaaaaaaaaaggaaaccaaccuguaggcuaauuuauacuaaggugggagugacacauagcaucacuagcuuaguagcauuuucaccuugaaauagcagagcauggagugcacgauacuuaaucuaaaaagcugcuuggcaagugguguaauauuaggcauguagcaaguuuugguguguagggguauguuuuaguguggacuaugcugcuccauccucagaucauaccccguagguaauuuccuacucuggccacacugaagggacuaguuggcuaagcuggaugcccaguggcagccacaugaacacagggugcgaugugggagggcugagguuagccaggcugauggcaucacauacauccuucccuuccccccugucuucagagcccuguuggggacuguuagggagaacguagccccucuugaggcuuugaucuuuggcucugcaaguuccagauucccuuugaaguauaauuauaauuaaaaggaaaaucccaagcagacaccagaugaggucugcacccgacacgcacuguuggcagaguuuccuaagucaacagcuggcuccgcaugucaggcucaaaggaaaaaaagaaauuggccacucauuugaaggaacuuuauucugaaugagcuggaacuguaaaggucccuuaaucccuggagaauagaacagaugggagggcaagggaaaccuuggcagugagaagaugauuaauuaaguuggaucccaggucccucuuucaacaggaggaugcccaucuggguccugggugcaucuccuuuugagcaccccaugaacuaagagggugaccccagucugucauccaggcuuccagagcugguucuuuauccuaagcuagggacacaaagacuucuuccuuaggaucaagauaaacuggggccucuugaauugaugaaauauucauaccccacugcccuucauccuauauuuuuuuucuccauaguuuuuguuugagaaacuuccuuuggcauugcauggcccuauauugcaggucacugucaucacugugugacucugggcaaguuagaaccuccccaugcaucaauuuccucaucuguaaaaaggagacauucauaauauugccuuucuuuuuagagauaugagaauuacagcuaauaaauucuagguaccucacauaguaccuggcauuuagugugugcuuaauaaauguugucuguuaagacaauucugggcucugccaauaaacuccuuagcucuugaaggccuaaacuaaaccuuacuacaaagagucaguacgcauuaaacaaucuuaagacuauaaagggauccucaagacagauuaucuaauuguaaaaugcuaguuucaccacuuaauaguguguccaugaccacuuuuaucagugaaaaggaaaagugagcaauuugauuuuuuuaaaggaauggaguuuugcucugcugcccaggauagagagcaguggugcugagaggugacaaaggugcuagcagcccucacucuuggcgccuccucggccuuggugccuacucuggccgcgcuugaggagcccuucagccugagcugcacugugggagccccucucagggcuggccgaggcuggagcugguucccucugcuugcggggaggcgugcagggagaggcacgggugggaaccgagucugcgugccaugcucccaggccagcacgaguuccgggugggcguaagcucggagggccacgcacuaggagcggcuggccggugccggugccuggcagugaugcgcuuagcaucugggccaggagcugcagagguugcgccgggucccccagcacugccggccugcccgcaccgcacucaaauucuugccaggccucagccaccuccccacagggcagggcucggaccugcagcccgccaugccugagccccccgccuuccuccuccccucugccaccccuuccuccccccacaccgcccccuuccuccccccgcggccccuuccucuccccccacccccuuccuccccccccgcugccccuuccucccucccgccgcccccuuccucccauccccccacaccgccccuuccucccacuccccacgccacccccuuccucccccucccacacagcccccuuccuuccuccccgcccccuuccuuccccacccugcccccuuccucccccacccccuuccucccugccccacuuucugcccucccucccccccccccccucccccucccccccuccccccucccuccccccuuccccacccugccccacccagccucccugacgggcgcugcccccugcuccgugguacccggucccauugaccgcccaagggcugaggagugcaggcagcggggugggacuggccggcaacuccaccccugccccacuugcaagauccaccaggcgaagccagcugggcuccugaguugaguggggacuuggagaacuuuuaugucuagcuggaagauuguauaugcaacaaucagcacucugugucuagcucgggguucauggaugcaccaaucagcucucuguaucuagcuaaucuggugaggacuuggagaacuuuuaugucuagcuagaggauugcaaaugcaccaaucagcacucugugucuaacucagggauuguaaacgcaccaaucagcacucuaucaaaauggaccaaucagcucucuguaaaacggaccaaucagcucucuguaaaaugggccaaucagcaggguguggguagggccagauaagggaauaaaagcaggcugcuggagccaguagaggcaaccggcucaggucccuuuucagaucauggaaguguuguuuuuucgcuguuggcaauaacucuugcugcugcucacucuuuggguuugcaacaccuuuaugagcuguaaugcucaccaugaaggucugcagcuucacuccugaagccagcgagagcaugaacucacagggagaaaugaacaacucuggaggggaggaacgaacaacuccagaugcccugccuuuaagagcuguaaaaugcacugugaaggucugcagcuucacuccugaagccagcgagaccacgaacccacuagaaagaagaaacucuggacacaucugaacaucugaaggaacaaacucuggacacaccaucuuuaagaaauguaacacccacugcgaggguccgugacuucauucuugaagucagcgagaccaagaaccuaccaauucuggaugcaguguuaucacagcucacugcagccuggagcugcugggcucaagugauccuccugccucagcaucuugaguagcuaggaccacaggcacacaccagacacuugucuaauuauuuaaauuuuuuuguagagacugggucuugcuauauugucuaggcuggucuugaacucuugaccucaagugauccuccugccuuggccucucaaagugcugggauuacagguauuggcuccugugucuggcccaauuugaucuuugaggucucuuccaaugggacucacugugucauuaugacccccuucuuucugggaaagggcccacaccaaagcccuuguugugauagugggucccuguuccacugcugcauccaugacccauuccuccucuuuugggauggcuuucuggcuggucuccuagguucccacugccacucucaccucuauacaaucuggaguggguugaauaguguccuucugaaacucacauccacccagaaugggaccuuauauguuaccuuugcagauguaauuagucaagauaaagucauacuaacuuaggcccuaaguccaauggcuggugucuuuauaagaaaaggagaggauaaggccagguuugguggcucacgcuuguagucccagcauuuuaggaggcugaggcgggggaaucacuugaggucaggaguucgacaccagccuggccaacauggugagacucagucucuacuaaaaauacaaaaauuagccaggcgagguggugggcgccuguaaucccagcuacuugggaggcugagggagaggaaucgcuugaacccgggaggcagagguugcagugaguugagaucaagccacugcacuucagccugggcaacagagcgagacuccaucuaaaaaaaaaagaaagaaaaggaugcaugauggaggagaaugccaugugaagauggaaguggagacuggagugaugaggcuacaagccaacaaacaccaaggauugcaggagccaccagaagcugggagagagacauggaacaugagagcuuccagaagaaacuaacccugcugacaucuugguuuuggacuucucaccuccugagcugggagagaauaaaugucugcuguuuugagccacccauuugugaucauugguuauggcagcccuaaaaacuaauguaccaucuuucuauagagugaaacucauuaccgugcugauaugguuugggucuuugucccugcccaaauuucaugucaaauuguaauccucaauguuguuggguccuagugggaggugauugguucaugaggguggauuuccccucuggugccguucucaugauagugaguuaccacaagaucuggucuuuuaaaaguguguggcacuuccacucuuucucucucuuccccauuugguaagacgggucugcuuccccuuugccuucugccaugguuauaaguuuccugaggccuccccagaagccagcaucaugcuuccuguacagccuguggaacugugagccagguaaaccaccuuucuuuguaaauuacccagucucagguauuucuuuauaguggugcaauaaugcacuaauacacaugcucuugcucaagacccuucaguggcuuccauggaucacaaaggaaagccucaauucuucaggguguucuauagagucauucaugacuuuucaucuguugguugcaccucugcccagauacacucuuuucugcagccacucugaguacuucugaaacacgcugaacuccuggaaacacauuauaccuucuguaggcaaugcuguuucucucuucucucacuuggaaaacuacucauccuucaagacccaacuuaaguauccucaccauuaugaagccuucguaagcacccccuucuucaauucucccuccacuggcugaguuagucaugcuucucuguguuuccagagcauauugaucaagucucuuuucuuggaacacugagcucaugcacuaaaguuacuuguuuuaugcaucugccccuauucagguagggaucugauccugagaucagagcugaccuuguaagggaucagugaguguuuguugcuugacuaaaugaaaguuggaggaaagugacguuauuuaacaggagaugcaacagcuggaagguggcaaggacaaaaaaggacaugaaggacaaagauauucaauuuucccauucagucuuggggagaccaguugcccauauggucgugcaugccaugccuuggucacccaugagaauuacuguuuucugugcauccauggggguauucauucugggaguaacuagaaagugcaacugugcuuuuaggggaugccuggggggcagugagaggucuccuugggcuuugccagaggcacggaguauguccuugccuggacuaccacaugguggguggacgcuaagcauguagaucucuugaagcaugaaauuaccccguuuccuuuguaacaggcagaaggaacuagggaaaaugcuuuuaagaagaaaaaggagagacguuggggagacaagagacaauaaugcggauuuuaguaucagacagacauagguuucaaauccucaagcuucugcuucccaguggagugaccuuggacaaguccuuuaucuucucugagccucuguguucucauuucuaccauggugaaggugcuuauaacaauacuugcuuugcgguacaguuguaacaauuaaacuuagugaacacagaaugccuggcauguagcaagcuauugguaaauggaaucugucauuuuuuaucuagcaugaugauuauuaguuccacaaauauuuucugggggccuauuaagggccugucauaguuccagcaucuugagacucuaaaaugcuuaagcucaagaugaucagggcuguuaaacacuguuuuacaacaccaaacauggcguguguacgugcucacuuccugaaggugcugguuaaagucugauggcuucauuguagcccuguugcaccagaagaggucaucugaccuugugucauuuauuaaaugaauccuuauuuccuugcucuaucccuucacugaaaacgucacacaaaagcaggaagcuccagacugauauuucuuuccucuugaagccuguccaggugugggcacgaguugccacuuugaaggcucuuuucuaaaccacugggagaaaauuucauuugcaaagcuuucccugugucuugcucuccaagggcgaguugauuaagcauguuugucugcauuuauuccauguacauuucaaaaguuguuuacugcagcuacauuuuaaaaauauaaacaugcucccuguuuaaugcagguacaaaucuccaggaugugcauuuuugagccuagggcguagguggagaugcagacaaaauaaauacaauucgggagcagcgaaagcaaaacaaggaaucauuugugaaagagagaaugacugcaggaaguauaaaaucagaaauacgcuuuggaacucuuggaugcuauugugaaaugcauuuucccccuccucccuuuccaaggaaaacuuaaaccauauuuccugcacgaugaaaucuuugaaauggcccaaaucucauuuuaacaaaaacacacgauugaguuugucuaauuagagauuuaaugagccguaaaauguauggugaguaccuggcaacccucagaauucuuucuuuuuugugacaggaucuugcucugucacccaggcuggagugcaguggugcaauuacaacucacugcagccucaaucucaugggcucaagugauucugucaccucagccugcuaaguaacugggaccauaggcgugugccaccaugacugucugauauuuuuaauuuuuuguauuuuuguagugauggauucuugccguguugcccaggguggucucaaacuccuugucucaagcaguccuccugcuuuggcuucccaaagugcugggauuacagguguaagccacugcaccuggccacaaaacuguuauauaguacuugcaccucacaaacacgagacccagggucaggauguucaaccugguuucguuuaggaggcaaaguccucuguucuccagaaagagguuuuguacaaacaugugguucauacauugccauggcugagcaucaacuagcauggcugacugcagccuauggcauucccugauugauugauucauucaucccguaaauauuuauugagcaccacuuugugcuaggccuuaugcugugguguuugguauuggggauaaccaugaucauaacagucauuuuauugagugcuuauuaugcacccugcguuggguaagaacuuggcauggcaucucucauuugaucuccaccacaacucuacuagguaaauguuacuauuauuaucaccauuuuacagaugagaaaaccagccaggacuaauucagccauaauuccaaacucucaggaagaaacuuauuggccuagcuuggguuaaguguccacuucuccucacagcagaggugaagagaguggagcugugucacuuaguucaaagcuggcuacaguccaacaggaggcaguucucagagaaacagggucucugugaguagcugccuucuuccaugucugcugggcugcagaggguggauuuuggggaagaugaagugauggauauccuagaccagugauauccuaggucuugggaccacuacacugggagguuucacagcaucuccuacaucugaacuccacaggacaccccuuucucuagaauaaaucacccuuucuugaucucugaaaggguuuauguuacuuaugauugaggggggccugaguuagcuggucuuguaaucacagauugcugaauacuuccagagcccucuccuggguuuuggcuccugaccucugcaauauugcacacccaauugcacaguggagcaaagcaauagaaugaacagcugucucgagcacucagacgugccacacaacucacugguaugcugcgggaccccacugcagaaagcuuccagaagguggccacuucagaccaagcauuuuugcagggcucagaaggaagaaaaagauacuggaccuuugcuaauccuaauacagaaaagcccugucaaccuacacaacaaaauucuuuuagcuuucucuaggaguaccaacaacaacaguaauaacagcgcuaacgauagcucucauuugcuaggugccagacaccgcagcaucacaugacaugcacauuacucugcagcaugcacauuacaugcacuuuucuguuugacauucacaacaacccuuuccgguagagguuauuauugcugucauugugcagaggcagaaacugaggcccaagagggccaaguaacuugcccaaaggcacauggcuaugagguauggguggugacucuccaauccagaucagucugaggcuagagcucaaguucuaacauuauauccaugccuaagacauuaagguauugucugguacuucagcaauuugaugauuauuguugaaguccucaggaucugcagcucagaauguccucuauaaguccugaaagcacccagacguggauggcauuuuaagaaaagacacacacacacauacacauagacacauacuuggaaaaagaagucacacuggcaugaauggugacaguaggugcugcugguccuacuguggcuuagaggagcucagaauagccacagagacguguggguaacaguccauuuucugaugcuucuugaauuugguucaucucagcauccucaaauccuccccucacauuuuauaaaaaguaaagucaugcagaacugggugcuucauugaggaaugugguuaagaccuaaccuaaaaugagaaauggcaucacacaaaauccugaauguguacugaggucugacuagguggccugagguuaaacagcaggaaauuaagccaaguggcauggcugccccgccuggaagcacugcugcuuuuuagaacuuuuguaaaaauaaaugucaaugagggcaaaaggaaugagcucuuuaaaaauaaaugcaccugccacuguucuugcuuaagaucaucuaacuccuugcuacucaaaguguggcucgggaacuagaagcaucugugucaccugggggcuugucagaaaagcaagucucagcccuacuccgagcugcugaauucaaaucugcauuuccacaaggaucuccaagugauuccuugcagauuagaauuugaaaagcagagagcuuccucuggucaucaaagaacucaucuuggcaucauuauacugaaagaaugaccacucucugagggguccauccacauucauucauuuguccauucauucauucauucacccauucacugauucaucuauuuaaaaaauauauugauuauccacuaaaugucaggcacuggggcugugacuguaaacaggagagaugugauguauagaauggugggagagaaagacauuaaacaaacauuuauuuaguuauuauaguaaguaccaggauaaauuuaguaagcacaacaaacaguguuuuagggcccugaucugcuuacugacagggagcaccugcagggaggauuagggaaggugucuuugggaaguaguaucuaaacagacccaaagaaggacaaaaguguguuuauuaagggaauguucugggcggcaggaauggcuugugcaaaugccuggaggugggaagaugugagguauauugaagccuugucuuuuacgauuugagaauggcauuaugguagcauuacauguaauagugagauguuaggagcccuuccucccuuaggagagagauuugaugaccuauuuauuuuauguaugaaaauaugcaucauuacagacuaaacagacauauuucccucuggagaaagucuacuucuuucauguggccacacacugaccaggagucagggugucuuccugaugcagagaagagaaagucaucuuugucuuccauuugcauuuuccauuuaguuuucaauucaucagccacuaaugguaaugugugcaaagccacuacccaaaugaauggcaagcuugcucuguguaugugugugugugugcaugccuguguguugguggugauuuguggaagugaugggagguggguaggggggcuaacccuaaagaugccuugggucuggggcucaggggcucagacuuaccaugaucgacaauccccugccauuucccacucuacuugcuucuuuucuaagccugucuaguauguuacagcuuugugagcacaaguaguguauuugggaggugauccugggaaacccccauaggagagugggacaaggagaggaagguauguuaaugagcaagcaggugaccaccgugggcaacuuggggcucaacccugcuggcaccacaggggaauaauauagaguuggagucagcaaacuugucuagaaagggccacaccauaaauacuaggcuuuuggggguauacagucucuuguacaacucugcccuuguaguaugaaggcaaccauagaccauauguaaagaaaugggcguggcuguguuccaguauaacuuuauuuauaaaaacaaguggucagccagauuuggcuggugaacuguaguuuguugacucuugauauagaagaugucucagaauuguugcaucugaaggcaaggcaacugagguacuuauguguuaucauuugucugccauugguaaagggaugcuccuuaaggcauugccuuucuugucccuucugaacugccccagaccacagacagagagccacaggugcuacugugggaagccaugaaugugcaugagcaugggaagagccaagaaaggggacuauuuuauaaugagugaaguaagacucagagagggcaaaugaugguaugagaucacaagaaagguaguggucaugaucaaaacagagcugaucccuaugcuguuuguacauggugauacucuaaaaguaggaaauuuugugcaguguuuuccaguugcauuuuaacaucugucuaggaacuuuuguucugaagcacaccauuuagaaagcaugucaccauaaccuauuccacgaaauggauuuucuucugcuccccaaacuguuauagaagcacuugagaaucaaaguaagaacaaagauacauaauuuaaguguuuauucuuaagaaccuuuuaaaaugucuugauuauauguguuuccaagauguacauauagaaacuuugcaaaucaaugaaaagagagcaaacuaccuaguagaaaauagggcaaauaauacaaauaagguaauucuccaaagagaaaauauaaauaaacaaugaauauauagaugauccucaaucuugacaaucagguagguacaagaaaacaacaacauguccucuuugcccaucacacuggcagaaacuuaaaugccuuauuaaaggguggaugaagaugcgaaguaacugguacuuggauauucaaguaggcugugauuugguacaaauuuucuggagguuuauuugauuaauaaaaucuguuuccucucacuuucuuccuccaagaacaagagaaggaaucacaauugguccaugacagucacggucaucucauuccucuugccaguggcagguguaugugugaguuugcagcucaauccuggccaaggggauccaaggacugcugaagaggcaugucugcacaugucaccuagaacaucuccagccaucaugugaucucugggggaggcauucccaacucucugagagaagcagaccagaaagauggaaagaaagcaccuggcuccaggaugaugacauugagccgaugaauuaaccaccuuugugcugcucuaaccuucagaguucaccuuaacaugagaaaauaaaacccuuauugcuuagccacugggaucuucuuuuauuugcagccaaaaguaucuuaacugauauaauuaucucucccauauagaaauggggccuuauguguccaaauaggcaauguacaaguauuuuauuauagcauugcauguaaucgugagacauuaagaguaaccugaaaugugcgucagaggggaccuagggaaauaaacugugauucaguaacacuauggaauuugaggcagccguuaaaagcaauuagguaaauuuuuaugugcugaucccaacaucuccaagaucucuaagacauuuaaguuuuaagaaguugugaaauaaauacauaugguauaaucccauuuaugaaaaacaaaauaauccuuaaaauaaaauguguaaagauucauauauauauacauucauaccuauagaaaaagggggugggaggaaucacaucauauacauaaaagcauuuaccucuggagcugggagaugggcagggggugagaauuaagagaaacuugugcuuuuuuauguauggcauuuguccuuuuagcaacacaaaugagugaauuuagggcuuugucauaaaaagauaauguuuggaaaauagcccacaugcucauuguagaaaaaucuagcaaauacuagaaugcacagauguaaguuuuguucaaaccgugcaagacagagguuuuuuuuguuguuguuguuguuuagaaaaacacaauauuucagguuuccugggggcaaagaggaacuucucuucagauccucaaaugauuuucauguguguggcacaauuacucgggcagaguucaguguuuuuaaucaaaagcuacuugucaaguaggcaaugucacuuugccuagccugcguaaacaaagcuuugugaggacuggguuuggaaaguggaagagcugaaacauuuuaauuggagagugugugugugugugugugugugugugugugugugugugugagagagacagagggggagggagggagagagagagagagaguugagggggaagaggggaggaggauggaguacucugugugauguacacaauucuggagaauucuccauagaaauauccacccuguguuuuccagcaccggcucugcuccuaaucacuuggaaccauaagaauuugaccuuccaaaggagagaggcuuccucgcaaugcucgguugguaaugacugaguuguaggcacggacuguuucguaauugccuuccaguugucuccuacauuuuucugaguuggguaccauuagucuuaaggcuccugucauguggccauuaaaucauuguuuucucugacagugucauuucugcaaaacccuggagagaaaauacuacacauuuuccaaggcuggaaugcugccaccuggucauuaugcccagcagcccucagacggcuacuccuaaagaugugcaccuuuggugcgaccgcaccauggcuccccagacuaaacagcucacuguuacugguugcuuuuuuuuuuuuuucuuagaguggaauuacccuggucagcaagcacccucuagcacuaauuuaggagacugagucugacaaauggguguaaagaaaagaagaauggcaggaaaaauauugguuuucagaaaucaaaaaugaugcuucucuaaggguaucacuuauuuuucccuccaccccugcaaccuacccagggcaagagcagaagaaaaauuuuuccaauagggucuaauuguugucugaaauaaaugagaacagggagguuugaggacugcugaacauggacagaugaggugggaggaauggucuucaugagugauuuccaacagccgagcugcaaggcugaauaaagaggaugccagugaguccuuaacaaaacaacaaaaaaccaaggcuugccgccuucagggaucauaauuuauucauucaacaaauaaaugguugaaugguuagugguuguucugugcuggaaauucuucuaggagcuggggacacagcaaugaaccaagcaacaucucuauaucuuaacugggcucugaguaggaaagagauggugcacucaaacugggaauuggaggaggaguugaauaaagggacuauuugcacagacuguuugcauagaucccccuacaagggauggugcaguccccuggggcuagcaacagcagggagcuguuaccacccugaaggggcacggagggggagcagcgacuggcagugaagagguuagugguagggagaggccgugugacaggagccaggaccagagaaucacaaacaaccaaguccauguagcaaaaaugagacugggaacagagacuccaaccuuucuaucucccugcccuuuuguauuagucuguuuucaggcuauuuauaaagacauaccugaaacuagguaauuuauuuuuuaaaaaagagguuuaauggacucauaguuccacauggcugggccucacaaucaugauggaaggcaaaaggcacgucuuacguggcagcaggcaagaaagaaugcgagccaagugaaagggggaaacccuuuauaaaaccaucagaucucgugagacuuauucacuaucacaauaacaguacgggggaaacugcccccaugauucaauuaucuuccaucaagucccucccaccacauacgggaauuaugggagcuacaauucaagaugagauguggguggggacacagccaaaccauaucaccuuugaucucccagcagugcuuucuauuggcugaauccaacuggaggcuggagagcaagggaggucauuaaguugucauucuccuggggcacagagcagggaggagaaggguggcaagugguucuggagaggcaaaugguauauuuccagcacaguccuuguccucaaggagucaauauucuaccuaugggacacagaccauaaacaaguaagcccauagcucuauaacacaauguugccaggacuucauuaaucuaagcagcaccucuguaaaaauuagaaaaagccacccucucuccaaaugaaugcagccccgugccagggcacaugguuucgccagugaagcaagggcuggauaucagcccccccacucaauguuuggucaggagcuugugcagaacucaacccacaaaacacaauauccuucauggccaagcggucaaggugucauaaagaaaauugagaauccacgacuuggaaugagcuggugacaggugaugcccagaaauagcuuuucuagggcauuaggcuuggucauaccagugacauggugacaugcugcaaacacagggucauuaaggggcccuaaggauguccaacaaguugcucucccaggaccagccccuugcagcucucugcagacuucacagguaggcagaagccaggaugggucccuuguaaaguuagccaccagugggagcggcccggagcucgcagggaauggcaggucugucuucucccagcuccggcucccugaacugugaugagcaauuugucuuucagccuugaucugcugucaguggggcugacacugacuccaaguauuaauuucuucuugagcugucuuacauugcagucgacagagggauggaaaaugaaguagauuugccagauacagaaacucaucacccagcugccuuuauuaguggugaagcugcagggaggaagaaggccugagcugugcuccucuucuuuucuuaagaagcagaugccaaaccccuaaugaagcaucuuucauuuugcagcccugugcuuugacaccuuucugccuucacucucccuuggcugcacaauaucuuagcucugucucucucucucucuuuuuuuuuuugagauggagucuugcucuguccccuaggcuggaguguaguggcacgaugucagcucacugcaagcuccaccuccugggucacaaccauucuccugccucagccucccaaguaguuggaacuauaggcgcccgccaccacgcccggcuaauuuuuuguauuuuuaauagagaugggguuucaccguguuagccaggauggucucaaucuccugaccucgugauccgcccgccucggccucucaaagugcugggauuacaggcgugagccaccgcgcccggccuaggucugucucuuuaaaguggcuaggcagagauauuacaaagaaacccauggacaccccaagucuuuucaucagcuuauaacacgcucacccaucucaugaacaugcccucuugaaggucucuuguguugucuagauugcguuuuauucagguaucuguggugggcagaaagaaacagguucauucagcucaaguuuuuaaaaauguaggaaaucucaugguauccagugacaggacagcucagcuacuugcugugucucuugagcucucaaaaggcaugaaugcucagauaugcuauuuucugcacacucguuucuuuauucuuucucuauccuggcuccuucugcucucgcacacagcccaucauagcugucgcggcccuagaguuuauggggcccucaucuccauacucuguggcuaucuggauccgucuuucagugucuaaaguccaaguuccagauaaggaaaucugauugguucagcuuguaucagguguuucccuuugguccaaucaucuguagccuggagggugggaccauguggucgguauagcuuccugucucugaaauaggaaauauggguggggcgagaagacuucucuagaacauccagaaagagaugcuauagaagcaaaagcagaucuggauaauauauuuuuaauuuuauuuuuguagagauagaaucucacuguugcccagguuggucuugaacuccugggcucaaguaauucucccgccuuggcuucccaaagugcugggauuauaggugugggccacugaucccagcccagaucuggauuuaaaucucuauucauccaaucacuuccagacuuuugaucaauuauuuaauuucuuuaauuaauuuaauuuccagugcaguggccacccaggguuaugccugcaagaccagcuucaagaacauggcuaacaggcaagcacaaagagguuccgccaucaguagaucuccaauuacccugggucugcugcauuuucagcaccucaucucuuugggagcaaaggagagaaguaaagcuuuguauucacauugaguguauugggauggguggguggugagauagucacagcuugguggcccggcauguuuggggaaacaugaaacauaaucacaucacuauuguguagaaugcguccauggccuccccucacaguuaggcucaaggucaaaauuccucauaacagacuucaaagacuucaugaaucagccuaaguguguaucuccauccucaucucccagugugccccauuacacucugcuuauucauucauucauucauucauucauucccacuguucugaaugccugugaugggccagcccaguaguacaggccauacugggccuccuugagcuccugcugucucaugacucagggccuucacagaugcucuucccccuguuacgaauacuuuucccuccaccccuucaucaguuaggugcucccacagaacuuuuguacccuguuccccuucugugucaggacuuauugggaugaagacagagggcagaaauggugcucaucgugcuucccuguacccacagugaccagugcgcuggcugucacacagccgagcaucaggccaagucugcugaauggauuaaugucaaaaaaaggccuggaagacauaucucugccucaugguaaaacgcuaaagacugcugugaagcucauuugcagguuuugagaaaauuuuaauuacugaacauugacaagggaaagaguuuuuguggcuaaaaguuucguggcuaaagcacaugaaaaucagcuucauguuuguggaaggagaagagagguaugcauuugccuggauggggucaaguaggguuucucccuggcucugccccugccccgccuuaucucucucucucaagcacuaacgauaaagauaggaaggucaugagaaggugucagaugccugcaaagagccagccugcuuugugcucacuuacugcacauucuucugacuuuagaaaacaagaauuuuccuuaaagggucucugguuguagcacaggcaccuccccaugucaccugcuucaacuuuccauuguagaucuuagggucugagauaagaaauccuucucauaaguuuggagcacugagacuuuggggccacagaucuaagaguccagacuccacugcuugcuggccaggagaccuugagugacuucgacucucugagcuccagcuuccucguccuuagaaugggguggcaauagcaggugccacugggguugucaugagguguaagugagaggaugcaugggaagcugucaguuuggugccuggugcacaggaaggccacaguagggagcagugauuacuaccacugagucugaguaucaggauaucacacugaggaucugguuuuccaaaggacaaagauagggagcuagagacaguaauuccagagauuuaaggcacagaaacaaauuauccugccacguuugcuuggcaaccacagacuccaauuccucuuguauagggagaacagcuucaauuggagaaauguugacacaccaaggacagaauucgacuuuaaaggucaucauggcucaguucaucauaaagacccuaagcccaugacaauuaauggagauauugagccaaaggcaaaccaagaauagaaacuggagaccuugcagacugaguaguuuuggcccaauaagagaauauuguaggaaauacacuuaauuuaaauauggugcuggucauggggaggaagaaacaaaagucccuguuaauucaaaugaaguguuucacugauuaccguaacagaagugccuuaccgaguggugaccucccugucacugggcauauucaggcaaagucugccugaucuaggguacgucuguguuccagacguguuggucauucacaaaccaccuucaggauauuugccaucucucuacacuaauuuuauuauaauuuacuuaauauuugucucuaauugagcucauuuuagaaacgugauaaaaaguaaacuuacuacuaucacuguaagaagaaagccauuccugcaugucacaaauagaaaguaacuauaaaaguaaauacaauaaaaacaaaagaagcuauucaauuacagcuaggcacuaaucuucacaaggcucugagccugaggccugcccuuucuguuaaaaggaagagcaacaaguccuuagagagguguuaaaaauugaauagcacuaaauugagacuuucuccuuugcauaauaaaaaaggacaaaagagaauuuaaaaacaaguaccuuuucugcuaugcgauuucauguuaaugucuauguaacacugaaaaaucauuucaccaucugcuguuaguaacugccccauccucagagaaacuccugggagaagaauucuagcaccaaaucugggguuggguaagagaagaccuaaaaucccuuccaacucugagauauuacgacgucagguucucacuauacuuucuugauauucauuucccaccaaacgcuggcaaaugcuuaacaaucugcucuccaggggagaaggaaaggcccugauuuacaguguuugccaauucccaugguguaaauauucccaucauggcugauuuuacucuaccaauaugagaucaccaaauuccgaccaagaguuggaaggagaugaauacaauagguucaguaugagcugcuucuagcacacaugacuguucccacccaacugugguuguccucuuaagaauguaaaacaaaacugcuuccaagggauuuauaucuaauacugaaaaaucuugaaaaagccucugagacacuuggccaucucuuagagaaugugugugugagggaugaacuagaagacuucuugcagucccgcuccacaaucugauuccauuugugcccauuucagagauagaggcauugagauacuuucuugccugcacccccacacaaacacuuuaguaaccacugaguugggcuugaccuucaauuguccacuguacacaucuguauguauaugcacaucuauauuuaauuaacaucugcauuucgccugcuggguauucucaaugguagcuuugcuuuauauccaagcaggguguugaggcuucugcuuacuuaacuuuuaagucauggccaaagggcuacccuaccuccaguagcuucccugaaucaguucaaaccagucaucgccuuuccauauuuagcaucucccacacaucaguuaccaucugcaggugaauuacuguguaugacuauggcaauuaaaucuucaucugaucuguuugcacauuucaccauacauacuuucaagaaagcccugggucuaaguaacauugcauugagacccauuaugugccaggcauuauaugauuauuagagugucuauuucagaguugcuaugaggauuagauaagaagcuuacccaccucugccaugccauggcaugcuuccuuuuuguuccuguaacccaacaaagugcagaacaguguuguggaccucguggguacccaaucaacuucauggauggcaguaaggcugcccauggcuccagaugcaagcccuggcuucaguccagucuagcccuuucaacaucuccuggguguccaggccacaaaacauuugaguguccuccaccuggaaaaugauguucuauauaucaucacuuaagcuuaauugugagugguuuggaggacaccccacauggggugauuuuauacacgguuauuauguuggcauauguguuucaugaucuguggccuuccgcagcaacaacuauuuuuagcuuccuagcaaaggucuggcaugagcuccuaguguuuucuuuuuuucuucuccucuucaaugcuggaauuggccucugccugguaaaaccaagccaggccgagcugggggcuuccagaaugaguggagaacuacugaauaaagcugucgucugaugaccuugcccucuugucccagacccaccagaauguguuggcccugggcugagcauugauuguuaucaacaucuuagauggguggcuuacccaccauguacagagggaagauucgucuaugggucuggcucucugcacauauccaacaggcucacugccugcugucuugacaagccugugucaaucuuggccugugcauagggcuuugcuugugauacuauauaggcuugugccuugaggaucuucgcaaaaacaaaaacaaaaacaauuucaccaauccacuuacaacuguuggagggacagcaaauuucagcugugucuggggaggcaggcaccauguuuguuaagagcauggacagaccuggguuccaauccuaucccugaugcuuauuagcucuaugaccaguuaccuaauuuucuugagccucagucuguggaccugcaaaaauggaaccaauuacacuggcccucaugauguugcuguaaagauuaauugagguucuugguuuagugcugauacaggagcuagaaagaaauuauuuaggcagauagugaggguaagagaguccuugguaagguuucccuuuuaauaaaaggcagcccccaaaucauuuccuuucuaacaaagagaagccuguaaaaucaagcugcagacauagaaaggcaagcuagaagcuugcacgggugaaugccagcagcugugucaauaggaaaaggcuaccugagggccaggcauguucaacaugguggcuccaucuucccuuuucuuugucaaccacguguacaguaaggaacagacaacacggcacccgccagguagagaaccgaucugcuaguaagagauuagggugggauggccagcuucuuugcauacuaugcaaacgucauaccugguccgacugaucucucgggcucuaugugaaucagacaccgccuccucaagcuuuucuauaaaaccccgugcauuucaccauggagcuggaagucccacuugggagcuccucucucucugcaagaaagagagcuauucucuuuucucuuucuuucgccuaugaaaccucugcucuuaaacucauuucuugugugucugcguccucgauuucccuggcgugagacagcaaaccucgaguauuuaccccagacaacgaugccacgucugugccuggcauaccgcaagcacuuccuuaugcuccuuggcaaaggguuuaagagccuguguucacacagcgguuaaauuugguguagaaaaaaauguguagagguaaaaugaaaagacuuugaaaccaaauuuuccuggauuugauuccaaauuuuuucauuugcuaguugugcguagaagugggaauauggaaggacucacacuaaauaguuaauaacuguuuuguaacuauuuuguuaguuauuaacuauuuaguuaguuuaguuaauaacuauauagugaccaguuguuacuucuggaguaaaacugguuugggaugauggugaaugauacuuuuaaccuuauuuauaauauuguaacuguuuacagaguuaauguagugauguuauuacuugugcauguaaacacugagaauaaaaagaaaacagaacugauuauuugaauuuaccagauuuuugugguuacagagacaaggcuuuacaacaauuggaagauauuucuuauuuuacuucuccgucucuugagacuuggguuggaauuuuuucuuucuuucuuuuucuuuuuuuuuuuuuuuuuuuuuuuuugagauggaguguugcucugucgcccagacaggagugcaguugcacgaucucagcuugcugcaaccuccgccucccaagcucaagcgauucccauacuucagccucccaaguagcugggauuacaggcacgugccaccacacccagcuaauuuuuguauuuuuaguagagaugggauuucaccauguuggccaggcuggucucgaacuccuggccucaaguaaucugcccaccuuggccucccaaagugcuggguuuacaggugugagccacugugucuggccugaguuggaauauugagggcuuagucuccauccacauugucuaguggaagcuugcaaauacuauccagcccagagaaagacaaggccuuucucuagcccuaaaucccugcagcuacagaacaucccccaauauuccaaaauggguaaaugaccccagccccaacuacuuauaccauugccuauaaaguagccacucuguuggaaauauauaggggcacacuguuuaaaggauauaggagccuaagggagguuugggaaugaaccagacgaagccagcauccugagauuaccacuguguacuuaggaccauccccugaguuuuauuuuauuuuauuuuauuuuuuugagacaaagucuuacucuguugcccagccuggagugcugugacucaauucuggcucacugcaagcuucauuuccuagguucaagcgauccucccaccucagcuucccaaguagcugggacuacaggugcgugccaccaugccugacaaauuuuuguauuuuuuguagagacgggguuucaccauguuucccaggcugguuucaaacuccuggacucaagcgaucugcccgccucagcuucccaaagugcugcgauuacaggcaugagccacugcccucggcccuguuucuucauucugguuaauuggagaccugcagguauuccuggaaagauaggacaggagggaucaaagugaucaaggaugagccuuguaguguaaggcaguuuuuggcaaaccccaaucuucagcucagagaggguugccucugcuguuccaauugagugggcuaagcuucacugggguauuagcaagugcguuuuucugaagguggccaugcuuucuuuguuauuaaugaaauacaagaagaaaacguguccaacacacaaauccagaugggcgugggugugugggcucucuuccaacagccacauuucuugguauaaugugaccuuucugucugauuaccacucugcucuuuucaccagaggaaagucaggagaggaggucuuuuaaagagacaacgggcaaguugauuagguggcuccacguuugucagacuuuauacuaagagcuucaagggaggggcugguuguugcaggaagaagcugaggacuugauucauuucgaaaacuguccccagggccuucuggcucacccacuuccccacauugcauccugcaugcaucagaaacacaugaaauuuucaugacauccaagccacuucccuccacggcucuauuucuguucauucugcugaaaacugucuuugucauauacagggagcaguuuagguggacgaaggacucuggucucucagucccugacuccacaccccauuauuuugauugauuaaguaaaacacagccaucagugagcuauucauagagagacaguuggggggaggggcucauggacacauuuuauuuguauggggacauucucugaugggucaguagguaggguggagggauguggcccagcaaagacagcucagggggaucuuucaaguccagugcggagaaagcaaugguguacuagcuggugagggugauugcaugagagcugauuguaugcaucugcuucccaauucuuuguucagugaucgauagcuugaaauuggccacagugggaauauuuacaccauggaaacuggcaaacaaacauugcaaauuaggguuuuuugcuugcuuguuuguuuuuuccagaaagcugguuguuaaacauuuaccagcacaucaauggggcaaaaguuucuguccauauggauacauucuuaagacacguugucccuaaaccccacugucagaggcgcuggaaacagagcaacucuauuuugaauagggacuggguaaaaugaggcugagaccaacugggcugcauucccaggaggcuaggcauuccuagucacagaaagauaggcgguuggcaggacugguaucacaagauaugggucacaaagacccugccgauaauacaguaugcgguaaggaagccagccaaaacccaccaaaaccaagauggcaaugacaguaaccucuagucguccucacugcucauaauuuuaaugcauuaugcuaaaagacacucccaccagcgccaggacaguuuacaaaugccaaggcaacaaccagaaaugacccuuauauggucuaaaaggaggaggaacccucaguucugggaauugccugccccuuucccagaaaacucaugaaaaacccaccccuuguuuagcauauaaucaagaacuaacuauaaauacacucaguuaagcagcccaugccacugcucugccuauggaguagccauucuuuuguuucuuuacuucucuaauaaacuugguuucacuuuacucuauggacuugccccguauucuuucuuaugugcgguccaagaauccucucuuggggucucgaucaagaccccuuuccaggaacaccaccaccccucuauagcaucucucaucauacccuuucccguccagauugcaacuaucuauguauuugucuuuauuauuucuauaagguuuccuuuccuagcuucauacuuacuaccucugaaguugagcaagucaguuaacuucucugugcuuuaguuuucucaucuuuaaaaaggaggagaguaauagcauugacccuuauagguaauuucuucauggcugccauggaugagugguguaauacauuauauuuaauauuuuaaucuauuuaauccucacaauaacccagugacaaagguauuauuauccaucuaaggacgagaaggcccucagaucuuaagucucuagaugaaagucuaacagccauuaaguggcagagcugggauuagaacccagagcuuuuggaauuucaaagucuguguaccuaaccagcacagaaaacugccucuucagcauagguuuucucccucuggcaaguuggcuuccuacuacucagccccugggcaagagcugguguucugucaggagcagaaaaaaaaaaaaagauaaaguucucuucauuuccuucaaagaaaccuuucuugccucaaagagagagugagaaaggaauuggcucaaguucauuugaaauuccagguucauuauccauguacuuaaagccugucuagauaacaaaugaaacgugaaaaauguagucaaucauccacauguuuggucucugccaugucagaagugguguauuuuagaaacaucuggauggcuagaaaagaggcuaagccaagcuuccauuaaugagaacuuguggaaaugaagggggacgccccccaucucauuuuacagauaagggaacugagacccccccccaccccaccccggagagaaaguaucuugccuaaguuugcacagauuuuugguggcaaaacuaaagcauaaacuuucaccagugcaguuucaaguccaccacgcugcuccucuuugcugaaauugcucaccacggugacagacaugguccuacacucagaggcauguaguaagugguuuggcagcaagcuucuauugacagugccucaauugugauaagcaggguuggacugaugaaaaccccuauuugcaaaugaggaaacugaggcucagagagguuaaguaacuggcucagagucacauagcugccggugggguuuagagugauuggagccagcuuuucuuuaggucaaucaguguucucuuaagcaccaccaaaagaaucacagauuauuuauugaguaaaugcuaugugcuaggcauuuuaugacuguaagggaauuggaguuauauucugagcuccccauuuagcaucaggaaguugaaguugcuccaggguuagauccaggucagucagcuugacugcauuucaguacuuuguaaaggagacgccacccacucugcagcuuaaaccugacauugcccccuccuccugauuccacguuuuccaaaauucaaacuuucacuuacaaucaucauaaucuauugugguacucaugcacugccacuuuuacuauuaauauuuuucuuuacaguaacguuaaacaaaaaaccuuaaguaucuacuuuaguucucuccuaagcaauaauauccacgacauuaugcuuuugaaacgccuuguuagaguuuuccuaaugcacuauugaaaugaacacaucauaaacaaggaagagugaaagugacuguccauuuaaaauuacgcugcaugucaccauggcguguguagcaaccucuaaggcccaggcauuguggcuuguuuaguggguuaugcaaccaucucuagggcccagguguugugugaaaucuaugucaugccugcugauaaggcggggggacucaagcaccgagauaucucucugaguggggauucguagguggaggcugaacacugaagcauuuuccagaagcagcuuuggacuauggcacugccugacuuccauaaugugggggauuuuuaugugucaaucaaaucucugagauuuugcccagugauugucucugucuugauuuauguuacccugggacccuggaagccacgcuaugggagggugguuccuaguuacuaggguucuauacaucagcucuaaaccucacagucucuugaaagauugacauuaugccccaguuuugcagaugagagcucagagaggcaaaguggcacagccauuaaguagagaagccuagcuucaagcccaggcuagccuaacucuuaaagaucaugcuuaccugccauucuuauuuuuuauuuuugagacacagucuugcucugucacccaggcuggagugcgguggugugaucucagcucacugcaaacucugccuccugggcuuaagcaauucuccugccucagccucccgaguagcugggaauucaggcacgauccaccauacccggcuaauuuuuuuguauuuuuaguagagaugggguuucaccauguugggccagcuggucucaaacuccugacaucaagugauccacccgccuuggccucccaaagugcugggauuacaggggugagccacugcguccggccuaagaucaugcuuaccugccauucuaaccucuguccuagugccaccucccaccugggaucaccagauugagagaguccuuagguggcaucaucacagagacucagcacaagccccuuuuaauaauggauguaggcucuaguggaugggcucuucccagagccagggaggggaauuccuggccaggcucugcaggaagaauuccaagcugguuuguuucuugaagcccggagaaaagccuauuccuaaagaaaugaacaacucugggguuaggaaacacagcugccuggagaacuggauggaugcugugguuuguuuuagaaaauugaaacagcaacuugggagcgcuucugagaucccaccaaugggaaaaccucaggcucagaaaagagaagugucuugaccaagauuugauggcuuuuaagcgguagacaugggauucuaacccagcucugacuauaaggguaguuguuuuuuucugacacaaagcagaccgagucauucauucacucauucauuucauucauucacucauucauuccacaacuauuuauugagccacugcucuauccaggccuugggaauagguugggaacuaugagauuugggcucuggagaaaaaucccugaaguuuucuggcuuuaagcccuuccuccccucucuccuauugaacauggguaccacuuggggugggggcagugucuugcauuuuuuauuaauuaucucaaguaucuauuuugcugauggagacacaaugucaugaucugaucuuguucuccuauagaaggaaucaaguccccagugauggugguuuaaugaagaaacacaaggcugucucaagaaauggaaucagguagagagaaccaacccauccaaucgcugaggcauuaggguccagggcccagggugauuaaaaagcuacuauuuuauuuuauuuuuuaaaauagagacagugucucacuuugucacccaggcuggagugcagugcuauggucauggcucacugcagccucaaccuccugggcucaaaggauccucucaccucagccucuuaagugccugggacuacaggggugugccacuauaccuggcuaaguuuuuugaaaauauuuuguagagauggggucucacuauguugcccaggcuggucucaaacuccugggcucaagugaucauccugccucagcuucccaaaguguugagauuacaggcaugagccacuaugccugccucauauucuaaaccaaacuguugaagaguaaguguuuuugaugaaugcccccaccaguuccaggcuuaaauuauuacugaacuucugcauuucagccuucaaggccuagguuguuggugagaugucagagcuguuccugagaugagcagggaggaguggacugcuccauccacgugaccccuucacauagacuucaggcccucaaguacaguuuuaaagagcuguguugaaaauaaccuucucucauccauccauaccugugauguguguuugggauuguugccuugcaaaugagguauaaggugucaccuuugcgaggcacuucuuuucucaacucgacaugauauucuggaucuauucccaagccuaagugagcacggcaauucauuaucaugacaacuuaagccauagucccggauguggaaugcaccacggggcgcacugucugccugacauuuggcaacuuugccaagaacuuaacaauagugcaugauuauauuugauaugcuuuccuuaauucauuauggauucuguggguuggagagaaauggaacuuuaaaauggauuguguuguuuggaauugucuaagugcaggguugggcuuaugggacugaaucaggcguuggacagguucaggcauguuggaacacguuaagugaccaccuuuccugaagcggccucaaagcuggucuggccuggucucuucuuguguuugauagggagguauacguccuuauccccaagcugaauuuacucauuuguauuuccugccugggucuugaagacauuuacauuugaaaucccugauuuuaggugguggauugaaaggcaaaauucugaauaauugaggcacuuacugaugcccuuggcaagccucugaacccccauuucaccacauucauucauucaacaaccauuuacuggcaccugcuccaugccaggccccgugcuagguacugggaggcagcaggcaauaguaauuaacaaacacaacauacgggaugcugcuucaacacauuaaccuccuaacaaccccacgagcuaauuacauccuccuaacauccucccaacagcuccacgagcuaaguauuauuauuuucuccauuuguagauggagacuguggggcucagagaggcaaaguaacuugccuauggcugcacagcuagugagcaaguccauauucuuaaccacuaugcaucaguguuucucuggcaagaugauuuccagggagcuuacauuagcuuucaaggauucagugggcuuuaaaguucugcagcccucugaaucucuggcacucugcagauuuaagaaauuuaaugcaauacaaguguuuuuucuaacccaauaaaacuagaaagcuucccccaucccccaggaaugcuguuugucagcucuccacuugcaguguucacccuuuucugggcugaaaggggagacuuccuuggagaugagcuuggugcuuugugccuuguaaaucuuuuuaaaaccuacauugcgagcgucuuucucuccaaauauggcuacuucucaggccuggauuuagcauucauuccuccagcacaggaaaggaaggccucguauaaggucaugcuuguguuauuuucuucucuuguaccaaccugccugccugcuuuuaccuccuguaucccuaguucugcagccuugaguucuaccagcugagaccucacugugugguuggauauugagacucuuaucuuuccacaauucuuccucugucaccaaagagaauaggcauugucuguccccacccauuccucuuucuucauccucucuagacguuaguucagaaaaacaagaggaaaggggaaaaagaacuacgaaacgaucagguuaucaccagcauagaaagagaaauaauuagcaccaauuaaauuugggguauuacagauaaaguggcgacuaaguggagguuggccugaaccgaagcacagagaugcaaccgggccacguuaauuacgagcagggauugucauggaaacccaaggugggcacauucaugaaccuguguuaauuacauggaaauagcugcacugcaaaauggugcugagggcaaaagggcauguauuugaaaguugaggccacugguacaaccuuuagaagcugcugaugacaaacccaauuucagaugguuucccccaugguugcaaauucucagcucagaagucggaaggcguaauucuuuauugugaggccgagaguaccgcccuguguuccccugaccacuccagucccucuccagcaagcuccuuggacuuucacaugauccagccacaaaagaguuaauggcggguccgguguccuagccauacugauugcuaaacauuuuaauaucauuuacuaucauucucagcuaauauuuauuagacaagaaaaaugagguuugggccaguagcucaagguuguacagcuauaaaauggcagcucuauggcuugaacccaggaauucuuucaucagagccgucuucuucuuuucuaucuucuccucccccuccuccuccuccucuuccucccccuccuccuccugcccuucccccuccuuuuucuccuccuccccuuccuccuccuccuucuuuucuucuccucucuucuuccuucuuccuucuuuccuucuccuccucccccuucccuccuccucccccuccuccuucuucuuguucuucuuuuuuucuucagaaaaacagauuuauugacauauaauucacacacaauacaauucacccauuuaaaguguacaguucaaaaguuuuuaagagacucacagauaugugcaaccaucaccaugaucaauucuggaaacuuuucaucagcucaaaaaaaaaaaaccccuuuauauauuaccccauuauccucccaggcuucugagccccuggaaaccccaaauuuaccuucugucucuauagauuucccugguuuguacuuucauaaaaauggaucaugucauaugcauccuuuugugaccagcuucuuucauuuugcauaacguuuucaagguucuuccauguugcagguugcauuaguauuucauuccuucucaugacugaauaauauuccacuguauggauaggcuauaucuuguuuaucuguuugucacuucacggacuuuugggcagagcugucauguugaccucuacauuguacuaagcuuucccaaggucacagcuaagggcaaaccugggacucagaccuccauaacucaggcacacaaacacuaaaauagauaucuuauucuauacuuuuaaauaaauaugugaagaucccauaauauuucaaaugcagaguuugggggacuuggaggauauaggcgguggaauuaucauguagggaaggaaagcuaugagugacuuugaaggaacaagaaaaggagacucgagggcuuuuucuggagaggguuuaacuuacuucagaggguaggacuauagcccuccaugaccuugcacaaguccucuuaaucucucugugcuucaguuucuuuggcuguaaaaugcaggaaauaaucauaccuacuuuuuaggauuguuugaaggcugaguuaaucuguggaaaagugguuagaauugugucuggcacauagcaaguaugauacguguuuucaggccaggugcgguggcucacgccuguaaucccagcacuuugggaggccgggguggguggaucacuugaggucaggaguuugagaccagccuggccaacauggugaaaccucgucuguauuaaaaauacaaaaauuagccaggcaugguggcgggugccuguaaucccagcuacucgggagggugaggcaggagaaucgcuugaaccugggaggcagaaguugcagugagccgagacugugccacugcucuccagccugggcaacagagcgagauucugucacaacaacaacaacaaacccuaaggguuuucuguuccuucuguucuuacuuaggagguauccucuggcucgucuugaucccacggguacauggggugggucccugaaggcuguacucauucuaagagacccucacuaucucacugcccuugcccuggaucucaguuuucucauccauuaaaucaggagaacaggcacaugccaucuaagcauguuaagacucucucuugcuacuugauuuucucaugaagccccacacccccacccagggcacaguuuucugugugugugucaaagugggguuucuuaggcccuccagucagagagucagccauccugugcccuaucccaucuccaccuugcuccuccuucaggagaaguguggauucaggagagagcaaagguucaaaucaagggcuuugguggaaagcagaagagucuccuaaacaugaguuuugaagacagacagagcugggcucaaauccugcuaugaccguuaauaccgucaccugggacauguuaucucgucuccuugacucugauuccucauucauaaaauggagcuuaguauauuuaguauacuucucacagguguucugaggauuaauuggaauauuuuuaagaaaugucuaucacaacaucuacgucacuguguagaucuucagugacguacuaacuggaguuuucuuaucucuaaaacggugauaaaccaucuacccugugguuguuugagggugaaaugagggaguucaugugaagcaucuuagcacaguguguguauguguguauaucuaucugucuauuuauauaguuaggucuagauauaucucaauacaucuuuauucuuauuauuacugugaggccaggacuccaggugggaagccuggauguuuucaacauuguaaucuuggccccauugcccuuuuacuuauuaagcagaucaugguccccacaauuugugaguuuacuggagagaaacuguccugaucuccauaggcuguuaggcaccugccugugugucuccuaucaaagagagcuuccgcugguauucuaaucacauuccucuguuaauaccacauauuucuauguaaaaggaaacaaauuacaugcagacaacagcaaauaugaaagcuugcagcaacacuuucauuguucaggcagcguucuuugcucacugcuucugagaauauaaaguuaauuggcaguucuauuuaucuugcuuugguuaacugauagaucccuuugcccuuuagucaguaaacaccucuugguauuucucugaucuugcuuucuuuuagcccuugccucugaccgcaaaacaaaacaaaacacacacacacacacaaaaguugacauuuguauaaugugacaauuuccagguagacugcauaggauuuaauaaauuugucagucaucagugucuuuauuuuuaauuuaaacaaugaacuaaauacaaacgaggaaacacagacaauaugcuaaaggauuuccuuuccuuggauauuuauucauucaauaaauagaacuuuuuuuuaguguucauuacugccaggaacauguugauccuucuugaaucugucccuuuuguuccaucuccuuugcaaucagucuaaccagggcucgucucaggacagggaggaagcaugaguuuugaggccagauagagcuggguucgaauccugcuaugaccacuaaugcugucaccugggacacguuaucucauuuccuugaaucugauucaucguucauaaaauggagcuuaguauacuucucacagguguucugaggauuaaauggaacaauauuuuuaagaagugucuaucacaacaucugccucacuguguagaugcucggugauguacuaauuuccaacugccuuccauguccacugaguuuucuauacaccucagagccugucuccaucuucacaucauucacucccagucauccuuggcucucaucucaaaugcuuuuucagggagcuuuuccugaaucccuggacaaaacaaggucuuccugcuguuugcuccugugacagccugugcuugccuuucugcaacacucaucaugcuugcgguuguccaaagggagaucgccccguggaucuccucugugcucuguucccagcggagucugugcucuguuaccagugugggcaucaauuauaagaugcaccggcaaauuacuuuuaucuucucagacuuuuaaaagaaaaacuggaacugacccaacugugcaucaacaggugaauggauaaacucuguuauauucauauucaguaauaaaagagagcaggccacugauauguccaacaacaugaugagucucaaaaacauguuggaugaaagaagcuagacacagaagagcauauacuaugugauucaauuuauaggaaauuagaaaacagaaaaaaagaaauuaacuuauagugauagaguauagaugaggaguugccuggguuuuaggguaggaggaggggauugacuucaaauggguaugagaggucuuuuggggacuauaaaaaugcucuauaucuugauuaggauggugguuacgugggugcauacaaucgucaaaucucauugaacuguagacuuaaaaugugugcauuugguuauauguaaauuacaccucaaaaaguugauuaaaaauaaaugaguauaucaaagucaaaacaaagaaggaaggaaggagagaagaaggaagggaagcaaauauccuagcucgaaaccgccccaaauuaaagcuuguuuucaauuucugaguagguuguggcaguuagugaaagccuauuguuuucauugcaacagcaagauuacaaggaucguauuuucgaaggcacuggagagccauggaagcaaaagaagaacuaaaauuucagagagugaagagugcugcuuagaaauuaugaaagacauaaaacaacagaaugacauauuuaaagugcuaaaaaaugaaaaucccaaaccccaaacaaccaaccaaacaccaaaacccaagaaucugcucaccuacaauucugucuccaauaaaaguauuuuucaaaaaugguagcaaaauaaagguauuuucgcaccuacaaaagcucaggaaauuccucaccaccagcaggucugcacuacaagaaauacuaaagcagcucuccaggcugcaggaagucaaucccagauggaaacaaguacccacagaauagaacaaagagaccagauggagcaaauguaugaaugccuggauagaauacugacuguuuaaagcaauauuaauagcugugucuuguggcuuucuaauacauauagaaaaaaagcuccaacuauaauaaaaagaauggauaaauuugacuuuguuaaauuuaagaauuucugcuuauggaaggcaccauuaaaggaauaaaaaggcacuucgugaauacacacacacacacacacacacagaggacucauaccuagacuauauaaagaacucuuacaagucaauaauagaggacaaaauuuugcaaagacagcagacucaaacaggcauucacaaaagaggaauccaaaugauccguaacaacaugaaaaguuguucaauaucauuacucaucaggaaaauucagguuaaaagcacgaugagguaucacuacacacucaccagagaggcuaaaauaagaaagacuaaauuuugaugaggauauggagcaacuggagcucucauacauggcugacaccuuagaaugcuggaauccugccaauuucuuucuuuuuuauuuuuauuuuugagagggagacuggcugucucgcccaggcuggggugcagcggugcagucucagcucacugcaaccucugccuucugcauucaagcgauucuccugccccagccucccgaguagcugggauuacaggcaugugccaccacacccgcuaauuuuuauauuuuuaguagagaugggguuuugccauguuggccaagcuggucucgaacuccuggccucaagugaucugcccaccuaggccucccaaagugcugggauuauaggccugagccaccuugugggccaguuucugauuaaacuaaaaauauuccuauucuaugacccagcuaagaaaaucuaguguauauguucacccaaaagacauguaaaagaauguccaagaagauuuacucauaauaguccuaaauaggaaacacuccauaugucuaucaaugagaggguaaagaaauaaauuaugguauauucauacaagaaaauacuauuuaccaaugaaaaauaauaaacuacugauacgugcaacacuguggauuaaaucacccagauauaauggugagcaaaagaagccagagguaaaagagaauauauacccuaugauuucauuacaugaagaucaagaauggacacaacucaauauuguaaguuagaauacugguuacaucugugguggguguaguauuuauuuauuuauuuauugcagggagaagugggugcaguauugauaggaagagaugagagaaucuucuggaauguuuuauauauuuauuaaggucaugguuaacagguauauagauauguaaaauuuaauugagcuguaacuuaaguuuuaaacauuuuauggcauguaauuuacaccucaaauuuaaaaggggcugagucuccccuaagccccuucucaugcauccuagaaucaaccuccaagucuuaaauaaaaacaaauuauaaauacauacaaguagguaaguagauagauauagacacagcuauagauauaagauagauguuuaaauaaaaaugggauuagaauucuggccacaauacauauguguuuguccaggacaaucuuaauuuauauguauuuuuccaggauaacugaugaugcaccucauuuuacucugaaaaguguccaaguugggcaauaaauuauauggccauacucauuauacuguacauacaaugaucacuccccucauuaaacuaugcacaauggccaucuuuccaugucuauauguacggacuuaaccuuguucauuuuaguggcugcauaauauuccacaguaugcauggacaugacuuauuauuugauucucuuauuggugcacauuuugggcuguugccaguuuuuugaaaauaugauuaaugcugauggaauagacacuaacuguuuuugucuugucaacaguugggcugccuucuuuugaucaaagcaccuggauuuucaucuugggacuuaucccuucuccauccucaguacauguugcucaaauguggguaacccuggucucugggcuccaagugaauaacucaggggugauucuuuugcgacccuugauguuucuuuacagaaagagaagcuuauuuuuuuuucccugcuguuccuaagccagaagaauuuaaaccuggagcugcugguggccauuuugacacucaauaaagagcucuugccugagaaugaaaccaucacaaauggaaauagagacaaugaauauaggcagauucuugaugacuuugucuaaacucuuggaucuagcuaugccugaaaccuuagaguuucuguaaugugaaccucugauuccaauauuuuuugcuuguguaaauuugagaggguuuuguuacuugcaacuaaaagauuuuugauaaaauagaccugugauagacuugagcucucccucucccucucccucucgucucccucucccucucccucucccucuccccauggucucccucuccccauggucucccucucccucucuuuccacggucucccucucaugccaagccgaagcuggacuauacugcugccaucucggcucacugcaaccucccugccugauucuccugccucagccugcggagugccugcaauugcaggcgcacgccgccacgccugacugguuuucguauuuuuuugguggagacgggguuucguuguguuggccgggcuggucuccagcuccuaaccgcgagugauccgccagccucggccucccgaggugccgggauugcagacagagucugguucacucagugcucaauggcgcccaggcuggagugcaguggcaugaucucggcucgcuacaaccuccaccucccagccgccugccuuggccucccaaagugccgagauugcagccucugcccggcugccaucccaucugggaagugaggagcgccucuucccggccgccaucacaucuaggaagugaggagugucucugccccgccgcccaucgucugggauguggggaacgccucugccccgccgcccuguuugggaugugaggagugccucugcccggccgccaccccgucugggaggugaggagcgucuccgcccggccgccccgucugagaagugaggagacccuccgcccggcagccgccccaucugagaagugaggagccucuccgcccggcagccaccccgucugggaagugaggagcgucuccgcccggcagccacccuguccgggagggaggugggggggucagccccccgcccggccagccgccccguccgggagggaggugggggcgucagccccccgccuggccagccgcccaguccgggagggaggugggggggucagcccccugcccggccagccgccccguccgggaggugaggggcgccucugcccggccgccccuacugggaagugaggagccccucugcccagccagccgcccuguccgggagggaggugggggggggucagccccccgcccggccagccgccccguccgggaggugaggggugccucugcccggccgccccuacugggaagugaggagccccucugcccggccaccaccccgucugggaggugugcccaacagcucauugagaacgggccaggaugacaauggcggcuuuguggaauagaaaggggggaaagguggggaaaagauugagaaaugggaugguugccgugucuguguagaaagaaguagacaugggagacuuuucauuuuguucuguacuaagagaaauucuucugccuugggauccuguugaucugugaccuuacccccaacccugugcucucugaaacaugugcuguguccacucagaguuaaauggauuaagggcggugcaagacgugcuuuguuaaacagaugcuugaaggcagcaugcucauuaagagucaucaccacucccuaaucucaaguacccagggacacaaacgcugcggaaggccgcaggguccucugccuaggaaaaccagagaccuuuguucacuuguuuaucugcugaccuucccuccacuauuguccuaugaccgugccaaaucccccucugugagaaacacccaagaaugaucaauaaaaaaaaaaaaaaaagaccugugauaagcaucuaucuauauauuuaaaaauauauguauaaguacucaauauucucaauauuuauucuugaggacaguacuuauuaggaauauuuccaugcaaucaacaccuaaaagugaaaugacuacauaaagggucuugguguauuuaaaaccauguuccaagaauguacagauuuucacucucaccuacaccagugcuuguuuccccacaucuggaaguagaucugagauguguauaacaacggaaaaaugaacaagagacuugaacuggcauuucaugaaagaauauauccaaauggccaauaaaccuaaaaaaacaugcucaaccucauuaggcauuaaggaaaugcagauuaaagcauuuccacaauaugauacuacuaagcacccaccagaauagcugacauuaaaaacacucacaauaccaagauuguugaggauguggagcaacuggaaauuuccuucacugcuggugguaguauaaauugaaccaccccuauggauaacuguuuggcagcauauaaagcuuauaaggcugaacauaugcauuuccucuggccagcaauuccacucaugggaaaucuacauuuauucaccaaaaggcauuguacaaaaaacauucauagcauuuuguaauagcuccacucccaucuucucccugaaacacaacccaaaaguccuucaagaaguaaacagauaaauaaauugugguacauucauauuguagaauacuauauagcaaugauaaugaacaaaugacaguuaugcacaaaaauauaagugaaucccauaaacauaacauugugaaaugaauccagauccaaaagaguauaccccauauuauucauuuauaugauauucaagaaacaggcaaaaauaauugauggugauagaggucaggauggugguuaccauuggggagaaggaggaccaugucugggaggauguuugaggggguuuuuuggguucugguugucuuagucuguuuugugcugcuauaacagacuacuugagacuggguaauuuauaaugaacagaaauguauuggcucaaaauggagacugggaaguccaagauugaggggcuggcguggcaucuugugggaaccuucuugcugugucaucccaugguggaagguggaagggcaagagaggggugagaaaggacaaaacucacccuuuuauaauagcaauaaucccauccaugaggguggaggcuuucuggucuaaucaccuuauagggaacuagaggucauuauagcaagugaaauaagccagccacaggaagacaaauauugcauguaaucaccugacaugguuuggaucugugucccacccaaaucucauguugaauuguaauccccaguguuggagguggggccuggugggaggugauuggauuguggagguggauccuccaugaauggucuagcaccaucccccuugguacuguccucaugauagugagugcucaugagaucugguuguuuaaaaguguguagcucgccuugccccccacuuucuuuuguucuugcuccugcuguguaagacaugccugcuuccucuucaccuuuagccaugauuguaaguuuccugaggucuccccagaagcugagcagaugccagcauaaugcuuccugcacagcuugcagaaccaugagcaaauuaaaccacuuuccuuuguaaauuauucagucucagguauuucuuuauagcaaugugagaaaggacuaauauaucucucauacauauuugggaucuaaaaaagcugaucucagccaggcacgguggcucaccccuguaaucccagcacuuugggaggccgaaguggguggaucaccugaggucgggaguuugagaccagccugaccaacauagagaaaaacuguaucuacuaaaaauacaaaauuagccaggugugguggcacaugccuguaaucccagcuacuugggaggcugaggcaggagaaucgcuuaaacuugagaggcggagguugcggugagccaauaucaugcuauugcacuccagccugggcaacaagagugaaacuccaucucaaaaaaaaaaaaagcugaucucaugaaguagagaauagaaugauagcagagccugggaaagauauggguguggguguugggaauggagagagguuggugaauggguauaaacauauaguuagauggaagaaauaaguucuaauguuggauagcagaguaguguaauaauaguuaucaacaauguauuguacauuuaaaaauagcuugaagugaggacuugaaauguucucaaaacagaaaugauaaaugguccuagugacagguauccuaaguacccucacuugaucauuacacauacuaugcauauaacaaaauaucaccuguacccaucaacauauuuacaaauauuacauuucaauaaaaaaggcccccaucucuuaauggugcuacaauggcaauuaaauuucaacaugaguuuuggagaggacaaagguugaaacaacagcacugguaauggucuguaucuugauuuuggugaagagguugcauggaucuuuucacuguguaaaaacuuauaaaacuauguacuuauauuugugugcuuuucucuauguauguuauacuuuaauaaaauuguuuuuuaaagcauuugggugagaauaaaauaauuuagaaaaauucuacuaguggaaaagaacuucagaacacagagagaaaugcaagacauugcaaaauugguccugaugcaagauacugcaaugaugaaaggccaauuuuucaggccuuuguugcaaaccugaagugaaacaucugauauauuucucauuugcauugcuaggaauuuuaucuuuggacaaacacaggaauaaagugaaaaauggaccaagagccaauaaaggaagaaaacuggauggaaacuuuggggaaaguucaccacagugccuguaucuggggacugauacuguauugggaaggagauaauucuggucauauucugcacuagauuuuggaaggaaauggucugaacaaucucauaaaagauugacaugaguucuuugcuaaagucucuagaaagaaauauggcauuagaugggugaggaacucuagaaaaugaaauaaauaugagugaaugaaugaauaugaauauaaaugaaaugaaugaaauaaaaugaaaugaaauggauaacuauguaucauucuaauaacaaagcaaaaggugcaguaccuagggaaacuugauuuccauagaacaccucaucucagauauucaaagagauuucacugaagauggcugguuccaggaguaaauggcccucuagaauauucuggaauuauccagaaaaucuaaaguuaagaaugaguggaaacuuaaaaagaacaauacauuuuaaauagaguuuguacuguuuagagcaaguagcuguacaaggagauaauagguccacuauuugcggaagauguugcauuaauuuguucaacaaauauuuauuauguuuuuuuccauggggcuuaacugguacugagguaggaggcaggacuugacugaggaggugggacuuggacacuggaguaaauugaggacuagcuaaaacagggacaagguggaagcaguuuuuucugagccacauccaccagcaugccaugucagcuuaccacugccauggcaacaacuggaaguuacccuuuccauggcaacaacccgacaaccuggaaauuaccacccuuuuucuagaaaauuccacauauucugccccuuaauuugcauauaauuaaaaauggguauaaauaugacugcagaacugccucugagcugcuacucguggcacacugccuauggggcagcccugcucugcaaggagcaucaguucugcugcugcuguacacugccacuucaauaaaaauuguugucuaacauuaccagcuugaccuugaauucuucccugggcaaagccaagaacccucccgggcuaagccccaauuuugaggcucgucugcccugcgucaguacauaguaggugugcugcaaauggguuuugaauaaaugaaugaauucaaagaucauuaauggcuguuccugcucugaugaaucugcugcugguggugacacagacguaucagcaguugcaugaugaaggcucugacuguggaaccgcacagaguuagggaggaagaaaacaaggagagaguuagagaaagcuucuuaaagggaggaacuuccuaaucugucugguuuuaaugagcucugaguaugugccugaacccaggccaacaauuuuaccaacaaauaggaagacaauguagaagaucagaccaccuauuaguacugugcccaccucaggccagcccucucucagggagaccaagucacccugguuacccaaguuucaagacuuuuaaaaguaggcacugucuuuaucuccauuuuguggauaaggaaacugaggcuuggcaugagaggugauuuguucaagggucaaacaggaagaaaauagcagagccauggcucauacugugccugauagccaaaaacauuacauauccucccauuuuggauaggaagcugguuagaugcccugcaagguuacucuaugauucuguggcucuagaugaugaggccccaucuucagaacugggagaaucuauugguuuggauuguucugccucuuuaacccaagaagagauuucuuuggcuuugucucuguuagccugaauucuacugcuacuagaacauaaagacagugucugagugcucugugacccugguuggagcagcagcaaaggcugagagccagccuuugcaaaaugaagaaauuauuuguaaaaacauuuuguggucuacauuaaugagcaguaacuugauaucaaguucuuuaugcaaacaaacucacauccauuugccuggagccccgugcacugugcuguagcuggaaagaaagucuccccguuucuuugcuaaagcagaaaggugaaccuucagaaaauggcgauuuaugcugaaaaacccugacagacccuuaacugaaacuguaugaauugugguccugucauuuacagcuggagacacccgaugauuuucugcuuuugguuuaaaacauuaccuaagccacucuguuaucaaucuuaucuaaugaucuauuuaccuaaaguacacaauuacagacagacacccauuacaauccaggcagacgaaagcacauuaacgaaacaaggagucugugggauuggauugccuagcaauuggucugaaagucugcuuuccuugauguccaaaugaacaggcugucuaggguuuuucuguucacuuuuuaaacagauaaaauuguuacaauuauuuaaaaagcuaaaaggaagcauaggaagaacuaagaaauauuguuaggugucaugauggaggguagacagagaaagagagagagagaaauggagaagaaaggaaagagguaggagagagacgagagagagagagaaagagagagagcaagcagggagagagcagauagcuagaaagagggugagagagagugagaaagacagaggagagagagcaagagagcagggacagagagagcagauagccaggaagagggugagcaccacacccagcuaauuuuuuguauuuuugauagagacgggguuucaccauguuggccaggcuggucucaaacucuggaccucaggcgauccacucgccuuggcauaccaaagugcugggauuacaggcguaagccacugcgcccagccacaccccuuuuucucacccucugggugugguggugggcaccuguaaucccagcuacuugggaggcugaggcaggagaauugcuugaacccuggaggcagagguugcaguaagcugagaucacaccucugcacuccagccugggcaacaagagugaaacuccaucucaaaaaaaaaaaaaaaaaaaaaaaaaagaagaagaagaagaagaaggagagaggggagagagaaggagagaaacauagagagacaaagaaugagagacagagagagagaaauacagacagagagacagagagacagagacagagacggagagagauggacagagagugagagagagagagagauuuugagagauuuguuuaaugcacaguuuccaaaccuuuggugaaauaaaaacugcuuucuggagagugacauuauuugauuuccuuuggaucuguguuggcuacuuaggggccaucugaccucugaucaacauccccagccauuucaugaaguucccuaucauggauuaagguccuuuaagugcugaaagaggcuaucuuccuucacaggcagacaaggaacaguggaaucuggcuuccuuucaagucaauuugcaggaggaccauguucuuauauaaaaaaaaaaggagaaaagggacacuuuguuuugugagugacccugagacagcugcaucugaggugaacagugucauaacccccucacccccacuccacccucucaaaugcuccuguaacuucugagcuuaagagucuuugguagcaaggagggcucauaaaagcuguaugagcaucaucuggaagugaauuuauuuauuuuuuuuuaauuuuaauuuuaauuauugagacagagucucacucuguuacccaggcuggaguacaguggcacaaucuuggcucacuauaaccuccgccucccugguccaagugauucuccugcuucagccucccaaguagcuuggaucacagguaccuaccaccaccacauccggcuaauuuuuauguuuuuaguagagacgggguuucaccauguuggccaggcuggucucgaauuccugaccuucagugauccaccuguuucggccucccaaagugcugggauuacaggcaugagccaccaugucugacugggaagugaaauuugagaaacuugagaaugaagccaagacuccaucccagcaauuauuagcagcucuggucauguugcagagggaaauauugagacuuuugggccagacugggcugguuuucaggguuagcuucuccauccauuagcagugcaacaucuuauaaacauauuuaaauucugagccuuuguuuucuuaucuguaaaaaagaggugauaacaccuuccucacaaaguuguccucagguuucaaaacacuguuuguaaaucaccuggcacacagugaacccuuaguaaaugguaggauaacaggauagacuaacaggcaggauagugauaugguuuggacccauguccccauucaaaucucagguugaacuguaauccccaguguuggagguggggucugguagaaggcgacuggaucauguggguggauuucccccuugcuguucucacaauagugaaugaauucucaugaucucuaguuguuuugaaaguguguagcucuuucccccuucacuuucucucucuccuacuggccaugugaagaugugcuugcuuccccuuugcccuuuugccaugauuguaaguuuccugaggccuccccaacugugcuuccugagagucaauuaaaccucuuuuccucauaaauuaaucucagguaguucuuuauagcagugugagaacugacuaauacagaaaauugauacugggagugaggcauugcuauaaagauaccugaaaauguggagaugacuuuggaacuagguaauaggcagaguuuggaacaguuuggagggcucagaacaagacagaaagaugagggaaaguuuggaacuuccuagagacuugccaaaugguugugaccaaaaugcugauaguaauauggacaaugaaguccaggcugagguggucucagauggaaacaaggaacuuacugggaacuggaguaaaggucacucuugcuaugcuuuagcaaagagugguucuuucaugaaugguuuagcacuaaccucuugguucuguucuuacaauaaaguuguuacaagaucugguuguuuaaaagucuguagcaucuccccuucucucucuggguccugcuccugccauguaaggcucucacuccugcuuugccuuccacuaugaguaaaagcuuccugaggcuucuccagaaguagaugcugccauguuuccugugcagccugcagagccaugagccaauuaaaccucuugucuguauagguuacccagacucagguauuuuuuuauagcaaugugagaauggacuaauacagaugguauggacugagggcucaagauaggcaucagacaccaagugaaagugagaaagaccacccugaaggcaucuucaagguagcuaugggagaauggaucucucaauucuuacccacuuugagaauacaaaacuagagaguggaaagggagagaggcacuuacgaagcaauuucaucaacagcuucugugaugcuuugaauccugaccccaaagggaagaggaugcuuuauccuucaccucaaaaugaaugagggagaggccaccauugggauugcucaagagcugaagaugagaucccugcagcuggggacuggugggcuggucucugacacccuccuggaaaauccagagaacagacgcaggcugggaagugcuucuggggcaaggaagguagagagauggagaauagcugcugcgucaggaaguggugcuugucuucagugguaugucaggggugugugaaaccuggggaucagaugugacaccaaaggcagaaacagcaaccugggauccugcccauaaugacucccaccaguaugcaggacaccccaauaucaugagucugaaugggguggacuucugaaaaacuaggaucugaggggagugcacagcugguagaaaauauguugagagcgggaaccagagcauuguaguagagaacuuugaaaaaauuaccuucagccaacaaaauuaccuucagaaugagccaauuuuaggcaucugcuggacccagagagaauagaaccauuuuauggcagugcugauaagagcuuucccaugucuccuauuuucuuuuccagccaauacaguuagaaagcaaaggagaggcugggcaugguggcucacaucuguaaucccagcacuuugggaggccgaggcaggcagaucacuugagguaaggaguuugagaccagccuggccaacauggaaaaacccugucucuacuaaaaauacagcauggugaaacugugugucuacuaaaaauacaaaaaaauuagcuggguguugugguaugcgccuauaaucccagcuacuugggaggcugaggcgaaagaaaugcuugaacccaggaggcggugguugcagugagccgagaucaugcuacugcacuccagccugggugacagagcgagacucugucucaaaaaauaaauaaauaaauaaauaaauaaauaaauaaauaaauaauaaagcaaagaagagcuggggaucucccugguucaagauaggggcacaccccacaucucccuccuggguggccugccugaaaccauccuuaauagggaggagaacaggaccacucuucuccuugagggaagguugaaauguugcuuaguaucuuaugucaaugcuuuugguuuuugaauuguggcuguguuuugugacuuaaagagacuacuagaguggcugucacccaagggugagcagaaaaggcacuggguacaccauuuuuaugcaggcuccagagaagagcuuccugcacugaaaauaucugaagggaguaaugagaggcaaagauaaaguuggguugauuagauaaucccaggcuucauucaaugaacaggguauauucgugauuacugacauuacaaaagacgggauggagacuucacaggguucuuggaggggauggaguggauugagaguccuguggaaugucuguccguugucaacuucagggacuacuggggugaacaggguguccuugaaacacgcccugggccaggcgcaguggcucacgccuauaauccaagcacuuugggaggcugagaugggcagaucaucugaggucaggaguuugagaccagccuggccaacauggugaaacccugucccuacuaaaaauacaaaaaaauuaggugguacacaccuguaaucccaguuauucaggaggcugagacaugagaauugcuugaaucugggaggcagagguugcagugagcccagauugugccacugcacucuagccugggcaacagagagagacucugucucagaagaaaaaaaaaaaaaaaaaaaaaggaacacgcccuggaccuuggccuuggugggugaagagaagccagaagugaacaguuauaagaugcagucaauguuuuuucuaucccccaaagcuucucaaagugggugguuuuccuuccuucugcucuucuuuugagagugggggcauauuuucucucaacccacccacccccaguaaaaagucaaguuuaccuuguugagaaauacagcauaaugguuaaaaaugauggaugguccacuaaccagcagcuguaugacccuuguugacaggcuuccucaucuguaaaauggaauuaauaaugccugccucuuagcacuguagacugcauggaauugcauaacucacauaagggguuugcauggcacaaggcacacaauuaaguacucagccaauaacaugaguuacuucuauuaucaugaucauggcuauauaauguaccauuuacuuauucuuaaaacauugacauaauuuuuaaccucauggagaauacaaaaauauaccuccaggacgaccuugagagaaugaugauuuaucaggaggagauuucuuuucucaauacuaugccaucuuuuucuggacaaaagagccuggcauuacauauaccagaacauggagauggcugggaugcacauaaaacaucaagagcauugaaaaaugucaaucacaaaucaaccuuagcuauuauuuuggacucaguccuuaugaacauuaucuugaaucuucacgagauucuauuacaggugagagcuuucagcaucagagaagugaaauggguaguguaaggucacagagcaggcaaacagcaucagaauugggacucaaaaccuagaaugagcccgugacccagaugcuaacucaaucagcucuggcuagaguuuguuuagugaaggagacucaaaugugcuuuuacugaggcaauuuaaauccugaaccauagaacacaaggaacaggggacugggaaggcuguuuguugguuggggcaggaagugaaaaggugaggaggcuaguuaggguuaaagaagcauccaaacugcuuacucugguucuaaaagacccugcagaaugcucucaccauucucacauucucuaugagaaugccauauucacggugucucaaauucuuugguaucugccaauaagcauugcuuccugaguuuugaggagccucuuuuaaaaggucuaaaaauaucaaagaagcaguuugauuagcagaggaugggaucagcuaaugagcaauagcaacacaggcgacagucaugugcuaauugccuuuugggcauuuucuucaagggcucuuagaagugaaacauuuuagucauguuauccuuuuggcugccuuuuccugaaugcauaaaaaugaucagcauaagaaucgucaucucuggaaaugucaguauuuaaauauuuuaauucuugauauuugggagccauuggcuucgauuuugaaggagaauauuaagagauaacauuuugugagcacugacuacgugccuggggcugucccugauccucucaacaacccgaugaggcaggaacuguuauuauuuuugcauggaggagaggaaaacugaggcacagagaguaacuugcccaaguuuacauaguaaguauuagaaugguauucauauauauggagcacccagcauguacugggaauauaguaauaaaacauuuguaggccuuguccaaauggaauuucuaguugccuaaggaauguguugccucacuauguggagcuacccuugguccugagaauagagacgagaauauugaacauuuugccaguaucagccccugugcuaggcucuaggauagaaucaugagcaacgcauggugucaccuuccucaaggagcuacaaguccaguggugagaucagaaaaauaaacaggcaauuaugauacagaauuuuuuuuggagaaaauaaaaauuucagugggucagagcuuggauucagagugaauccauuuaacuugauauuuacucaaaguauucaacccaauuaagcuguuuacgauuaucaacauuucagccacacacaccccagagccucaucucucauuaguugggccugucuuccucuccauuuuuucuagcagguuuuggcaguauauugauccaguaucaaaauaugucuuuuuuagaaaugugacucuaauuagaaauggcuuauacaucuucauugaaaugaacauuauuuagaaagaugagucuaggccgggcacguggcuuaugacuguaaucccagcacuuugagaggcugagguggguggaucacgaggucaggaguuugagaccagcuugaccaagauggugaaaccccaucucuauuaaaaauacaaaaguuagccaggcaugguggggcacgccuguaaccccagcuacucaggaggcugaggcaggagaaucgcuugaacccaggaggcagaggcugcagugagcccagaucacgccauugcucuccagccucggugacagagcaagacucugucucaaaaaaaaaagaaagaaagaaagaaagaaagaaagaaagaaagaaagaaagaaagaaagaaagaaagagaaagaugagucuaagccacaugcagguuuuuucucccucuucuucucauccuuagcuguguuuuuuucuggcagaaaccugcuagcauauuuuagcaaaagcucaagaaaaugcaaauauccuugucuguggucacgggcacagucacauucuuguuugcauugccuacagcuaaaauuggcacuuuccccuuucuuccagaggcuuuuuaaacauauucuuuaaaaauugcaccaauaguugccccuuuuagagagauacuugccccuucuuacugcaaccuaccaggcucaucuuaagagcacaggcuuucuguaguuacuugguucuggauucaaauccuaacuccaucaccugcuucucuggugucucuggacagguugcaaaacuucuucaagccucaguuuccucaucucuacaaguagagguuagaugucaugauagcaccugccacacuggauugaagaguucauuuuaauaauauaggcaaagaaauuggugcaaaauagaugcucaguaagugguagccauuuuuuuuucaagugccaucaagggagccuagcaauuuccagguuaagauucccuguuucuucagaugaagacaaagaaaucaaagagguuaagugauuuguccaaagucauacagccaggccagguacaguggcucacaccuguaaucccagcacuuugggaggccgagguggguagaucucuugagcccaggaguucgggaucagcccgggcaauauggcaaaacuccaucucuacuaaaaaaaaaaaaaaaaaaaaaaucagcuggguauggcggcaugugcuuguaaacccagcuauuugggaggcugagaaaagaaucccuugaacccgggagguggagauugaauugagcugagaucgcgccacugcacuccagccagggugacagagugagacugucucaaaacaaacaaacaaaaaaaaacaaaaaacaaacaaacaaaaacaaaagucauacagccagauagugagagagcugggaaccaggccucuuaauuccagguaagggcuaugccugcuccaccaccauucaaauuucuggaaagauauugccgugaaaaaccauaaggauuuggcuguuugaggggaggucuugagaggcagcuccguuucuaugucccaucuaaacugacuguuugaggagaggucuugagagguaccucccuuucuaugucccaucuaaacugcaggccccauuugcugucucucucuuauuuauuuauuuauuuauuuauuuuugagauggagucucacucugucaccaaggcuggagugcaguggcaugaucugggcucacugcaaccuccgccucccggguucaagugauucuccugccucagccuccugaguagcugggauuauaggcacaugccaccacaccuggcuaauuuugguauuuuuaguaaagacgggauuucaccauguugaucaggcuggucucgaaauccugaccucaugauccgccugcuuuggcuucccaaagugcugggauuacgggcaugagccaccgugcccagccuccuuuuucugucuuaagcaggguugguuuggcuuuaauguuauacuuaugagacaagagagcacuagaaagagcuuacucaucuaagucuuaauuguacgucugauguggcagguccugugggauaccaaagugguggcaacaaaaaagccaccauguuucuugcucuggaggagcuuacaguuuccuagggaagauaguauuacaaaggggaauuuuauggugcaaaagaagcgugugaccuggauggggaggugguggccagggaaggcuugucaaaagaagugauauuaaagcugacauugaaggaaguaggagagauugugugugugugugugugugugugugugugugugugugugugugagagagagagagagagagaaagagagagagagagagagaauguucuaagaggaggaagaagauauaaggcagaaauuccaaaacuaguguggcuccuuaguggugaccaagugaagaaagaugaggcugaagaaccugccaugggccagaucaugcagagacuuuuaaacuucauuaaagauauucgucuucauuuucaggacaauagagggucauugaauuguuuuaacaaggggaaugacaguaucacacuugcauugaaagauaaugggucagauggaagguaaaaaguacaguaauggggccaauggggugguccaggcaagaaauaauggugcuauggaccagguaguaaccuuggggaaggaggcagcauccacugaacacccacccugugguaguuaauuggacauacggggugaugaagaggcagaggucauagaugaagcuuggguuucuacuugaacaacuggguacaugacggcaucauuuauuuagacggggaagguuuuaccaucagauaggcauucaacuggggaaggguagucaagacuuuaguauccuucugcuggugauucucaacuguggauggucuugcccccugaggacauuuggcaauacugagauguuuuucguugucaccauggggaggcugcaacugucaucuaauagggagaggucaggaaugcugcuucacacccugcaaugcaagggacagccuaucuggccucaaauguucaauagugccaaauuugagaaacucugcugaaacguaaagccuggagagaaguaacacacuagauauuuccaauuauuuaaagcuuuagugggaguucauggggcaaaguccucccuaauuugacaacccuuugggacagaaacuuggguaacuuuggguauggagaaggagaguaugaaaagagugaucugcuggagcucugugaggcagcauuuuuucagacaggauaccaagaaagaaguuguuuuuugcaggagaaugguaauacgcccccucccuuccucccugauguauuagaaaaugaguucuagguuuggcucagugucuaguaccacccaagucuauauccagccaacguucaagauucagauggcuucacugcaccugucuuuccaugauagaacuuguuucuaccucaagcuuauauauacauauauauauauauauauauauauaguuugccuuucuuuugguacuuguuauucacuaucuugauucauaguuauuuauaaauguucuuuccaacagcacuguggguuccuugggagaagaccacaagucugcugcauuuuagcgcccucaaaacaucugucacaugguaggugcucaauauauaccucaaaagaugacccugaucauguaccaggcugcaaugagggauagucucucucuguucugccccugaucuacagccacuaugaaaccccugacaaugcugaaccuaucccagaaucugucccaguuguauaaucuccccgcuuagugaaauccagaaaccccgaggcauuuccaagcuugcaagccgauugccagacgcggcuaauuuucaaguuauuaaauaaaacuaccgauugcauaaauuccaauuuaggcagaaauacauuagaucaaaauugagccccgcaagaaauuuucucagcagaguuugaaaacaggaauuuagaagggaaaaugccaccaucucaugauagaagguaucccauuaugaugauuaugauuuugaauuuagcugucagaaauaucucugagaaaaaauauguugguuuauucaguccaagaaagguuuaauuggcuucugucagauuuuuuguaagugcuauuugccacugaaccccauaugaauuuuugcagcuuuugaauuuaacagcugauggcuguggggauguugaaaggaagucaagaauaaguuucuuuccacaguugugcaaaggcuuaucuaaccagaauuuccuuaagccucaccaaacagugaaacagaugggggucacaggaauaaagauggcacacauuccauuuguuuagauccaugcuuguguuauucucccuacauuuuucagaguguccagagugucucauuugauuuucuuuauucacuucuguguccccaccaccuauaaccaugcuuggccuauccuuggaacucaauacauguuaguugagugaauaaauguucccacugggggaacucuacuuuuucccucacccccacagcucuuugauggguacuacuauggacaagugcccuugagauuccuaagcaguuguuguguaggguaggggauagggaugacuccuuuuuuggguuacccucugucaaugcauggcuugggaucccuauuauuugaauuuuugugaaaucauuugugcaagucacugcugaauagucaauccaguacucaucuucaauaucaccaucgcuuccuugcuccugcuuucuauacucauguuagaugcauacuuucccagccauucuuacugcuagaaaagagaggugacacuguucuggaaaauuagaaauagagaaaauaggucaggaagguucuuggaaagcuucuguuucccucauaaaagggacaaacauagcuuuuccucucugcuuuuuccucuuucugcuggaauauggaugugggacagccauuuugugaccugggacagccauuuugugaccaugagggaaagggccuugggccuugccagccugaugcuagugagcucucgagccaaugccaacagcuauccaccuccagacuucucacaugagaaaaauaaauuccuauuuguuuacuucgcugcuuuucaguuuuucucuuacuugcagccaaaaacaacccuaauuuauauaugguguuuuccuuuuauuuuuccucacuacccuuuggcucucuaugggauuaaaagaugaauaaugggacugagcugagagguaaauccaaggaacucaaaccaugcucaggagcacccccuucucuacaacuaacacauugcaucucucaugcaaauauauucucauaccaacucuaaaaauaucuuuggaccugcuucuucccuucuacccuuaagcugaggccuggccucauuaaugauggaccucacuaugugacuuuacaguuaauacucaguuuccucuagacuucaucucuggguuggccauaucuucaaaacagucaugguagcacucauguccaaucagagaagggagaggagcacaaguaacaauaaugaccaugucaccacuuaguggaggcuaacuggguaucgugcucaguauuucacaugcauuauuuuauuuaauccuuccaaaacaucuaugccauagaucuuauuguucuucaaccccauuuaccagaaacucacacuagagugucaaaaagaggauuugaacccaccuuugccugacuucaaaggcagagcuucuaacuaauuacaaagcuuauuaucccaucaacaagacucuuggaucauuucuucacuccucucccacccuccccucccccugcagagcagcugccuccuugcagaugggacaaauagccugcuucauuuuguccagcaugaagagugccgaucgcucuucucgugucaggagguaaugaacacacuccuucccugcauccugauuuaucauggaaaagagccgacugucacaugcccaugcaauuagacacagcaagauucgcuaaggcaagcauugccuguccaaagcauuaggccauaaagauaacaaaacaaaacaaaaaaccaaacaaaccaccuaaacaaaaaacaugaauucugcaauuuaucucaugcaguagcaauggagcuagaagaaccucuuggagagagaaaagagucccuucucccucauuucucuuuuccuggcuuaagucaugagugauauaaaaauggaacagccagcugagauucuuuagaauugaaucucaagugguuguuagauauuuuguuuuauuuuuuucaggguaaucagugauuccaugcagggggcguggucucagugauuagaggccagagagaucacugagcgcugacgucaccuuuaacaaaaaccaaugacucacuacagcccgccauuuaucucuucaggucacaauuucuucuauuuggacaaggaggaaaaucguuuuauguuugccauggaaacguauugugcugggaguccagguuucucuuguuggggaaaauguuucucaaauauguugguucuccuuuuccgacuccaggcagcccagcuggguauaugcuggauugggcuucuaaggcugucucuggagacauccauccucaucacuuggugguggggggcaggggguggggcggcaggaaggauggagaccgucaggcccaggucuuuuccauaccuggguuugcccccuucuucaggcaccugccaacuuaccucucagcagagaacuagacccuggggaucuucaagccccagucuaccuagguacuaaagcuuauuaacaauaccucuauuauggaguuguugaaaggauuaaacaacgccguaaugguggcuaccauuuaaugguauuuacuguaugccaggcucuguucuaacagcauuacccacauuaagucaucuaauucccacaacaccccuuugauggggaagcauuuuuacauguauuucaucuauccuaagaugcaccuuuucuuucugcauuuuaauaccucugaaacugagacauauaauugaaacaggugauaguuuaauuuguuaaguuuucuuuuuuagcagcacaagaaaauggugaugcaucuggaaauggaaggcuucuuggauuagauaaaacgugauaacgcuuguuucacagagcagcaaacugaggcacagagaggaauugaguaacccaagaucacacaaccuaguaaguggcaguguugggguucgaacccacagaguuugccgaagaaucuacucuuuuauugguugguugauuuacugagacaggaucucgcucugacaccccagcuggagcacagaguuugcgaagaaucugcucuuuuauugguugguugauuuauugagacaggaucucgcucugucaccccggcuggaguauaguggcacaaucacaguucacugcagccuugaccuccugggcucaagcaagccuccugccucagccucccaagaagcugugaccauaggcauaugccaccacaccuggcuaguucuuuuguuuuguuuuguucuguuuuuacuuuuuguggagauggggucucacuuuagugcccaggcuugucucaaacuccugggcucaagugauccuccugccucggccccccccaaaguguucagauuauaggcaugagccacugcgccuggcagaaucugcuccuuuaaucacuaaaagcuaggauaugagcaagucacccagaaugguuccuggaaguuuuaggaucugcccaaauuagggaugcugcuuuucucucuggguuuuuaaugacaacgagguggaaaguucagacacuaagagacagagcuuguauaaaggauugcaaaccuuuacaguuuuugccaaaugcuacuuuugaguuuucauucuagaacauaaagggggauguucuaagcaccucucuuuuucagccuuuuccaaggcagaaaucguggguccgugguaauccuauacacaaucugcuucuccccucccccaugucugaucccauuagacuucgucugcuuccuuaggaaacaaagggaaaagggacucccuaagcagauuagggaacccaacauaagggcaagcuagacgguuucuuuaacaaaagacuuucaaacagaggauuugcauauguuauuuauauucccucaguuaaaaaaaacaaaaacaaaaaccaugaagagccuguacaaggcaguugccaguggaacauucguuaggauauagcaauguccaacccugugagaaaggaaaauggccaguucagagggcuucgagacccuuuugagguuuuuuccaacagucauucauuauacuaguaugcaggggacucuuaauauuaccacgcagccaguguggcuauaccuucccccgggagaggccacuccucauauuccuccucauuagacacuuaccgggccgccuggcauuuugugauucuacuuuuaggugucguucccuuuccuccuccaaacaaaccuggaagcuauuugaagccaaugauugugucuuacaccuuauuuuuguagccccuguggugcugggcacauugaacagaacaaccauuuaucacagcuugacuagaauggugagauggagaggacuugugcucagagccagacagauaugaauucaaaucccaguucuguuccuugcccguugggugcccuuggguaagggaccuguccucucugagccucaguguugccaucucaugaagagguaacaguucauagcuugaaggauuguagaagguucugaaaauaucacacuuaagaguuuuuugaguucaauacguggcacaugaugcaugcauacucaauacaugccaacuaucgucaugaucaugaucaugacugcaguuauuauucauuugauuuaccccagacaucaauccugaucucuacauauuuccuuguggcuugucacuuucuauugacgcuagauuagguuaauuaaugcuuuacuauaacucuaaaaccuugaaauuccuaagggcaugaucuuuugaaugugagcuaggaaccccuggggucuucauuauuuccuagaaaguagagaggggugcgaaggauuucaaugaggcuuucgggccggaagucuuggucuauccaacaguuuccuggaagccuucuucccauugcuugacaucccugagucccacuacccuccucccaagaaagagaugaucauuucaucuucuacaucuuccuccacucucuacaucucucuaugguaggaugaaaaacucuauuacauuuauuugaguacauggcuuguuucuucccaaaauccaacauggagacacacacacacacacacacacacacacacacacacacacaaauacacacacacacaugcgugaaucuaaauuagcugucccuuuucuuugcucccacaacacccucugauacuuccucaacacaucauuaaucaaccugcauuauaacguuucuuaucucuuuuacuccccaucccaagcauacacacuauagauuguaagauucuugaaggcgagucucauuuuuaacuagagcaaguguuuagcaccuaacagcagugcaauaaauguuuacuaaauaaaugaaauaacaauagaacuaaaaccuaaagugugcuuacuauaugucaggaacugugcucguagcuuuuggcguacguuaacucauuuaaugcucacagcaaucccaugaggaagcucuaugacauucccguuuugcagauggcagcacugaagcggagcagcucugcagcuugcccaagaccacagggcugcgaagaggcagauccaaacccagggugauucugucugcugcucccgcucugauguucacccucgcuauugaaguguucauuucccucuucauucuuucccucauucauucucccaccgcuaugcugggaaguucagucccagagcgggcugcucuggauugaacauccuucugugugguauuuugagaugaaaggagauggaaaaaggcuguaucuugcagaguggucuugcuaagagggcugaguaaugaggagugcacagagauggguuaagccuuagagaagagcagcuugggaacauuuuggaccacauggagagcccuugugaguuuuaagcucuccuucacagacugaccaccugccaggcccuccuuccuggggcaugacugugagccacaacugugccuuguggaugcacuagaguggaccagcauugcugaccuuggccaguccaugcaaagugggguuugaggauacaauaacaaaugcacacuuacaguugugcucguccaguuaugaucauuuaaaaaacaggaaccauuaacuccagucauucaguacguaucgauuuuucuuuguuuuucaaaucaacaacacuguuucaugucccauaaacacauuauccagcguuaacaucacaguggacaauuuucauagcuuauucgauuuaguccucacacugcuucugccuaguugauguuccuguucuaaauucauagacacaaggaaauaaagccucagagaggcuaagcaauucaccugucuaaagucacacagcuggugcguggcaaaccuagccuuugaacaccaaaaguugacccucugcagccucuccauagagagaggggauaugccuguuucuggagaccagcagaucucugagaguaaguccugcagacggcaaaccuacaauucaucuuaauuuuuuucugauguucuacagugucauugcugauuuauuccaucauuuuggaauuacuggcuaauaggauggcccagcucacugaucugguucgcguuuucacucuuuaagagaaaccagccauugauagcaacgggaaugugucucgacaauuuaaucacaccaugacucuccucucucucccucucccuuguugguuucgaggcuaauuccuuuuuuuguauuauuauacuuuaaguuuuaggguacaugugcacauugugcagguuaguuacauauguauacaugugccaugcuggugugcugcacccacuaacucgucaucuagcaucagguauaucucccaaagcuaucccuccccccuccccccaccccacaacaguccccagagugugauguuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaaaaccauaaaaacccuagaagaaaaccuaggcaauaccauucaggacauaggcaugggcaaggacuucacgucuaaaacaccaaaagcaauggcaacaaaagacaaaauugacaaaagggaucuaauuaaacuaaagagcuucuguacagcaaaagaaaguaccaucagagugaacaggcaaccuacaaaaugggagaaaauuuucgcaacauacuuaucugacaaaaagcuaauauccagaaucuacaaugaacuuaaacaaauuuacaagaaaaaaacaaacaaccccaucaaaaagugggcaaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagcuaauuccuauuucacuuguucucgaaaacaugauugguuucagcagaggggagacuuaccugccuuagguucuccgaggcauaaaagggccggacagcccccgaguugggggaacucugaagcuucuugguggcuggaaccuuggucaucuuaaaaauccuucagguuuuagccugugcccccaagacaaggauuuuuccagaaucuucuacuucaguaguuacugguaugagaaguuucggcaacuucucccugauccccaagucccaauuacacgaacuccaaagcgguuuccuucugaagaguaaugagaaagcaccugggucucccacagacgggauaaggaaguccggguagggcagaaucaggcaagccuggacuuauuuacuuuuugaaagguuauaaacuucuguaagcuuccuccucuucggaagggauaucuuucucuucuauaagcaaaauaaaauaugaacuaaaaaauaaauaaaauuccagugacaaagugugagaggggucccauggaggggcucccagaucgccauccuccgagagcggccgagaacuaaggcggccccaacgagggguuuaucgcacugcggggaaaguaggcaacu

SEQ ID NO: 191513 - RNA, 31088 nt, Homo sapiens
gggugguuggaugggugaguggauggaugauaaauggauagguagauggauggauggaugauggaagacggauggguggguggaaggcugugcagauggaugaugggugaguauguuggcagaugaaugaauggacagaaggacagacagagggcugcacaggaggcugcaugggggauggcgcagaacccaaaccugagaggagaaaaagcgcugaccccaccuucccugccaccccaagaagcacagcauggggccacagccgcucuuguuuaaugguggcacagccugcggucugguuccuccaucagggcgcuguggguauggcccugaggugaggggcaggccugggguggggugggguggggccugaggcagaagcaugggggcugacccucugccugacauggagagaggacauucagaacccuccagccacagauggccagaaacuuugguuuguguuuguuuucaaguuucuguccucaaggaagcugcccagaaagggagacgaggggacugcuuccugagggagcagaggggccagagcugggaggagcaaugccagccgaagacaacgcccagacaaagcucaccagcuccagggccacccgugggaaugcagcugggagaagggugcuggaacaggcuccuuccaccccaugggagccccagagucugccccaggaccuucccaaacccucaggaaggagaagcacgaggaaggggccccagaggugggaaugagguugagagagcagcaguaggaaacagacagaaacagagagugggagauuuagggcagggcagaagagacgccacggugcccacccaccucgggggagagagggggucaguucugagccccaucagguucgugacccacucuaggaggagaugacucagaccccagaucagagaacgaagcccccaggaggggcuggaguuagaaguccgguggccuugggacgggggugacccugacgagggucagcaggggcgaaagcagcagagcagggacagaacuucagucccaugaaaccuugacaggcgcgaacuuccagaggucuggcuggcccaugugcagcaggccgcugaagggcgaggugcuccacuggaacgggggcaccuggucccacgugggaccgcuggccgccagcaggcucaggauccuggccagugacaugcuggucaccuggggacagggcagagccgcagcugagcagggguccuggccugccccaauccaggcacccagccucccacccugaccuugaccccagagcccaauucugaacugucacuuuuuuuuuuuuugagucucugcucugucacccagguuggagugcagugacgugaucuuggcucacugcaaccucugccucccggguucaagcaauucucaugccucagccuccugaguagcugggauuacagacgcccgccaccacgccuagcuaauuuuuguauuauuaguagagacggguuuucaccauguuggccaggcuggucucaaacuccugaccucaagugaucugcccaccuugggcucccaaagugcugggauuacaggcaugagccaccgugcccagcccauacugucaccuuuacugugaccccaaccacagcccaauuccgacugugauuccugccccgccaucagcuuugccccaaccugucccuuccccaaagcuggugauggugacuucccccacccacagcucaggcccuagggaggaggcagcaccuucacaucgauacccccaugggagcgcugacgcagggccuggaagggguaggagccauuggccggguugaggucggagcgggcggagauagcauucuccccauugggcuggggguugcaggcuuugcacagugacagagggucauggaggaagucauuguaccuggauggggaaaaggagggaacaucagucaucccaggaaggagaggcuaagacgggggccaaaauccucacaggcagccccguuaacagcugccagccuucaacuugaugagccccucccacugcacacuacccccgacaguuccucugccuggggcccggaccccuucaccuaagucacucugccuucauuauucagcucucugcucaggcacucauccucagggaaggccuccaugccaccaccccagccaggugaggcacccguuuguuccuggauagccucucuuggaacacagccaucuuuacacauugacaccagugcaagaacuugauggauuucugcaccgcccaagagacaggacaguggggcacagguuuucuaccuguugcuccugguaccaagcauagugccuagcaguacaggucacucaacagaugucuagcauccuccccuuagcuaugaggacagugacagggcccaaguggagagcggccaccgagcugcugcacugguguccaacaucugaccacccccugcuggcccucuggggcuggcagcaaaguuugaaugaguugguacaaaaagcgcacaggaaguucuguguuccugcggccucccucuccccaacccaccacccaacuggcaccuaccucaucagccugaccauggaguccaugucuuguaccagugacugguuccgccggaagaucugggcccgggggcucccgucauaagaaaaccaguccccauacugggccacuagggccugcagcccacuggcauugaacacagucucgaaggaccugccggggacaaggauggucacccaugacccccacuggccucacucagccaaggcuguggccagggaggggaggggcagucacaccaggacauuauuacuuacaacuacgacauucaggcugggugcaguggcucacaccuguaaucccaauacuuugggaggccgaggcgggcagaucaccugagcucaggaguuugagacuagccuggccaacauggugaaacccugucuccacuaaaaauacaaaaauuagccaggcacgguggugugugccuguaaucccagcuacucgggaggcugaggcauguacucacuugaaccuggaagguggagguuucagugagcugagaucgagccauugcacuccaaccugggcgacacagcgagacuccgucucaaaaaaaaaaaaaaaaaauuagccggcgugguggcacgugccuguaaucccagcuacuugggaggcugaggcacaagaaucacuugaacccgggaagcagagguugcagcaagcugagaucgcaccauugcacuccagccugggcgacacagcgagacuccgucucaaaaaaaaaaaaaaaaauuagccggcgugguggcacgugccuguaaucccagcuacuugggaggcugaggcacaagaaucgcuugaacccgggaagcagagguugcagcaagcugagaucgcaccauugcacuccagccugggugacagagcgagacucugucucuaaaaacaaacaaacaaacaacaacaacaacaacaaaaccaacuaugacauucgggauaacaauaaugucuuccauuugugcugggggguggcuuggugggguggccaagcuugggcucuggggcccaaaaggcauggcaucaaauccugccuucaguccggguguggugacuuaugccuauaaucccagcacuuugggaagccaaggcaggcggaucacuugaggucaggaguuugagauuagacuggccaacauggugaaacccugucucuacugaaaauagaaaaauuagccaaggaugguggcuggcgccuguaaucccagcuacucaggaggcugaggcaggagaaucacuugagcucaggaggcggaggcugcagugagcugagauugcaccauugcacuccagccugggugacagggcaagauucugucucaaaacaaaaaacaaaaaacaaauccugccuucaccauucgccaacaggggaagcuugggaaagugagguacuuucucagggccucaguuucaucaucugugagaugggaacaggaacucuagugaccacauguggcaauuuuaagagucaaaugagaaaaugcagguaaaguaagugagccucaggaggugacagcuguacagcccaguaaggcagauccagucagagacccuggcaggggccagucccugagccuggccaccccacaccacccugcucuggguguuagaaccagaggucacauggaugcugacuuaagccaugcaacuacacugccaaacugucugggcucuccuggccagaaaaggggguaggcugggauucuuuguucuguggguuuaaaaacauugccuaggaaggagcugggcaaggagugagguggaugcccuggagggugacggggagcggagugagaaggcacgcacgguauguuguagcuggcccaguaggucuucugguagagcuccgaggucuugucagccaccaccaccaugccgcugagaccgagaagagagaugggguggaggugaucagaaaaggggcuccugugggcacugcccugcucggggagccccgauggcuccccauugccuggaggauggauuaaguccugaacuucagcccccaccagggacaccuucucuuccagccacacccuccugagaucguucacuuccugcacagcgccagcacggcucugggccuucacccuggcaguccccucugccccgagcccccaccccucccucccaggguacgcacgggaucugcuccaggaugguaagcacccggcucccggggcugggcccacccgggaugaacgccuuguaguccacgaucauccacugguuguuauaccugccgggcaggggaagggaggacugaacagagccuggagccaccuccccagcuuuccccacccugcagugucccacucagcuaggaauuacaggaagugggccugggguuguccagccauucaacugacacccugacgcugcagcaugaccagguauccacaaaccccucucucgucaugcugcuugacuguuccagaauauucuguggcucccuaggucagcuccucugccggaugcuguaagaucugcacugcccaguuccagugucucuggcucacaggcccugccacccacccacguccaccuccucaaacagcccuccccacuguccccuugagagucuucagguuccaagugcucuuccuguacugccaccaaggcaccccuuccuaggcugaggagccugcaggggaggggcaaauccuuuccuucccuagccucagucuccccauguaugaaacaaaggagggcgugggguguguggcccggaugccacaucugguccccaggagugugaguguuaaaggggagguuggucuaucucuuggugcaggggaagccacagggccagaagcccacucacgugccgcuguugaaccucuugaagaugucugcccagguggccccauccgaggccaggcgguuggccacgauguugcguacccacuccagcacacagccccugggccgcacauacuuccacagggcuggguucuuguugccaaugguggucuccagugucaccugugggaaggucaagggggcugcugcacagccuaggcaugcugccaccaaguggcaguacuucaucagucauggcuccaaaaauuuuuuuuuuuuuuuuuuuuuuuugagauagagucucacucuugcccaggcuggagugcagugguguaaccucagcccacuacaaccuccgccucccaaguucaagcaauuuucgugcuucagccucccuaguaacuaggauuacaggcacgugcccccacgccuggcuaacuuuuguauuuuuaguagaggcaggguuucuccauguuggcuaggcuggucuaacuccugaccucaagugauccgcccaccuccgccucccaaagugcugggauuacauguguuaaauacuuacuuaaucugccgggcaugguggcucacacuuugggaggccaagguagguggaucaccugaggucaggaguuccagaccagccuggccaacaugguaaaacccugucucuacuaaaaauacaaaaauuagccaggugugguggcauacaccuguaaucccagcuacuggagaggcugaggcaggagaaugacuugaacccaggagacagagguugcagugagcccagaucaugccacugcacuucagccuggguaacaaaagaagaaauaaauaaaaauaaaaacucauauccaguugaggcacguguuccccaccaguuccuuggacaagcacgcaggaggauuugggaucaugcaucuagcuuugcccuggugaacagccccugagaggcccaaagagccgcucccaugaacccacucccucaccaagcugggcaaccucccauucccaccccuuucccacaguucugcaggaaaaguugcacggccugaggcugucagccuggcagaugcagcagucagaggacuaggaggccuuacaacaggagaggcccucagucucccuccagccuuggggcaugcaggaugcccaccgcugccuccgauugccuccucucccuucuccauuuccugcuggaacccuuggcugccuucagcauauuugaaaaguaaagcuuaguucuugugaguuaaaaaccaaaccaaacaaaacucauguaaucccagcuauucggaggcugaggcaugagaaucacuugaacccuggaagcgaagguugcagugagcugagaucgugccacugcacuccagccugggcaacagagagagagccuaucuaaaaaaaaaaaaaaaaaaaaaaacacacacacacacacacacacacacacacacaaaaaaccaccaccaccaccacccccaccaaaaagcugagaacagcuaaaagauagcuguauccauaaaugugauuuuuucuuuuuucucuuuaaagaggaaaaaaaaggcuggacacaguggcucagcacuuugggaggccaagggggucagauugcuugagcccaggaggucaagaccagccuggguaacauggcaaaaccugucucuacaaaaaauaaaaaaauuagccaggcaugguggcaggcgccuauaguuccaguuacuugggaggcugagaugggaggaucgcuugaggcugaggugauagaggcugcagugagcugugaucaugccacugcacucaggccugcaugacagugugagauccuaucucugaaaaaaaaaaauccugaaauuugguauuucuuuccacuguuaacgugacacaccacagugguauuaguagucacugggacggucacugucagaaaucacagauguuuuuccaucagauuacaaggcuguacauaccuuaaaguaucauucaugcaccuugcuucuucuaacuuaugguauuuaucacaccugcuucuggaucuuauuauucaguguguuaauaaagcagcacauauauacuaaaaguuuacuuauauuuugauaaccauauuucacuauaacugguuuccuccauaauccuauacauuuugguuuaugugucuaaaaacacuaauuugccaggcacaguggcucacaccuauaaucccagcacuuucggaagcugagguaggaggaucccuucaacccaggaguucgagacuggccugggaaauauagugagaccucauuucuacaagaaauuuaaaaauuagcugagcaugguggcaugugccuguagucccagcuacucaggaggcugaggcaggaggaucgccugaacccaggaggugggagguugcagugagccacgaucacaccacugcauuccaaccugagugacagagagagacccuaucucuaugaaaaaaaauaaauaaauaauaaaaguuaaaacacuauucugagaagagggccaacagccuccuggacugcccaagguguuuauggcacaaaaacaguuagggacccugauggaagggaaguuuccugcccagacccuuuccugguaaccagguggaaccauuucacgugucccuccccagcugccucaguccccuuccccaccugggccacagcauggggguucccucacccaccgccuggcccucucuugccucguuccacacucagaaaaaagcaaggaucagacaagaagaagaguccccaccccucccguccccgcagggagcuggcguucucugcgcuaaggguguuuuuuagagugauguuuuuucuccucugucucguugcccuggagaucaaaggguucacuuucucagcgaggggugccagggacagauuucuaaacaagucuggaccgcagccaggaaaaaagaugaaaacaacacacuguaaacagccucuauucagcaaaccuggucaggucagaggggcucugaggaaagcaagagggaggcaggaggagagggaagcgguggggauguggggggggcgggggcacaguuauccugaauacauaaaaacaagugaggucacugaggucagggauagucccaaacauccccaaguccagccuuuccugacaaccaggguuacaugcagagucccaggccaucugcagguuuuggaggcccugugcggggccugggggucuauguuuaaacacgcccuuguggugguccaaguccccagagcaggggaagggcgagucugggcucugaauggcagguggggcagcguccaccucauccuccacugcaccccuggcuccuacauggcacccagcacugggcugcagccugguccccacuugccgcaggaaucaauccugccagcucagagccgccgugugacaaacaccccaggaacagaggagacaugagaaagggacucaccagcccacugcccaggauguagaagucgucgcaggagaagauggugccgggguaggaggagaagaccagcuuguugccgggaaccagcggguaguccccugugcaggcagagcgagccagggaugcuggucagacaggcacagguggaggccccugcacccuaccuaacaagacacaggcacaggggcacaggcaggccuccgaggaagcccccacuguguccuuuuugucauuuagcaaaugaggucauugggcauauaaaagugcauauacgugcaaguaaaaauaaaagcuagcagcaaaacuuauauaguuggcccuccauguccguggguuccacauccuuggauucaaucgacuggggaccaaaaauacuaggaaaaaaacaugauuaaaaagaaacaacacagcugggugcaguggcucacaccuguaaucccugcacuuugggaggccaaggcaggcggaucacgaggucaggagaccaagaccauccuggcuaacacggugaaacccgucucuacuaaaaauacaaaaaaugagccaggcgugguggcgugcgccuauagucccagcuacuugggaggcugggucaggagaauggcgugaacccgggaggcagagcuugcagcgagccgagaucgcgccacugcacuccagccugggcgacagagugagacuccaucuaaaaaaaauaaauaaauaaauaaauaaaagaaauaacacuaaaagauaaaacaaauuuuaaaaauacaguauaacaacuauuaauguagcauuguauuaggucuuacaaguaaucuagagaugauuauaggauaugggaggauauguauauguuauagguaaacagucagccguauuauagaagagaccugagcuuccacaggggcuccuggagucaacucccuccccaacaccaagggacaacucugugugugcguggguauauguguauguguuaaauauauauacucagauagauagacaaacagauaaauauuuuguucacuggacauuuuuuuuuuuugagacagaguuucgcucuuuuugcccaggcuggagugcaauggggcgaucucagcucacugcaaccuccaccucccaguuguaagcgcuucuccugccucagccucccgaguagcugggauuacaggcccacccccggcagguacccucaccccugcccuagaacuccuucuaccugaaacccaucccuugacaagugcuagucugguuuuaugcacugucugcagcagggcuacugugaccucacgcuuaugcuggaggcucauuaccccugugaucuuguaaauugacuccuuauacccgcccugcaugggggcagagaauuaucaucugcacuuugcagauaaggcaaucugagacucagaaaggcuaaguaacuuagcagaggccaaacaguuaaauggcugagcagggauucuacccagaccucuucccuacagugcuccagaguucuggguguagcucucugaauuauccuuugucuuuuuuuuuuuuuuuuuuuuuuugagacagagucuugcucuguugcccaggcuagagugcaguggggggaucucggcucacugcaaccucugccucccagguucaagugauucucuugucucagccucccgaguaacugcaauuacaggcauuuaccaccaugucuagcuaauuuuuguauuuuuaguagagacaugguuuuaccacauuggccaggcuggucucgaacucugaccucaagugauccaccagccucggccucccaaagugcuagaauuauaggcaugagccaccgcgucuggccugaauuaucucuuccacauuaagucuuugcacuuuaaaacaaagggaccaguaggccgggcacaguggcucacgccuguaaucccagcacuuuggaaggccaaggucaggaggccaggaguuugagaccagccuuaccaacauggugaaaccccaucucuacuaaaaauacaaaauuagccagguugggggugcaugcccguagucccagcuacucaggaggcugaagugggagaauugcuugaaccugggaggcggagguugaagugagccgagauugugccacugcacuccagccugggcaacagagugagacucugucucaaagaaaaaaaaaaaaaaaaggaaaggaaaaaggcacagugggacccagcgcagaggcucacaccugaaaucccagugcuuugggaggcugaggcaggaggaucaccugaggcuagaaguuugugaccagccugggcaacacagugagacccugucucaaaauaaguaauuugaaaaacaaaacgcacaguggaccaaacauggcaguacuggcaacucuccaaggcagccuagugggcaaaagaaggaagucgcaaauaauucauacaguauaaucuuaauuaugauuuuaaaaaaacucagaaagcaaacauuuuagagcagugaaacuauucuguauaauacuacaaugauggguauagcaccccauuccaugcaugaagcccacccuuggaaauuuuuuuuuuuuuuugagacagaggccgacucuguugccuagguuggaguacaguggcaccaucuuggcucacugcaaccucugccuucgcgguucaagcaauucuggggccucagccucccgaguagcugggauuacaggugugcgccaccacgcccagcuaguuuuuguauuuuuaguagagaugggguuucaccauguuggccagucucgaacuccugaccucaaguguuccaccugccuuggccucccaaagugcuggguuuacaggcauaagccauugugcccaggcaagguacauuuuuuaaagucuaggagaaaacauaaccaaauguucacagaaauguucucuuuuggguuguggaguguucaagugauuuucauugugagaguguuuugguggauucuccaauguucuauaacauaccuguaugacuuauacaguauguuuuuaaaagcuauuaaaauuuuaauggauauauagcaaugagaaugauagaucuacagcuacacacaguaauacagaugaaucucacagacaugcagaacaaaugagcacacacuacaugauuccauucauaugacauucaaaaccaggcaaaccuaaccuauucugugagaaaucaggacaggcgguuggaucacuugaggucagguauucaagaccagccuggccaacauggcgaaaccccauuucuacggaaaauacaaaaauuagcugggugugguggugugugccuguaaucccagcuacucaggaggcugaggcagaagaaucgcuugaaccuaggaagcagagguugcagugagccgagauugcacuacugcccucuagucugggugacagagcaagacuguuuaaaaacaaaacaaacaaacaaacaaaaaacagaaaucaggacagagaugaugcuggggugggggugugccuggaaagggauacgagggaagcuucuaggggcugggaauguucuguuucuccagauggaugcuauacacagguguguuccacgugcaagaaauucaaguuguacacuuacaguguauacgauuuccuguauaaaugucaauuuagaguuuacuuaaauuucaaugaauggacauuagguugucaccaaaccacugugauagcagacuugcuuauacacacuccccaugcagaagcugaaaugucucucuagggacagacuggagucagagaauugcuggaucacuggagugacagauuuugaauuuuauuagaugccagcuggauuccucuuaaaaguagcugugccaacgcauacucccauuagcaaugaauaaggcuggacacuuccccaccuccucaccagcuccuggucccaucaaguuuuuacauuuggccaugaaggagguacugcaaacauuuggcagugguaucccuggggcugaugcuggggccugggaugaaggauguggcacuauggaggacuuuggccuugacuguaaaacuguuuuuuucuuuauuagagacaaggucuugcacugucacccaggcuggggugucauggcgugaucacuguucacugcagccucaaccuccugggcucaagcaauccuccugcuucgaauucccaaggcgcugggauuacggggaugggucaccgugcccagccaguuuucacauuugacaggaagaauguauucaugcaauccuugcaauugguuguuugcaaaaauagcucuaauucuucccaugccugcauccaagccauaugugaugugacucugcaguuccucauagcaaaugguggagccuauucucccaucucuugagccugggcuggccaccugacuugauuuggauaaagaaugcugugucagccaggugcgguggcucacaccuuuaaucccaguacuuugggaggccgaggcggcuguaucaccugaggucaggaguucaagaccagccuggccaacauggcaaaaccccgucucuacuaaaaauacaaaaauuagccagacacaguggugcgcgccuauaaucccagcuacuugggaggcugaggcaggagaaucacuugaacccaggaggcagaggucacagugagcugagauugugccacugcacuccagcuuaggcaacagaacaagacucugucucaaaaaaaaaaaaaaaaaaugcugugucaagccaggugcgguggcucacaccuguaauccaagcacuuuaggaggccaaagugggcagaucacuugaggucaggaggucaagaccagccuggccaauaugggaaaacccugucucugcuaaaaauacaaaaauuagcugggcauggugaugcacgccuguagucccagcuacucgagaggcugaggcaggagaauugccugaacccgggaggcagagguugcagugagcugagaucaugccacugcacuccagccugggcaccagagcaagauucugucucaaaauaaaaagaaaagaaugcugugucaguuucaccaaggucucaagaggccuuuaccauauccugccccagugcuacaugaacaggccugugcucaccuacugaugaugaaagaccacguagcccagcuguccccaucacccuggcugacaaucaaccccagacaggagaagaggccaucccauuccagccaucccaccccagcugaccugccagcagacugcugaugcaucagugagccuagccaagaucagccuggcccagcccagaaaaccaaaaccaccuagcugacccauagaggcaggagcaaaaaauaaauagcgguuauuuaagcuguuguuguuuuaaauuuugggguaacugguuaagcagcaauagguaaaauaaaaaaggcaauaaacauguaaaacaagaugaacuggcuaggcgugguggcucacauaaguaaucacagcacuuugggaggccaagucaggaggaucacuugagcccaggaguuugagacaagccugggcaacauagugagacuccaucucuuaaaaauaaaaaaauaaacaaauuagcugaguguggugguacacauuuguaguuccagauacuugggaggcugaggcaggaggauaaucugagccugggaagucaaggcuacagugagccaugacugugccacuguacuccagccugggcaacagagcaagaccccaacucaaaaagaaaaaaacaaaaccaaaaugaacucuuggaauaucccugcagugacuccguguguugggaggguuuccaaggcccaaaccuccuaggaccacuccccacgugugugcccacccaccugcucaucccccagacacacccacacccaccuaccccaggggccuucccggaacuggagccaguacuucuugaugacacgcagcaugugcugguaguuguuccagguguugugggcaaccaggaggucacucuggccagggagcagcuugaugagggcagaacaggagccagagcccagagaagguuugaucuuggucuuguucagggccagcuccaggucuuccagguccccagagagcugcagcaggcugaggagggccagggcaucagaggguuaccacgccugcugugagugcuguuauguacucauuuugcagaggagaaagcugaggcucugggaagucagcugacuguuccaaggccacagagccagggaguggcaagguugaugcuggaacccaggucuguccgacuaugaguguguggcccuucuucccacccuguucacucuggggguggcacuuacaggaaccccaaggguuugauggugaacuucccagcugggaagcucacacggccuucguagcuguccuccaggccuuucagcugcaggagggucagccgcaccuaggggagggggcgggggcagagggagggugaggccucuccuccaggcucacaccuucuccuucaacgggacgggcucuggccuggggguucagacagagcaggaggcccggggguacccuccagacuccagccagccuugacucccccaaacuaccacccaccccuccaugcugagcacucuccugcuuucaaugaauuaacucuaugucucugcccuguguuaaccccaaaucagccccacuuaagagccuaguucaaaagccaucucuucuaggacgccucccagccuggccuggccucuugccaacugcuccuguucugaguucaguacugacuguauugcugccucgggcaccugucucaugcaucugacuucuccccauugucaucauuuugccucaacauccuauagccauaaaguaucaucagugugucccucauggggccuugggcaggcacacugggcacuuaguaagcaucugcaagauggauggguggguuguuggaugaauggauggguggguggauguauguauguaugggugggugaguggguugacaggugggaggugaauggauggguggaugaguggguggguggguggguggauguauguauguauggguagauggauggaugauggauggacgggugugugaauggauagaugaauggguggguaaauggauggauggaugagugagugagcgaauggauagauauguagaugagugaguggguggguggguggaaggauggguggauggaggauggauggauggguggguaaauggguggguaaaugaacggauggaugagugagugaauagauggauagguagaugggugaguggguggguagguggaugaauggauggauggaugcauggauggauggauggguggauggaugggugguggauguguggaauggacagguagauggguuggugguagaagagucugucuuagggugugaguagguggguggguaaacagugagaaguucuacagaggaaaauggugcaaaccuggccuaggcuaggcagacaugcuaacaggcauugauggccacuuuacagagacagccugccguguguaccucacagcaaacaccugacauuuuccggggaauccauaaauaacugacuuuuccaaugauggccuagccaguggcccaaaggcagagagccugccugggccucuccguuagcugccagcugaucagcagcucacucaaggaaaggaaaacaaaauucacuguguccagacuuucugggauuuucugguuuuccccuuccccucuuucucauacugucuuuacuugcauccaauguaaucaaucuaccaagcaaccucccuuguaugcaagcaaaacaccauauguacacaagcaaaacaccaugcuaacaacugacuauuuguuuuuggucauuauuuaacuguagguaggcuaggauggauggcuggaguuccagcaaguggacagauggagacugggcagauggaugaguggcaggucggcuaggagggauggagaugaugauggaaacagaggcggcugggcagcuggacaugccacaaggcuggccagaacaacaggagacaggauggcuggccagcuggaagcccccucccaccaagcguggcagcaggacucaccuggugccaguaaggugagucuggguuugacuccaucucuuccugcauccacucuagguuggccuccaggaagcucuucagccucucgcaguagccgacuucauacucgaaggggccgcaguaauucaccaccguguucauccagugcauguagaugagcugugggguagggggugggcgaggcaagggcgggcagcuggggugcucucuucccugagagccccccacccaggcugccccagagcggaggcugcugguguggccaccugaguccuugcucaugcuguccucucccuggaggcuccucucccugcccagcucugccccggauagggaccccaggccccuggaaguugcccugagagccuuuagccugcaaagccuauaacugauggcaccaccucugcuacuggggaccccaaucuauauguguguucaguuagucaauccaugaauguuuuuuuuuugagcaccuauuauguuccuuuuuaagcacugaggacauagcagggaacaaaacagcaauaacccuucugauuccacugggcaagagaaugccguggcaguuucacccagacuucaugcggcccucugcacuucccaccgagaugccaccugcaugaguccaggcucgccugcugggggacaaaagaccacguagccuggucauccccgugagugaguggcagcacucacugccucaggauugauggcuucaugacugcugcuccaucaccaucucacugaaacacauccaaauccuguucauccuucaaggcccacuaagacaccaccuccuccaugcaggccuccaugacuuccacagcauuuccccacugccuguccuauaccagguucugggcugggaucaggggacacagcuggggacaagacauauuaccacccacaagaaggccacaggcuagagggggaggcagcagggcacacuaguuaggagcgagacguggguuagacagagcugagguugaauggugccuccucuguggacuggcuggcugaccuugugaaaguagcuucaccucucugggcccaagccugcccauccauccaggggaggugcacaugcuucccucagggguuuaggguggaggcucagugagacuuugugggcaaagugccuggcacaugggccugggauuccugacauaagagccacuuguggccuugccucaguguccccagcaggccgugagccccuugagagacugaaccgugucucauucaccacugagcacccacaacagcccuggcccagcaucugaccacuuccccagacacuaaggucccagagggccacccacaacugcgacugggugucagaaggagcagugugaguuuuauaaaagggugucccacuggacguuguccucugugaugugcucuuucccccucgccuccaggcaucucagauucacccauuuccacugcucugucaugcugcacugugcaccuccaccuggucagccauucaccugcccaugguguuuuaaggacucccacuuugggacugcuuugaguaccuugugcauguccgugggucaccucuaagguaugcacccaaguaguagggcugcuggauccuaaggcacaugcagguucaacuccacaaguugaugucaacuugugacccaaugcaugccuccaucugcaucacaggagacagcugucacuccacagccucgccuacuucuuguuuuguuuuuugugugguuuuguuuuguuucauuuuuuugagacaaggucucauucugucacaaggcuggaguacagugguacaauccuagcucacugcagccuccaacuccugagcucaagcaguccucccuccucagccucccaacauccugggauuacaggcaggugcucugccuuugggccacugguuaggccaucaauggaaaagucaguaauuuauggauucccuggaaaaugucgguguuuacugugaaguacacaugacaagcugucucuguaaaguggucaucaaugccugauagcaugucugccuagccuaggccagguggcucguaccuguaaucccaacacucugggaagccgaggugggcagaucacuugaggucaggaguuugagaccagccuggccaacauggcaaaaccccaucucuacuugaaaugcaaaaacuagccagacgugguggugcaugccuguaauuccagcuacucuggaggcugaggcaugagaaucauuugaacccagggaggcagagguugcaguaagccaagaucacgccacuguacuccagucuaggugacagagugagacucugucucaaaaaaaaaaaaaaaaaaaaaagaaaagaaaaagaaaauuacacuagguacuaucugauacacagaaaaaauauauaacauauucuaaguuaugaagcaugauaauaaaaugaacauccaaacuaaaaccuagaaugguacugauaccauugagcauccccuaagccccugccuccucuaucccuagaggcacccaccacccuaaaugcgguagcuaucauucccuuucauucagucauuuauauugagauauagucagcauaccauaaaauucacauuuaaaaauguacaauuuggccaggcacaguggcucacaccuguaaucccagcacuuugggaggccgaggugggcggaucacuugaggucaggaguuugagaccagccuggccaacagggcgaaaucccaccucuacuaaaaauacaaaaauuaggugggcaugguugugcacaucuguaaucccagcuagucggaaggcugaggcaggaaaaucacuugaaccugggaagcagagguugcagugagccgagaucacaccacugcacuccagccugggugacagagcaagacucugucucaaaaaaaaaaaaaguacaauucaugguuuuuaauguauucauaagguugugcaacuaucaccacucucuaacuccagaacauuuucaucaucccagaaagaaaccccauacccaucagcagucacuccccacuccccacuccccccaagucccuggcaccacuaguuggcuuucugucucuguagauuugcuuauucugaacauuuuauauaaacagaaucauacaguaugugcccuuuugugacugguuuuuuucguuuagcauguuuucaagguucuuucauguucuggugugcgucaguccuuuauucccguuuauagcugaauaauguugcauuguaugauagaucacguuguauguauccauucaucagcagcugggcauucgaguugugccuacucccuuacuuuuguuaagcuaguuuuacugcaugugaugagucccugaacaacauacuauuuugcuuuacuuguuauugagcuuuauaagaagucagacaauaucagaagugggugagagccaggugcaguggccggccccuaguguaauuuucuaaagaaugcauguccacuuuuucuccccagauagaugaagggcuguggcaggaguugggggccuacucugcacacaucucaaaagcacacuggggaacaugcuuguggggcuggggcagggugggagccccauguccccaccuuggcccuuaccuccuccgacacagcagccuccaccacaccggcugcauaggccugcaagcugucauuguauuggccacuugugcccagcuccaggaaggcccaccuggaggggaaggaggggacacucagucagcagcagaggcccccagcuagacacauggcaucuccaggcuuaaacuaugaaaacaacacaguggucaguagacgugcacgugaaugucugucuguccaucuuugugagcuugccggauuaaaucccuccaagaggaacuacuggcucaaaggguacacguauuuuuaauuuucauagauauugacaaacagccucccccaaaaaugcagaacauaucuauauucccuuacccacaauaacaccagcuaacaacauccauugaggaugacauguuagcucugugccacgccauguucuagucacuuucaugucuauuaacucauugaguccccuauaauccuacaaggugggcacguccccaucuugucccucuugcagaagaggaggaaauuaaaacacagacuuaugucacaugccauccccacccccauguccaugcccuuugccacgagacuacaguccuccaccaauggccaaguauccuucccugcuccuucauuugggcuugguugugucacgugaccugcuuuggccaaugggauauggguggaagugacagcaugcuaguuauaagauuagccuucaggaagccucacuugccccuuugugccucugccaucaccaugggaagaacaagccccggccagcccacuggucccagggauaugagagccacacaagcacaccaggucuguagagcugcagcaugaaguagagcugccccagcagccccacggauccaugagaaucaauguuguugguuuaagcugcuggauuggggcugguuuaucacacagcacugcugcccaauacuagcggauacaugugaaaggucacagaguuggcaggggcaggauucacuuccaggcaggcuggcucccacuccucugaaggagcacuucucaaccucugauguauauaugcagguuaccugaaggccugguuagaaggcagguucugaucaguucugcaauggggucugagauucuuguuuuuuuuuuuuccugagacagagucuggcuguuucccaggcugggggguacuggcaugaucucagcucacugcaaccucugccucccagguucaagugauucuccugccucagccuccgggguagcugggauuacaggugugagccaccacacccagcuaauuuguguauuuuuaguagagacaggguuuuaccauguuggccagucuggucuagaacuccuggccucaagagauccgcccaccucagccucccaaagugcugggauuacaggcacuuuguuaagauacuuuacaguagcuuaaggccacugcaccagggcuuuuuucuuuuuuuuuuuuuuuuugagacagcaucuugcugucacccaggcugaagugcagcggcaugaucuuggcacacugcagccuccggccucccaggcucaaacuauccuuccaccuacgccuccugaguagcuagaacuacaggcaugugccaccacacccagcuaauuuugguauuuuuuguagagacgggguuucaccauguuggccaggcuggucuugaacuccugacgucaagugauccaccugccucggccucccaaagugaugggauuacaggcaugagccacuaugcccgggcucugcacuucuaaguagccuccagguaaugccaacacugccaguccuggaaccauagcaggucacagacugagucucuacaaugagcaaacuucuguuugcccacucccucacuaaaaugauuacuagcaaacuuuuucaucuuuaccaaggugauagcugcagaaguuccaacaugcuuccaauuuuuaaauuaguugaguuacauauauuuucuuauuuuuauuggucauuuauauuucucuguuucauguccuuuauccauuuuucucuauuggguuuuuaaaaaucuuuucuuauugguuggugaaauucccuguauacacauuagcccucugcuugucacuaacauugagaauacggggccaagcacaguggcucaugccuguaaucccagcacuuuggcuggccaagaauucgagaaauuugagaccagccuggccaacauggugaaacccccaugucuacuaaaaauagaauaaucagcuggguguagugguacacucuuguagucccagcuacucaggagccugaggcaggagaaucgcuugaacugggaggcggagguugcagugagcaaaauggcaccacugcacuccagccugggugacagagcaugacucugucuagaaaaagaaaaaagaaggggagggaagggggagggagggagaggaggaggagggaaggaggggaguggggagaggccagguggcugaugccuauaauccuagcaccuuaggaggcuaaggcaggagcaucacuugaggccaggaguucaagaccagccugggaaagcaagacucugucuacacgaaauaauuuaaaaguuacaggugcaguggggugugccuguagucccagcuacucaagagguugaggcaggaagaucacuugagcccaagaguuugaggcugcaguaaguuaugaucauuccacugcacuccagccuggaugacagagcaugacccucucucuaaaauaauaauaagagaaaauauguuuguguuuuaauugguuuuugcauuuguucuugccauauagacguuuucauuuuuguguaaccagaucaaucuuuuccuucacggugcuagauaucauuuuugcuccaaggacacaaaaauauucacucaugucauuucuauaacuagcggggggaagcauuuuuaaaggcaauuucuauuaagaaaaugagggcaacaggaagacgcuaaagagaccuugaagaggguacaagacagggagaggcaggcuuggccagggcugucucgugggaaguuggcuaaaaagccaucgaacacuuccaggacaggaauagcucagcccuggagaagacucuggagagggaaagacucaaaaaugcccacaucugauaccuucaguaagcaagccuuuuugagugccuacuggcugccagacauugaggguaucuaaggaugaaugauguucaucuggccuucaaaaugcuaguggcagcagaggggaaaggcaugaaaacagauaaggacauaacgggguaaccauuaugauggaaaaacgaauaaagugucaagggguuguccugaggagguauacugcugcugcuacaauuaucugacuacaaucugugaaggcaucacagaagaggugacagcuguucuggguuuugaaguuuacauaggaguuugccaggugaagagaagagagaaaguaaaaggaagaagccugaguucugaauguuccaaagcaaaguacuuuggggccagcaggguggggcuguggggaucuuuaguggggccuugauacagggaauuacaguagccccagaaacugugguaaguacuuacauuuuuauguaacucuaaauucuuccaaaaauggccagggcucgguggcucacgccuguaaucccagcacuuugggaagcugaggagggcgaucacuugaggucaggaguuugagaccagccuggcuaacauggugaaaccucgucucuacuaaaacuacaaaaauuagcuggguguaguggugcgugccuguagucccagcuacucuggugacugaggcaugaaucgcuugaacccgggagguuacaguaagcuaagauugugccacuauacuccagccggggugacagaaugagacucugucaaaaaaaaaaaaaaaauucuuccaacaaccguaugacauggguuuuauucuucccauuuuacagauguggggaaccgaggcucccacauaauacaguuagaugaagugauuugcccaaggucacacagcaggugagcagcagagcugagacuaacauucuugagugaaugcucugcgccucuaacucaacucagguuugugggggaguguugggggcaaggagguauaguucuuaucaaaugcagaugacagccaugaacuucgggcuaauuauucacauagcaucacagauaaggacagaggaaaaaacaaggggaaaaaauuagauuuuuaaauuucaaggagaauggaagacaaagaguuugggcuugugggucccuccgacuuggucugaaucccuggguagaucccuuacugguuguguaccuuugggcaaacugcuuuaccucucggggccucgguuuucucaucuguaaaaugggcagagugacucccccuucagaggacugcuguggcaugugccaggagagaacacacauuaugcacucacuaaguauuugucucaucaagaaucugagaggagauggcgcaguggcucaugccuguaaccccagugcuuugggaggcugaggugggaggaucacuugagaccaggaguaagagaccagccuggacaauaaagcgagacuccccucucuacaaaaaauacaaaauaaauuaaccaggugugguggugcuugccuauagucacaggaggcuggggcuaagaugggaggaucgcuugagcccaggcugcagugagcuaugaucacaccacuguacuccaguccagacaauagagcaagaugcugucucauuaaaaaaaaaaaaagaaucugaggggguaggaguuugaggagacccggcgagugugaugaugggaggaagauuauaacagggcccaauaugcagauccccucgugauaaaagcuggcaguggaucaaaggagaccucggacaaacugcguaaaaccaaaaaagcugugcagccgcgagccccaguaguaacugagcggccaguggccuccuccagggcacaccuggugagagcuaccccuucuagcaagggugggcucagccaaggccucggcacugaggccccggagacgggcagugguuaggaacccauucccuggccggaugcucauacagcccugcagagaugggcauaaaggcccuucuucacagcaggacuucucuucaaagccagaaaagacgggccuucccgaaacacccaucauuaggggccugauacaauaaucacacaugccauagcggacugcaugugcugaugagcaaagaggucagagaugaaguucaaaaaaaagucgagaaguccaaaugguaggcacgaacuaagccccuguguaaaugcaucacacaccacauaugccucuacauuuauauguaugcaagaagguuuaggccucuuuaugcauagaaaauucuggaagaaagagcuaaaaguccgggugcaguggcucacgccuguaaucccaacacucugggaggcugaggcggguggaucaugaggucaggagaucgagaccaucuuggcuaacauggugaaaccccgucucuacuaaaaauacaaaaaauuagccgggcgugggggcgggcaccuguagucccagcuacucgggaggcugaggcaggagaauggcgugaacccgggaggcggagcuugcagcgacccgaaaucgcgccacugacuccagccugggcaacagggcgagacuccaccucaaaaaaaaaaaaaaaaaaagcuaaaaauguuuauaucuaggaagaaugguagggggaggcuuuuacuucccauaucccauccccucuuucuaaacugcuagaaauuuguuuuguuuuguuuuguuugagauagggucucacucugucacccaggcuggagugcacuggcgugaucacagcucaguguagccucaccuggacucaagcaguccucccgucucagcuucugaguagcuggaacuacaggcacgcaccaccgugcccagcuaguuuuuuauauuuuuugcagagauagggucucaccauguugcccaggcuggucucaaacuccugggcucaagcaauccuccugccucggccucccaaagugcuggcauuacaggcacaagccacagcgcccggccagaaaaacacuuuagagugugucuauaacuagaugugcuuauuaaagacuacucuucggccaggcacaauagcucacaccuguaaucccagcacuuugggaggcugaggugggcagaucaccugacgucaggaguucaagaccagccuggccaacauggugaaaccccaucucuauuaaaauuacaaaaaaaaaaaaaaaauuagcuggguauaguggcucacaccuguaaucccagcuacuagggaggcugaggcaggaagaucacuugaacccaggaggcggagguugcaaugagccaagaucaugccacugcacuccagccuggguaacagagcagacucuaucucaaaaaaaaaaaauaaaucaaaagaagauuacuccuuauucagagaguauguccuuucugcuuguuugcucuaaaauugccaaucuuuuaugagauaaacgcugacagggguugacaaauauugcucuccuuuguuuuuaaugcacuugcuugacaaaaauuaaaaguuggcagcaguaggucuguuuccucaaucuuuuuuuuuuuuuccuggaaaaucuaugggccaaauugcaauuucaugccaggggcagcuaaugucucuaagaugacucaagagucuaaucaaggugccucuugaaagaggccacauuggaaaaagucagaccacugauaugagcagggggccacaaauaucucacaaauaucagcaccccacuuccgcagucuaguauggccuuggaugcucuccauuaugugggaugccccccauaacugugucuaucacuccuaucucagccuuuuuuuuuuuuuauuugagacagggucucacucuguugcccaggcuggagugcaguggcacaaucacagcugacugcagccucgacuucccaggcucaaacgaguagcugggaccacaggcaugcgcaaccacacccagcuaauuuuuuacuuuuuuuuugcagagacaggguuucaccacauugcccaagcuggucucgaaauccuggccccucgccauccuccugccucggucucccaaaacauugggauuacaggcaugagcuacagcgccuguccuccuuucucauucuugaugguauagauucaucuccugugauuguucaaagaaacagcugggccuuauuuauccauuuuacugggcuguuuuugccuguugguugguggauuugggaugcuuccccguuuacuaaauuuguuaauucccucuaacuuugauucacuuccucucucaacgggauggugauuuacuuuaagcaaccucgucgauaaggugcuggucagugggaucagaucagggaaggaagacaaaguaagguuggaggauacagcuuccccaggaccaaggccagagcuagacugaggcaggcucugcuccuagugacaucucugaucuccaagcaccaaaucauaaauguuuccaggcuguguggggguguuggcccaaagucaagauauggcacaacugaaagaagguaccgagcacaguggcucacaucuguaaucccaacauuuggggaugcuaaggugagaggaucacuugagcccaggaguucaagaccagccugggcaacaugacaagaccccuguuucuacaaaaaaaaagaauuuaaaaauuagccaggcaugggggugcguaucuauagucccagcuacuugggaggccgaggucggaggauuucuugagccugggaguucaaggcugcagugagccaugaucauaccacugcacucgagccuggauaacacagggagacccugucucaaaaaaaaaaaaaaaacaaaaaaaaaaaaaccuuuuuuaaaaaauaaaaaagacgaaggauuaugguguagggagaauuuauccugauaaucccaggauccccaguggcaaaaucuggggauuucaccaggaaggaggaggauccuaauucugagugaacagaggcaucaaaucccugcccccacccuccgaaauaagacacagagucccccacagaucagagauucugcugaucaggagccaggacacccccuauggcuuucuuucaucugacccugaguccucaagcagcugucucugaggaccucaguuuccugccuauaaaauggggcucgcuuuaugguuuucccugcaucagagccucaagggcuggcaaacucaaagggaaaggggcaugugagcguaagaggaggggaugagagagggugccgaaaacaagccagaaaguccaagaugggcagaucaccugaagucaggaguuugagaccagccuggccaacauggugaaaccccaucucuacuaauaauacaaaaauuagccgggcaugguggcacacaccuguaauuccagcuacuugggaggcugagacacgagaaucgcuugaacccaggguggggagguugcagugagccaauaucgugccccugcacuccagcugggcaacggagugaaacugugucucaaaaaauaaaauacaaauaaaaauaaauaaacagugcuuucugugaccccagugaauuuccaugacccuuuugguccuaccuugauaugagggaacaugcucagagaggugaagggauuugcccaaggucacacagcagaggggcugagccuggaagaacuuuccauccagcacaaucaaggaagccuucucuccacuuccauguuuaccauagucaagagcaacacagcccaggaggggccuccagaggccaaagcccccuccccaugcugggccucgcuccugccccuccucgccugaacaguucugucauguccucuugauucugcuaugcagggccaaaaacaugagugagucagcaaagaacgggucaccagauccaagagucccggcagcccccgaggccagccacaaagcuucaguucccuccacagaugccagcucacucuguggccuccucucucugggagccuucccagauuuaccccaaccagugccccugugucugugcaaauaucucccccaaaucucacgucuacuugauguaccccccaagugccaccagaauggggguguccucggcauccugugucucccuaacaccugcagaagccaauggaugccaguaaaauggauaggggcuaaagugggaggaggcccuuucugcugcagggggcaguguggucugagcacagaccacauccugggcacauccuagugcuaggguucccuagcaucaucuggacacuaggauaugacggaugcaccccggguucccuaggaucccccagcacagccugauccagcgucugggcccugcugacaaggcuuugaagcugauccuucccacucccacugacucugauuucucuucuaucgcugucuguguuucccacugaguagagacagcugcucagcugugucccuaaggccaaccaucaggguaaugaauaaaugaaugggcacaagcccuuguacagaacuugcagcacaugaccacccaacuagagcacauccucaaaaucugggccacagauggggaaacgggagcccagacaggcggaggaguuaggugagacucacacaucagaaugacagccuggguuccagcaauaaagauggugagcauggcugccaaacacggcauccagccaaggacuuccccuuggaccaggacacagaagacaagggaggagcagagcccuagcaggauacuaaaugggucuaugugacuuuagggacccucugcuuuuggacuagccuggaacccagguucaguccugcugaccuggcacuggaagggaggcagggugcuggcacccacgagcaagccacagccaagcagguaagaauuagucuccugcugaguucucaucaccccucaggccuggggacagggggcuggccuccauggggugaggaggcaaagucuagggaagggagcagguccccgugaggauagaauuuacccaccagccauggaccugauccagaugcaggcacugcggccucggugguagggaacuggcuucuuggggacagaaguacugucaccacuggcugaaggcaagggacuggccccaugaggugagggaugccgcaguagccagcucccaaacaggguacuuggcccgcagggcggugcugcagccucgggaguagcugacccccagagaaacgggcguucccacccggcaagaggccggucccgggaacaggcgagguccggcgcccacgcaucccccucccccgauggccccgcguggggauaagccaacccuuacccagucucgcggauggcguuggugagguuggcccaggccacggcgucaggguggcguccguccaccauaagcagcuggcccgccgagacguccaggagcaccgagcggcugcgggaggcuggagggaccugcccaucgcgcgcccagcggccccccggcgcugggaucgcccccgccaggccgcucaggaacggcccgaccagcagggccagcaccagggccagcgccagcgcccgcgucagcgcccgggccagguggcugccgggguagcaguacaucuggcccaccaugaccgcacaaugcugcgccccgcagcccgggucac

SEQ ID NO: 191514 - RNA, 31088 nt, Homo sapiens
gugacccgggcugcggggcgcagcauugugcggucauggugggccagauguacugcuaccccggcagccaccuggcccgggcgcugacgcgggcgcuggcgcuggcccuggugcuggcccugcuggucgggccguuccugagcggccuggcgggggcgaucccagcgccggggggccgcugggcgcgcgaugggcaggucccuccagccucccgcagccgcucggugcuccuggacgucucggcgggccagcugcuuaugguggacggacgccacccugacgccguggccugggccaaccucaccaacgccauccgcgagacuggguaaggguuggcuuauccccacgcggggccaucgggggagggggaugcgugggcgccggaccucgccuguucccgggaccggccucuugccgggugggaacgcccguuucucugggggucagcuacucccgaggcugcagcaccgcccugcgggccaaguacccuguuugggagcuggcuacugcggcaucccucaccucauggggccagucccuugccuucagccaguggugacaguacuucuguccccaagaagccaguucccuaccaccgaggccgcagugccugcaucuggaucagguccauggcugguggguaaauucuauccucacggggaccugcucccuucccuagacuuugccuccucaccccauggaggccagcccccuguccccaggccugaggggugaugagaacucagcaggagacuaauucuuaccugcuuggcuguggcuugcucgugggugccagcacccugccucccuuccagugccaggucagcaggacugaaccuggguuccaggcuaguccaaaagcagagggucccuaaagucacauagacccauuuaguauccugcuagggcucugcuccucccuugucuucuguguccugguccaaggggaaguccuuggcuggaugccguguuuggcagccaugcucaccaucuuuauugcuggaacccaggcugucauucugaugugugagucucaccuaacuccuccgccugucugggcucccguuuccccaucuguggcccagauuuugaggaugugcucuaguuggguggucaugugcugcaaguucuguacaagggcuugugcccauucauuuauucauuacccugaugguuggccuuagggacacagcugagcagcugucucuacucagugggaaacacagacagcgauagaagagaaaucagagucagugggagugggaaggaucagcuucaaagccuugucagcagggcccagacgcuggaucaggcugugcugggggauccuagggaacccggggugcauccgucauauccuaguguccagaugaugcuagggaacccuagcacuaggaugugcccaggauguggucugugcucagaccacacugcccccugcagcagaaagggccuccucccacuuuagccccuauccauuuuacuggcauccauuggcuucugcagguguuagggagacacaggaugccgaggacacccccauucugguggcacuugggggguacaucaaguagacgugagauuugggggagauauuugcacagacacaggggcacugguugggguaaaucugggaaggcucccagagagaggaggccacagagugagcuggcaucuguggagggaacugaagcuuuguggcuggccucgggggcugccgggacucuuggaucuggugacccguucuuugcugacucacucauguuuuuggcccugcauagcagaaucaagaggacaugacagaacuguucaggcgaggaggggcaggagcgaggcccagcauggggagggggcuuuggccucuggaggccccuccugggcuguguugcucuugacuaugguaaacauggaaguggagagaaggcuuccuugauugugcuggauggaaaguucuuccaggcucagccccucugcugugugaccuugggcaaaucccuucaccucucugagcauguucccucauaucaagguaggaccaaaagggucauggaaauucacuggggucacagaaagcacuguuuauuuauuuuuauuuguauuuuauuuuuugagacacaguuucacuccguugcccagcuggagugcaggggcacgauauuggcucacugcaaccuccccacccuggguucaagcgauucucgugucucagccucccaaguagcuggaauuacaggugugugccaccaugcccggcuaauuuuuguauuauuaguagagaugggguuucaccauguuggccaggcuggucucaaacuccugacuucaggugaucugcccaucuuggacuuucuggcuuguuuucggcacccucucucauccccuccucuuacgcucacaugccccuuucccuuugaguuugccagcccuugaggcucugaugcagggaaaaccauaaagcgagccccauuuuauaggcaggaaacugagguccucagagacagcugcuugaggacucagggucagaugaaagaaagccauaggggguguccuggcuccugaucagcagaaucucugaucugugggggacucugugucuuauuucggagggugggggcagggauuugaugccucuguucacucagaauuaggauccuccuccuuccuggugaaauccccagauuuugccacuggggauccugggauuaucaggauaaauucucccuacaccauaauccuucgucuuuuuuauuuuuuaaaaaagguuuuuuuuuuuuuguuuuuuuuuuuuuuuugagacagggucucccuguguuauccaggcucgagugcagugguaugaucauggcucacugcagccuugaacucccaggcucaagaaauccuccgaccucggccucccaaguagcugggacuauagauacgcacccccaugccuggcuaauuuuuaaauucuuuuuuuuuguagaaacaggggucuugucauguugcccaggcuggucuugaacuccugggcucaagugauccucucaccuuagcauccccaaauguugggauuacagaugugagccacugugcucgguaccuucuuucaguugugccauaucuugacuuugggccaacacccccacacagccuggaaacauuuaugauuuggugcuuggagaucagagaugucacuaggagcagagccugccucagucuagcucuggccuugguccuggggaagcuguauccuccaaccuuacuuugucuuccuucccugaucugaucccacugaccagcaccuuaucgacgagguugcuuaaaguaaaucaccaucccguugagagaggaagugaaucaaaguuagagggaauuaacaaauuuaguaaacggggaagcaucccaaauccaccaaccaacaggcaaaaacagcccaguaaaauggauaaauaaggcccagcuguuucuuugaacaaucacaggagaugaaucuauaccaucaagaaugagaaaggaggacaggcgcuguagcucaugccuguaaucccaauguuuugggagaccgaggcaggaggauggcgaggggccaggauuucgagaccagcuugggcaauguggugaaacccugucucugcaaaaaaaaaguaaaaaauuagcugggugugguugcgcaugccuguggucccagcuacucguuugagccugggaagucgaggcugcagucagcugugauugugccacugcacuccagccugggcaacagagugagacccugucucaaauaaaaaaaaaaaaaggcugagauaggagugauagacacaguuauggggggcaucccacauaauggagagcauccaaggccauacuagacugcggaaguggggugcugauauuugugagauauuuguggcccccugcucauaucaguggucugacuuuuuccaauguggccucuuucaagaggcaccuugauuagacucuugagucaucuuagagacauuagcugccccuggcaugaaauugcaauuuggcccauagauuuuccaggaaaaaaaaaaaaagauugaggaaacagaccuacugcugccaacuuuuaauuuuugucaagcaagugcauuaaaaacaaaggagagcaauauuugucaaccccugucagcguuuaucucauaaaagauuggcaauuuuagagcaaacaagcagaaaggacauacucucugaauaaggaguaaucuucuuuugauuuauuuuuuuuuuuugagauagagucugcucuguuacccaggcuggagugcaguggcaugaucuuggcucauugcaaccuccgccuccuggguucaagugaucuuccugccucagccucccuaguagcugggauuacaggugugagccacuauacccagcuaauuuuuuuuuuuuuuuuguaauuuuaauagagaugggguuucaccauguuggccaggcuggucuugaacuccugacgucaggugaucugcccaccucagccucccaaagugcugggauuacaggugugagcuauugugccuggccgaagaguagucuuuaauaagcacaucuaguuauagacacacucuaaaguguuuuucuggccgggcgcuguggcuugugccuguaaugccagcacuuugggaggccgaggcaggaggauugcuugagcccaggaguuugagaccagccugggcaacauggugagacccuaucucugcaaaaaauauaaaaaacuagcugggcacgguggugcgugccuguaguuccagcuacucagaagcugagacgggaggacugcuugaguccaggugaggcuacacugagcugugaucacgccagugcacuccagccugggugacagagugagacccuaucucaaacaaaacaaaacaaaacaaauuucuagcaguuuagaaagaggggaugggauaugggaaguaaaagccucccccuaccauucuuccuagauauaaacauuuuuagcuuuuuuuuuuuuuuuuuuugagguggagucucgcccuguugcccaggcuggagucaguggcgcgauuucgggucgcugcaagcuccgccucccggguucacgccauucuccugccucagccucccgaguagcugggacuacaggugcccgcccccacgcccggcuaauuuuuuguauuuuuaguagagacgggguuucaccauguuagccaagauggucucgaucuccugaccucaugauccacccgccucagccucccagaguguugggauuacaggcgugagccacugcacccggacuuuuagcucuuucuuccagaauuuucuaugcauaaagaggccuaaaccuucuugcauacauauaaauguagaggcauauguggugugugaugcauuuacacaggggcuuaguucgugccuaccauuuggacuucucgacuuuuuuuugaacuucaucucugaccucuuugcucaucagcacaugcaguccgcuauggcaugugugauuauuguaucaggccccuaaugauggguguuucgggaaggcccgucuuuucuggcuuugaagagaaguccugcugugaagaagggccuuuaugcccaucucugcagggcuguaugagcauccggccagggaauggguuccuaaccacugcccgucuccggggccucagugccgaggccuuggcugagcccacccuugcuagaagggguagcucucaccaggugugcccuggaggaggccacuggccgcucaguuacuacuggggcucgcggcugcacagcuuuuuugguuuuacgcaguuuguccgaggucuccuuugauccacugccagcuuuuaucacgaggggaucugcauauugggcccuguuauaaucuuccucccaucaucacacucgccgggucuccucaaacuccuacccccucagauucuuuuuuuuuuuuuaaugagacagcaucuugcucuauugucuggacuggaguacaguggugugaucauagcucacugcagccugggcucaagcgauccucccaucuuagccccagccuccugugacuauaggcaagcaccaccacaccugguuaauuuauuuuguauuuuuuguagagaggggagucucgcuuuauuguccaggcuggucucuuacuccuggucucaagugauccucccaccucagccucccaaagcacugggguuacaggcaugagccacugcgccaucuccucucagauucuugaugagacaaauacuuagugagugcauaauguguguucucuccuggcacaugccacagcaguccucugaagggggagucacucugcccauuuuacagaugagaaaaccgaggccccgagagguaaagcaguuugcccaaagguacacaaccaguaagggaucuacccagggauucagaccaagucggagggacccacaagcccaaacucuuugucuuccauucuccuugaaauuuaaaaaucuaauuuuuuccccuuguuuuuuccucuguccuuaucugugaugcuaugugaauaauuagcccgaaguucauggcugucaucugcauuugauaagaacuauaccuccuugcccccaacacucccccacaaaccugaguugaguuagaggcgcagagcauucacucaagaauguuagucucagcucugcugcucaccugcugugugaccuugggcaaaucacuucaucuaacuguauuaugugggagccucgguuccccacaucuguaaaaugggaagaauaaaacccaugucauacgguuguuggaagaauuuuuuuuuuuuuuuugacagagucucauucugucaccccggcuggaguauaguggcacaaucuuagcuuacuguaaccucccggguucaagcgauucaugccucagucaccagaguagcugggacuacaggcacgcaccacuacacccagcuaauuuuuguaguuuuaguagagacgagguuucaccauguuagccaggcuggucucaaacuccugaccucaagugaucgcccuccucagcuucccaaagugcugggauuacaggcgugagccaccgagcccuggccauuuuuggaagaauuuagaguuacauaaaaauguaaguacuuaccacaguuucuggggcuacuguaauucccuguaucaaggccccacuaaagauccccacagccccacccugcuggccccaaaguacuuugcuuuggaacauucagaacucaggcuucuuccuuuuacuuucucucuucucuucaccuggcaaacuccuauguaaacuucaaaacccagaacagcugucaccucuucugugaugccuucacagauuguagucagauaauuguagcagcagcaguauaccuccucaggacaaccccuugacacuuuauucguuuuuccaucauaaugguuaccccguuauguccuuaucuguuuucaugccuuuccccucugcugccacuagcauuuugaaggccagaugaacaucauucauccuuagauacccucaaugucuggcagccaguaggcacucaaaaaggcuugcuuacugaagguaucagaugugggcauuuuugagucuuucccucuccagagucuucuccagggcugagcuauuccuguccuggaaguguucgauggcuuuuuagccaacuucccacgagacagcccuggccaagccugccucucccugucuuguacccucuucaaggucucuuuagcgucuuccuguugcccucauuuucuuaauagaaauugccuuuaaaaaugcuuccccccgcuaguuauagaaaugacaugagugaauauuuuuguguccuuggagcaaaaaugauaucuagcaccgugaaggaaaagauugaucugguuacacaaaaaugaaaacgucuauauggcaagaacaaaugcaaaaaccaauuaaaacacaaacauauuuucucuuauuauuauuuuagagagagggucaugcucugucauccaggcuggagugcaguggaaugaucauaacuuacugcagccucaaacucuugggcucaagugaucuuccugccucaaccucuugaguagcugggacuacaggcacaccccacugcaccuguaacuuuuaaauuauuucguguagacagagucuugcuuucccaggcuggucuugaacuccuggccucaagugaugcuccugccuuagccuccuaaggugcuaggauuauaggcaucagccaccuggccucuccccacuccccuccuucccuccuccuccucucccucccucccccuucccuccccuucuuuuuucuuuuucuagacagagucaugcucugucacccaggcuggagugcaguggugccauuuugcucacugcaaccuccgccucccaguucaagcgauucuccugccucaggcuccugaguagcugggacuacaagaguguaccacuacacccagcugauuauucuauuuuuaguagacauggggguuucaccauguuggccaggcuggucucaaauuucucgaauucuuggccagccaaagugcugggauuacaggcaugagccacugugcuuggccccguauucucaauguuagugacaagcagagggcuaauguguauacagggaauuucaccaaccaauaagaaaagauuuuuaaaaacccaauagagaaaaauggauaaaggacaugaaacagagaaauauaaaugaccaauaaaaauaagaaaauauauguaacucaacuaauuuaaaaauuggaagcauguuggaacuucugcagcuaucaccuugguaaagaugaaaaaguuugcuaguaaucauuuuagugagggagugggcaaacagaaguuugcucauuguagagacucagucugugaccugcuaugguuccaggacuggcaguguuggcauuaccuggaggcuacuuagaagugcagagcccgggcauaguggcucaugccuguaaucccaucacuuugggaggccgaggcagguggaucacuugacgucaggaguucaagaccagccuggccaacauggugaaaccccgucucuacaaaaaauaccaaaauuagcugggugugguggcacaugccuguaguucuagcuacucaggaggcguagguggaaggauaguuugagccugggaggccggaggcugcagugugccaagaucaugccgcugcacuucagccugggugacagcaagaugcugucucaaaaaaaaaaaaaaaaagaaaaaagcccuggugcaguggccuuaagcuacuguaaaguaucuuaacaaagugccuguaaucccagcacuuugggaggcugaggugggcggaucucuugaggccaggaguucuagaccagacuggccaacaugguaaaacccugucucuacuaaaaauacacaaauuagcugggugugguggcucacaccuguaaucccagcuaccccggaggcugaggcaggagaaucacuugaaccugggaggcagagguugcagugagcugagaucaugccaguaccccccagccugggaaacagccagacucugucucaggaaaaaaaaaaaacaagaaucucagaccccauugcagaacugaucagaaccugccuucuaaccaggccuucagguaaccugcauauauacaucagagguugagaagugcuccuucagaggagugggagccagccugccuggaagugaauccugccccugccaacucugugaccuuucacauguauccgcuaguauugggcagcagugcugugugauaaaccagccccaauccagcagcuuaaaccaacaacauugauucucauggauccguggggcugcuggggcagcucuacuucaugcugcagcucuacagaccuggugugcuuguguggcucucauaucccugggaccagugggcuggccggggcuuguucuucccauggugauggcagaggcacaaaggggcaagugaggcuuccugaaggcuaaucuuauaacuagcaugcugucacuuccacccauaucccauuggccaaagcaggucacgugacacaaccaagcccaaaugaaggagcagggaaggauacuuggccauugguggaggacuguagucucguggcaaagggcauggacauggggguggggauggcaugugacauaagucuguguuuuaauuuccuccucuucugcaagagggacaagauggggacgugcccaccuuguaggauuauaggggacucaaugaguuaauagacaugaaagugacuagaacauggcguggcacagagcuaacaugucauccucaauggauguuguuagcugguguuauuguggguaagggaauauagauauguucugcauuuuugggggaggcuguuugucaauaucuaugaaaauuaaaaauacguguacccuuugagccaguaguuccucuuggagggauuuaauccggcaagcucacaaagauggacagacagacauucacgugcacgucuacugaccacuguguuguuuucauaguuuaagccuggagaugccaugugucuagcugggggccucugcugcugacugaguguccccuccuuccccuccaggugggccuuccuggagcugggcacaaguggccaauacaaugacagcuugcaggccuaugcagccggugugguggaggcugcugugucggaggagguaagggccaagguggggacauggggcucccacccugccccagccccacaagcauguuccccagugugcuuuugagaugugugcagaguaggcccccaacuccugccacagcccuucaucuaucuggggagaaaaaguggacaugcauucuuuagaaaauuacacuaggggccggccacugcaccuggcucucacccacuucugauauugucugacuucuuauaaagcucaauaacaaguaaagcaaaauaguauguuguucagggacucaucacaugcaguaaaacuagcuuaacaaaaguaagggaguaggcacaacucgaaugcccagcugcugaugaauggauacauacaacgugaucuaucauacaaugcaacauuauucagcuauaaacgggaauaaaggacugacgcacaccagaacaugaaagaaccuugaaaacaugcuaaacgaaaaaaaccagucacaaaagggcacauacuguaugauucuguuuauauaaaauguucagaauaagcaaaucuacagagacagaaagccaacuaguggugccagggacuuggggggaguggggaguggggagugacugcugauggguaugggguuucuuucugggaugaugaaaauguucuggaguuagagaguggugauaguugcacaaccuuaugaauacauuaaaaaccaugaauuguacuuuuuuuuuuuuugagacagagucuugcucugucacccaggcuggagugcaguggugugaucucggcucacugcaaccucugcuucccagguucaagugauuuuccugccucagccuuccgacuagcugggauuacagaugugcacaaccaugcccaccuaauuuuuguauuuuuaguagaggugggauuucgcccuguuggccaggcuggucucaaacuccugaccucaagugauccgcccaccucggccucccaaagugcugggauuacaggugugagccacugugccuggccaaauuguacauuuuuaaaugugaauuuuaugguaugcugacuauaucucaauauaaaugacugaaugaaagggaaugauagcuaccgcauuuaggguggugggugccucuagggauagaggaggcaggggcuuaggggaugcucaaugguaucaguaccauucuagguuuuaguuuggauguucauuuuauuaucaugcuucauaacuuagaauauguuauauauuuuuucuguguaucagauaguaccuaguguaauuuucuuuuucuuuucuuuuuuuuuuuuuuuuuuuuuugagacagagucucacucugucaccuagacuggaguacaguggcgugaucuuggcuuacugcaaccucugccucccuggguucaaaugauucucaugccucagccuccagaguagcuggaauuacaggcaugcaccaccacgucuggcuaguuuuugcauuucaaguagagaugggguuuugccauguuggccaggcuggucucaaacuccugaccucaagugaucugcccaccucggcuucccagaguguugggauuacagguacgagccaccuggccuaggcuaggcagacaugcuaucaggcauugaugaccacuuuacagagacagcuugucauguguacuucacaguaaacaccgacauuuuccagggaauccauaaauuacugacuuuuccauugauggccuaaccaguggcccaaaggcagagcaccugccuguaaucccaggauguugggaggcugaggagggaggacugcuugagcucaggaguuggaggcugcagugagcuaggauuguaccacuguacuccagccuugugacagaaugagaccuugucucaaaaaaaugaaacaaaacaaaaccacacaaaaaacaaaacaagaaguaggcgaggcuguggagugacagcugucuccugugaugcagauggaggcaugcauugggucacaaguugacaucaacuuguggaguugaaccugcaugugccuuaggauccagcagcccuacuacuugggugcauaccuuagaggugacccacggacaugcacaagguacucaaagcagucccaaagugggaguccuuaaaacaccaugggcaggugaauggcugaccagguggaggugcacagugcagcaugacagagcaguggaaaugggugaaucugagaugccuggaggcgagggggaaagagcacaucacagaggacaacguccagugggacacccuuuuauaaaacucacacugcuccuucugacacccagucgcaguuguggguggcccucugggaccuuagugucuggggaaguggucagaugcugggccagggcuguugugggugcucaguggugaaugagacacgguucagucucucaaggggcucacggccugcuggggacacugaggcaaggccacaaguggcucuuaugucaggaaucccaggcccaugugccaggcacuuugcccacaaagucucacugagccuccacccuaaaccccugagggaagcaugugcaccuccccuggauggaugggcaggcuugggcccagagaggugaagcuacuuucacaaggucagccagccaguccacagaggaggcaccauucaaccucagcucugucuaacccacgucucgcuccuaacuagugugcccugcugccucccccucuagccuguggccuucuugugggugguaauaugucuuguccccagcuguguccccugaucccagcccagaaccugguauaggacaggcaguggggaaaugcuguggaagucauggaggccugcauggaggagguggugucuuagugggccuugaaggaugaacaggauuuggauguguuucagugagauggugauggagcagcagucaugaagccaucaauccugaggcagugagugcugccacucacucacggggaugaccaggcuacguggucuuuugucccccagcaggcgagccuggacucaugcagguggcaucucggugggaagugcagagggccgcaugaagucugggugaaacugccacggcauucucuugcccaguggaaucagaaggguuauugcuguuuuguucccugcuauguccucagugcuuaaaaaggaacauaauaggugcucaaaaaaaaaacauucauggauugacuaacugaacacacauauagauugggguccccaguagcagagguggugccaucaguuauaggcuuugcaggcuaaaggcucucagggcaacuuccaggggccuggggucccuauccggggcagagcugggcagggagaggagccuccagggagaggacagcaugagcaaggacucagguggccacaccagcagccuccgcucuggggcagccuggguggggggcucucagggaagagagcaccccagcugcccgcccuugccucgcccacccccuaccccacagcucaucuacaugcacuggaugaacacgguggugaauuacugcggccccuucgaguaugaagucggcuacugcgagaggcugaagagcuuccuggaggccaaccuagaguggaugcaggaagagauggagucaaacccagacucaccuuacuggcaccaggugaguccugcugccacgcuuggugggagggggcuuccagcuggccagccauccugucuccuguuguucuggccagccuuguggcauguccagcugcccagccgccucuguuuccaucaucaucuccaucccuccuagccgaccugccacucauccaucugcccagucuccaucuguccacuugcuggaacuccagccauccauccuagccuaccuacaguuaaauaaugaccaaaaacaaauagucaguuguuagcaugguguuuugcuuguguacauaugguguuuugcuugcauacaagggagguugcuugguagauugauuacauuggaugcaaguaaagacaguaugagaaagaggggaaggggaaaaccagaaaaucccagaaagucuggacacagugaauuuuguuuuccuuuccuugagugagcugcugaucagcuggcagcuaacggagaggcccaggcaggcucucugccuuugggccacuggcuaggccaucauuggaaaagucaguuauuuauggauuccccggaaaaugucagguguuugcugugagguacacacggcaggcugucucuguaaaguggccaucaaugccuguuagcaugucugccuagccuaggccagguuugcaccauuuuccucuguagaacuucucacuguuuacccacccaccuacucacacccuaagacagacucuucuaccaccaacccaucuaccuguccauuccacacauccaccacccauccauccacccauccauccauccaugcauccauccauccauucauccaccuacccacccacucacccaucuaccuauccaucuauucacucacucauccauccguucauuuacccacccauuuacccacccauccauccauccuccauccacccauccuuccacccacccacccacucacucaucuacauaucuauccauucgcucacucacucauccauccauccauuuacccacccauucaucuauccauucacacacccguccauccaucauccauccaucuacccauacauacauacauccacccacccacccacccacucauccacccauccauucaccucccaccugucaacccacucacccacccauacauacauacauccacccacccauccauucauccaacaacccacccauccaucuugcagaugcuuacuaagugcccagugugccugcccaaggccccaugagggacacacugaugauacuuuauggcuauaggauguugaggcaaaaugaugacaauggggagaagucagaugcaugagacaggugcccgaggcagcaauacagucaguacugaacucagaacaggagcaguuggcaagaggccaggccaggcugggaggcguccuagaagagauggcuuuugaacuaggcucuuaaguggggcugauuugggguuaacacagggcagagacauagaguuaauucauugaaagcaggagagugcucagcauggaggggugggugguaguuugggggagucaaggcuggcuggagucuggaggguacccccgggccuccugcucugucugaacccccaggccagagcccgucccguugaaggagaaggugugagccuggaggagaggccucacccucccucugcccccgcccccuccccuaggugcggcugacccuccugcagcugaaaggccuggaggacagcuacgaaggccgugugagcuucccagcugggaaguucaccaucaaacccuugggguuccuguaagugccacccccagagugaacagggugggaagaagggccacacacucauagucggacagaccuggguuccagcaucaaccuugccacucccuggcucuguggccuuggaacagucagcugacuucccagagccucagcuuucuccucugcaaaaugaguacauaacagcacucacagcaggcgugguaacccucugaugcccuggcccuccucagccugcugcagcucucuggggaccuggaagaccuggagcuggcccugaacaagaccaagaucaaaccuucucugggcucuggcuccuguucugcccucaucaagcugcucccuggccagagugaccuccugguugcccacaacaccuggaacaacuaccagcacaugcugcgugucaucaagaaguacuggcuccaguuccgggaaggccccugggguaggugggugugggugugucugggggaugagcaggugggugggcacacacguggggagugguccuaggagguuugggccuuggaaacccucccaacacacggagucacugcagggauauuccaagaguucauuuugguuuuguuuuuuucuuuuugaguuggggucuugcucuguugcccaggcuggaguacaguggcacagucauggcucacuguagccuugacuucccaggcucagauuauccuccugccucagccucccaaguaucuggaacuacaaauguguaccaccacacucagcuaauuuguuuauuuuuuuauuuuuaagagauggagucucacuauguugcccaggcuugucucaaacuccugggcucaagugauccuccugacuuggccucccaaagugcugugauuacuuaugugagccaccacgccuagccaguucaucuuguuuuacauguuuauugccuuuuuuauuuuaccuauugcugcuuaaccaguuaccccaaaauuuaaaacaacaacagcuuaaauaaccgcuauuuauuuuuugcuccugccucuaugggucagcuaggugguuuugguuuucugggcugggccaggcugaucuuggcuaggcucacugaugcaucagcagucugcuggcaggucagcuggggugggauggcuggaaugggauggccucuucuccugucugggguugauugucagccagggugauggggacagcugggcuacguggucuuucaucaucaguaggugagcacaggccuguucauguagcacuggggcaggauaugguaaaggccucuugagaccuuggugaaacugacacagcauucuuuucuuuuuauuuugagacagaaucuugcucuggugcccaggcuggagugcaguggcaugaucucagcucacugcaaccucugccucccggguucaggcaauucuccugccucagccucucgaguagcugggacuacaggcgugcaucaccaugcccagcuaauuuuuguauuuuuagcagagacaggguuuucccauauuggccaggcuggucuugaccuccugaccucaagugaucugcccacuuuggccuccuaaagugcuuggauuacaggugugagccaccgcaccuggcuugacacagcauuuuuuuuuuuuuuuuuugagacagagucuuguucuguugccuaagcuggagugcaguggcacaaucucagcucacugugaccucugccuccuggguucaagugauucuccugccucagccucccaaguagcugggauuauaggcgcgcaccacugugucuggcuaauuuuuguauuuuuaguagagacgggguuuugccauguuggccaggcuggucuugaacuccugaccucaggugauacagccgccucggccucccaaaguacugggauuaaaggugugagccaccgcaccuggcugacacagcauucuuuauccaaaucaagucagguggccagcccaggcucaagagaugggagaauaggcuccaccauuugcuaugaggaacugcagagucacaucacauauggcuuggaugcaggcaugggaagaauuagagcuauuuuugcaaacaaccaauugcaaggauugcaugaauacauucuuccugucaaaugugaaaacuggcugggcacggugacccauccccguaaucccagcgccuugggaauucgaagcaggaggauugcuugagcccaggagguugaggcugcagugaacagugaucacgccaugacaccccagccugggugacagugcaagaccuugucucuaauaaagaaaaaaacaguuuuacagucaaggccaaaguccuccauagugccacauccuucaucccaggccccagcaucagccccagggauaccacugccaaauguuugcaguaccuccuucauggccaaauguaaaaacuugaugggaccaggagcuggugaggagguggggaaguguccagccuuauucauugcuaaugggaguaugcguuggcacagcuacuuuuaagaggaauccagcuggcaucuaauaaaauucaaaaucugucacuccagugauccagcaauucucugacuccagucugucccuagagagacauuucagcuucugcauggggaguguguauaagcaagucugcuaucacagugguuuggugacaaccuaauguccauucauugaaauuuaaguaaacucuaaauugacauuuauacaggaaaucguauacacuguaaguguacaacuugaauuucuugcacguggaacacaccuguguauagcauccaucuggagaaacagaacauucccagccccuagaagcuucccucguaucccuuuccaggcacacccccaccccagcaucaucucuguccugauuucuguuuuuuguuuguuuguuuguuuuguuuuuaaacagucuugcucugucacccagacuagagggcaguagugcaaucucggcucacugcaaccucugcuuccuagguucaagcgauucuucugccucagccuccugaguagcugggauuacaggcacacaccaccacacccagcuaauuuuuguauuuuccguagaaaugggguuucgccauguuggccaggcuggucuugaauaccugaccucaagugauccaaccgccuguccugauuucucacagaauagguuagguuugccugguuuugaaugucauaugaauggaaucauguagugugugcucauuuguucugcaugucugugagauucaucuguauuacuguguguagcuguagaucuaucauucucauugcuauauauccauuaaaauuuuaauagcuuuuaaaaacauacuguauaagucauacagguauguuauagaacauuggagaauccaccaaaacacucucacaaugaaaaucacuugaacacuccacaacccaaaagagaacauuucugugaacauuugguuauguuuucuccuagacuuuaaaaaauguaccuugccugggcacaauggcuuaugccuguaaacccagcacuuugggaggccaaggcagguggaacacuugaggucaggaguucgagacuggccaacauggugaaaccccaucucuacuaaaaauacaaaaacuagcugggcgugguggcgcacaccuguaaucccagcuacucgggaggcugaggccccagaauugcuugaaccgcgaaggcagagguugcagugagccaagauggugccacuguacuccaaccuaggcaacagagucggccucugucucaaaaaaaaaaaaaaauuuccaagggugggcuucaugcauggaauggggugcuauacccaucauuguaguauuauacagaauaguuucacugcucuaaaauguuugcuuucugaguuuuuuuaaaaucauaauuaagauuauacuguaugaauuauuugcgacuuccuucuuuugcccacuaggcugccuuggagaguugccaguacugccauguuugguccacugugcguuuuguuuuucaaauuacuuauuuugagacagggucucacuguguugcccaggcuggucacaaacuucuagccucaggugauccuccugccucagccucccaaagcacugggauuucaggugugagccucugcgcugggucccacugugccuuuuuccuuuccuuuuuuuuuuuuuuuucuuugagacagagucucacucuguugcccaggcuggagugcaguggcacaaucucggcucacuucaaccuccgccucccagguucaagcaauucucccacuucagccuccugaguagcugggacuacgggcaugcacccccaaccuggcuaauuuuguauuuuuaguagagaugggguuucaccauguugguaaggcuggucucaaacuccuggccuccugaccuuggccuuccaaagugcugggauuacaggcgugagccacugugcccggccuacuggucccuuuguuuuaaagugcaaagacuuaauguggaagagauaauucaggccagacgcgguggcucaugccuauaauucuagcacuuugggaggccgaggcugguggaucacuugaggucagaguucgagaccagccuggccaaugugguaaaaccaugucucuacuaaaaauacaaaaauuagcuagacauggugguaaaugccuguaauugcaguuacucgggaggcugagacaagagaaucacuugaaccugggaggcagagguugcagugagccgagauccccccacugcacucuagccugggcaacagagcaagacucugucucaaaaaaaaaaaaaaaaaaaaaaagacaaaggauaauucagagagcuacacccagaacucuggagcacuguagggaagaggucuggguagaaucccugcucagccauuuaacuguuuggccucugcuaaguuacuuagccuuucugagucucagauugccuuaucugcaaagugcagaugauaauucucugcccccaugcagggcggguauaaggagucaauuuacaagaucacagggguaaugagccuccagcauaagcgugaggucacaguagcccugcugcagacagugcauaaaaccagacuagcacuugucaagggauggguuucagguagaaggaguucuagggcaggggugaggguaccugccgggggugggccuguaaucccagcuacucgggaggcugaggcaggagaagcgcuuacaacugggagguggagguugcagugagcugagaucgccccauugcacuccagccugggcaaaaagagcgaaacucugucucaaaaaaaaaaaauguccagugaacaaaauauuuaucuguuugucuaucuaucugaguauauauauuuaacacauacacauauacccacgcacacacagaguugucccuugguguuggggagggaguugacuccaggagccccuguggaagcucaggucucuucuauaauacggcugacuguuuaccuauaacauauacauauccucccauauccuauaaucaucucuagauuacuuguaagaccuaauacaaugcuacauuaauaguuguuauacuguauuuuuaaaauuuguuuuaucuuuuaguguuauuucuuuuauuuauuuauuuauuuauuuuuuuuagauggagucucacucugucgcccaggcuggagugcaguggcgcgaucucggcucgcugcaagcucugccucccggguucacgccauucuccugacccagccucccaaguagcugggacuauaggcgcacgccaccacgccuggcucauuuuuuguauuuuuaguagagacggguuucaccguguuagccaggauggucuuggucuccugaccucgugauccgccugccuuggccucccaaagugcagggauuacaggugugagccacugcacccagcuguguuguuucuuuuuaaucauguuuuuuuccuaguauuuuugguccccagucgauugaauccaaggauguggaacccacggacauggagggccaacuauauaaguuuugcugcuagcuuuuauuuuuacuugcacguauaugcacuuuuauaugcccaaugaccucauuugcuaaaugacaaaaaggacacagugggggcuuccucggaggccugccugugccccugugccugugucuuguuagguagggugcaggggccuccaccugugccugucugaccagcaucccuggcucgcucugccugcacaggggacuacccgcugguucccggcaacaagcuggucuucuccuccuaccccggcaccaucuucuccugcgacgacuucuacauccugggcagugggcuggugagucccuuucucaugucuccucuguuccugggguguuugucacacggcggcucugagcuggcaggauugauuccugcggcaaguggggaccaggcugcagcccagugcugggugccauguaggagccaggggugcaguggaggaugagguggacgcugccccaccugccauucagagcccagacucgcccuuccccugcucuggggacuuggaccaccacaagggcguguuuaaacauagacccccaggccccgcacagggccuccaaaaccugcagauggccugggacucugcauguaacccugguugucaggaaaggcuggacuuggggauguuugggacuaucccugaccucagugaccucacuuguuuuuauguauucaggauaacugugcccccgccccccccacauccccaccgcuucccucuccuccugccucccucuugcuuuccucagagccccucugaccugaccagguuugcugaauagaggcuguuuacaguguguuguuuucaucuuuuuuccuggcugcgguccagacuuguuuagaaaucugucccuggcaccccucgcugagaaagugaacccuuugaucuccagggcaacgagacagaggagaaaaaacaucacucuaaaaaacacccuuagcgcagagaacgccagcucccugcggggacgggagggguggggacucuucuucuugucugauccuugcuuuuuucugaguguggaacgaggcaagagagggccaggcggugggugagggaacccccaugcuguggcccagguggggaaggggacugaggcagcuggggagggacacgugaaaugguuccaccugguuaccaggaaagggucugggcaggaaacuucccuuccaucagggucccuaacuguuuuugugccauaaacaccuugggcaguccaggaggcuguuggcccucuucucagaauaguguuuuaacuuuuauuauuuauuuauuuuuuuucauagagauagggucucucucugucacucagguuggaaugcaguggugugaucguggcucacugcaaccucccaccuccuggguucaggcgauccuccugccucagccuccugaguagcugggacuacaggcacaugccaccaugcucagcuaauuuuuaaauuucuuguagaaaugaggucucacuauauuucccaggccagucucgaacuccuggguugaagggauccuccuaccucagcuuccgaaagugcugggauuauaggugugagccacugugccuggcaaauuaguguuuuuagacacauaaaccaaaauguauaggauuauggaggaaaccaguuauagugaaauaugguuaucaaaauauaaguaaacuuuuaguauauaugugcugcuuuauuaacacacugaauaauaagauccagaagcaggugugauaaauaccauaaguuagaagaagcaaggugcaugaaugauacuuuaagguauguacagccuuguaaucugauggaaaaacaucugugauuucugacagugaccgucccagugacuacuaauaccacuguggugugucacguuaacaguggaaagaaauaccaaauuucaggauuuuuuuuuuucagagauaggaucucacacugucaugcaggccugagugcaguggcaugaucacagcucacugcagccucuaucaccucagccucaagcgauccucccaucucagccucccaaguaacuggaacuauaggcgccugccaccaugccuggcuaauuuuuuuauuuuuuguagagacagguuuugccauguuacccaggcuggucuugaccuccugggcucaagcaaucugacccccuuggccucccaaagugcugagccacuguguccagccuuuuuuuuccucuuuaaagagaaaaaagaaaaaaucacauuuauggauacagcuaucuuuuagcuguucucagcuuuuuggugggggugguggugguggugguuuuuuguguguguguguguguguguguguguguguguuuuuuuuuuuuuuuuuuuuuuuagauaggcucucucucuguugcccaggcuggagugcaguggcacgaucucagcucacugcaaccuucgcuuccaggguucaagugauucucaugccucagccuccgaauagcugggauuacaugaguuuuguuugguuugguuuuuaacucacaagaacuaagcuuuacuuuucaaauaugcugaaggcagccaaggguuccagcaggaaauggagaagggagaggaggcaaucggaggcagcggugggcauccugcaugccccaaggcuggagggagacugagggccucuccuguuguaaggccuccuaguccucugacugcugcaucugccaggcugacagccucaggccgugcaacuuuuccugcagaacugugggaaaggggugggaaugggagguugcccagcuuggugagggaguggguucaugggagcggcucuuugggccucucaggggcuguucaccagggcaaagcuagaugcaugaucccaaauccuccugcgugcuuguccaaggaacugguggggaacacgugccucaacuggauaugaguuuuuauuuuuauuuauuucuucuuuuguuacccaggcugaagugcaguggcaugaucugggcucacugcaaccucugucuccuggguucaagucauucuccugccucagccucuccaguagcugggauuacagguguaugccaccacaccuggcuaauuuuuguauuuuuaguagagacaggguuuuaccauguuggccaggcuggucuggaacuccugaccucaggugauccaccuaccuuggccucccaaagugugagccaccaugcccggcagauuaaguaaguauuuaacacauguaaucccagcacuuugggaggcggaggugggcggaucacuugaggucaggaguuagaccagccuagccaacauggagaaacccugccucuacuaaaaauacaaaaguuagccaggcgugggggcacgugccuguaauccuaguuacuagggaggcugaagcacgaaaauugcuugaacuugggaggcggagguuguagugggcugagguuacaccacugcacuccagccugggcaagagugagacucuaucucaaaaaaaaaaaaaaaaaaaaaaaauuuuuggagccaugacugaugaaguacugccacuugguggcagcaugccuaggcugugcagcagcccccuugaccuucccacaggugacacuggagaccaccauuggcaacaagaacccagcccuguggaaguaugugcggcccaggggcugugugcuggaguggguacgcaacaucguggccaaccgccuggccucggauggggccaccugggcagacaucuucaagagguucaacagcggcacgugagugggcuucuggcccuguggcuuccccugcaccaagagauagaccaaccuccccuuuaacacucacacuccuggggaccagauguggcauccgggccacacaccccacgcccuccuuuguuucauacauggggagacugaggcuagggaaggaaaggauuugccccuccccugcaggcuccucagccuaggaaggggugccuugguggcaguacaggaagagcacuuggaaccugaagacucucaaggggacaguggggagggcuguuugaggagguggacguggguggguggcagggccugugagccagagacacuggaacugggcagugcagaucuuacagcauccggcagaggagcugaccuagggagccacagaauauucuggaacagucaagcagcaugacgagagagggguuuguggauaccuggucaugcugcagcgucagggugucaguugaauggcuggacaaccccaggcccacuuccuguaauuccuagcugagugggacacugcaggguggggaaagcuggggagguggcuccaggcucuguucaguccucccuuccccugcccggcagguauaacaaccaguggaugaucguggacuacaaggcguucaucccgggugggcccagccccgggagccgggugcuuaccauccuggagcagaucccgugcguacccugggagggaggggugggggcucggggcagaggggacugccagggugaaggcccagagccgugcuggcgcugugcaggaagugaacgaucucaggaggguguggcuggaagagaaggugucccuggugggggcugaaguucaggacuuaauccauccuccaggcaauggggagccaucggggcuccccgagcagggcagugcccacaggagccccuuuucugaucaccuccaccccaucucucuucucggucucagcggcaugguggugguggcugacaagaccucggagcucuaccagaagaccuacugggccagcuacaacauaccgugcgugccuucucacuccgcuccccgucacccuccagggcauccaccucacuccuugcccagcuccuuccuaggcaauguuuuuaaacccacagaacaaagaaucccagccuacccccuuuucuggccaggagagcccagacaguuuggcaguguaguugcauggcuuaagucagcauccaugugaccucugguucuaacacccagagcaggguggugugggguggccaggcucagggacuggccccugccagggucucugacuggaucugccuuacugggcuguacagcugucaccuccugaggcucacuuacuuuaccugcauuuucucauuugacucuuaaaauugccacauguggucacuagaguuccuguucccaucucacagaugaugaaacugaggcccugagaaaguaccucacuuucccaagcuuccccuguuggcgaauggugaaggcaggauuuguuuuuuguuuuuuguuuugagacagaaucuugcccugucacccaggcuggagugcaauggugcaaucucagcucacugcagccuccgccuccugagcucaagugauucuccugccucagccuccugaguagcugggauuacaggcgccagccaccauccuuggcuaauuuuucuauuuucaguagagacaggguuucaccauguuggccagucuaaucucaaacuccugaccucaagugauccgccugccuuggcuucccaaagugcugggauuauaggcauaagucaccacacccggacugaaggcaggauuugaugccaugccuuuugggccccagagcccaagcuuggccaccccaccaagccaccccccagcacaaauggaagacauuauuguuaucccgaaugucauaguugguuuuguuguuguuguuguuguuuguuuguuuguuuuuagagacagagucucgcucugucacccaggcuggagugcaauggugcgaucucagcuugcugcaaccucugcuucccggguucaagcgauucuugugccucagccucccaaguagcugggauuacaggcacgugccaccacgccggcuaauuuuuuuuuuuuuuuuugagacggagucucgcugugucgcccaggcuggagugcaauggugcgaucucagcuugcugcaaccucugcuucccggguucaagugauucuugugccucagccucccaaguagcugggauuacaggcacgugccaccacgccggcuaauuuuuuuuuuuuuuuuuugagacggagucucgcugugucgcccagguuggagugcaauggcucgaucucagcucacugaaaccuccaccuuccagguucaagugaguacaugccucagccucccgaguagcugggauuacaggcacacaccaccgugccuggcuaauuuuuguauuuuuaguggagacaggguuucaccauguuggccaggcuagucucaaacuccugagcucaggugaucugcccgccucggccucccaaaguauugggauuacaggugugagccacugcacccagccugaaugucguaguuguaaguaauaauguccuggugugacugccccuccccucccuggccacagccuuggcugagugaggccagugggggucaugggugaccauccuuguccccggcagguccuucgagacuguguucaaugccagugggcugcaggcccuaguggcccaguauggggacugguuuucuuaugacgggagcccccgggcccagaucuuccggcggaaccagucacugguacaagacauggacuccauggucaggcugaugagguaggugccaguugggugguggguuggggagagggaggccgcaggaacacagaacuuccugugcgcuuuuuguaccaacucauucaaacuuugcugccagccccagagggccagcaggggguggucagauguuggacaccagugcagcagcucgguggccgcucuccacuugggcccugucacuguccucauagcuaaggggaggaugcuagacaucuguugagugaccuguacugcuaggcacuaugcuugguaccaggagcaacagguagaaaaccugugccccacuguccugucucuugggcggugcagaaauccaucaaguucuugcacuggugucaauguguaaagauggcuguguuccaagagaggcuauccaggaacaaacgggugccucaccuggcuggggugguggcauggaggccuucccugaggaugagugccugagcagagagcugaauaaugaaggcagagugacuuaggugaagggguccgggccccaggcagaggaacugucggggguagugugcagugggaggggcucaucaaguugaaggcuggcagcuguuaacggggcugccugugaggauuuuggcccccgucuuagccucuccuuccugggaugacugauguucccuccuuuuccccauccagguacaaugacuuccuccaugacccucugucacugugcaaagccugcaacccccagcccaauggggagaaugcuaucuccgcccgcuccgaccucaacccggccaauggcuccuaccccuuccaggcccugcgucagcgcucccauggggguaucgaugugaaggugcugccuccucccuagggccugagcugugggugggggaagucaccaucaccagcuuuggggaagggacagguuggggcaaagcugauggcggggcaggaaucacagucggaauugggcugugguuggggucacaguaaaggugacaguaugggcugggcacgguggcucaugccuguaaucccagcacuuugggagcccaaggugggcagaucacuugaggucaggaguuugagaccagccuggccaacauggugaaaacccgucucuacuaauaauacaaaaauuagcuaggcgugguggcgggcgucuguaaucccagcuacucaggaggcugaggcaugagaauugcuugaacccgggaggcagagguugcagugagccaagaucacgucacugcacuccaaccugggugacagagcagagacucaaaaaaaaaaaaagugacaguucagaauugggcucuggggucaaggucagggugggaggcugggugccuggauuggggcaggccaggaccccugcucagcugcggcucugcccuguccccaggugaccagcaugucacuggccaggauccugagccugcuggcggccagcggucccacgugggaccaggugcccccguuccaguggagcaccucgcccuucagcggccugcugcacaugggccagccagaccucuggaaguucgcgccugucaagguuucaugggacugaaguucugucccugcucugcugcuuucgccccugcugacccucgucagggucacccccgucccaaggccaccggacuucuaacuccagccccuccugggggcuucguucucugaucuggggucugagucaucuccuccuagagugggucacgaaccugauggggcucagaacugacccccucucucccccgaggugggugggcaccguggcgucucuucugcccugcccuaaaucucccacucucuguuucugucuguuuccuacugcugcucucucaaccucauucccaccucuggggccccuuccucgugcuucuccuuccugaggguuugggaagguccuggggcagacucuggggcucccaugggguggaaggagccuguuccagcacccuucucccagcugcauucccacggguggcccuggagcuggugagcuuugucugggcguugucuucggcuggcauugcuccucccagcucuggccccucugcucccucaggaagcaguccccucgucucccuuucugggcagcuuccuugaggacagaaacuugaaaacaaacacaaaccaaaguuucuggccaucuguggcuggaggguucugaauguccucucuccaugucaggcagagggucagcccccaugcuucugccucaggccccaccccaccccaccccaggccugccccucaccucagggccauacccacagcgcccugauggaggaaccagaccgcaggcugugccaccauuaaacaagagcggcuguggccccaugcugugcuucuugggguggcagggaagguggggucagcgcuuuuucuccucucagguuuggguucugcgccaucccccaugcagccuccugugcagcccucugucuguccuucuguccauucauucaucugccaacauacucacccaucauccaucugcacagccuuccacccacccauccgucuuccaucauccauccauccaucuaccuauccauuuaucauccauccacucacccauccaaccaccc

SEQ ID NO: 191515 - RNA, 10337 nt, Homo sapiens
caagaguugguaagcucgcugcaguggguggagagaggccucuagacuucaguuucaguuuccuggcucugggcagcagcaagaauuccucugccucccauccuaccauucacugucuugccggcagccagcugagagcaaugggaaauggggagucccagcuguccucggugccugcucagaagcuggguugguuuauccaggaauaccugaagcccuacgaagaaugucagacacugaucgacgagauggugaacaccaucugugacguccugcaggaacccgaacaguucccccuggugcagggaguggccauagugaguccagggcugagguugggucucugggaggcaggagauuccacggcggcagcaaggccgagcuacugggugcugggugccuauuaugugcgaggcccacacuugggugggaugugguguaggagucucaggcucuggagcaggcgcuugcuccagagcugugugacacugggcaggcuacuuaaccucucugugccucagucucugacucuguaaaauggggagaggcauaauacccacuucagaguaucguaaggcuugagcacaucauguucuuagcaaaagacuggcagugcucagugaauucacugugauuacucacugcgauuuucuucuauccucuccacaguacagaggaguaaacuuagggaggcuagagaacuuuguucaaacuacccagguugccuugugguuucuccgcagcaagaaggaguggcuuuuaucaguuagaaauauuugguuuuguggacacaaaucucaggacugaggcugaaaauucuggaccucuggggaggaagggggacuggggagaugccaggacccuagaauugggggcguggggguccugauggcccaauacuauccucuuagccuccugagcugcugacgucccuucucugcugcugccacacuuuuuggucucuaccccuugcacacauccgcuagugccucaauaaagaaaucuagacacgugguguccccagcccuggcccaggccagcaagcuaaggcaaguuugguuaauagcuauugucagaacugggauuuuaagccuggguaauuggcuugagggcaugcauguuuaaccacuacacuauccugccucucaauuuuuuuuuccucauggaaguaaaacagaaaaagugcccagaucaaaguguccagcuugauagguagccacaaacaauguaacuguguaacccccacccagauccagaaacaaaacauucucagccccccagagcccugggcccccgauccagucagcaccuccaaacccagguaggcaaucuccugacuucuaacagcauagacacguuuugccuguuuuuaaacguuuuacaauuauagggugaccaacuaucccaguucauccaagauugggguguuuccugggaugugggacucuuggugugaaagcugggaauguaaaccaggaugcaugggugaacccuacauaaauggcaucaugggcucugugugcuuuagugcgugguuucucugaccuaugauguuuaugaaauuuauguugugggguacaguuguuuaucuuuucauuguugugucaauuccauuaugugaauauuccacauuuguccauucuacuguguuuuuuuauuuuuacauaauugugcauauuuauaugggguacaugugauauuuggacacauggauacaaugugaaaugaucaggguaguuaggauauccaucaccucaaacauugaucauuuauuuguguugagaacaguucagaucuucucuucuaacuauuuugaaauauauaauaaauuauuguuaacuauagucaccccauugugcuaucaaacacuagaauuuaucccuucuaucuaacuguauguuuguauccauuaaccaacuucucuucauuuccuccucuacuucccagccucugguaacuaugauccuacucucuaccuccaugagaucaacuuuuuuuaacuuccacauaaacacaugcaauauugucuuucuaugccugacuuauuucauuuaacauaaugaccucuaguuccaugcacauugcugcaaaugacagaauuccauucuuuuugugucugaauaguauucuauuguguauauauacuacauugucuuuauccauucagcugcugauggauacguugguugauuccauaucuuggcuuuugugaauagugcugcaauaaacaugagggugcaguuaucccuuuuuuggauaaauaccuaguagugggauugcuggauugaauggcagugccauuuuuauuuuuuuuagaaaccuccauacuguuuuccguaaugacugugcuaauuuacauucccaccaacaguguguaagauucccuuuacuccaaauccuugcuagcguuuauuuuuugucuuuuugauaauagcuauucuaacuggggugagaugguaucucauugugguuuugauuugcauuucccuagugauuagugaugucaagcauuuuuucauauacccauuggccauuuuguaugucuucuuuugagaaaugucuauuuaggcccuuuggcugcuuuuuaaugggauggguuguuuucuuugcuguugaguuguucacguuccuuguauauucuggauauuaaacccuuguuggaaaaauaguuuccaaauauuuucucccauucuacagcuugucuuuucacucuugauuguucccuuugaugugcagaagcuuuuucauuuaauauagucccaauugucuauuuuuuguuuuuguugccugugcuuuugaagucuuagccacaaaauacuugcauagaccaauaucaugaagcauuacucuucugcuuuauucuauuaauuuuaucauuucaggccuuauguuuaacucuuuaacccauuuuuaguuaauuuuuuauaagaugacagacgggggccuaguuucauucuucuacauauggauauccaguuuucccaacaccauuuauugaagagaguauccuuucccuaauguguguucauggugcuuucucaaucaguuggcuguaaauuuguggauuuguuucuggguucucgauucuguuccuuuggucuauaugucuguuuuuauaccaaucccaugcugcuuugguuacuauagcuuuguaguauauuuugaagucacguagcaugaugccucuagcuuuguucuuuuuccucaguacuauuuggcuauuugagaucuuuuguguuuccauacaaauuuuaggauuguuuuuucuauuucugugaaaaaaaaugucacugguauuuauaaggauugcauugauucuguagauugcuuuggguaguaugguuauuuuaacaauauuaauucuuccaauccaugagcaugggaugucuuuccauuugcuugugucaccuucaguuucuuuuaucaguguuuuguaguuuucacuguagagaucuuucacuuccuuaguuaaaugcauuccuagguauuuuuguuaaauacuauaagauugcuuucuugauuucuuuuucagcuaguucauuacugauguguagaauauguugguauuuugguauguugguaugguauguugauuuugguauuuugauuuuguauccugcaacuuuaccaaauuuaucaguucuaagagguuuucuugguggagucuuuagguuuuucuguauagaagaucauauggucugcaaagaggggcaauuugacuuuuucuuuuccuauuuggaugccuuuuauuucuuuaucuuuugggauugcuuuggcuaggacuuccaggauacaggcugaaagccuuucccaauucaguaugauguuaacuguggguuugucauauauggacuuuauuauguugagguauguuccuuacaugccuaauuuguugaggguuuuuagcauaaagggauguugaauuuuaccaaauguucuucuacaucuaccaggauaaucauaugauuuguccuucauuauguugaugugaugugcaaauguucaacauuuguugacuugcucauguugaaccauccuugcaucccugggauaaaucccacuugaucauguguuaucuuuucgaaguauuauuggauuugguuugcuagcauuuuguugaagguauuuguaucuauguucaucagggauauuggccuguaguuuucuuuuuuguugugucuuuggucuaguuuugguaucaggguaaugcugacuucauagaagugguuaggaguaauucccuccucuucaauuuuuuuggaauaguuugagaagaauugguguuaauucuucuuuauaaguuugguagaguucagcaguaaagccaucuaguccugggcuauucuuuguugaggaguuuuuuauuacugauucaaucuacucacucacuauuggucuguucagguuuucuguuucuuccuggaucaaucuuaguagguuguauguguucaggaauuuauccaucuccucuaggcuuuccaauuuguucacauguaguuguucaucauagucucuaaugaccccuuuuauuucugugguaucaaugguaaugucuccuuuuuuaucccugauuuuauuuuacuugggucuucucuuuuuuuagucuauuuagucuaaguagcgguucauccauuuuguuuaucuuuuuaagaaaccaacuuuuuauuuuguuaauuuuuagccucuauuauguuuaguucuguucugauuuuuauuauuucuuuccuucuacuaauuuuagguuugguuuauucuugcuuuuuuguuuguuuuugagauggauuuuugcuuuuguugcccaagcuggagugcaaugacgugaucucagcucacugcaaccucugcccccuggguucaagugauucuccugccucagccuccugaguaguugggaucacaggcaugcaccaccacgcccggcuaauuuuguauuuuuaguagagacgggguuucaccauguuggucaggcuggucucaaacuccugaccucaggugauccacccgccucagccucccaaaguacuggaauuucaggugugagccacuaugccuggcuuuucuugcuuuucuaauuccuuaagaugaaccguuagguuguuuauuugaaauuguucuacuuuuuuugauguaagcauguauugcuucaaacuuugcuguaucccuuagguuuugguauguuguguuuccauuuucauuuguuuccagaaauuuuuugauuuccuuuuaaauuucuucaucagcccagugguuguccaggagcguguuguuuaauuuucacguauuuguacaauuuccaaaguuccucuuguuccauuguggucuguauccauugugguaaguauccauuaagauaccugacaguauuucaauuuuuaaaaauuuguugagccuuguuuugugaccuaccauagggucuauccuggagaacauucccugugcugauaagaauguguauucuguagcugaauaaauaaucugcaaauauucauuagguccauuuggacuauaaugcagacuaaguccaguauucuuugcugaauaaauaaucugcaaauauucauuagguccauuuggacuauaaugcagacuaaguccaguauuucuuugcugauuuucugucuacgugaucugcccaauaccaaaagugagaugaaguucccagcuauuacuguauuggcagucucucggucucuguuuagcucuaauauuugcuuuacauaucucagugcucuaccguuggguggucauacauauguguauaaauauacauauacauauauaugucuauauacauauauacacauacuuauauccucuggcugaauugaucucuugaucauuaauuauaaaaugaccuucuuugucucuuuuuauguuuuugacuuaaagucuacucugucugauauaaguauagcuacuccugcacacuuuugguuuccauuuguguggaauauuuuuuccauuccuucacauucagucuauauguaucuucacagaugcagugaguuuauuggaggcagcauauaguuggaccuuauuuuuuauccauucagcuugucuguaucuuuuaacuagagaauuuaaaccguuguuaaauucaggguuguuauugauagguaacaacuuacuccugucauuuuguuauuuguuuugauuguuuuguacauucuuuguucuuuucuuucucuuuauugccuaccuuuccaauuguuggggguuuuguaaugauaacauuugacuccuuucucuuugucauuuguguaucugcucuaccagugaguuuuauacuuuuguguguuuucaugaugguagacaucaucccuuugcuuccagauguaacacucucuuaagcauuuucuguagaacuagucuaguggugaugaauucccucuguuuuugcuugucugggaaagacuuuguuucuccuucauuuuugaaggauagcuuugcuggguaucguauucuugucugaaaggguuuuuuuuuagcacuuugagcauaucauccuauucucuucugaccuguaaguuuucugcucagaaaucugcuauuagucugaggagaauucccuuauaugugacuuuauacuuuugucuugcuauuuucagaauuauauguuugucuuugacuuuugacaguuugacuauaauaugccugcagaagacauuuugggguugaaucuauuugagaaucuuugagcuuccuguaucugggugucuaaaucucuuguaagacaugggacguuuucagcuauuacuucauuaaauagauuuucuaugccuuugcccaucucuucuccuagaucuuuccaaauuuaaauauuugguuacuuuaugauuaccaauauggcacauaggcuuucuucacucauuuuuauuuauuuuucucuccuuuugucuggcuggauuauuucaaaagaacugucuucaaguuuagaaauucuuucuucuccuugaccuagucuauuguuaaagcagugaguuguauuuuuauuuuauucauugauuucuucaguuucaggaauucucuuugguucuuuuuagcaauaucuaucucuuuguugaguuucucauucagagcauaaauuauuuuccugauuuauuuguauuguuuaucuguguuuucuuguaucuuacugaauuucuuuaauaucaugguuuugaauuuuucuuaaccauugcacagauaucauuuucuuugggaucuguacuaaagaauuauugugcuccuuuggaagugccauguuucccuugcuuuuucauguuucuguguccuuacauugauaucagcacagcuaauguaacagucacuucuccaauuuuauuuauugacuuucauagggaaagacauuuuccucugcugggcaugauggcucaugccuauaaucccagugacucaggaggcugaggugggaagauugcuucuggcaggaguuugagguuacagugagauaugauugugccacuaugcuccagccuaggugacagagcaagacccugucucuaaaaaauuaaauaaaaauaaaauaaaaaagauguuuuccuguagaugugucuauaguguugguugaguggagcgcuuuggcuuugauucugugugggcacaguuaguggagccuccacaugauuucauuagcaucaguguugucugugagcuccucaguggcugacaguguaguuguuaauggagucuguggaaaggcugugcugggaacagggacaucaggcagguuggucuucaagcaccaguggugacagcaguaugccaggcaugcugguccucaggcccccaggcaguguaugugggugucaaugcugguguguccaggugggcaggguaucagacuucaagaugacauguucgggugccagugguagcagcaguggacugaacaggcagguccuugggcccccagguggcuuguuuggaagcggcagcagcaggccaacccucaggcccucaagugguguacacaggcaucagugauggcaagcuggguaggcugguccccaggcccuugggagacacauguggucacuaguggcaggcagagugggcccauccuuaggccucuggauggugugugccugugcugcuggugguaaagaggacggguuaaucuccuggccccugggcagcacauguggaugcugguggcagguggggcgagccugucuucagguucccuaauggugugugcaggugcuggccgcaggugggacaguuuuacccccauucccccagaugcgcacaggcaccagcaacaauggcaggugaggcgauccuauccucaggcccugggacaguaagcacaggugcugguggcagguggggcaguucaauccguuucuauugccagcggccauuugagucaccuccagguuggggcuaguaugaaaaguguuacuaugagcaucccaaucaggucuuuguggggcaaauggaugccugccacucaauguuaagaccauuuuuggcuuuuacuugaguugagaaauaccacugccugcuagagaucccuguaaccccagaaucuagugucucauaucugcuucuuugucacuggcaggguggcuccuauggacggaaaacagucuuaagaggcaacuccgaugguacccuuguccucuucuucagugacuuaaaacaauuccaggaucagaagagaagccaacgugacauccucgauaaaacuggggauaagcugaaguucugucuguucacgaagugguugaaaaacaauuucgagauccagaagucccuugauggguucaccauccagguguucacaaaaaaucagagaaucucuuucgaggugcuggccgccuucaacgcucugaguaagcauugcugggugucaggagagaaaagccaaagaagcgggugccagacagcucugugcaaccucuaggccaugagugggauagauaccacugcugcuuuaaaaaaugggagaccauagacccucaggagagaagaaucccuucuacccuggacucgcucucuucucuggaacuaacuucucccccauacccugauugucuuuggagaaaauguucuggauucuagaaucuaaggcagagccuuuuaagccauacuguacacauaaaucaccuggaaccuuguuaaaaugcagauccugacucaggaggucugaguuagagcccaggauuucauauuucuagccagcuccaugaugagcugcugguccgcagaucaugcuugcagguuuugaccagagucaguguugguuagaguaagaggaugaggcagacaucugggaaaaguccagcuggggcaagcauuugaagucugccuuccuaccaggucaaaaucaaggcaacgaccuuccauagauaacuaucaaagcuugagggggugccuugaacccaacuccuaaaucccuaagaccugcccaccucuugugucuccugucucagcaaacauucccacacucuugcauauuguuaaaguaaccucugcuuaccaggcuucugguuuaauaaaagauggcuagagugacuccaucuuaaagcaaguagcuaggcacucaaaaggaaccuacaggcuuaauacuugggucugaaaauagccacagucuaagcugaccaccaauuauaauugcagaauauuuaaggccauacaaaacaucucccacuaagccuacaaaauguccagguguccuaaaaguucagcccacuuaaaggcagcauuaaugagcagguuuagguugaaggauuaauggucaucaauaccacuguuaagaagaaaauucuuggccaaauugaauuuaauggaguuuaacugagcagacaauucacaaaucuagaagccuccugagccagaguagguucagagagucuugaacacagccacgugguggaagaagauuuauggacaggaaaaggaaaaugauguacugaaaaugaaagugagguacagaaacagccagacugguuauagcucagcauuggccuuauuugaacgagauuugaacaguuggccaccuuugauuggccgaaacucagugauuggcacaagaguagguugcagucuguuuacacauccuuuuagguuauaguucaccauguacagagaaauuuuaggccaaacuuaaaauauguaaggaggcagcuuuaggcuaaacuugauuuaacagcaccaauacccccuaccuuuagugagcacaucugcacauuccaauuuuaaugacagcuccuuagaauuucuuaucaacgaagacacuaacaaagaauggcgcauuccuccuucuccuuucugaggaugcccuacccuguaacaaagucguuucuaauaaauuugcuucuuucaccaua

SEQ ID NO: 191516 - RNA, 28060 nt, Homo sapiens
agugcggggucugacagaggaggcuccgugucugcagcuagugugucaacucagcguuucuccucucgucccuggugagguguagcggcggcacgcggcuggagauccccuguggccuccaguuuaggaaggguccagcaucccaagggaggggugugugggcgaggggucucugggcccggggucgcggcugugaggagaggaugcccgcgcggcggcaucucaggcaccuggaggaggccgcgcuuucuccucagggaaccggcgccuuggcagcccccggcgacgccgcccccuucgcggccuagguuggucuggugagccgggaagcgggcgucguucgcagcgccgcugugaccaccgcgucccgggcggagcugggcucagugccggccugggccuagaguccgagccucgagcugccggcguggggggucgcgaguggccuaaugcggccucgaagccgaaggacccgaguccgagcucgcacuccgacccgcuggugcuguggaaaacucagguggccuuccgcuuucguagccucuaaaguggggaccaagacuuucaccucuuaggauuguagucgggauuaaaagauuuucccgguaagcguuuggcaacugcuauuauuugagaagccgcuuacuucuucacuccccaucaccgaccuuccuggggacgggggcgauuggaaacugccuugggguaucuggacccggcaggggaagcuccgccgccucgggcagagggacgguccccucugcggacuagagagaucuagcugacccccaacaggcuccuuauaagcuugaagacuuuucugugccucaacucuuccgugcauucgcccguuuccuugacccuuugaaguauugucaguccucugccugaagaaucugaggcccagagagguuaaaucuggcagaaccagccagaccuugacccccagagggggacccugcaggcuacccccagucuccuugcaucuagaaaagcaagcaccugcuacaucugagcucuggccuuagaguuggccagagugggcuggaauagagcacaccugaaaucagucggacagccuuccuuaguugccauuucauaucagagugaauaucuuuuuuuuuuuuugagauggagucaccuucuguuguucagguuggagugcaguggcgagaucucagcucacugcagccuccgccuccuggguuuaagugauucucuugccucagccuccugaguagcugggauacaagcgcccgucaccacgcccaacuaauuuuuguauuuuuaguagagacuugguuuugccauguuggccaggcuggucucgaaccccagaccuccagugaucugcccaccucgcccucccaaagugcugggauuacaggcgugagcugcugcgcccagcccagaaugggugucuugaauuaugucauucccuaguuuaaagcccuucagugguuuaccauugagcuuggaaucgaauccaauauucuuucugucugauaugacaagaccuucuugagucauuccccuuuuuuauuaugcucuuccagaucugccuuuacuuucucuuucauugcuuuuaggccuuuugcccuucccacugccuggauggauuuccccgcauucccauccucuaucuuugucuuuucgugguuggcucuuguacuucaguucuuaauuuaaaugucgucuccccagaaaguucuucccugaccacucuuaucuaccuaaaguagauuugccucuauuccgcccccauuuauuugucaguauacuuuuccaucacaauacucaaguuauauguauuuuuuugcuuauuguuuuucucuaccacuaaaucgcuuuaucagagacuauauuuccuuauuuuguaaaguauuuuuagugccagggcacaguggcacacaguauggucuucuuuuucuuugagacagggucucacucugucaccccggcuggagugcaguggugugaucacaacucacucacuguagccucgaccuccugggcucaagccucccaaguagcugggacuaccucagccucccaccccagccucccaaguagcugagauuacaggcaugugccaccauacccaccuaauuuuuugcuuuuuuguuuuuuguuuuuuuugagagggagucucgcucugucgcccaggcuggagugcaguggcgugaucucggcucacugcaagcucuuuuuaguagagacuggguuucaccauguuaggcaggauggucucgaucuccugaccuugugauccaccugucucggccucccaaagugcugggauuacaggcaugaaccaccgcacccggcugcuuauuuuuuauaaaggcagggucuuacuauguuuccuggcuggccuugaacuccugagcucaagugauccacccaccccagccuuccagagugcugggauuacaggugugagacacugcaccuggcccacaguauuguccuuuuuuuuuuuauuuuuauuuuuugagacagaggcucacucuguugcccaggcuggggugcaguggugugauccuggcuuacugcaaccuccaccucccggguucaagcaauucugcuucagccucccuaguagcugggacuacaggcacccggcuaauuuuuuuauuuuuaguagagagguguuucgccaugcuggccaggcuggucuugaacuccugaccucaagugauccgcccaccucagccucccaaagugcugggauuacaggcaugagccacuggacccagccucaaaguauugucuuaauuaagcauguugaacaaaugacuaaauacauguuuugaaaaguggcaacucgcuugauaaugccaaaaccuuuaaagaacccuacugggggcaggauuuaagaccauuuuuguaucauggaaaggaauaaucuaaacuaaacaaugguaguaaaguugccagugcuuugcuuucugcauugacaucuuguuuaaaaagcaggagaaacuuuauagugaagaaauuuggcagacaccauaucaacuaugugaucaugguuuacaucaauaguaaaauaagacuguugacaucauguaccuucugauauaaggcacugagaugagcacaacaugauuucuaugguguucuugccaaaaauauauaaccugaauuuaaucaugagaaaauaucagacaaacccaaauugaaggauauuauauaaaauaacuagcuggcugggcacggugacucaugccuguaaucccagcacuuugggaggcugaggcuggcugguggaucauaugaggucaggaguuugagaccagccuggucaacauggugaaacuccaucucuacugaaaauacaaaaauuagcugggcaugguggugcacaccuguggucccagcuacucaggaggcugaggucgagguugcagugagccgagaucgcagugagccgagaucgcaccacugcacuccagccuagacagcagagugagacucuguuuaaaaaaaaaaaaaaaaaaaaagccaguaugcuuaacaaggucaugaaagagaaggaaagacugaagaacucucccaaaucaaaggagauuaacuacaaguaauagccaaaugcagugugugauccuagauugaaugcugaaccagaaaaagggugggauggugauuuuuuuuuuuuuuuuuuuuuuuuuugagacaggaucucacucugucacccaggcuagggugcagugguacaaucacugcucacugcagcuuugaccuccugggcuuaagugaucuucccaucucagccuucugaguaguugggaccacaggugugugccaccacgucuggcuaauuuuuaaauuguuuguagagaaggguuucaccauguugcccaggcugaucuuaaacuccuggguucaagcgauccucuucagcucagccucccaaaguucugggaguacaggcaugagccccugugccugacuuguuggugaaauuugaaugaauucuauagauuaguuacuaguauuguauuaguguuaauuuccucuauuugauaauuuuacuauuguuaugaugcuuuuaggguaauuggaugaagucuguaagggauguuauuuuauuuuuauuuauuuauuuauuuuugagacggagucuuacucugucgcuaggguggagugcaguggcacgaucuuggcucacugcaacuucugacucccugguugaagcgauucuccugccucagccucgcgaguagcugggauuacaggcaugcgccaccacacccagcuaauuuuuguauuuuuaguagagauggggguuucaccauguuggcuaggauggucucgaucuccugaccuugugaucugccugccucggccucccuaaguccugggauuacaggugugagccacugcgccuggccaggauguuauuauuauuauuauuuuugagacagggucucacucugucacccaggcuggagugcaguggcaugaucauggcucucugcagccuuaaacuccuaggcuuaagcauuccucuugcacauuccuccugccucggccucucgaguagcugggacuacaggcacacaucaccaugccuggguaauuuuuuuuuuuuguauuuuuuguagacaugacguuaccccauguuguggccagguuggucuuaaacuccugggcucaagugauccgccugccucggccucccaaaguacugagauuacaggcaugagccacuguacccagccuaguaaaaguauuuuauuuuauuauuuuuauuuuuuaaaacucccuuauccaauaaaauuauuuuaaauugaaaauuuuaaaauaagaaaaucccaagggacuggauauugaauaaaaugcuuuaacaugcagguuugggugacaguuucuguauacuaguuuuuuauuuguuuuuuugcaugucaucuuuaaagcagaaaugaaagagaaaguucaugucuuccuuugugguuuucaggaagagcuaaagauggcugaauuucuagaugaccaggaaacucgacugugugacaacugguaagacauuaaaucuaagaaauguuaguggaaugaggacagucaagcuuaaucacuaucauuuccugauuuaaaaacuguuagugaagacuggcacagucuugaguuaagcuuucuauuuugguguuuauaacccacaugaauuacaagaaagagcaucucuuuccugaugaaaugaaaccgguuguaaaguuaauaaucagcugguuccuguugggguuuuccuaagaacuuaucuugguaucuuggugcuauacaagugcuguuacuguaagcugacaaaaaaagcaaagcagaacugucugcuauguuuauuacuuuauuuuccuucacuggguacuucuuucacaaugugcuauguuuaccuuagcaaacugugguagaaagagauguggaauaaggaaaauaguuuaacucauugguggaauauuugagccaaauaacauuuuugucaucaucguugucuuuuucuuucuucucagccuaacuuuggcagaauuagaauauaauuagagcaacagcugguuacaauauucuuuaccugcuuggaauuaagauuucaucucauuguaggugucuugccauauuguagaguauuucugcuaugccacuaucacuuucuaccauuucauaaacuauuuuaguuuuguuuggguuuuauauguauagcuacugaaacagaguaaucagaaacaaauaaucaaaagaaaacaugauuuuguaagaaaagagacacauugguuuuuagcauuaguuaagauacaccuauuuuaucaguccacuccaauuaggaggaaucucaagccuaggacaaaauauaaauaacuaugcuaagagaguuaaagggugaguuaauggaaagcuagugaaaaacaaugcuauucaaagccaaagaaauuaaagaaaaaagcagauuagcauagaaggcugacuaaaccuguaaagaauuaauuucuggcuguuuguguuuaguguuuggaaaguucuugggaauuuuucuggaagcuuugguuugccuuucagcuauuucuaucuaaaugaaauuucaccucuaauuugcuagcccuuccuugagacuuuuagcaguuuuaucuggauacggaauugugugcucauuuaucucacuuaaaacaucuucauuuucuccgaagguaggaaguaagcauauuaguauuuggucugguuggaauguuugguaggaauauguuggcaguuaaauuuuaaaagaaaaaaacccagcaggcaacuguuuuauauaauuguugcaaauaucuuuuuuauuucagcauuuccuaagaggugaauaugugcaauaguaaaugcuuuguggucuuacuugacagcugcuuuugauucuuguugcuucauauuaugauggugugguccuuaauauuuuuuguuuuaauucuaaaguuuuaggggccuuguguauguaguaugucaacaaguuauccugaacagccuuguaaaguaaaugcuagacauuuagugucuccauauuuaccauuaaaauaaaaauuauugccaauauuaugaaaaaggaacccagguuuucuacacccuaagcaguaauuacuggcuuuaauuuucauggcauuuguacauacaugauuuacaaucacaauauaacauuucuucuuucacuuuguugguauacuauauguaacuuagcuauuccuuucuugcuuagguauuuuuaaugacuuucauuuuuuaccauucuaugauacuguaaugaaaauauucauacauaaucccaagaguaggauuauuguguuacagaguauauaauuuuaugguccuagaaaugaauuuucagacuguuuuuaggcaguuuauacuaccaccaguaauguauuaaaguauucauuucacaacaucuuuaaaaaguugggauguauuauuuuaacuaaauuaauucaaaaugaguaguuuccuuagaaagcuaaaaauuugagagaaauaugggaaguuaaaucugucaguaauuuuccucuuuauccauuugaguuuucuucccaucucucacaguugauuguucugucaccuuccagugcugcuuugagagcugccuuggggucccuagcuugauaauuccaccacuggaugaaaaugaauuugcacuuccuuggugucuuggucuuucaguuuggaagaaugacuauagcuggaggcacaucauuuauccuacuucaaaauguuucuuagacaaugucugaauauuaaagguuauuaaaagagaaauaagcuauuuauaauuuaguaugggagacaguucuucuaguauucagcuucagaggcaaaauaugguauuaaauaauguguuuuaugacuaucuguauugauccuguucaguauuuuauuuuucugaauuauuguuauacguaccuucuuuaauguaguuuuuagcuggugaaauuggaauuuuacaaugguccuauccaaauaaguaaaaguaaggccuuugaauagaauguaccuuuaguucgaguacauguauaaucuuuucauguuuaaauggucuuacucuuucauguaacauuaucacuuuaccuccuuaauuuguauagcuuagauaugaucuuugaaccacuaaacuaagugagaaaggcaaaaaugaaguggagagaccagacugguggaggaaaggguucaggauuucauuuuuguacagcuuuacagugaaguuucuaccaacccagccagagagcauguuccuguagucaggaagcauccagccugcuucgaaaggcaugugaggcauacaggagacaauuuccccuuccccuuugacuguccaaaagcuggagucuucucuuuuugguuugacuuuucauggaauaaaauccaaugaaauuaaacuacuuaaaagugagagaaaaucagugguaggguguuuuuucacuuguuuuuguuguuguuuugguuuguuuucuguuuuaaaauaauccuggagcguaucacucugcuuugggacauggaugguuuuggaauagccuagcuccacucuuuuuggcaucugacuucauguugugaucagcucugacuuugagaaaguaaggcugagcuuuuagauguaguagugcauagcaccgguaacucagaauguugcacagaagagccuucaggauuuaguucuuuuuuuuuuuuuuuuugauacggaaucuugcuauccccgaggcuggagugcaguggcaugaucucagcuuucugcaaccucugccucccggguucaagugauucuccugccucagccucccgaguaauugggauuacagguacccgccaccacaccugguuaauuuuuuauauuuuugguagaagcgggguuucaccauguuggcuaggcuggucuugaacuccuaacuucaagugaucugcuugccucagccucccaaugugcuggcguuacugcaccuggaaaggauuuaauuuuuuuuuuuuuuuuuuuuuuuuuugagacagaguuuugcucuuguugcccaggcuggagugcaauggcacgaucuaggcucacugcaucuuccgccucccggguucaagcgauucuccugccucagccuccugaguagcugagauuacaggcaugugccgccacaccuggcuaauuuuguauuuuuaguagagacgggguuucaccauguuggccaggcugaucucgaacuccugaccucaggugaucugcccgccucagccucucaaagugcugggauuacaggcgugagccacggcgcccggccaguuuuuuuuuuuuuuuuuuauagcaaccucugccuccuggguucaagcgauucuccugccucagccucccgaguagcugggauuacaggugcccgccaucacgccuggcuaauuuuuauauuuuuaguagagaugggguuucaccauguuggccagguuggucucgaacgccugaccucaggugauccgccugccucggcuucccaaagugcugagauuacaggcaugagccaccgcgccuggccaggauuuaguucuugaaaagcaggaaugguaauagucaugaguuuguaggcuagguauucacuaaagauaaauaauggagacuaaagauuggacaggacagauuuccaugugaugccacugugcaagaaaaggcauagauuagucaguaaugcuugccuuuuucuuuggucuauuuccguagcaaaaaagaaauuccuguguuuaacuuuaccauccaugagauccacugucaaaggaacauugguauguguccuaccuguaaggaaccauuucccaaaucugacauggagacucacauggcugcagaacacugucaggugagccaccaaguacucaaauguuuauacauguguuauacuugcuguuguucguaaauguauucuguuugcuauugugcaauagcaaaugagcauauugucccaaagccaauuuacugauucucacuucuuacucuaggugaccugcaaauguaacaagaaguuggagaagaggcuguuaaagaagcaugagguuaguccauggagugaguuaccgugggcccaguccugcugagauuacagacccacaugcagagcaggaagccagucugguugaguguuaguucuccgugagcucacaugcauacuguuucucaaagccuguuugaggccuugacuauguaacugcugccagauucggcuaccuggcuguuggaacucacuuguguauguugagacucgcgaaguaucucccuuuggaacugagucuauuauuucuguugggguuugguuauuggcagccucacugaauaugaagccagcccuagaguugccaguaugggauaaccucuuuagcacacagccugccuuacaagcugucauuucauuuaaaauucuuuuuuguuuguuuguuuuuugagacggagucuuguucuguugcccaggcuggagugcaguggugugaucucggcuuacugcaaccucugccucccagguucaagcaauucuccugccucggccuccugaguagcugggauuauaggcgcccaccaccacucccagcuaauuauuaguagagacgggauuucaccauguuggccugaccuugugaucugccugucuucagccucccaaagugcugggauuacaggcgugagccaccacaucuggcuucauuuuaaaaucuugaacaccuggauaacaugcuauuuaaccuaagaaauuccucagcauuuggugagagagaauagaguaucauuugcucgcuaguugagauaaaacuggccaaagguuuuuuuuuuuuuuuuuuuaaauacagacagggucggcugggcaugguggcucaugccuguaaucccagcacuuugagaggcagaggugggcagaucacuugaggucagaguuugagaccagccuggccaacauggugaaacccugucucuguuaaaaauacaacaauuagcugggcguggaggugugugcuacuugggaggcugaggcacgagaaucgcuugaauccggaaggcagagguugcagugagccgagaucgcgccacugcacuccagccuggaugacagggugagacuacaucucaaaaaaaaaaaacccaaaaaauagagacagguguugucucuauugcuguguugcacagguuggucuugaacuccugggcucaagugguccuccugccucagccucccaaagugcuaggauuacaggcaugagccacuguacucagcccaaaguuuuuuuuuuuuuuuugagauggaaucuuguucccgucuugcaggcuggagugcgguggugcagucuuggcucacuguaaccuccaccucccagguucaagcgauucuccuuccucagccuccugaguagcugggguuauaggcgugcucuaccaugccuggcuaauuuuuuuuguauuuuuaguagagacaggauuuugccauguuggccagggugaucuugaacuccugaccucaggugauccacccaccuuggccccucaaggugcuaggauuaaaggcgugagccaccaugcccggucauuuuucuuuuuuuuaauuaaaaaccuuuuuuaagagacacagucucacucugucacccaggcuagcaugcaauggcaugaucauaacucacugcagccucgaauucuugggcucaaaugaucuaccugcauaggugguacuacagguauaggccucuaugccugacuaauuuuauuuauuuuuguuuuucauagaguuggggucuuguuauguugcccaggcuagucucgaacucuuggccucaagugauccucccuucuuggcuuucccaaaugucgagauuacaggcgugagcuauggcaucuggccaaaacuggccaacguugaaugaguauguuaauucaccaauuuaaaaauccagccgggcgugauggcugaugccuguaaucccagcacuuugggaggcugagguggguggaucacagggucaggaguucgagaccagccuggccaauauggugaaaccccgucucuacuaaaaauacaaaaauuagcugggcguggauacgcacgucugaaaucccagcuacucagaaggcugaggcaggagaauugcuugaaccugggagguggagguugcagugagccgagaucgugccauugcacuccagccugggugacagggugagacuccaucuaaaacaaacaaaaaaaaacuggcucaccuuguuuucaaguguugacauaaacagucaaaagcaccacucagucuuuuauaaugcaagugaaaucagugcugugccccuucaaggaaccacgugacaguuuguucaguugagcacaaguuccuugcaggaacaguugcuggcagaagggcugugucuacagcccauguggaaccaaggacaguuuucccauucaguagggagcaucccucagccuugaucuucauuucuuggcugggcgcaguggcucacgccuguaaucccagcacuuugggaggcugaggcgggcggaucacgaggucagaagauugagaccauccuggcuaauacggugaaaccccgucucuacuaaaaauacauaaaauuagcugggcgugguggcgggcgccuauagucccagcuacuugggaggcugaggcaggagaauggcgugaacccgggaggcggagcuugcaguaagccgagguugcgcuacugcacuucagucagggcgacagagcgagacuccgucuaaaaaaauaaauaaauaaaaauaaauaaauaaaaauccaaacagcuguuuauaugguaguuauagaagaguggauauacauauguaaaaauucaccaagguauauacuuaaagauuugugcauuucauucugugugccucaaacuguaacaacuugauuuuauuaauuuauaauuaaauuacccuuaaagguaauucacagcgggcuacagugacucaugccuguauccuagcacuuugggaggccaaggcgagagcauugcuuaaaccaaagaguucaagaccagucuaggcaauaucgugagaccccuaucucuacaaaaaacuaaaaaauuagcugggaauggugguccguuccuguagucccaauugcucgaggggcugagguacgauauuguuugagccuggagguugaggcugcagugagcccuguuugugccacugcauuccagccuaggcgacaaaguaagacccuguuucaaaaaaauaaaaauaaaaauaaaaagguaggccaggcgcaaugacucagccuguaaucccagcacuuuuggaggcagaggagggcgggucacuugaggucagaaguucaagaccagccuggucaacauggugaaaccccaucucuacuaaaaauacagaaauuagccaggcauggugccgcaugccuguaauuccagcuacucgggaggcugaggcaggauaauugcuugaaccugugaggcagagguugcagugagccaagaucacaccacugcacuccagccugggcaacagagugagacugucucaaaaaaaaacaaaaacaaaaacaaaaaaugcugggcgugguggcucacgccuguaaucccagcacuucgggaggcugaggcaggcagaucacaugaggucaagaguucaagaccagacuggccaaaguggugaaaccccaucucuacuaaaaauacaaaaauuagccagguguggugguaggcuccuguaaucccagcuacuugggaggcugaggcaggagaauugcuugaacccaggaggcagagguugcacugagucgaaaucaugccauuguacuccagccugggcaacagaagcgaacuccgucucaaaaaaaaaaaaaaaaaaauuaaacuaaaguucuauucuaaaugcuacuccaacauuuucagcacuguuuguauauacaugaacuaccucuugcaggaaacacaauaaauugauaaaaaggccuuagguagcagaggaacaggggagaagagacaugauuuuuacauauauccuuuuugggcuuuaaaauuguauaccagcugugcacaguggcucacgccuguaaucccagcacuuuggaaggccaagguaggaggacugcuugagccuaggaguuuugagaucaaccugggcaacauaaggagacccuugucucuacaaaauaaaaaauaaaacaaaaaaccuagcuaggcaugauggcauauaccuguggucccagcuacuugggaggcugaggugggaggauugcuugagcccaggaggucaaggcugcgguaagccaugaucguaccacugcacuccagccugggugacacugagauccugucucaaaaaaaagaaaagaaaaauuaaaauuaaaaaauaaaauuugauaccauguagauauaaugccaauucagaaaguuuuuuuucaaaagcuuuuuuuuuuuguuuuccacucugucaccuaggcuggagugcagugguguuaucccagcucacugcaaccuccaccucccggguucaagcaauucuccugccucagccucccgaguagcugggaguacaggugaaugccaccacacccugcuaauuuuuguauuuuugguagagugggguuucaccauguuggucaggcuggucuugaacuccuaacuucaggugaucugccugccuuggccucccaaagugcugggauuacaggcgugggccauugcccaggucccaaaguucuuuuauuagauaaauaacacggauuugcuaggaguaguggcucauaccauuugaggaugggaguuugagaccaacuuggcuaacguggugaaaccccuucggugcuaaaaauacaaaaaaauuagcugggugugguggcacgcaccuguggucccaagcaacucaggaagcugaggcacaaggauugcuugaacccgagaggugaagguuguagugagcugagauugcaccaugcacuccaugcacaccacucugucgcugggcgacagcaagacuuucucaaaaaauaauaauaauaaaugaaaaauaaagccugugcuaaauacaaauaugaagguuagagaaaccugugucuuucuaaagugcaguuucuuuuccucauuauuagguacuuaagacugaauuggaggccgggcgugguggcucaagccuguaaucccagcacuuugggaggcugaggcgggcggaucacaaggucagaaguucaagaccagccuggccaacauagugaaaccccgucucuacuaaaaauacaaaaaauuaagugggugugguggugugugccugaaaucccagcuacucaggaggcugaggcaggagaaucgugugaaccugggaggcagaggucgcaaugagccaagauugcgccauugcacuccagccugggcgacagugcgagacacugucucaaaaaaaaaaaaaaaaaaagacugaauuggaauaguugguaggggacagggacauuggagcuuugacaaacaucugacuugcuaugauucuuguuauuugcuccugggcuucucuggcugguuuuagauuacuaaguaaugugugcacaaaacaauaugauaguuaggguggcugaguagugggcucccucuaauauuuuauuuuccuuuauagaacauuguggcaggaacaaaaggggaagcugugacucuuaaauaauuaaauacauuaaaaaaggguaggagaaucaaggguuggaagagaagauugcaguagauacucuuggcuuuccuugcccuauacuaaaacacaccucuccuagauaugcauauuaacugccucauuccucuguuuuguaggagacugagugcccuuugcggcuugcugucugccagcacugugauuuagaacuuuccauucucaaacugaaggaacaugaagauuauuguggugcccggacggaacuauguggcaacuguggucgcaauguccuugugaaagaucugaagacucacccugaaguuugugggagagagggggaggaaaagagaaaugagguugccauaccuccuaaugcauaugaugaaucuuggggucaggauggaaucuggauugcaucccaacuccucagacaaauugaggcucuggacccacccaugaggcugccgcgaaggccccugagagccuuugaaucagauguuuuccacaauagaacuaccaaccaaaggaacauuacagcccagguuucaauucagaauaaucugugugaguugugcuugggauuagggaacuagaaugguaucaaaaucccaaggcaaaugggaacagggcuuuggggccagauagaucuugauuauagaaacccgacuguagcugaguaacacugggaagaauaccucucuuuccuauaaaauggaaauaaccuccauuggauuauaguuaggguucauaauggugaguaugaugacaguguuguaaauagccaacacuuauacagauugaguaucccuuauccaaaauacuuggggccagaagugguuuggcuuuugaaguauuugcauuauauauacuggaugagcaucucaaaucugagaaucugaaauccaaaauguuccagugagcauuuucuuugagagccauauugaugcccaaaaaguuucaaauuuuggauuuuuggauugguaugcucaaccuguaucuuauuucccuuaggcauuugcaaagugcuuuauacguauuaacucauuuaauucucucauuauuugaagguagguaaauuugaagguagaacugagauuugaauucagauaaucugaccucgugcuuuaaaccauucuacuguaauucagaaaauaaguauaaaauguuuagcacagugccugucucauaauuauggcucaguaauauugcuuaauaauacaguuagaauaauaauggagccuuuucacagggcagacuuuaauguucaaagcuaggagacccagagggugaagagagcuaguugaacauggucauuuuuauuccuucccggaugccuguaaaccuugacuauuugcuaggcauggacuugaguugagggugguaacauuucuaauguauccugaauguugguugguuuuuuuuuuucaguugaagaacaagagaggcaggaaaggaauagaggccaacagccccccaaagaggguggugaagagagugcaaacuuggacuucauguuggcccuaagucugcaaaaugaaggccaagccuccaguguggcagagcaggacuucuggagggccguaugugaggccgaccagucucauggcggucccaggucucucagugacauaaaggguaggcuugcuuauucugcacuagccucuuucucuacaguuuuuguaagucuuagguuauacaauucuuauacaauugaaagauuuuaaugaaauagaauuugccuuacucuuuuuuguuucuuuuuucuuuucuuuuuugggacagucucgcccugucacccaggcuggagugcaauguaaugaucucggcucacugcaaccucugccuucuggguucaagugauucucgugccucugccucccaaguagcugggauuacaggugaaugcuugaacccaggaggcagagguugcagucagcugagauugugccacugcacuccagccuggugacagagugacaccuugucucaaaaaaaaaaggcucuaaaggacauuauuguacaaguagagaacuuacauuaaaguugcugagagugacauccguauuguuuacauaggagaaagcagugcccuuguucuucaaaggcacaugaugaaguacuuaggaauaaaauguuauguguucaaacuuauucucaaauaguucaggggaaaaauacauaaaaguaaugugaggaaauauuaagcuuugugaauauagaugaggaguauauggguauuugcuauacuauucugaacauuuuuuuuuuuuuuuggagauggaguuuugcucuuguugcccagguuggagugcaauggcacgaucucggcucacugcaaccucugccuccugggcucaagugauucuccugccucaaccuccugaguagcugggauuacaggcaugugccaucacgccuggcuaauuuuuuuuuuuuugagacagagucuuccucuguugcccaggcuggagugcaguggcacgaucucggcucacugcaaccuccgccucccggguucacgccauucaccugccucagucucccgaguagcugggacuacaggcgcccaccacuacacccggccaauuuuuuguauuuuuaguaaagacgggguuucacuguauuagccaggauugucucgaucuccugaccucgugauccgccugccucggccucccaaagugcugggauuacaggcgugagcuacugcgcccagccaugcccggcuaauuuuuuguauuauuaguagagacgggguuucgccauguuggccaggcuggucucaaacucuugaugucaggugauccaccugccucagccucccaaagugcugggauuauaggugugagccacugcgcccagccauucuggguaauuucuuaucggucuucuaguucacugauuuuucuccguaguuauuucuaaucuguuguuuaaugugucccuuaagauuuucacuuagugauuauauauuucauuuugaguucuguuugauccuuuuccucauuguaccuccuaauuuuuaaaauaaucuuuuguuccauagucauauuacaguucccgcuuugguuuuuuuuuuuuuuuuuuuuugaggcaggaucuugcucugucaccgaggcuggagugcaguggugugaucgcggcucacugcagccuccgcccccaggccucaagugauccucccacuucagucuccgauguagcugggaccacaggcaugcaccacuaccuuuuuuuuuguauuuuuaguagagaugguuccuuaccauguugcccaggcuagucucgaacuccugaacucaagcaaucugccccaccucggccucccaaaggauugggauuacaggcauuagccacugcgcccagcauaguucccucuuuaacaugucuuuaaacauguuaaauauacuuauuuuucuuuuguguccaaaaauagcaaaaacuguuucuuugcuauguuguuucugcgucuccuguucauggaggcuugcuacgugugugugugaacaccaaguuuucuagcauguuccucugagaauuuauaaaugcuucuggcaggcacauagagauacuaccauuagggguaacuuuaagcuuuuggccuggacuuuuuuuuuuuuuuuucuugagacagagucucccucuguugcccaggcuggagugccauggcgcgaucuuggcucauugcaaccuccgccucugggguucaagugauuucuccugccucagccuccaggguagcugggauuacaggcuuguaccaccaugcccgccuaauuuuuguauuuuuaguagagacaggguuuuaccgugucgcucagguuggucuggaacuccugaccucagguaauccacccaccuuggccucccaaagugcugggauuauaggugugagacaccaugcccggcuggcuuggacuuuuaaaaagcauaaacguagcugagcaucaugucucauuccuguaaucccaacacuuugggaggcugagacgggagguucauuugagccaaggaguucaagaccauccugggcaacagagucagacuucauuucuacacaauauaaacaaaaacuagcuaggcaugguggcacacaccuguagucucagcuacuggguaggcugaggugggaggaucucuugagccugggagaucaaggcugcagugaaccaagauugcacaacugcacuccaaucuaggcaacagaaaaaaaaucacaaaugcgaauuuauguaaaaauagaaacauaaaaaacagaagcacagacugugaccccaaaccuauguaaggggccaagcucuaguuacucuacuugguagagacuuuucuuuuacccagaacuaaaaucuagauggguagaaggguaaauuucccuacaucccgccauuguucacccucccauuuguuuagcaguuuuccugaggauguugugucugggaaucuuggguuuaaaauguaucgauuuguucacuucaguuacuuuuaggcagcauuuuuugguacugggaggaguauucaggauauuguuugccaguuuauccguaaaauaaggauaauguaggaucuacuucguaaguuuuuucugaggauugaaauaguguguggaaaacacuuaagauuauugccuaugguuauuacacauuuaaaucgcuuccuuagaguagugaguagcagguaaacuacugcuauacugcuacucaggaaauuggggucaaguacauuucuuguuuugucauggaaguuuuggccuagaguuuaucucuuggauggguucccucugagaauauacagccccacaaauugcuaucuauaagaaacauuaaagaaagccaaacuucuauauaagaccccauaaagaggauaaaaaguuaaauucaaguuuguuuuuguucauccugagucucauuguguggccuaauaccuaggugcagcugacgagaucauguugccuugugaauuuugugaggagcucuacccagaggaacugcugauugaccaucagguguguuaugaauuacuugaggacuuuuaguaggauuguaugcaggccauaauugguguugcaggccacaugaggccuugaacaaaucauuuuaauacaaugcccauaguaggaauagcaaguguucuuuuccaugaugugaguggcauacagauaugaaaacuuagccuuguuccuucuuagaaaaagugauggcauccuuuguagggacauggaugaaauuggaaaucaucauucucaguaaacuaucgcaaggacaaaaaaccaaacaccacauguucucacucauagauggcaacugaacaaugagaacacauggacacaggaaggggaacaucacacucuggggacuguugugggguugggggaggggggagggauagcauuaggagauauaccuaaugcuaaaugacgaguuaaugggugcagcacaccagcauggcacauguauacauauguaacuaaccugcacauugugcacauguacccuaaaacuuaaaguauaauaauaauaaaaaaaagaagaagaagaagaaaaaaaaaaacaauagugaaauaacagcaaaaaaaaaaaaaaaaaaaaagugauggcagugauguaugccuguagucccagcuacucaggaggcugaggugggaggauugcuugagcccaugaguuuaaggccagccugggcaacauagugagaccccagcucuaccaaaaaaaaaggggggggcagggaaugaugcucauuucagcagaccuggaaaucucaugcuagcagcccuuucaugugguagugacuggugcacauauaucuccacuauccguuuugugaucuggucucaucucaugccacauuuugauuuauuggagcuguauugaaguccuugcauuuuucuagaaaggucaaggguguuuucugcacauuacuuuaucuaccugaaaggugucuggccuucugccccugucuccuuaacacauccaacaacacagaccccuuacuuguagaguugguucagaugugacuuuauggaagccauccugauagguacuaugaaggcuaggucaggaaccacaccugugugcuucuaaaagucugugcccaccucucuuauaguuugucacuuuaugauguggucuucugaucuccuguuggucugcaccacuaggcugauuucccugagggcagguucuggguuuucccaguuucggaaucucuaaauacuugguaucugaaaaggugucaguuauuugaaugauugacuauucuugagccauuuaggaaugaugagcaaauagcuuuauguguuugaggauuaccugauggagggaacuucuguuuuuuuuuuuuuuuuuuuuuuuuuuuuuugagauggagucucacucugucgccuaggcuggagcgcagugacgcgaucggggcucacugcaaccucugccuccgggguuccggcuguucuccugccuuagccuccaggguagcugggacuacaggcacacaccaccaugccuggcuaauuuuguauuuuucguagagacaggguuucaccauguuggcuaggcuggucucaaacuccuaaccucgugaccugcccacuucagccucccaaagugcugagauuacaggcgugagccuccacgucuggccaggagggaacuucuuguucccucaauacucugauuugguuuggccuagucuggcauuuccacaacuaccaaauagugccugugcucuggaugguggaacauacuuucccccauaaaugaaauaauauauuauuugaauacauguaguuuuuguuuugggaguaccauagaaaauccauuaacaaagauaauaaagaauauuugugccucucuuuuacuguauggauguggugggaagaaccuugaaucuuuucaaauuaauuuaaaaagaaugaacacacuuaaaaaaaaccauaaaaauauuuaaaaguaaaaugaguguucuauguguauuccucuuuuuuguuccucuuuccaauauuaagcauuuaaaaaaauuuuuuuuuuuuuuuuugagacggagucucgcucugugacccaggcuggagugcaguggugcgaucucggcucacugcaaccucugccucucagguucaagcaauucucugccucagccucccagguagcugggauuauagccaagugccaccacgcccggcuaauuuuuguauuuuuaguagagaugggguuucacugucuuggccaggcuggucuugaacugcugaccucgugauccaccugccucggccucccaaagugcugggauuacaggcgugagccaccgcgcccggccaagcauuguuaaaauuauaugacuucuucuagaaaauauuuuaggaauguaguuuuuuucuuaaccucugauucuuguuuuuaaccuauauuuuuugaaugacagacaagcuguaacccuucacgugccuuaccuucacucaauacuggcagcucuucccccagagggguggaggaaccugaugucaucuuccagaacuucuugcaacaggcugcaaguaaccaguuagacucuuugaugggccugagcaauucacacccuguggaggagagcaucauuaucccaugugaauucugugggguacagcuggaagaggaggugcuguuccaucaccagguaagggucccuggagucccuguccauguggcucugugcgugaaccugaggcuuccagagcugagaacacuuccuuagccuuuaaguugcauuccauccugacaaggaaugcacacacuuggcuucuggccaagucaucuuugugagcugucugugguaaccaauaccgcaggcuuucagacuuucccucccuuugggcaacugaagccaucuuguuacuagcugaggaccaaagagccaggacucuauuugagcagguguggaaggaagccuugucagagaguuuagaugacagucucccugcuuuucaccagguggguuuuucccauugugguggcauuugagacuugcauucuaggagaccugagggucuacuucugguuuuguccuguggaugacccuuacuggggccaucugugagggaguuggacuagacaauaugaagucauuuuucagcauuuacaguauaggauuccaaucuauuaguggaaaauauguuuucugcccaaucguauauguuacagggagugagagucaacacugcagcuaccauuucuguaguugaugccauguagcuguuacuagaacauuguacauuucauuucuguaauaaagacuccugcuuuucagaggccaggcaugguggcuuaugccugugaucccagcacuuugggaggcugaggcgggcagaucacuugaggucaaaaguuugagacuagccuggccaacauggugaaaccccaucucuaccaaaaauacaaaaauuagcuggaugugguggcgggcaccuguaaucccagcuacucgggaggcugaggcaugagaaucacuugaaccugggaggcagagguugcagugagccgagaucacaccacugcacuccagccugggugacagagcgagacucugucucaaaaaaaaaagagaaagaaagaaaaaaaaagacuuuugcuuugggaucaaacaguagauaagugacugcuuacccucuagggcagacugaaauaagcaacgacacaaauaaauacucuggugagaguauagaaaugcuuuucagcugcucugaagguagugaguuaucucaguugauuguucacagucaguuacagauugaacuccuuguucuacucuuuuccccguucucacuauugcacuugaauagucuuaaaaaacagaaaaaaaaaagaaauaaauguuuuucugggcuccaagaucagcccuucccgcaucccugcacaaaucagaaaguguuucugucagugccucaugugccgaugggauugaaugcaaccauuccagaugugugguuucugaaaguucccagaacuuucagagguugucaaagucccccuccagaugaggaauacacugcuguuccucccaucgcaugcucuuuucugggaaugacucaauucagagguacuaauucugguuuuucuuguuuaggaccagugugaccaacgcccagccacugcaaccaaccaugugacagaggggauuccuagacuggauucccagccucaagagaccucaccagagcugcccaggaggcgugucagacaccaggguauuuauuagccaggacucagccaaggccgcaggucuacugcuggcuccggccuguuuaccacuucccauccacugcucuaauguggggauuaccugcaucucaaauuuccaaacacacuagggucucauaggggacuccucugcagguaguuguggucccacauuagacugagcucucucaagugugugauuuuuaggguaauggcuuugcggacauccaugagauacauguaguaguaagugcuuguaauaaguuucugguuuccuaucugugcacuuaguggauuauuuguagauaauuugcagaccuuaugguagcuacccugggcccccauuucaaguugaaauacacuuaggguacucaaaccuauuauuauuauuuaauuuuuuuguagagacagagucuugcucugucacccaggcuggaguacaguggcacaaucauagcuuaccacagccucaaacuccugggcucaagugauccucucuccucagccucccaaguagcuggaacuacaggcacacucuacuacacccaacuaauuuuuuuguuuuuguagagauagggucuugcuauguugcccagggugauuucgaacucuuggccucaaguaguccuccugccuuggacucccaaagcauugggguuacaugcguaggccacugugaccgaccucaaacuuauuuauuuaauuuauuuuuuuuagacagggucucuuugucauccaggcuggagugcaguggcgugaucacugcagucucaaccucuugagcucaagugauucucccacucuuagccuccugaguagcugggacuauagguaggcuaggugcccaccaacacacccagcuaauuuuuaauuuuuuuuuguagaguugggguuucgccacauuguccaggcugaucuugaacuccugggcucaaguguuccucccagcucggccucccaaaguguugggauuacaggugugagccaucacacccagccucaaacuuauuauuauuacuuaagaccaucauguuuaggcaaguaaacuguuuuugaaaccucaccacuacaaagccaauuagaaauuauuuuuuggcugggcauggugacucacaccuguaaucccagcacuuugggaggcugaggugggcggaucacaagguugggaguucaagaccagccuggcugacaucaugaaaccccgucucuacuaaaaauacaaaaauuagccgggcgugguggcgggcgccaguagucccagcuacuugggaggcugaggcaggagaaucacuugaauccaggaggcagaggcugcagugagccaaaaucaugccauugcacuccagucugggcgacagagcaagacuccaucucaaaaaaaaaauuauuuuucaagguuugcuugcacacuauuguugaauaguuaggaggcugucuuugaggacucagauaauaugugcagaauugauaaaauauccccaucucugcccuggagauguggguuccagcagccuuuuggggugagcaguugucuuuuuuuuuuuugagacacagucuugcucugucuuguccaggcuggagugcaguggcaugaucuuggcucacugcagucuucaccuccuggguuuaagugauucuccuggucucagccuccugaguagcugagacuauagcugugugccaccucaccuggcuaauuuuguauuuuuuuuuuaguagagauggaauuucaccauguuggccaggcuggucucuaacucuugaccucaggugauccccgcaccucggccucccaaagugcuggguuuacaggcaugagccaccacgccuggcugagcaguugucuucuaucuggaaucuuuuuguuccugcccuaaaccuggcacuauagccagagcaggcuuuuuccuaaagcuguuaccauuuucucuucucaggagaccugucuucugguuaccuggaugauacuaagcaggaaacagcuaaugggcccaccuccugucugccucccagccgacccauuaacaauaugacagcuaccuauaaccagcuaucgagaucaacaucaggccccagaccugggugccagcccagcucuccuugugugccgaagcucagcaacucagacagccaggacauccaggggcggaaucgagacagccagaauggggccauagccccugggcacguuucagugauucgcccuccucaaaaucucuacccagaaaacauugugcccucuuucuccccugggccuucagggagauacggagcuagguaagaaucaguagcccaggaauggggcuugggaguagcugaagcgaacaugggcaaaggccugguuacccuugccaggccugggguaagacugagguacuugcaugguaaggggaggaguauggauuuucccuguauugucaccugacuccaaaaaaauuauuuuguggccuauggguuuuuugggguuugucugcuagcauaggacugcuuccuguucccucugaguuuguugaccuuugcucagggacacuucaggagcuaguuucuaauuguuuucuuucagugguaggagugaagguggcaggaauucccgggucaccccugcagcugccaacuaccgcagcagaacugcaaagguaaggugggcuccagcccaugaugcucagugggggacucagacaugguggggcuuguguggcuccugaaguuguagaaguuguugggaccaggcugguugugguucaaagauuguuccuuuggcuuuugagaaggagguuucuaaggaagcgggacauuuucggggauccaggggaggaguaaugcuuuuucacuuuuuauguaaagcuucguuuguguuguguuguucaccaggcaaagccuuccaagcaacagggagcuggggaugcagaagaggaagaggaggaguaauggugucuccagagacuuuacaucgguuccugucuucugugcacagcagcacuugccgcugugcaggcccaccucuuuggcucuuugggugggagaguuuuuccagauuuuagauuuuucuagguuauggccauuuugugucuuuugagguugugcuguggggguuuggguuugagggaagggagcaggguggcgguugaggaacgcuucagccuuagcugcuaccuuucggcagcagugaaauacaagcugcagccucggcugccagggcucccuuuugacuuauugucgccacugccccuuggugcuguguggucccaguggaaggaggggaagauuuuggaaaccugguagccaccaguaaggugauucucugcccuguuggggccuaaauuugggggcuuuugggcaaccucuccguguacugcgucuguccacacucgauugggccccagguguguaugaggcgcucugguaaggugcucaggccaguugcaaugucugucaguaacgaggcuuuugauguguugagcuggaggugaguggaccgggggcuguguuuuaagcugcuuccuuggcauuuggcaucacugccuucuguucccgggggagcauggaucuuuuguccucacugcuuucuaauggggagggcugagggcucccuguccccacagcagguauguugggcucugccccagccccacacuugcucugaaaaccaagugucagagccccuuccccuuguuuuuauuuuacuguuauaauaauuauuaacuuccuuguaauagaaauaaaguuuguacuuggaguuca

SEQ ID NO: 191517 - RNA, 316531 nt, Homo sapiens
ggccggagggcgcccgaggggccccgggccgcggcgcucagggcccgggcggccggcggcggccccggggcuggggggaguccagcccggauauugagugcagccauugagaaaagccaaacucuugugugugcgcgucucgauagcccccaagauggccgccaaugugggaucgauguuucaauauuggaagcgauuugaucuacggcgacuccagguuagugcgggcagcgccggccgcgcggccgugaggagcccccgggcgcgcccugggcgcauuggggagguccccgggcgggcaggcggacgcccuggggcggcgggcggcggcugccggggcucgccggggcucggccgcccgcugcccaucgauagguauuaggaauugaucucgccgcugcucuuuguucgguucagucaucgauuagcugccgcgaccauggagaagcgcuagugagcccucggucggcggagcggccgagcggccaggcggccgggcgaggagcggggaaggcaggggcuacggccucgggcagggggcugcuggcgggaacccccggcgguccccccugagccgcacuuugcgcgccucccaacuucgcggcgcccggggaggccgcggagcgcgccgcuugccaguccgcacccggcuggggcuccggcgagggagggagggagcuggcgggcagggaggaggaggaggagaggaggaggaggaggagagaggaggagggagccgggguuggcgaggaggcggcuccgcgccccgccgcucgccggcaccucagccuucgccgcccgccuggcugcgcagcccggacgcgccgccacccgggggccgccgccgccgccgccagagccgccgccgccggacuggccgcaagcgccggcagaccucuucuccucgggccggggucuugggguucgucuugcuucuugccuuuacccccccgccccuuccauccccuucccaagucuagaugcagacgggcgguggaggugggcccgggcgcucgcaaguuugcgcuccugccuccagggcgguggagagccgggagcggcgcagagcaggugacucccagcccucgggcccaagggaacuuuuaaaugagagauuuccuugcuuguucugccuccugcguuucuccccgcugcuccccucgucuccucucucccgucucugcuuuucuucuguuucuuuccucucuucccugcucuuucucucuccuucccuagggcgacucuucgaaaccccaucacuuucuccccauccucccuuugugggagucugugugccuccccuagauuuggagguguucucugcggaccccguaggagccggggcugggagguggaaucucagagaacgcaccguggaggcgcggcuccggccucuguucuuucccggagugccccggacgcgccuggcaaggccccccagccuuggagucucgcaaagucucggcgggugcggcggggaucaggggcgggaaaauggugcggauaacagggcgguuagagcauccugccuugaccgugacauucgcggaagacgcgagaucaucagucuggagauaaaaagggacccacuuuuuuuuuuuuuuuuaauccgccggcaaaucucguuaaguuucuucugauaagugguuccagcacccgcgccuucuccccguccuggccgcuucccaguccccguccuuccgaacgccccacuccucgcucucccccucccccaaagccauugagcuggggagaaaaucggggcacugaggcaugcaguuaauaacugccgagugccuugcaauuccggguccgcacucgaguuggggcuacaguuugguggccaacugagacgggcagggcugcgagcugugccugccggcuuaaaugaugcuaaaguggccuuucuggaagaguggggguuauggaggcagagagagagagagagagggagaauugggcagccacauugggcuuggcacgaaggccaaugguaaucguauucccugcuaauguuuguaaaugagacccgggcacggcugggggacagcgucuuuauuuaugauugauguucuguaacauaaggaaugacaagaacguggcacacaagaggagaggaaccagaagggcuggcgaaagcccuuugcaggguccuauuguuauucugggcuggagaaaauuuccgcggcgagauuuacagcgcugguauuugcucccggucggccggaaugucaguuaacacaauuuucauuagauaacucguuuucaauccggggagcucgggcugcagcccggggagaggcaggggcugggugcugaggggagggugcggcucccagggggcuaaugucugaacuagggagguuggaaccucacugucuucagucuucuacccaaggggucuuuuguggaacgguugaggucacccaaaucuugauuccagcuggacgcccauuaaucugggaacccuuuguuaggguuuuagaagaugcauagauggaaagcaaauuugaacuggaaaggauaaagguagggggugguggagggguuuguucaggugauggggagauaggacccagaccucccagccuacaggguguauaugugaagggggggguuguucguuaaaacaauggcuagugugucuggcacacaggagaaggcucucagggaagggggguaaacucauuuacaucgauauuaaguggagggggugucccugugggaguuugcaaggcagcacacuucuagaaagcaaagaaauaaacguggcagccguggccgcgugcaaacauuuuggcccuccaucugccgcguuccccacccccagccugaaaucuucagcugguccccuggccaacaggcccgcagccccccacccccaccccaccccauauccucacugauggcauuuuuguuggaaguggauuaggagccuaagcacuuuggccugggauccucucuuguacauaaugccagugacuccuacgacacacuuuuauuuucauuuuuugccccuccccuacuuuccucuuauaggggagauagccagaaaggagaacuucugccggcuuuuucugagauccagguaggagaggcagguccccgugcccagccccaggcagccggagagccggggucccgcgucccgaggcugagcugccugugaugugaggaggugcguggcuuucauuccuggcuguucagguugaaugguuucucgcagcgugguugcugagcauuaaaguggccgaggcaacaugggcggccccguguccccaggccauaccacgucgcugacgccauaccgauccuggcaagaaaggugaccuuguaccagcccgguguccagcccuccggaaacguauauuuuucaaaaauggaagcguuccaguuauuauuccuuccagcgccgucucuguacacagcagggcuguuuuccuaggcuggaagucagucaacaaccuuaaugacuuugggccgaugguaaaggugaucugacaugugccacccuacuccggcacuccugaaacuaccuccccccgucuuugcuucuuuuuugccuuugcugcuagcagcucaggaaacgagaagaaauaaaauuccauccaaagauaaugcuaggcauauuucauuugguuauaagauugcuuuauggugaacauuacuaaugcaguauuuuuuuauggcuuuucuguguauaaucgucguaaccggauucauaccuuuaugauuuucuuuuucugcuuaacuuucuacuuuuuuuuuuuaccaugcucuggguccagucucccaugcugucuucccugacuccaaagaggguuaauugagcuaacaaugagcuggggggcacccaguccaaaugaggguccucgguccaaaugcccaucuguguuucuggggagaaaggagcuuggucaauaggauuacauaguacuaaucugggaggaaggggcaaauucugcuucgggugucagcaguugggagaaagaucaacaggaugagcaaagagaggccggacuuuuccaaggaguuuggagaaacuuccgggaacacucaaucuccuggcgcaggagagcaagauggugcuugauggaauauuuuccccugcucaaaguuuagaaaagagcagggaugugauuaaaauauuauaaccuuaugauauucugaagugcauaaauuuuacauaucagccacagagaguuuagacauccauuagagccucugacagcuugacuuaucuaaaugugcuaucauuuaacaaugugucaaaauuccucuuucuauagaugacagcaguaaauaagcuaucagcccuguuggcggaauccuaacuuuggaaacuucaccauaauagaauugcugccgagguccaauugcagccgagguggggagcgugagcccgcagagcuuggcauggcucagcccccugagagggguuggcauuaggugaagacagcucugagaauaagacaaacccuuggacucucuucuaacuccagccagugggugaccccauucccucugccucuccaaguccguagaacccacacccuguggcccuuuucugcagaaagagcuagaaacagguguugagaauuuauuuaaagaacccagcagccuuuucugggucucccaaaauuguaguuucucaacuugacagagauugcuucucaaaaacgggcucucucuuugaaugcuagaagaaaaaacaagcaacaucucaucccucacugguuuuacuguugggggucuugaaauuucuuuuauuaauacuugaauucacuguagaaaauggagaaaccacggaccagcuaaaagaagcaaauaagugucucgguggguuauuucagaugagcacggugcuauuuugaccagagggaacagcuuuucugauggugguggugguuuuucuuucuuuuacuuuuuuccuuauuuuuuuuuuuaaacucuccuguuaaaaagaggauucuaucuucgaacuugacauucugucaugguaaccuuucuuccggcagaugggauuucaaacgugagcaccuuggcuagugcuaaauauaugguccuggaugaugguagacaaggcugcccagaaacugugguuuucugugcugcuucugaaagggcugaauuuccgguggcuuccuggcuaucuaauucaaaggccgggccuggcagaggugaagcauuggaaggggacucagguggugaccugccuuuguuccuggccuugggauucagggucccaucuucuguuugauauuuuuccucugggggugcucauuauuuaugauggugucauauacuggagggugucagggaugguagagguuggcaggggggaaggaccccaagaacuguauucuguguggccuuuagugcuccugggugaaucaucccacaucccaagucuccugcuucuuaacccuugaagucagcuggcugugcccaacuuugcuguacgaguuauuguaaaggugaaggaugcugacaccuuugugggucacuuaaaugcauugucuucuucuuuuuuguuuuuucaagauggagucucgcucugccacccaggcuggagugcaguggugcaaucucagcucacugcaaccuccgccucccggguucacgugauucccaaguaguuggaacuauaggcgcaugccaccacgccuggcuaauuuuuguauuuuuaguagagacgggguuuugcaguguugaccaggcuggucuugaaguccugaccucaaaugauccaccagccucggccucuuaaagugcugggauuacaagugugaugaccuugggccccuccccuucuuucuccaucauggucguggugguggggcuauugaccuuuuaagcaauauuuuugaaacaaaaaauuaugucuaggauggaguuauuugguuucuaagccucagugagcccuucaccaaaauggcuuguaguguuuuggaggauguagacauuauauuccuaucauggcccaggcgagguggcucaugccuauaaucccagcacuuuggcaggcugaggugggaggauugcuugaggccaggaguuugagaccagccugggcaacauagugauaccccuucucuacaaaaaauaaaaaaauuagcuggacaugguggcaccugccugcagucccagauacucaggaggcugaggugggaggauugcuugagcccaggagguggaggcugcacugagcuaugaucauaccauugcacuccagccugagcaacugagcaagacccuguuuaaaaaaaaaaaacggaaaaaaauauacuccuaucauguuuagauuaaaauucaaauuuuuuuucccugacagaucccccaggaucugccccauucucucaaucucucuggcucccucuccaaccacuguaccgcagcggccuucucuuugucccacaaacacaucaagcauguccccaccucagggccuuugcauguaugcuuuccucugccugcgacccuuucccucccaucucucugugguuggcuccuucaucucuuucauucugagcccaaaugucgugaccacucagccuaaagaaaacuaaagaagcuuccaccacuguuuccccacuguaauaugcagaugugcucccauauugcuaaggacaccccagaggguuuugaccauagaacccucucaggguauggucucucucuacacaugcuagguuuaccaucagauggggccaaccuuuuucuauagaguuggauaauaauacacugggcuucguggaccauaagccuccacucugccauuagcaugaaacagccacaaugagaaugaauggacguggcuguguuccaauaaaacuuuauuuauacaaacaggcagggggccgguuuuggccugagagcuguaguuugccugcccugggucuacuggucuaugucauggcugucauauauaggcuguggcauggcugaaauuuuaacuuuucaguuaagaguauuaaaguggaucaaacucaguucccaaaacuuguucuugacccuuucccuccagagagaagcaugaagagucagagcagugagaggccccugccuggcuucaaauccuggcuccaucaccuacuagcugugugaccuuggaugagucacuuaaccucuccaagccuuacuuucuuugucuuuaaaugggacuaauaauagucuccgccuucuagguuguucaggaagaucaaaccacuuugaacaugaaaguguuuagcacaguguggggcacacaguugcugcccugugaaucugagugacuuccuauugucauugguauuuuuagaguaugagaggagaaaaccaaauaaacagcagcggcuggaacuugcuggccuugcaggcuguuuuagagauuucugagcaaguuuucucuucucucuuacuccuuugggguuacuauauuaguauuguacuaauauuauauguaguauauuuugggaguucugaccacagaaauugcagacggggagcuaugucuggcccauggaugugucugucuagauuagugagauauuuaaaaacacuuuuguguaaguugucagcauuuaaaacacaagagauuuaccuaagaaaucuaggugaccaguguccccugaaaaucaggagcucuggccacugugggcagguccaauggagaaggggaguggagaccugggagggacauuuccaggcagagggaacacccagugccagggcccugugccagggguccucagugggucaggccagcugucggaguccugaggagggucuucucuguaguucaaggccacaggccgcaccuucccagugccuaguuccagaagaggcugcauuuccagaacaaaugaaaggcuccugaccaaugcaugaagauacccgguuaguaggguucagagccugcugucucugcuucuucccaggagcccacacccccaaaagugggccuguggcugucccccgaaaccccuccggagcacaccccagccucugccagucuucaguucagcccaaugaaacagcaguuccaggauaugcauuugccauuaaaaacaaagaaagaaagaaagaaaucaauccuucggccucuuuggccugagcuggucgucugcccagagacgcuggggggcccaacggugcuuaagacucugugagccgccgucgcucaagcuggacgggguaaauggcucccggggaaccauuauggucgauugacuugcccagccgccgguguggacuguggguguugcggauccggagaccacaggggucacaggggccgccaguccagggcagauuucccugaguggggccaucacuccuaggccuugcugcuacagaugccugugagugucugucaucugcuacgagugucuaugggugcgggugucccaggggauguggugugagcugcggaaucaagcccuacacccuccacccccaaagacuaccuggacucuggagccagcaggccucgguucaaaucccagcucugccacuuaccagcugugugaccuuggaugagucaauuaaccuuucugagccucacuuuucucauauauaaaauggggauaauaguaguagccaccuccuuaagaauuguugugaggacuuuuauuauuauuuuuuugagacgaggucucagucugucacccaggcuggagugcaacggugccaucagggcucacugcagccucaaccuucuaggcucagaugauccucccaucucagccucccaaguagcugggauuauaggugcaccgccaccacgccuggcuuuuuuuuuuuuuuuuaacguagaaguggaggucucaccaugcuacccaggcuagucucgaacuccuaagcucaagugauucucccaacucaaccucucaaagugcugggauuacaggugugagccaccgugcccagccuguuuugaggauuaagugaguuaaugcauaugaagcgcugagauccaugcccagcacauugaaacaugauauaauguuaaagugaauaauaauugcuguuauccuucacuccagaacuguacauucaccacuuacgguauaaauaauuauauauaaaaaacaaauacaauaacuaauaauuacauauuaaagaugauauaguaagcaaggaaggcaaggugccagcucucucagagcccacaggccaugggacgaguggaugcacaugccauuucacagacgggcaaggggaguagauuccgagacaguauauggcaaaggaauugccugggucuggaccucaggggaugcuuccuggaagaaaugacccuucuguugagaucucaaggacaagguuagggaaaagcaucucagaagagggaacagcauuugcagagaccccgagaaggguggaagaauugugccuccaaggaacugaagaaagcaguauggccgggagaagauucugagcagguuacugggccugucucauucucacuuuugccaccugccaaugaggaguagggauggaggauauaauacgacacugcaugguggccgggugcgguggcucaugccuguaaucccagcacuuugggaggaugaggcgggcagauaauuugaggucaggcauuugagaccagccuggccaacauggugaaaccccuucccuacuaaaaauacaagaauuagccaggcgcgguggcucacgccuguaaucccagcacuccgggagguaccauugcuauacccaucuuccagaugagaagacuaugccucugaaaggggaaauaaguugcccaaggacacauaucuaggaagaaagaaguagagcuaggauuugaauccuaguugcccuguacauacucacgagacagaaaugguaguaggagaaagggcauuccaugagaaugcaucuugcccaucuucgacuucagggagcgugauaggacccgugcugcgcuggaaauccaucccauagcuggcccagccaggggcagagugcagcagaaauucuggcacagacucguaccugggacacacgggaccccucugcuaacuccaugguagucuaggagcuuccgucaaccaaacaaccuuccuccuguccuucuguccucucuccuucacacuggcucccuccggcaggugcagguguugacccuuacaaaucucuuugccauaugacccugccuucaagucuguuucuugucccacaggaaagaagaaaugggauugggacaucugcauaaggcucucaggguguaggagacgcuccguugaggucgcugucaugucuugggggaggcuggggagcugucacucccagcacugucucuuuccugguugccuguccuuacuugcccucagguuuuaggauccccucauccuaucccccucccguccccugucauucucccccucuuuauucaagccccuguggccuccuugcugugccucaaacaagccaagcaggucccagcuucaggguuuuggcacuuacuguucccucucucugagacaauuuccaaacaccucccuucaguuaguuugguccuuugcuugaauaccaccuccucagagaaguccuccuugacuucucuuuccaaaucagcuccccucuccucacucugccucaccugaugugauaauauuuauuuguguauuuauuuguucauuuguuuacugucugccucccucucuggggagggcagggacauaguaagugcucaauaaauauuugauugauggguggcugaauccacaggagggaugagguagggggcaguugccccucgacuucaccuugaggggcagucuugggggacccuuggcugcuacaccccucacuggcucuugaaaguugcugggaauugggcaccggccucaggccuguggcgaaugaggguuuguuuaccuuuagcuccaucagucucgccuuagggugaccucaguuccaaccugggaggcagcucccaucuaauuaguauaucuauuuauuaauugcuggaaggcugcaggccauaagcgaugauuugguggccucagccauagagagcugaaagcaucccuacagccugugagauggcugucauccaggacacaagacagccaguuaauguccucggacccggcugacauuccugacacugauucccaggcccacuggaucaucccagcaggcaugagaaagcggccugggucucuggacagugaucccaggguugaagggcuuucuuucccaccaugcgcagggaccccucguuuauaaucggggggagacccaucuuuccuucuuuggcugggccccaguuuuucuaucuagaauggagcaucccugguuuguugagacaggucauuuauucauuugaugagcauuauucagccccagcuaugugucccaagcugccugagguguugggaguguagcacagaacaaaacagaccaaguccugcccucauaaagcuucuacuucauaaucauuuggagguagaacuacuuuucuucaaggaucgugagaaguagaaagugacagcuccauauagacacuuggccuagggcugggcauguugugagccuuuccuaauggugauuauuauugcuauuuauuaucuuuauuagcaauuguuauuauuaucuuucuuaaaaugggagggcauuuccuguugaauuucaguugccuugggagcugcaccugcaaugaugggcgcugggcucggagcagucagaucuugcuucagaccccggucuugccacuuccucacugagaggcuuucggcaacuccccaguuuuguaagccucagcuuccucaucuguaaaaugggacugaaacacagccccuaccucauagggacauugagaauauuugauuugaugcagagcccauaacacacacuugggacaccaucauuccccaguaaacaggagugacuaguauuaccuuuauuauuauugccaucguuguuugucauucaccuccaggcccucacugcucagcucaguggugcccaaaucuggguggagccuagagauucguuugcaguauuagcugcucagguaucagaugagagaagcucaccugaacuccagccaggugcaggaacccccaccacacccuguaaggacaggaaucuaaccugggucuuccucccagcccggcccacccggagccagcagccagcagccaggugcgcuggcucuuugcagagaagcuugggacaggaggucaggccucccugcaugccgcuuggcagggcuuagcaaggcugggccuggcuuugugguucagaagacagcuugcggagagaccagugcaggccugggauuucuuuaacaaauggcgccugcacucuuacugccaugcaagccaguguucacagcccuuuguauugucuuauuuuuaauucccacagcaacuuuaugaagggaaaacgaugaccauucccauuuuacagaugaacagagugaggcacagaaggcucagucccuggcuacauugccaggaagcggcccagccuggacuugaacccaagacccagggcuguuggccacccguguuccugcucuggacucacuaauggccaaagcugccccucccaggacugauggcugucucacgccacugccgagguccccccaucuacaaucacuaugucaguauuuuucucuuuaugcuuuauuuuuauuuauuuuuuuuugagacagagucuggcucugucgcccaggcuggagugcaguggcgcaaucucggcuuacugcaaccucugccucccagguucaagcaauucgccugccucagccuccuaaguagcugggauuacaagcgugugccacuacgccuggcugauuuuuguauuuucaguagagacgggguuucaccacgucggccaggcuggucuugaauucgugaccucaugugaucugccugccucggccucccacagugcugggauugcaggcgugagccaccacgcccggccccuugcuguucuuuuuaaaaaccucugaagauaccuugccacugucaacucauggaaauggauuugggccccaaagccugagaagcaugggucaggggaaggugagagaaagcucccgguucccagcgugucucccagccuggagaaugagcaccacccggccauccauccccggcccccgcugggucccggagccgcguggcgcgcccugucguccggccugcauuccgcgagauggaauucucggcuggggcugauaauaagcagguauugauugcugccguggucauuaucaagauuuauuuagucaauauggccuccccggucaauaaaucgugucguugauaaagaaggaaggagauagacuuguagccuuuauuaaaaaaguuuuuuagauuuuuuuuuuaaagccaaguccagcccuccuuucuguggcuguaccagccacacucuacaguucgcguuuuuaccuuauaagcucuuucuuuccauggcagaccuuauacucauugcucugacuccaagaagcaaggacuuggggcuggggcuagggcuggagaauggucccugaccuuuguucuuucauugaauccucccagcaucccuuggggcaggcucuggugucacccuauuuugcagcugaggcuacugaggcccagggagguucauuuacuagcccaaggucacacaagacucgaacccagacagucuggccagagucuuugcucugaaucugacauucauccaucaaauagcagguauuucuugagcacgugcuauaggccccgcacaaugccagcugcuggguguggaagggcaagcuaaacaaauaaauguguaaugacagaaauagaaagaauggaggaaagagcgcugaaaucacauggaggggccgccuguuuauuuagggugaugauggaggcccacacuggguaggugacauuuaggcugagaccugaaccaugaagaggagcugugcaggcacaguucaggcaggggagcucacagcuccaggaggagccugugcaaaggcccugaggugggacucagcuuguaaaguccuggaaccaaagggaggccagugaggcuagagaggggagaagaggggagggagagaagucacagggggaggugguuacugcucacgcaggcccuuuuagaccacgguaguggcuggauuccuuugaauucuauuaucauggaagugggaagauacugagggucuaaaacgggagaaacgagauccaauuuauguuuggcucccgcuggguucagccugauaggaaacauugaagggagggaggggacguuuggaaaauaggcaaaggacagcaucugugaugaacuggauguugucaucucugcccagagaggaguucuucguggcaggaagccuuugggcacgcaaacguuucgaggacuagcacucuacagcauugugggaguggagagauugccaugggaacaugccugguacccccagcaaggugggagcugugcuuccuugguaagcguauggcugguuuucugugugaguggccagcugguguggauuuguaggcuuuuagcggcaggcaugcagugggcaaggggcgccuucucuccuggacauagagcuggugcaaggagggucaugggggauuggguuauguucugagaagggcccuuugcccaguggucucugugggcauuauuaccaguguguuuccaggugccacuuguuaggaaaggccauaaaaagaugaggugacuaagacggcguggcuguagagcccgggccacaugcagguauucugucccagggggucgugugcugacuuucauauauggggaugcuguuagguguaagagagguugaaugucuaccugggggacugcaggggaugugggcuggaguauggaauaaagagaacuuuuucaccuuuuaguuuugucuaaucuaugagcaccuguggacuggaaguagcagggguugggggaucaccucuuuaucauccaucauccacucauccaccacccacccaacauugucuuaucuacucauucauaaaucugcucucucauccacuguauccauccaccuaacacuuuauccagcuguacuuccccauuucuuacugaucuuaacuauccauccaucuguccacucauccauccaucccaugaauccauccaucuauccauccaugaauccuuccauccauccauucaugaauucauccauccauccauccauccaugaauucauccauccacgaauucauccauccauccauccacccauccacgaauuccuccacccauccacccacccauucaucuauccauucauccacuuagccacccagcaaccuucucauccacccauccacauauuugugcauccaacaaaaaucccuuccuccaugcaugcauccauccaacaucuacucagccaacacuaggaauguaaagaugaaaagaaagcagucccuguucuuaagaaugcuuuagauugguggaggagucaacuguagugaaauaaccccaaaaugacauaauuagcacaguaaucagaggcuguacacagagcuguggggaacaagaggggagacaaacacuggcccugcaggccugugagguuggugagggcugcuggagaggguucuagacuugagacguguaguucuccccuccuuccccaucuggauucagugauguucucuagccuagguagaggguggguggucucagaaggcagccugccuucaaggagacaccacaggaaccauggucaccaaacccuggaugggcccaggaaggaccaagcucuguccuguagcagauuggagcccagcaaggucuuuuugagagagacuuuuuugggcaagggggauggucugugaccaaggagguggacaaggcagaucaucaggucugccacuaggacaggggcucccugguuuuacuguucagugcagauuagcagccccuaaccucugcauggugcuuggagccugucagaaaugguuccacccaccuaugcuguuggaccaccucccauucugcagaggaggaaacugaggcaaaaggguauaugaaggaaggcagggcagagaaacccuucaccuacauccuccucuccugcucagccacauuuauagagcaucuggcucacacuguaucuccauuucuguaucucccacccacccugccgcuucccccacagagcccccucuuggcccuccugauacuacauucucuucauuuuccuccuaccucuugccgccacuucccuguuucuuuucagacccauccuccucuggcuggccucuaauuauguugguccuuucaagguccaucucuucucacucugugcccugacccugugugaccucaucuguauccacaacaucacugccucccagcucuccagucccugccucugggugucaaaccucucuguacaauagccuucuugacauuucugucuuucuuuuuaagccacuuuauuugacuuuucuugaaugucugucucaaagaugucuccaggucaagacguucaaaaccuaauuuucucuccauuguagggucuucaucuuagggauggcuccauccgggucuacaggacagaaaccugggagcuacccugauuaccucccucuccuguaugcccccuauguccaguucaucacuaaauccuggggauuuaccuccuagauaccuccugcaucccaucuccuaccuccaucuccaccaucgucacuuggacccaugcccccauugccucucccgcuggacuuuggucuccuaauuucuuccuuugcugacucuggcuucuccacucuuuugaccacagcagcaagugagguuauuaaaaacuuguuaagaauuuuuuaauagaaguuuaggaagaagaauuucuaggggacgaugaagagagguugguuaauggguacaaacauacaauuagauagaaggaauacauucuaauguuugauagcagagcagggugacuauaguuaacagcaguguauuguguauuuuaaaauugcuagaagagaggacuuggaauguuuccaguaccugggugauggauauccuaaauacccugacuuggucauuacacauucuaugcauguaacgaaauauuacauguaucucauaaauauauacaaauauuauguaucaauuaaaaaugcauuuuguuuuaaaaaguaccauuuccaauggcccuccauugccuuugaggugaaagccucaauguaacuaaccuuccaugcucagcauggacuggucacugcccucuguucuugguuuauagugucguucaagucuucuauuuucuuguugauuuucugucuaguuguucuuugcacuguugaaagugggguguugaagucuccaacuguuguuaaauugucuauuucuccauuucugucaauuuuugcuucauauauuuuaguguucuauuaggugcauauauacauuuauaauuguuaucucuuccugacagauuggcccuuuuauuuagcaaagguccuucuuucccuaguaacuuuuuuuuuuuguuuuguuuuagagucuauuuugucugauauugguauaguuacucccaguuucuuaugguggcuguuugcauuauauaucuuuuuguauccuuuaauuuuccaucuguucaugccuuugaaucuaaagcgugucuccuauagacaacauauaguuggaucauguuuuuuauucagucugaaaaacucugcucuuugauuggauuguuuaauccauucauauuuaauguuauuauugcuaugguagaauuuaugucugccauuuugcuuuuuguuuucuauaucuuuuuguuccucuauuucucuuuuacuacuuucuuuugcauugagugaauauucucuaauguagcauuuuaauuagugagguuuuuuuuuuaacuauauuacuugaggauuuucuuagugguuugugcuaggguuuaccauauauauuguaacuuauaggaaucaaguucagauuuauagcaguguaauuucagcaugccuuucauucuuuuuuaauggacacauuauaauuguacaugcgcccucuguucuugauccugagccacauucccuaugcucgccauguuccagucacacgugucuucuuuguuuccccggcaccauagcccccaugggugaccugcucucucugccugcgacacucuucccauacuucuucccaucaacuccucccagauccuuggagcuuacucaauaucacuuccuuggggcagcugccugcuccaccuuguauggccccaugaggcugugcaccccaacuuuacagcacuuaccauagcaggugucagacauagcucuguggguuacugaugaacaccggccucccucuguggauugucaucaccaugaggguauagagcagcuuguccccagaacugagcagcagagggcagagcacauaguaggcccucaaaaaaaaaaaaaaucagucaaaugaacaaacagggauggaugugagugugaugugaguguaaugugaguguauuuguauacuuacguguguaugucugcaucuuuguggguacauaucuuugaguguguuugugggucuuuuaauuuuugugucuguguccuuguauguguaucuuaguguguuucugugugugugucuuuguaucuguguuuuucugaguaugucucugaaugugugccuguguaucugcauccacauguggggaucugugugugugugucagugcgugucuuuguuuauuugugcaccuuaguaugucuguguauguguuugugugcucaugcucccaggcagaacuucuuucaacaucuccuugccaugcaauuguauucugucuaguuugguguggcauuuaaugacuuccccaaagcuaagcauggccacugcagaguugaucucacugugauggaggugacacgggcauguggggccaguggcaggcacugccuccccaggauugccugcuguaccugcugaagcucccccacccccaccuucaucccuuugaggggaaaaccccagacggguagcuaggugcaggggcaaagcaggguuauugccgaacagacuggcucugcucuugccagauacaugaggccgccagaggacugcucagugccucaguuuucucaucugcaaaauggggauagcaaaaauaauccccucauagcaucuccacauggaggaaaugagcgccuguacaugcagggcccagcacggcgccuggcacauaccaggggcuccagaaaugugauuuuguuucucgugcuugcuccccgguggcucuugccccagcagugggagagugauuuuccacuaagucccacuaaugacaagaaacgcucuuccuucaagggggcccuuucccagugucaucucuggggccauccaagggcucuagugaaagcaaaauccuaacccacuuaaugcugagauguucagaggccucccauggacacacagcauuuccccagcagagaugggauuuagccccaagaguauucuaugaaucugccacguacuuccauagucuccauccuuagcauucugucucacuaucuccgcuucuacauccuccauacuccucacacuucccagcauugcauuuucuguuuccucugccuggaacaccauucacauugcucuucgugggcccuggcccucuuucccugacucugcgcuggguuggaugucuucuuuuaggucucacuuggacaucccuggccugggcugcuuuccauguuuccagaugauuccccaguuccuuguuggucucccguaucagacggugaacucauuaccauacauuaaagcuacaguacuuggcauggugauugguaaacauugaaugccugguggccugaucagagguuaccuuuuaaaaacucagagcugggcgcaguggcucacgccuguaauccuaacgcuuugggaggccacggcggguggaucaucugaggucaggaguucgagaccagccuggccaauguggugaaaccugucucuacuaaaaauacaaaaauuagccaggcaugguggcacacgccuguaaucccagcuacucaggaggcugaggcaggagaauugcuugaacccaggagguggaggcugcaaugaaccgagaucgcgccacugcacuccagccugggugacagaacaagacuccaucucaaaacaaaaacaaaaacaaaaacaaaaaacagauuccuggcuuucucuucagugugagagcuggcguccccgggccugcauuucacacagggcuggguucuggggguguggguuucccauuuugcaaaaccucugcugagcccaggccucccugugcagcuuucaguguggcccucauauaagcgugugaguuauaauagcaaccucacccuaggcauuagcugugccaacuuugugacugguguggaggugacucugccuucucuggccucaguauagccauuccagauaaugggcagaauuuacaugaccuuucagcaaugagagcagcucagaagagcuuuuuaaauuuuuuuaaauuuuauuuuuauuuauuucuaguuuaacaagcacuugccaaggguggcuuaugugacucuaaguacuuucuaaauaccaucauuuagugguuuaauucccaucacaauucuaugcuguagacauucuuuuuugagauggagucucacucugucacugaggcuggagugcaguggugugaucuuggcucacggcagccucugccucccggguucaagagauucucucacaucagccuccugaguagcuaggauuacaggcgcacaccaccacgcccgccuaauuuuuguauuuuuaguagagacgaaguuucaccauguuggccaggcuggucuugaacuccugaccucaggcgauccaccucccucagccucccaaagugcugggauuacaggcaugagccaccacacccggcccuagacacucuuaauauucccauuuugcagaggaggaagcugaggcacagaaagguuaagugacuugugcaaggccacacagcagagccaggcagucugacuccacaguccauguucguacgcucuccugucucuuguuauuucucuuuacuaugcaaagcagagacuguguaucauugggacagggcuacuacauguccagguucccucuuuucuccccagaagcugcuguaugugcagauuggccucauaaaggucuaaugugaugauggguggcucuugguggaccauguugucuggcaggagucggggccugggcccaaauuacugggacaagcaucagggaugucagagucccagaggccaccgucagagcuggucaccauagcagcauacacugggggacuaggccaauuuccuguccuuccuauccugggguagcuggacccugggacccucgggccagcagccuggaagucgcaaugaggcggccccggcccucggaggauauccucuucagccucugcaagcaaggggguuggucccacggcccuuggccuacuuugugaaauucaucucuggaaaaaaauuauucucugagcagagcagagcaucuuggcauaucacagugggugaggccugcugaggccgucugccucccuggagggggcgaggagagaaaccaaggcccagcuccugccucccgccuggcccccaagguggggcaccugaggaaggcagccccccuucccccagcccccggagcuugcccgacugccccagcggucccaucggcgcacguuuccuguccccugcccaggauggcaccccuagaagguuggggcuggcccagccucccuacagguaaguaggcuugagccagaggauaauuuguuucugugggauguauugaugagcugcccuaauuaggcaccuugcuaaugagaaucaaaccacuucgcugggagucgggcugaucgcagccuagcucugccgugaagcagccaugguccugagcaggccacuuagcugcguggcucucaguguuaucuucuguaacauggggcuuccugcguucuuuccccuccauagcuagauuguuugcuaugccccuggagaccucgggggcuguugagauccgaggcaaaaggcggaggccaauuguggcuuucuuuggguguucuugucacugguggacagauccauggaugcguuucucaugccggccucuuggauggaucugucagggaaggaggaugcuagagacgaggacuguucuuaacaugugugacugcaugugucucuguaaacgcagcagucauuuguugcuggguagcaagccaccccaaacuuaguggacagaaacaacucuuguauaccugauucugugggcuggaauuaggacggagcccaguugguucagcuuguccccacuccaugauagcuguggcuucaucugggcagauucaacauuugcggguaauuugacaacucccacaucuggcaauugaugcuggcuguuggcuggaaccucagcuaccugugggaaccccaguuuauggccucucugcagggucucucuguguguucuccuuugggcuuccucacagcaugguggcuggguuccgagaggcaacauccugagagagccagguggaagugcagguguuuucaugcucuugccuugcaaguugcuaguaucacuuccaucuacucugcugauuggggcaguaacaaaggugggcccagguucaaagggaggaggacguagaucccaccacuggguggaaggagugucaaggucaccuugcaggaagccuugguggcgagggauauuauggcagccaucuuuagaaaagacaguuggcuacagugagggcgauggugguggugauucaggugacucaggcugguugugacaggcuguaaagggagccagugcggcaggaaguggcugagcaggagaguagaugugacaggagguugugugaggugaguuggugugacaggaaguagccaaguagggagugggugugacaggaggaugugugggggacagaguguaacaagcgguggccaagcuggaaugguugugacaagagguugugugagggaauucagugugacaggagauugugugggggagugugacaggaaguggccaaguagggagugagugugacagaaaauggccaagcugcaaugguugugacgggagguugugugacgagagugaguaugacaggaaauggccugagcugcagugggugugauaggaaguggcccaguagcaaguaagugugacaagaaauugugugggggagucaguaugacaggaaguuaccaagcuggaguggauguuacaggaagcugugugagggcaauggguguggcaggagauuaugugagggaaguuagugggacagagacggcuaugugaguggaguggagugggugugacaggaaguggccacuggagaucuggcuuugucugccaugauggaagugggccugccagugacagggcccuagaugcugacagcaccaccuuuccuugcuuuccaagcugcccucuugagggccucagggugaccaggccgauuccaacguggggacccagaccuccuuacacgggccccaucuuucucccugcccuagccuccaccaucuuccugucuuccugugggccccucgcuccccacuucugccagcagccuccccuucugccagaaagagugacucccaccucaacagccuggaagcacuccaacuaccguacuuuucuucaaauaaaagcagcuaauuaacauuauucuuuaauuauugccuuuaucaacaaggggucugauuucuaccagcaggauaguugcuuucccuuaaacuacccaagugaaugcuucaguuccuggugcuuuugaaaugaauuugaugucaucugcccagagucacuuaauggggacgccuggguaaugacugaacgcgcuaacuccguuagcagcccuggaagcauguaauuuggccccucaggcaacagcacuuuugaaaucucuggauaguuuugaacucucuguucuuaauuaaauaugcaauuuuucacgguaaccagguuaauucuuuuguguuguguuguaauacuguuaggaauuuucauaguucuuauuaaacauuauucaggcauugugaauuccauaauuaaaaaaaaugaaaagaacaaagcuugauucacuccuuucuuuucccuggcuaauuuaucaaaugaauuuugcaaauuuuucuuucuguccccagacaguguggcaaguguuuuaaaggggaaggauuuaauugcccuguagggauuggcugguuaugaaggauuuggcuguuugauuaguaaacccaguugggaauggucuaaugcuccaugaucuuaaaaauugucugauuguacccucuccaaggaggccucucucuucguuauguagagcaucaacuucacacaagugugauuauuagguagugaggaaagggaagagagaaagaucugacuuuacuuuaaauuggggaucuugggagauuuuuaccuccauuucccuggcuggggaggaagggagaacacugaagagacacagagagagagagacagagagagagagagagagacagacagacagagagagagacagagagggagcaauucucucaucucagauacaggagaagcuggaggguggcugaaaggguggggcccaaggagacguuuuagugcacccuugcagauagugguguuacaggaagggggucccgagcgagaccccaagaucucacgcaagaaagaauucagggagagaccgcagugcaaaguaaaagcaaguuuauuaagaaaguaaaauggugaaagaacagcuacuccauagacagaguaggacauuccugaaaauaagaggaggaacacauccacccuagguacaauacucauauauauggggagauaugcucugugacaaggguuugugauaaaggauuaauuuucuuaauuacuauauuuugcaauaaucaauauuguuaucuuuaaagcaaaauuaggaaucccuuuguucuccaaauauugggauaucuggacacucccaagucuggguguguuuaguaaacauuauuaauuuguucccuuaaccguaaacaucuagaggcucggaaugcugaacuuucugaggaugcagcccagcagguaccagccucauuuuccagcccucacucaaaauggagucgcucugguucaaaugucucugacaguggcaccugccacacuggucagcuggagggggccccucuuugcagggcuucucggggaggugguaggggaggagggcuacauuuccauucuggaauugggcccagucucugaaaaaaugugcagacuccacacggagcaaacuggguagaaauaaccauaucgcccaaauguucuugauaaggcuaggugccccuggccccagcgaggggcuucuuggcagagauagccaggccaacucccagugaggggagcaggacuacugccugauuccuggaccauuuuguuuucuaugagggccccauugaugccucaguuucccucaccuuccaaauggggcacgugacucuucugacuuuccuagguccccccacccagggucagcuuucuguauccuagagguggggaggugggagaugaagugggggcaggguggcaggagccagaucaccuugagggcuauggugaggaggugggauuguuuucuaaagauagagccccuuagauauaggaggaggggagggugauguggaaggggugcuaccaaggagaagguggucgugggggguccucaguccuggcugggaugccgagggugggggcagugagggagguguuggggagagcaugggccccuuucuccccagcuuaccccuaccagacuuaagccugacuucuggggaagcccccuucccugcccccgaccuugggauccugacucacauggucuuuccagcagguccagggcuccauuuagaaucacucccgggaaaucauggcagggagguggcagugacuucuguuaggucuuguggcaguguccuuuguugauucucuugguuaaaaccaagaguuuuggacccugaacucugcugugagagaucuuuauugaaaccgaaucaugaccccacacccucuccccaacugaaaagcuuucaguggcucccuauuguuuaugggacaaaguccaaacuucuaccuuaugaggcuggucgugagcaccuccccucacccucauccaaucccaccaugucaucucuuauaaacuuccucguccccaaaucccccagccaggguuaaauuauuacccagcccucaaaugccuuacgcugucuuacauccagacuuggcauauccuggucucccugccuggaacucccuuuuuaaaaucaccguacaaacagacacacuucucucaucuuucgugucugaucugggaggcucuccugaaccuccuggcuggauuagggggcucccccauaauaaugcacaucauaauugauuggaguuccuuggcuagucuuuuuaagacccaugagggcagcauuuguaucugucuucuugacucuugucacaagcacagaguuuggcacauauuagaggcucaauaaaugcccauggaugggccagaguuuugggaagcagggaucucacuccugaacuugcuggaacccaguaggaagcagggguucuaucugguuugcggauacugagacgagcaaauucccuuucccucaggcccagcccggcccagccuguagcucuggaagguucuguuggagcugacagccucugggaagugaggacuagacaaagucccuucucuaagggccaaggaaaaaguuaggccaugguggucacccucgggaagcagaaacggaagccuuagcccccucuuccuucuacccucuugucagcuucauccucuggaaggccaagugccagggacaaagaugaagggaugugacacaguuaucgucccuccaggaggggcgugaggccuucagaaaggaagcagugacaccugccaccucccagccuugggaugccaggaccuccagcuggcccugcugcccccucccccgcuuccuuggggcuguucaugggaggccuccccucauggcuguggcccugcagaggccagccgcugaucagugagucucugcaggcccaagcuguccccagaugugugcaugcauaugcacacacacacacacacacacacacacacacacacacagcaaggaggaugccuggcuuucugagcuacaacccaggacccaugcacaccacaguccauggcauccuuugcucuccuuucuuccuauuuuuauuccuguuugagucacuaugggacaaugaggagagccacugaggaaagcuuuucgggaugggggaggaggagggaagcaugggcuguagaaggguuuucggggaaucccacgacugcaagugaaagaagggcuuuuuaaaaguaauuuugcauuauggaagacaaagucgccccauuaucggagggcuuuacaaauagagaaaagaggaagaaggagacuggaagaacacccuuuggcaugguguguguuucugucuacacccucguccugcuuugcccgccuaaguacauccaacucuacaucacggucuuuccacuuauacccacauuagcauucuccacgucauuuugcugucuuucggacaagcguuuuaccugcccgauguucugugaagugagugggucacucuccccucagccuggcccuggcccuggguaucucuggguuuuuugucguuuucuuuuuucugcugugauggaaacacugugcuuccaguuuuauguacuuggccuuguucucagcaggcagggauguggggggcgccucguggccaaacaccaggcuuuagagucaggcacagucaaguucaaauucugccccugccaauaagacuucagcgcgugcacuccaucugugccucagcuuccucgccugugaaauaggucgccucgcagccucacucacagggagugucggcaggguuagaugagugaauuugccugaagcauguaacccaggacuguucuagcacggaguaagugcccaauccauguuagcacuucugcuauagccgccggcgggucugccaugcuuaguguauacugggugcucacuuaauccuugcggaaugaauguggguggcaccuucccauguagguacuuuucugccuguguggcaugcacguuucuguuggggacaccuuguguagagauagauguguaucauacacucacacacgcucucucaucuacaccaaagggagugcacagggcuguccuccugguugaggguccacgagcauuuuauugugauuaaauauuuauccggggcuuguacuaugaacauugcauuuuauggcagauaaaaugaugucauguaaaaaaaggcuugaaaagcuguguggccccauucacagaaaaggcagcugucacuagggaagcagagcugggagacggcucgagcgaggggagucauccauucaacaaguauuuaucucagcaccuacugugggccugggcccaggccacgugccggagaugcccuggugaugaaaacagacaugcucucugcucucgaggugcuuuggucucugugguguuuagaaaucaaaucccugaagagacccacauuaaucaaauaaucacauauuugaaguugcaagcccagcuaagggcugcagaggaaaugagcuaggaaugaugagaccauauuacagggaccagcuuuagucuggaagucagggaaggacuccugaguuagcccagugaggaggcgcaugguaguccaguuagaggguaggagcgagaugugcgaaggcccuggggugggagaccauaccucuggcuccagcaagugaaaggugggcaguguggcuggagugcagggugaagggcagauaggcaggaugugucugagaagcaggggacagggcagggucccaugaggcuuguaggcccugcugaggucguuaucaugaaugggaggggacgaaagaggaggaggauugaagggguuugaggacagagagccugggcugggagaccuggccagacaaggaggcuuagcuguugccuccaccauccucuggcccaagucuguaugucuggccucccugggcauccagaaaguuccccagucucccaagguuggcacaagaauaaagcaauuucccugggcagaugaggaggggguugagggugguccucaccacauucaaauacaggcuucuuuucugccauguauuauuuaccuaggggcuugugaaaaagagaaggauccaaaaaaaacaacagcaagcaaacacccccuccccccaccacccugcaguccaacauugcuccaggcgugcagccugagggaaugaguauuuuuuuuccuccaguaucuguacgugugugagcaugugagacgcugugcuagagcuccaggucccaaccagcauagguggcucuggggccuuugggacaucgcgaggcggcaccaucgccucccacagccccggcaaagguuggccucauggggccugcacuuugagauacggugggcuuccguuuuagaucagucuggugcuccaguaacuccagcagggccugccuugggggcuggggguucucaggcaggcuggcuccuggaaggguaaaauucccagaggaagggagguagcgaguccgggggauuuggcggccgccccugcauagcauuauucugugccucacacauucuuauuagcaucguaaucgcuccaaaauacugauucauuauugcacuccgagcugcagacggaggcaaugggguuuaauaguuccauaugagccauucugggcuguugaguaaauauugcucauugugaaaaauuggguaaauguguguuuacgcugucgaggagcgaggcaccagccaaguagguagcuggugucuggacaugcacccggcaaggugguggggacaggggaaugaauguucucugggaaauauuugcuuccugucuggcuggccuuggaaauguucuuuggacauggacguugggaucaagaaaggggcuuuaccucaaaaucaagguagaaggagccuuguguuucuugugcgugugcaaauggcuuaggagugggcaggaaagacccugggccuuccaagcuuguagagacaaaugauuggauucagaaucagagagcugguuaccaccagcagcaggaggcgauguggcaggugagaagugugcaggugagaggguuugacucuggguucccuguucaaccaccugcuaauugugggauuucaggcaaguuaccugaccccucuguggccucaguuuucucaucuauaaaauggggauaaaauaacuuccucguagggcuaucaugggauuuaaacauacgcuuauaacauucaaguggugucaguuggcaucaugcacaagaaauguucaccauuaauaugauucuggucuagcauggagagaaggccuggauuugagucuggcuaucucagggcuuugauuuugagaaucugaugaaagcuauggaucuucuuuuuagaaauaugauggagacuuagcauuuugcauguaguuucagggaguugcaagauucccccaaaucuagccauguaccccaaguuaagagcuccuacuuuuaucaugcaccuugcucugggguggaagugaggcauagaauuuggaacugccuagaaguggguuucaacccaaggccuggguuuuauccuggcucugccucauauuugcugugaaauugggcaagugaaugacccaucucugagccucagucuuuuuuaccuaauguugaguggcuucauguggaaaggacuuggaguauauaaagcacugggcccaaugcccggcauacaguacucaguaaauaucauccucauaauuccuucugguuaaagaccuaagaguugcuaaauguagacucugacucucugcuguuuuuauagucuguguauaauaauuucauuaucugaaguucuugggugugauccugcuaauguugccuguugaucuaugguagaccaguuccccauguguuuuguaauuuuggauugagaggucaucuuugguaggcuuguaucucugugaauucuaugugaccaggauugaccuuagugcagaagucauccagauagcaaauauuuuucacuuugcagacuacagucucuaacacaaugacuuaacucugccuuugugcaaaagcagugauaaacaagaaauaaacuaaugaguggggcuggauuugacccagggccgaugggauuuggccuacaggucacuguuugcucacccuuguuuuuugguuuguuuguuugagacggagucuugcucuguugcccaggcuggagugcaguggcacgaucucggcucacugcaaacuccgccucuccugaguucaagcaauucuccugucucagccuccugaguagcugggacuacaggugcacaucaccaugccuggcuaguuuuuguauuuuuaguagagacgggguuugaccacauuggucaggcuggucucgaacuccugaccucagguaauccaccagccuugaccucccaaagugcugggauuauaggcaugagccaccgcacccagccaccccuguguuauuaauagaaauauuuuguauuuguuuuggcuuaauguccagcaguauuaccaugugagaaugauuuuuaaguuaauuucuuggcagagaacaguaguucucaaaguguggucccuggaccagcagcaucagcauccccaagaaauuuguuagacaugcaaauugucgagcuccaacccagaucuccugagucaggaauccuggcagugggacccagcaguuucuauuuuaacaaauugcccaggugauucugauccauacucaagucugagaauuccaaagggacaaucaauuugaacuccaaacccaugcgagugcaggauuaugguuauacauucucaggggaagcuaccuuuugguuuuccaaacuagaggcaaggcagagacagaucaaggcaugucuucuuccaguguuaguggauagagguguucugauccacauacucgcugagugugaaggccucuucaguacuaagaugggcaccuaucuaucccaugccccacuccuuuauugcagagggcacuuaauuauugguucacauacuuagcagucugagugaguucccucuucaguuuuggcccuugggaauuucuuacuuuuuccagaacugaccuauauauuuaaagggaugcugguauaccuuauccaguauuucuggguguuuuauagugggagcauuucagguuauauugucuuccauguuacuggacacugaaguccucucaauguaaugaaaauuaguuucuccuuuagaauucuuuuuagaaggucugguagccuccugcuucacuggugaccugacacuuuucacuuacccuggggucugagcccacuuugucacucacagggaccaaaggcugaacaaauccugggagucucucuaccuuaccucugccuggagcuggaguccaguucagccaacguuuguuaagcacccauugggugaggggugaggggaguucacuuuauacaagugacaaguaucucugcuagaggacaccaccccauggucaguguauuccagcauguaaauccccuugcucugcucuaggggaacuugacugcucuaaggaggagggucagaauggugucagggugaagagcucuggcuuuaaaauccauuggaaucaaguucaacucccagcucugccuuuuacaagcugugugaucuugagugagccucugccccucucugagcaucagcuucuccaacugcaaggugggaugacagaggguugcuguuaaggauccagugagaucauucauggaaggcacuuggccaagcaccugguacauggugaguccuccagggagcaccuccaaugaauguuugugacuggaauggccguuaugagucuguuucucaugauaaccgacuuggagaagucaggcuggggagguggacuggcccuugggugcuccagaggccaucgugucacagauacaacuugggguagcagcccugcaccccaccacuauuccuguagugaccuuucuucaugcuuuccaccucuacacagucaugugacucaacccaggaagacagggaagcugccagucauaguaugccaucccucuggcuacagugauuggaccaccagagagucacaugacuuaagcugggccaaucagaauucucugguacuuuucagcuggagcaggucucuguugucccuauagcugagacgugggaaggaagaaaggaaggaagccugaaggaaggaagucuagagccgccuggaggcaggguuucagacaauuucauggggacagagugaaaccagccugcagggagaggcuaagagacagaguccugauuugaaucauccugagggcauucucucucuuuaucguuugauuacaggagcccaacccauguuuuuauuuguguauuugguuguuuaagcuuguucagaccgaguuucugccaccuacaaucagaaacacccccaaaacaugucuccccauggaagguuccgggaacucuuggccacuccauucugugugaccaaaauucuccaaaggugaaucagacacaagucaugucugccaaccuggccugguguugauaggcgggucuggugcaggauguacccuguuguuugaagaacaucauguggagaacaaggggacagagggaggccauagggugugccaggacacaggccugggcagaacuccaccacccuugggauuugaguaucccagaagaaggaacauuugggcagugacauggccauguucgugucacugaaccacccugagaaauaaggucccgcgcagagcuucagcagauguggaauaguuccacccccugccucagauucuuuucagggcagcccaucacgaccccucuagcaagaguuaccugcccuccccaccgaucauacccuaguccagcagggaauggcuuuugcccacuuuuaaaaaguggccugcagagccuggcgaagucccucccguguccccaagcccaccacaccugcuucguucugcauaguucuccccgcuuuaucuuugaucucaaaaaaagaucaucuuggaaaagauuguuuugugugcaguuuacccaaaugccacuuuuucuaauuuugccggaguugcccuccccacuuucccucuuccuuuucuuucuuucuuggauuugcucugggguuggcuuccucgaaccaaaauaacucucacaaugcacagggaaaagugcuuccuguggaugaaugacaucuguaugaaaagccagccagccggccgauuucuguccuuugaagacgcuugucagcgagugcugcggugaagugucaggcgucacccggggugacuguggagacgccugcaacagugagcuuuuuuauuuuuuuccagaaagccuucagcccaaacucugggcucuccggggacccaggagcgcauccauuuucugaggagaugaaaagcgaugcugguuugagcagcugguguuuucuccuguguucccggcagggcccugcagcagugccuuuguagcucaccugcucugccuugcgugguucaacuccgcccccuucuucccugauucgugugcccaugucaggggcuguuugcacccugagaggagaggagacggggugccgguaaugcccccauggcccuccuguuggacaggaggggaaaaucucaugguuaagaauguggcccugggcaggguuugguggcucaugccugucaucccagcacuuugggaggccgaggcggguggaucauuugaggucaggaguucgagaccagccuggccaacauggugaaaccccaucucuacuaauaauacaaaaaauagccggacuggguggccuguaccuguaaucucagcuacucgggaggcugaggcaggagaauugcuugaacccaggaagguaagguugcaguguccguagaucgcaccucugcauuccagccuggugacagagcaagacucggucuaaaagaaagaaaaaaaggaauguggcccuggagucagaaugggucuggguucaaaucucugagccucaguuuuccuaucugaagaaugggguuguuagguuuagugaagacaguaugggaaaauuacuuccuuagcacggagcccaauacauaguaagugcucacuucuccagguucacccuggcugacccuuccucucagcccaugugcugccauauuaaaguuagcacagcucugaagggcaguauuuucucccucuuccgugcucuuccccuugcccacaguaacuuuccauacuucgucuguccaguggacuccuguucauccaucagggcccagcuuaaagcaucaccucucuguaaacccucagucagcaaccccuccauccuaaggcuggccauaaacaaagccuugcucugugugugugugugugugugugugugugugugcgcgcgcguguguguguguuauuuucucauagcucuggagguuagaaguuugagaucaagguuucagcagguucuuucugaggccucucuuauuggcuuauagaugccugucuucucccugugucuucacauggucauacccugggcaugucugugucuuaaucucuuauuagaaggacacccaucagauugaauuagggcccacugucaugaucucauuuuuaccuuaaauacaucuuuaaaggcccugcuccaaauacagucuccaaacacacauucugaaguccuggggguuaggacuucaguuggggaggcgggaguucagcuccuaauaaaaaagucaccaugccuaggugugcuucuagaugauaccugugugggcuucagucucuacaggacccuagagcauggcuuuagacagccccagggcccagcuccugugaugaggaugggagggucgcugcaugggggaugccggccugggagcuccuggccgcagagcuuggcugccuucccugacuugaggccuaggcacacaccuccaugcucugccuggucuuacaaggaguuuguaagucucugaacugcccacagcagccauggaggcguagggagccagagucucagauauccagggagugggagaagggaaugggugugccugaagacauccugcccagcuucagcaagugggggucucuggacaaccuucuagggccacacaagaaauaaaaccguuguuaacacuaucuauggguuuguccucccucucucccuuccuuccuucccuuccucccuucccucucucccucccucccucccuucuuccuuccuuccuucuuuccuuccuuccuuccuuccuuccuuccuuccuuccuuccuuccuuccuuccuuccuuccuucuuuuucaagauuuucuuuacagcaguuuuagguucacaacaaaaucgagaguugccguauccucucugccccaauaugugcauagccucccccauuaucagcaucucccaccagaaucguacauuuguuacaaaucaauguacauugacacaucauuacccagagucuguaguuuacauuaggauucauucuuggugugguauguucuaugggcuuggacaaguguauaaugacauauaucugccaucauaguaucauaccuaggauuuuugcugcccuaaaaaucauccgugcucuacuacuucaucccucccugcucccuccaaccucuggacaccagugacccucuuacugucuccauaguuuugccuuuuccagaauuccauauaguuggaaucauacaguauguagccuuuucagauuggcuuuuuucacuuaacaaccugcauuuaagauucuuccauguguuuuccuggcuuuuuagcucaucuuuuuuuagugccaaauaauauuccauugucugcagguaccaccguuuauuuauccauucaccuacugaaggacauuuuaguugguuccaaauuuuggcaguuaugaguaaggcugcuguaaacaucuuucucuagguuuuuuuuuuuuuuuuuguggacauaaguuuucaccuccuuuggguaaauaugaaggaacaagauugcuggaucauaugguaagaguaugcuuaguuuuuuaagaaacugccaaauugucuuucaaaguggcuacaccauuuugccuucccaccagcaaugaaugcguguuccuguugcuccacaucuuugccagcauuuaguguuaucaauguucuggauuuuggccauucugauagguguguagagguaucucacuauuguuuuaauuugcauuuuccugaugauauacgacuuggagcaucuuuucauaugcuuauuugcauauacuguauaucuucuuuggugaggaucuguuaaguuccuuggucaauuuuuuaaacaggcuauuuucuuauugucaaguuuuaggaguucuuuguauaaaaguccuguaucagaugugucuuuggcaaauauuuucucccagucuguggcuuguuuucucauucuguuaauacucccuuuccaggagcagaaguuuuuaauuuuaaugaagucuggcuuaucaagaauuuauuugcuuuugguguuguaucuaaaaagucaacaccaaacccaaggucauccagauuuuccuauguuaucuucugggaguuuuauaguuuugcauuuuacauuuagguccaugauccauuuugaguuaauuuuugugaagaguguaaggucugugucucuauugauuuuuauuuuuuauuuuuggcauguggcuguccaguuguuccagcaccauuuguugaaaagacaaauaucucuucuccauuuuauugccuuugcucccuugucaaagaucaguuaacuauauuuaugugggucuauuucugggcucucuguccuguucuaucgaucuauuugucuauucuuucuccaauaccacacugucuucauuacuguagcuuuauaguaagucuugaaguucaguagugucaguccuugacuuuguccuucucuuucauauuauguuggcuauucugggucuuuugccucuccauauaaacuguagaaucaguuugucacuacccacaaaaauagcuggcugggauuuuaacugggauugcacugagucuauagaucaaguugggaagaacugacaacuugacaauauugagucuuccuauccaugaacauggacuaucuccccaucuauuuaguuauucugugauuuuauucgucagaguuuuguaguuuuacucauauagaucuugcacauaguuuguuacauuuagccuugcuuuauuuauauauaguauuuagucuacauguguuuguguuccugucaagagcagguucccacacccugugggccucccugcccccaugcaguucccucuguguuuguaacccuuuguccaucucuccaucacaauacagugcugauugcaauaucuaccucaaggaauggcaaacucccaugagcuuagggacaggcaaguaacaugaaugguggaucaggcucugaguaaaguaggaggaaguuuguuggggguauggggugcuaggcaacuggggagaccuggcccugccccagggaaauaaaauugauuaaaauacugggcuggauggauaaaauaccugauuacuggcugacuguggcccuugggccugcuuguuuacagucucugguucuauuuauguccucuucccagccccaucaaggcagggagcccuuugagggcagggaccccucccccaaccccaacuucaguguccucugcuggggggcacacacauugcagaagugagcaaauuuuugaugaaugaagaaacacauuugcuguuauccuacucauucuuuugaaaaguaaaauauauucaauguggccauuauagaaagaacagauaagcaaaaagaagaaaauaaaaaugguccacuuaagagauaaauuuuugucacgguuucuuuagaucuuuuguugacaugucacagacagaaaaaggcacagauccuauagguucagcucaacugucacaaacugaacauacucauggaauuuccacucaaauuaagaacuagaaaaucccuggcccucuuagaggcuccuucguaucccuuccagucacuaccaaccacccaccccccagggugaacccugugcccacuucuuacagcacagauuagucuuguuuggaaucaaccagccugugcucuucugugucugguuucuuuuaccaacauuauguucucaagauucaccuguguugugcggcauuacaguuuguugucauugcuguguagcauucucuuuugugacuacaccacaauuuuucauccauuccccuguuaagguacauuugaguggcuucaguugggggcuccuacaaacagugcuguuaggaacauuuguucauuacugucuuuuagugcacaggggcacacaguuuucuuggguauaaauaaggguuucucagucuugacaccauugauguuuggggccagagaauucuuuguugugggugcugcucugugcguuguaggaugcuuagcagcaucucuggccucuaucuacucagugcgauagcaucucccaaauuguaacaaugaaaaaugucuccgggggcuggucaugguggcuuaugccuauaaucccaaugcuuugggacgccaaagcaggaggaucacuuggagccaggaauuugaaaccagccugggcaacacagggagacccugucucuaugagaaaauuuaaaaauuagcuggguaugguggcaagcgccuguaguucuagcuacuccggaggcugaggcaggagaaugucuugaggaguucaaggcugcagugagcgaugaucacaccacugcacuccagccugggggacagagggauaccucaucucagagaaaaacaauugaauuuuagauaaacagugaaugauuuucaguauaaguauaucccaugcaauguuugggauauacuuauacuaaaaaaaaaaaucauacauuguuuaucugaaaugaaaugugucauuguuuaucugaaaugaaaugugucuggguguccuguauuuuauccagcaaucggcuuaauuccauuucuucugucuucugaacacugcagugaauaacauccuggaagcugaaucuuugcauacaaaccauguuucccagucgaggcuucucauuugaaucaccugggggcuuguuaaagcccagcaucucgccccaccccaggucucucgaaacagauugcaaauuugguugagacugaaucuguaacuaaguccccaggugauucagagccaaagacguaggguaaacaccugaguagaguaaauugugagggccacccgccuauuucgcuaaaguggaagauggggcagggaaacauucuagcuguucccugccugaucagcugggucagcucucugcugugagugaagauagaggcuugucuuugcccaaccuugccugggaccccucugccuguggccuucagcuuggacagggggcugagggggugccccuaccuugagcugccccucagcucagcccagagccugcccugacuucacaggaagcagcagcugaacuuuggcagcaggagggaagugggggguugugggcaccagaaccaacugcauugauuucuggcugcaguucuuggaaggccugucaugaggaaaacaggcagcggguaaacagcagacggcggcagggcccagcagcugggaggaccuggcuggaccuaggaaccugucuuagcucgugguaccggccaggucuggccaccacuguuggggacaccgugccccucgggcccaggccugagccucucgagaccccaccaucuagccagguaagguuugcccagaccuggucccccagaacugucucccuugcucugccccugccuguucagagccuuagggauucuggguucauucauccagucccccacaggccuucucuggaccaggccuggccgagucacaccugagggcugcagaggauggaggagacagccaccacccccaccccccaccacccagccgcacccugagcccugcucacaggagcagccgcucucccuggcucuggagggcagaucugauuucuguuccaucccagcugcugccaggcaccccuggagccgucagaccgcagccaacuaggcgggccgacccugucugcgcagagccaccgcaaaauuacagcucagacaggaucaauaggaucaggucgaggggccuuuggaggaugauuuugcuuugaggagaggucagaggggcuucagacuuauaaauuuauuauuuaagggaggauuccuggugguccguaagaguuuguuggacagggaguuggccucucucuggucuccuggauguucucugggguggagucaaagcgucuaggcuguuugcgaugggauaagcugggugccuuccccggcaauggguagaggggaugaucaggguuugggggcagcguucggaugcggagagggagcugcucaccuuccauguccauuugcugcuguuguuuuuuggggagagcucaguugacaaauauauuugugugucaugcugucuuuuuacuuauuugggcgcuuauuguaggccuggcauuauucuaggcugagggaaucaggucaugaccaagccagauggagcuuauaagucucauuauuuguccuuacuggggaggaauccaaggcccaggguguccgagugauuugcccagggucacucagcaagaggccccugccagguuccacucugccuaggaaaugagcaaaauagucuccaucagaccaagugggaaacugagucugaauaauaaugaugaugauaauaaccagccuucaguaagggcuuagcagguggccgggaacugugcuaagugaacccuaugagguugguacuauugucuucccauuauaaaggugagaaaacuaagguucagagaggugaauucacauucuugaagucacacagcuagucaguggcaaagcuagaauuugaacucaggacuuuggcuuucaagcuuaaccacacaucauguggauacuuucugaaguucccacuaaagccuugugcacuggagaggcaagucagcaucaucauuuuuauaaagaucagguccucaggcugggaugugcaguugaggaggaugcuaauccaccaccacugacuuuauccagaacugaucuaaggagcaaaacaaaacaccuggcauauaauagcaauauuaacaauggaaacaacagaugccauuuuugagcaguugaauaauucccaugugccuccuaccauguagagaugaccuagagaacuucaaauccauagcugcauucuuguucccauuugauggaugaggaaacugaggcugggagacucacuugccaaagcucacacagccaggaaguggcagagccgggauuugaauucuguuggcuacacagcucacagagccuccuugcugguccucccagcagcugcuccaaggagccagugggagcuucugugcucuucuggggucucucaguagcucagagcauagauacaacucacccuucucuccaucacucagcagacgggcuagccuccucccagguuccagucuguuuccagcccugcucgagagucuuauauuuuccccucccaaguccuccuuucuaaucaggucagccguugacuacgggccccaaaauaaugccaagugcagccuuugcugcauuggauuucuugcuugcuuagcagaauggaaacuuuggcauggguauauguguguccuuaaaaaaaaauccuuuauuuacucugcuccuguuuuuauaagauaugacucuuaacgaggcuuuaauucaaggucaaagagucgagaaguuggugagaaaacccgucgccccucggggcccugcuggacacauaaacggccaaaggauggcucuuuucaucuccucuuuuaaacagucccauugcaacagagcuauuccuugcacgaggagguaaaauauuugaacugauuguauugccuguuccuaacuguuugcagaauacaucucugccccccuugacuauuuauuuuuuccuuugcuguaguucaagggaaauaauuuauuaacuugggaauuccaaauagugcucccaaaccccgcagcgcccccgaggcccaagcuggccucugccugcccugcuuggggaguugaaagaggccuuuccuugaaacgcgcagccguguggcagggcccgggaagacguggguaauguauucacagacaugacucccagaccccgagugucuugaacccuagccucuggggacuggcgcggccaugccaucgaccugaacccccuggacuucugccccccuggacugauggccuaaauccaucaggcucaccagccccggucuuggaccacugaauaauuuacggucccucggagcggcgaggagcaggucacuggaguucauggguuaauaacagguuugguuuucgaugucagcagcucucuugauaacguaugaaagaauccuauucuguugauuagauuuugaaauggaucaauuuuuaaucagccaaacaccugacucacucaauaagcguugcauuguggagacaggauggaggccagcuuuauuuacaagaguguuuguuuuuugggggccauacgcaaauucccacccagaucccuccuccuggaagaaauugaccagauuaucucccaccucaaauggcagcauuugauucaucuucugauuaguugggaaauccaugggucuguuuaagagauaagaacagcagcuaaagguuugauuuagucuucugugguuauugaugggaaaagcauuuauuugucaaugaagaaauuuuugcuuaauguaacagcaagaaagaagagaggaaacaaagggaguccaggugguacccagggguggcaaaggcaucucagcucuggggguaccugggguuucugucccuguccuuggagauuuucaaaacaaugauauagaaaucagcaaaugaguacauugaauuuguagguggcuaauuguggagcagugggguguugcuucuggucauuguguuuauucauucaacaaccaguugagcccacacugugcccggcaccagacuaggcaucggggaugagccgacauugagagagacaaggcuucugcccuuguagaguuuccauucuggugggaggagccaggcaggaaagaaaggacaaaguguucaaucacuaaggcaugcugagcauugggaggaagcagagaggaaguuaccagagaaaggaacaagagcaucucauuucagguguugggggccaggugcagcagcuuaugccuauaaucccagaacuuugggaggcugaggcaggaggcucacuugaagucaggaguucaagaccagccuguccaacauagugagacccccaucucuacacaaaaauuuaauaaauuaguuggaugugguggcaugcacuuguggucccagcuacucaggaggcugaggcgggaggaucacuugagccugggaauuugaggcugcagcgagcuaugaucgugccacuacacuccagccugggcgaccgagaaagauccugucucuaaaaauaaaaagucagcgaaggaguuuggguuuucuauacagugcaauggggauccacggacagguuuugaacagggggguggcuuguuugaguuuggugauggaaaaggucacucagaggcaggugggcugggagaccccugaggggucuacuguagccaucuggugagugaugaugguggcuuaacugggggaagcggauggguucgaucauucuggucaggggccagguggcugaggaaaaggagucgugcgugggaacaccuggggucccagccuagccuaaugaggccuauagccccaagccuauccuggccuggucccaugggggcugaggaacuacuugcagcagaacauuagcugucuauggacugggaagagcugggaccugguggcccagagcuugcaaacuugggcucuaagaucagauagaugugggagcuucccaucucacugccuuuuacaaacugguggccucagacaaauugucauucacacguacaagcagguuagaauaauuuuuggucuaagacuuuccuucuggaaagaagaaacuaccaaaagugguugccccuggaaagggauucuuggggugggugggggauuuacuuucuccucugguagccucugaguuuaugcuauaggugaguauuaucuagucaaaauuguccacaucaucugcgacacacagcagcauggaccugugguggccuucugaacgaggacugguuuugcugccccauuuuacagaugaggcucaggcaggggcagucgcuugccugcagucacacagcccuaccuggucgcucaagccccuucccaggcccugaccccucccuggcuucccuucccugcuguguuuucggcuugucuuccucguugcuguugguuaaguuuguagacuuagugagaccuagaagagcaagauuuuuccuggcacgaguagugauuucucauucccccaugcucugcucuaagaaucauugauugggcagcuuuauuuauuagcuuaaucuuugcacaucccucagcggcacuguucucccaccugcuuuguccagggcagaacagccugugcguacaccugugugcauguguguccaggucaguuuguguggguguccacaugggauguuccaaguguggguuugggacugggugggaggacgccucacuucacagcucucccuggugacaagcaggugcccacaaucaucuuaauccaggcgcagcacacaggaauugcucaccaagagauggcaguggaaaaauacccucuggucuaaugucagaaguccuggguucuaguccugucaugcccacuugcuugcugugugaccuugaucaagucacuucuguucucugggccucaauuucucaucuguaaaacggggaugaugauaauaucuggccuucuuguuucuugaacggacugagcacuuucucaccucagggccuuugcacuggcuguucccucugcccacggcagccugcccugcuccuuugcucugucugguggucuuucagaaguuaccuucacaggcuucuccagccacccugacuaaaaucccguaacacacacacacaccuacacacgcagcccucacuucccuccccugcuguauuuucuuucuuccuuagcacuuaacaugauugaacauuuauauuucacccauuuaccuuguuugcugauuucucccauuaaaaugucagcucuagggccaggagugguggcucacgccuguaaucucagcacuuugggaagccgagaugggaggauugcuugaggcaaggaguuugagaccagccugggcaaugcagcaagaccccaucucucugucucucuaaaaaaaaaaaaaauagccaggcauggugcuaugcacucauaguccuagcuacucaagagacugaggcaggaggaucacuugagugcaggagucuggggcugcagugaucguaccacugcacuccaaccugggugacagagugagacccuggcacucaaaaaauaaaaugucagcucuagaagggcaaggauuuuuguguguuuugcuuacuacugucuuccuagcaccuaaaauggcacuuggcacagaguaggugcucaguaaguaucuguugaaggaaugagugaaauaagucaauauaauauaggcacuuccugguauauaauaagcacucaacaaauauaaguuauuguuauuauuacugauauuacugcuauuaagcuuucuugagccucaguuuccucaucuauaaaguggagacgcugcugauaauagcuaugauagaguuauugugaagucagugcuguaacugucggcuccuaaaauuauucaauacauaggagcucuuauagcugucgguacaaugaauaauaagggccaguagugggaguguuucuggagaguggaguuuguguccaggacccaggccucagcccucaccaugcugucaccguuuccgauugacugcugcaguggugggaggauugaucuuuuuguuugcccccuacuguuguccacccagaguguccagcugagguuuacaaacaccccucugggaguccagcuuucucgagcggugucucaaauucuucuagauaaaguucauuuuauuuuguuuuuauugucuuuuuaaguaugggaaguuucuguuugggaggggaagaccaguggauauuuauuguccuagggaaacaucccuagcacauugcucuauggaugaaagccacugccaagcagcacaugugguguaguuucuguaaauuaagaaagcagagccuccucugaccaggggaaugagaucuagucucaccccuagagucagggaagaaccucacccaggacucuuaauugcaaacaacagaaaccgacucagcccccaccaagacucauguaaggaggggcuucuccaccuauaggaaggagauucugauucugacuggccauaaagcaugacagauguuggugacaauugggagaaguuaggaugaggugaggaggggaccccaaagagaauaaggagugauuucuggaugcagcgggaauuggugcugugguggugaccagccacuguccacuguguagccugagauagggcagaagauaagcaggugcuguucuguuccccuuggacuuuuuagugucuuccacgagcuuccgccugcuggugacugcaucucuguuuuuuuuccaaaacuguaagaccacuuugccugagagagggcaggccagaaguauugaggccguaaccccccaggugcagcccuccagccucaggaguuggcauauaaaugccccggcucccucacccugagaggaaugacacagaugccuguuuugcucuuccuuggggugguggagauuauaggcaauuuucguguuuggcuuucuuaaggaggauuuuagguuuucagcauagagaauguaucauuuugccguuuuaaaucaaccuucuacaaaaggacaggaaugucccugggaagguuggggaugucuguguggggacagcagguguuuugaggcaucucuguguuguaucugcucauguuguggacagagcaauucaggcuucuucauccagcagagaugagcgggagagagagagaagggagaaaguggaaaaucacaauauauuggaaggaauaugauauuuguaaaggaauuagagucaguccaaauaaaaggcugguggccugaauugguuugauuccaggaguuuucugaauuugccacuuuagugggaagagggauuugaauuaauuucacaccucuugaaugccuacggugugccaaggaccgugcugggcaaguguccgaaaaugucugagaaaaucaaaaaacagcagggacccaggucggacuggaguggcaggucgccccugggauguuaaagcccaggguguagggacagaggaaagagagugguuagaccagccagggagcugggagagaggacacagcuuugaaaccagacagaaacuuccccucccaaacagaagcuucccaugaaacuucccugaaacguggaagacucgccgggagguggaggaggcaggugccccagagcagagcaugagcaaaagcucagaggggaaggcauggccacacccugggggcccugagcagacugguuuggcuugucugggaagggugggcaauguggaaguuaggcugggagauugcaggaccaugggugucgugaagagggguugcuggguagcuuggugggccauggggagccauggaggacauuugagcaggaggaggagguguucugagcugugcuggaaagagucuucuaucacaguuucucgacuccacacuguugacauuuguggccguuucaugguaggggcugcccugugccuuuuagggugcuuagcagccuuacuggccacucccuucuaaguggcaguugccuccccugcuaaguuguaccaaccaaaaaugucuccagauacugcugacuguccauugggggucacgagcgaccucagccaagaaccacgguaccaccuuaggagagagaugagcagggugaccagccagagagcagccaccaagcaggugaccauugaggucacccagaacuggggcagggcaggggaaagagggcaugggugugagaggccuuccagagaaaggauuaaaaggccagggaucagcaggccaaggagaccacgaaggagacagauguuggagccuggggccgggguccaaggucuagggccugaugggucuaugggaccaaggacagaugggaagggaagaggaguccuuuggggugaguggagcuugaggaccccagagucaaugcaucuuggggugccauccagggcuuaacauaaagugggucugugguaaugggguggguguugcugagugaaugaaugagccagauauaagucacuuaggcaaaagaggacugagguuuaggagggaguuaagaggcugcuuccugugcaguuuagugagaaccugcugugucucggauuccauggagaauacagcccaguggaggggacgcccaccgagcaaacucacagguaauagaagaugacagcuggcacugagagcuccaagagggaagcacgggaguuuguagucgugaaccuuggggcuggcagggagauugggagaaaaggccaggcaaccagucaggggcugccauccacagggcagcccgccuuuggcccagagaacgugcuuguucaagguuacuuugaugggggaagaacaacaagccagcccuuggcacaaagggcagugagaguagagagcagggccaucuccucgaguaccagggugggaguagucagggagggcuucccugaggaggugaaugcuggagcugaggacggaaggaugaguagaaguguacauggggaagugugagggaacagcauaugcagaggcaucacgcugugcuugucagagaccagaggcagauagagcccugacuugucuuacuccuuacaaauaaauaugauuuuccuccuggucuacagcggugaagacugaaucagcaggaguggagugguuaguggugccugggcuggugggcauucucugagcccugagacauaaaggauuucagcccccgcccuuuccucccauuccugcccaaguaccaucuguuucuaggggagcagguggagggaccccagauguccccuguccccugcuuuagcaguugacaaccugugaauauuuagaaagugugauuuucaguuccucagugcaccgcuggagaaagcaaacuuuaacuuuuuccucuuuuuuucuucuuuguuuuuucaaggccaauuuaaacagaaucuuuuuuuuuuuuuucccuagaacaagccacuggcuauuacggaaauaguaaacaggagucagggcuggggcauaaguggccuguuuuaauuagaacauuaaaguauuuuaacgcuuacacuuuauauuucugcgaacuugauuauauagcauuuuaaauaccugugaacguuuuaaggacucacagcgaugaauuauuugcagguucacaggaaacuucuauuuuaaaagcaaaaugguaugagaguggcugugaaagcuuugcggcagcgacggcgcuguauaaugaggggccacguggcgggcgggcugguagacagcccgcuguaccugcucucacucgggcuccggggugcccaccuucuggagaggcugcugcggggugcaggggauuggagggaccucacccccucuucucccauucuuccucuucucaccacagugaagccacauggaccuucucaucauucuuuuauucucuugguauucauugagcaucuacuaugugccaggcauuguuccacacacugugacagagcaggcaacacucccugccuccguggagcugaccuucuagucuggggagacagguggcaaagaaaaaaaaauaaaugaacaucaugaugauaaaaauggugaaggaaaggaaaguaggauagaggauggggauggaggugcuguggugugcuggaguuggcucauaccagcuccugagagcugacugugugugucucuucccagccuuucauucagugacauuccaugggcagcuuaacaucagccaagguggaagaauuuaccccauggaaauuggcagaugccacaaaucagggcuuacuccuuagagagcccauuguuaaccauuuaccagcaugcaucugagcaggucaugcggagaucugggggaggguugggaaggguguuccaggcauucccugaugugggaauguguucagaaggguugaggaacauccuggaagccaguggggaugggaugagugaaugaaggggagaauggaaggagauaaggccaaaggaauucuguaaauacuuuuggucucugaaauccucuaaucaguuuacuugugccuccagaacuuugugcaugcuguaccucugcccagaaugcucuuccccuggcugauuccuuugguuccugucuccccuagagaaguguuccgggaccauuuuugccacagcacaucuuucgccuuuauucuuauaucagcacuacuugguucccuucccagcauuuguuuccaguuguaauuggguauuggguuguuucuuugaguuuggaaucugucucccucauuggacuguaaguucagaaagaucucguccccugccaucuccccaccuuccagcaagggcuuacacagggcagaugcuugaagcauuauugucacaucagugaaugcugguggagagacuuuucugcacuuauuauugguuugggaaaugcccugaauggugugagaucagggaucaggagcagauguagcugauggagaagcuagaggcuccuaccuugugccaggccugauccaggagcauaauuccuaggucccuucuaguuaacuuugaagcaacacaguggcagauugaggccacucugaugauggucauaguaauuacccccaccagcuaccaaccugucagugagaaagagcauucucucugcuccugcuaaagacauuggccacuucagugguuaaauauuucuauuauaucaugguaguaucacagagcaauggaugugaguucagaacuuaagaugaagauugugucacugauggagaaaguacuuaguucacaggcaacuggaacuguguagccuggggugcaucaaagaaggaaacauuuucaucaaaagaaucagguuuggcugaccugauuauuucuuuuucuaaugaugagagcuuagaacauaaugauugaggugaucagcauuuaggccuuucauaguuaaugaggaacuguccaauuuaucuuagaaacaauugcuauccagggccuuuagugaagugugcagugccugggagagaaagacacuuaacaucacagagcugggugcagacagggagaggaagaaggcuccucuuuuaggacaucaaauugacucugucuccgaggguuuaaauccuggcucugcccuucccagccauaugcccuuuggccacuuguuuagcaucuuggaaccucaguuuccucuucuuuaaaauggggcugauggagcaguuaucucagggaaugguuuuugguuuaugaggauuaaaagugaugaggcacagcugggugcaguggugcauuccuguagucccagcuacuugggaggcugaggcaagaggaucacucgagccuaggaguuugaggcuacccugugcaacauagcgagaccccaucacuaaaaaaagugaugauauguguaaaaaucugagaauggugccaaacauggcacucaagaaauguuacccauugcuauucgagcugucaagugacauacuuuuuauagccuaugaaauaggaauggacauaguaaguuauucuaccguaacaagggacuuacuaaagaaaaugcugugggccgggcacaguggcucacaccugcaagcccagcacucugggaggccgaggcaggcggauugaggucaggaguucaugaccagccuggccaacauggugaaacccugucucuaccaaaaauaaacacacacacacaaaaauuagcugggcgugguggcgggcaccuguaaucccagcuacucggaaggcugaggcaggagaauugcuugaaccugggaggcggagguugcagugagccaagaucgugccagugcacuccagucugggcacagagugggacuccaucucaaaaaaaaaaaaaaaaaaaaaaaaaaaagaaagaaaagaaagaaaaugcuaugaagaagaagucaccagaguuuucuagccugccagcugguggcuucaucuugaugcaaugcauguuuuacuagcagguaauacuauuccuugagaaaacacacgcaagugcuuugcacuuaaccuggcucacuggagcagcuacuaauuugaucauuaaucagagaaugcuuuucauuucuguguguggcuguagagucgacuuagccauaaguuguuuguucagucauuuuguuuuguaucauccaagaggacagaggcuuugucugccuuugugugcugucuccucagugccuagaacagccccugcacauaguagaugugugauggauaucuguugaaugaaugaaauuauaugccuguauggguuuaaaaaugaaggacuauauccuagggaacugaaaacugaaguuuaccccaaaaccugcacacaaauguucucagaagcuuuauucaugaguagccaaaaagugggaacaccccagauguccuucaccaggccagugguucaacuguggcacccccacaccgaggagcacuacucaguaaugaaaaggaacgaacuauugauaagcuaaugauguggauacagcuugaaggaaucgugcugagggaaaaaagacuauuucaaaagggauuacuuacugaaggauuccacuuacuuagcauucccgaaaagacaagguuggggaacagggaauggagugggaauggggucagggaggaaaauaugugugcuuaucaaagggcagcacgaaggccugggggugaugaaaugcucuguaccuugacugugucaaugucaguauccugguccugcugucaguguuguaaaaugugacccuugggggaaauugggugaagggggcaagagaucucccuguguucuuuuccaaacuucugaccucaagaaauccucccuucucagccucccgaagcacuaggauugcaggcaugggagcuaccacgcccagccucucuguauucuuucugcaugugaaucagcaauuaucucaaaauaaaaaguucaauuaaaaaaaaaaguaaaggacugaaaccacugcauuaauuauucaaaaugcagcgggcugaaucccuacgaugugacgcauuaacuggagucuucauagcagcggacugaaucccuacgaugugacgcuuuaacucuagucuucauaggagcccuguggaguagauggagaugaugucaccauuuuucagagaaggaaaaggcucagagagcuuaagggacuugucugaagacagacagcuggcaaaugguagagacaggacgcagaccugggagugucaggcccugagcccuuaguucuuuccucuagacgugcaacucugagcgccucagguuuggacaaugagcugagcuaugaagcucaccugucgugcauggacaugagauguccgaccgggcagcugggugccaugguacccccgucugacgaggcugacagcucugcaguggggagaggcgguggagagucaucuuggguuucccaccugccugcuccugagugagcugcugaccccucaggaguuacgacccccuccccacuccacuagguuugccuuauccaggggcgguggugugcaguguugggugguauuaugacauuuuacaggugaggagacugaggcacggggcgaagggaccugcaggauauuccaaguggagaugcaguucucccuagcuccagcauccugugguaaugaucacggucaguuugcuuuguccugugcaguuccuguucucagagcaucuucugcccugugacagugaucaagggcacaggcccuggaggccaaguccagcagcgcugggauugagucuuggcucuguagaucaccaaacuguggccuuaagcaacugauuucucuucaagccucaguuuccccaucugagaaauggggggaguaauggggauuaaauagaaaauauguuugauaacacacuguaggggacaaaaaaugcuagcagcaucugaagccuguaauuuggaacccuggucugucugcucugaggcccagggcucugagcugagaggagcaaagccuccaccugaauuauccacccugauguuaccccuccaggcccuacagugcucuccuggacccaaguucugcuaggcuguugguuuucugagcagggcaguauguguugcaacagcggccauccagagggccuggaaagcccucugcaggaggcagcaucgaagcugagagcugaaagauggcugggcauuccuagguuaaugggaggaaguagagggaaaggcauuccagagagagggaacagcaaguacaaaggcucagaggucagagagugcaggugcuuuuggggaacuguaaccagagcauucaugcuugagcauuaagcaggcaaaaagcagaaccuagucacuguggcccuaggucuccucuucaguuaaaacaucacaaagcaggcugguggccuuucagggggcucaugggcagauaaggaguuuggacuacauuuugagggugaugggagccauggagguuuuggggcagaggagugaugcaggugggcuuaaugugaggaaggugccucuggccaucaugugcaguggaggggagcagaggugagcuccaaguggaggcagggaggccagggaggaggcagcugcagcaucuugaugagugaucugauccccgguccuggagcagaguugugggaaugggcuuggauaggagugaccagcuagggacauuugucagugcugaauugacagagcucuccguggggccagaugagggagcaucucaggugagcgagguuucugucuuggguucugggcuggcccgaaaggggcaaucccuuuaccucuuuuuuguuuugaaauggagucucucgcucuggagugcaguggcaugaucucgguucacugcaaccuccgccuccuggguucaagcgauucuccugccucagccuccugaguagcugggauuacaggcaggcgccaccacaccuggcuaauuuuuuguauuuuuaguagagaugggguuucaccauguuggccaggcugaucucaaccuccuggccucaagugauccaccugccucagccucccaaaauguugagauuacaggugugagccacugcgcccggccugcgaucccuuuacuacacuauucuuuggucucuguaaaacagaggugauuuccaccuccccaucucucggcauccuuuuucugggugagggucaaaugauauccucccugagcccacaccuugcagugaacugcaaaaaaucccaaaccucaccaagaggccccucauguuagagauacaagcuccaucauuuuguccggugguuuuucaaaugugccaccaacccaucagcugaacagagaugcuacuucucacucucucuguuuuuuuuuuaauuguaaaaaccaguuugaggucuccuucucaucucaggagaggcacugagaaacaaugccaucaccaaacagcagguucuaagcaagcacaagccagcauugauggagcaccuacugugugccgaggcucccugugugcuucuccuugaucuucuggguuaaggccacgggggagugaaaucugacagagugagucugugcccggcugcgccguguccucacuacaugggaccuugagccaggaauucagucacucucagccucaguuugcacauccgugugcacauccauguaaggggucacucacuggacucacccaaaagguggcugaaggagucaguguucccacuccagccagggccaggugagcgggcaccauggacuggauaaaagacagucuuggacuuggccccaggagguuggccucauuguuccuguuugcggagggaagucagauccgcagccccaaagcugccaggguguauuucccgacucagccgugcccuuuucacaaaggcccggaggagacacagcugggguugcugcuggcggaggucaagugcaaccgggcagcguucacuccucccuguacagaccccuaagaacagagaucaggccaucgaggggugcaggauugggccaccucaucccaguugcccaacugauggggcccacuucaguuuuucaccccacccagccuggaaccuucccaaagcccagauaauugucaccugggguucugugcacuuuuuauagaagaacgcuguguuccuuucugaggacacuuguaacaaauuaccaccaacuaaaggggacuuaaaauaguagaaguuuguccucucgugguucuggaggccagaaguccaagaucaaggugucugcagggcugugcucccucuccagacuccaggggaggguccuuccucaccucccccagcuucugguggcugccggcccugccugguauucccuggcuuguggccgcaucacuaggaucuugccuccaucaccacaugacugucuuaucuuugcaccugucucuucuuauaaggacaagggucgcuagauuuagggcccacccuaauccgauaugcucucaucuuaacauaacugauuaaauccacccgccuuggccucccaaagugcugggacugcaggcaugagccacugcacccagccaagcucuaacagauuuaaguuucuuucugaccuuaucuuauuuccaaauaaggucacauucugagguucaagaugaugugaauuuuaggguaccacaauucaacccaauaccagcaucuuuagaaaacguugagagcaaggguguccuuuucacccugaccuuuguuaggaguuuuguggugaagaagagagagggugugcgaaugucucccccauccgcaggcaggaagaagggcuccagcuguuagucccagaugugucucugaaugaaacacugagacuugaagucuuggcugcaaacagggggcuguguggucaggcaggaggagcagagucuucugagcaggcugagcugaggucuaggcuauuggccuuuccucacagcuugccuuucccagacccucaauuuucaucucuguaaauugggcauaauaauaguaccuucccaaugcggcuguugggaagacaucacuguggguuuuaaugcuagacacugacuaguccaaggucucauuuggacaaagaaucugggacugggagaggagccguaagcaaaagugacaggccuggaaucagggcuggaucugcugccuccaagaacaguguuccuuucucacauccagcccugguccugccagcgauuggcuaggagggucuaagaccuuuaauaauaaagcuggcaaauaggaauggcagaggcuaaucuuugcagugacccucugaggaagggacagcuguaguaauccauauuuauuuuccugauaaggaaaccaaagcucuggcagauuuuuuuuuuuuuuuuuuuuuuuuuuuaagaaaaguucucacuauguugcccaggcuggagugcaguggcccgaucauggcuuacuacagccucugccucccaggcucaaaugauccuccccaccucauccucccgaguagcuggaaccacagguacaugccaacaagcucagcuaauuuuuguauuuuuuguagagacaaguuuuugccauauugcccaggcuggucucgaauuccugggcucaagagauccaccugccuuggccucccaaagugcugggacugcaagcaugagccacugcaccaggccaggcccaacagauuuaaguuuccugcccaaggccaugcaguuggaacguaguggagcugagaugcaaaugcagguacauccaccucuaugucucacuuccucuggcuccccuguaccucaguuucccuaucuggaaaaugacaccuguuucagguucccagcuuagaugaccccgacuccaguagaacugugcuguuacauaaacucuggcucgcccaggaggguguccuagcuuuugcaucuccugccccucacaccacggcgacuugagauuuuuacacagacgagaacuguguguggggcggugagcaaguaagugcguguuugcaacaaauauuuuauaauagacaagccucgucugccacuucuaaaaguagugaaaaaaaaaaacccacuuugagaaaguaaaaauaacccaacgccugagucacugaagucacugaacucagcuggaaccggcagcuccaagcugaacugacugcuucagcucacccagggcagcagggcuggggccagaaauuugacgggggggcgaugaacaccugagcuuuuagggggaagucccagugguuaguuugugggugaagcgccugucgcucuuccuuuuauuuuaagcugcaggaugaaauggcucccugaaacccucuaucuucuuuuucuuuuaaaagugacuugacaauugauaauuuugcccuggcgauggacaccuuagagcuuuuauuucuuggaggccaaacauugauguugugugaaaugggagcuuggcggagccuuugugcggaucucaagcuuccugaaaaauuuauuuacugugacugugauccgcaggagccaauugauguuuaucuauagucguucgcgccagcaaggaggggaaaaaugcauaacugcacuuucuucagaagccuugcgaggcuguuuaaauaaguaucuaauagugaacuuucaauagcagacaggcaauuugacggacaggggacaguguauuauuaaccauaagcaggcuuaaucuuucccccacauuuuagaggaagcuuuauaaccuucuggcagaggaauuccugaaaacgagguauuugaagcuaagcaaaaauuauccuggccauucccguggcagaaucgaucacuccaagagccgcaugaaggaggggaacaggcugcggcugggcccggugugagcagcccuggccaccucauuguggcggaagggcccgagaaguggacggggaccgggagcgggcagagggaggcaagggucaugcuggaagccugguuuuccugccagguaaguaacuucugcuguuaacugagcuuggggacuggggucagagaccugugucuucccccugugccccgguugcaacagcaccuagcuuuuggcagcauccaccuuuuuucuuugagacagggucuugcucgguugcccaggcuaagagcaguggugcagucccagcucacugcagacucaaccccuuaggcucaaggcauccucccaccucaaccuccccaguaucugggacuacaggcgugugccaccaugucuggcuaauuuuucugggcuggggggagauggaggucucacuguuugcccaggcuggucuccuacuucuggguucaagugaucuuuccaucucagccucccaaacugcugagaugacaggcaugagccacugcagcuggugcauccaccuuuuaagcaauagaagugauuuaugugauacuguucaaugcaugucugucuugcucauugugccggaaguuuugugcagccuggaggcugucuuauuuaaccagggaggcucucuugaucucuggacgaagguagacuggcuuaguuacagaauuguccccuggcccccuaccuggcugucaucaccuugggaguaaugcagccuucagugucugucuccuccuauuuagagggucagccgcaagcacccagggacuucaccucagucugcccagcaccagauaccccauagcaucucuuaugcuguuuauugaaugacuagccauguguuuuccuggggugggaacagcugugguuaagagcaugaggguggccaggcgcaguggcucaugccuguaauccuagaacuuugggagacagaggcagguagauaauuugagcucagggguucaaggccagccugggcaacaugguaaaaccccaucucuacaaaaaauacaaaaauuagccaggugagguggcgcacgucuguagucccagcuauucuggaggcugaggugggaggauugccugagcccaggagguugaggcugcagugagcugugauuguaccacugcacuccagugugggcaagagagugagacccuaucucaaagaaaaaaaaauggaugaagguuagauacucuugguaucaaauuccugucuguuacccacuguguguucuuaggcaaguggucugccuucucugagucuuuauuuccuggucuaaugagguaaggagggaaaugacuucaccauuuuaagucucaguuuccucauuuguaaaguaagcauagcagugcuccccuccuugagggcugcagugagagguagaugagagggugcaggugaaggacucagugugugaguuauagcuguucuuauuaaaauuguauugaucaauauuaccguuacuaccaucacuacuuuuucucuccaugaaauaagcgaaacucacagccuccauuuugucugcuucagacauugucaacccuuucaaugucucaaagccagaaugaaggagcaugcugggugccauguaggguccggaaaugcugggccuggagugagucccugcacauggugguugcucucaugcaucugcuccgugcaggagcagugagcuggcccuggagcugaguccccuugugcaaguccgagccuccucgagcaagggcucagaggcugacagggucagcagugaugcugggacaagagagagugccaggggcucaacaaguggcucguggaugagugaugguuccaggauuaagugugccaccgagccccccaucagcagggagaaccaagagcugccuggugcucagagcaguuaucaccagagucugguccgcauucuugccaacagccuagagaguacaaaauggagcccuccggugggggugaggggaaaucagaccuuggaggucucaaguucccuaccugccugggcugagguucuuugucugccccgggcuguucuauccccuaccccucacauccuuucuugcucucccagaagccaguuggguuuacccaaauuaucauccccauggccaccacagagcagagugggaggcggggcccuuugcugggugcuccccguauggaaucuuaggagcuuuuaucacuuacacccauuuuccagaagaggaaacugaggcucacagaggcaaagucacuugcccgaggccccauagccaucccgugguccugucccucuucucugaugcuucacauccccgcuucccagcucaguggcaccuccagccuccucuuucccuccagaaagcaaggccagcucagccacgggguggguuugugaguugagcuggaauuguucaggagaucuggcuugaagaaguuaguaggcuguaaucccaacacuuugggaggccgaggcagguggaucacuugaggucaggaguuagagaccaaccuggccagcaugaugaaacuccaucucuacuaaaaauacaaaaauuagccaggcaugguggugggcaccuguaaucccggcuacuugggaggcugaggcagagaauugcuugaacccaggagguggagguugcagugagccaagaucacaccacugcacuccagccugggcaacaaagcagggcuccaucaagaaaaaaaaaagaaaaagaagaaguugggaggcagcuaagaucuuggcuucagaaggugagucccuguugucaagauaaaaaggauuaaauccuaaaagcagagccuugccaacacaucggacagagcccagcacccccgaaaguucugcacugggcauccuuccuguucccuucucaugccucugaugggagcucugguccagauacacccaggaaggugacaugagacccucaaaugugugugugucaccugagaccaccagguguggccuuggagugaaaacccauguuguucugggcucagguacucagaugccugucuuggggugacaaaccccaucucccacugcuuccuguucaauuuugggaaguguuuugggaaaugacacacugcucaccugcuuguccccaagcccuccaucuccagagagcaggaugggaaguuggggaggaagcagaggagccagggucuuucuuuuuggcuuuauuuauuagcaacaaauacgagagcuuagagcaaggcaccagcagcagagggagccuaaaaugauauuaaucacagcagcaauaacuaauacauauucaugugccuacccggggccagaucuggggagcuccuagauaacuaaaaugggcuucugcucucaggggggucacuggcgugagcagaccacccgugacugcacaagacagcguuuucucacagcagcagguccugcucggcaagcgaggcgcucagagucaggagccagggaggauccgcaaagagacugcagcgagcaggcaggggaucgggguggcuguuuuguaccuggggcacagcauugggcaccaggaauggcgugggcauuggcacagagaacccaggcuccagggcgugugagucguuuugcuggguuagaggugagcuuggagugguuggugggugucagaucagacaaggccccaaggccaccacauggaguuuggacuuuuccccgaggcucagaguaaggauuuggggaguuuaguucuaagagcuacaggaagccauugaagggcguaagcuugggacaguagugacaggauccacuuaccuuuugcaaagaagucucaggccaccauggagaggagggucguagggguaagaacagagucgggagcugggcgcuguggcuuuacgccuguaauaccaccacuugggaggccgaggcaaguggaucacuugaggucaggaguucaagacuaggcuggacaacauggcaaaacccugucucuacuaaaacuauaaaaauuaaccgggugugguggugccugccuguaaucccagcuacuugggaggcugaggcaggagaaucacuugaaccugggagguagagguuacagugagccaaaaucaugccacugcacuccagccugagcgacagagcgagacuucgucucaaaaaaaaaaaaaaaaagaacugagugggagagacagggaggagcugcugcagucaucggccuuggcaccggggauucccggguacaggccaacgagggaccuuucaaaguagauacgcaucucuggagggaggccacugaggcugcugugagcugccuugccagcauuucuccuuuccaucccacaucuugacgcucggggacugcggagccccaguugacaauauggugacauguuaacgggggaauggccggaggggaccuauacccccagccccagagcagcucagacaagagcaggaagccaacgucaccucccucucucuagcaaggacucauguuggucuccugauucccuuucucuucgugaguucagaggaggaggacagugagccacgcuggagggacuuggccucggcuggcacaagcuggguauucauuuauucaugcacuuagcagccgcccauggggcucaugccuggugcaggggaaagggggagcaccgcagacugccuccuccccucagggagcccccagacaggaacggccagaagugcagcauguagaaccagccugagaagagcugucccugaguaggagccgggaggccucuggaguaaggauaggugcucaauauagccuggaaggccaaggaagucucccagaggaggccaccuacaucaucugcucagugaaggcaggaacuggguugcccauucaauacaggaucccaaaugcucagcaguguggaaggaagugacuuggaagcucagaccugaagggcgaccagguccugccccagcagaggcaggaacguguguucaagguggaggaaacggccuggccaaaggcucggaggugggcuuugugcaaaucacuguucagagugccugggaccuccgggugagcaggguguggcaagagcugaggcuggaggccagaggcagugcugcauuuuggggucuaggccucugagcucauaaaaauagcucggugcuuucuuaaaccguuaugugguuucucuucuuccuucauuucuugccaagcccggaaagccagguugggucacugcugggagguaugaggugagacucggguuugcaggcagggcaaguuguggggagguggggguggcccccuauuuguugggggcagaccugccauuugaaagccaccauccucauguguagcccucacaugggagaacaggauuggaccugcagggauccuggcuggggugagauggagucucaggggaaggugggggaugucucugccagcuuuggggcucccagucucucugaucaccuauuggguuuauugggcgccgaaacuggggccugcacggaugguguaaaaucagacccaggcagccugggucagugcccaucauucagagugacccucuguccccuccaugcccagcggggccgaugggcagcuaggaggcgagggaccgucuggcucaaucgagagccaaagagguaaugcuaaugucuuuuaaaauuagaaugaaaauguuuauugcagagcagaaccugcgucagcucagaguccugugggaagggaacggcuuuaucgcagccuuucgcuuuuauuuuugcacauucgcuuuuuauuugccgguggugcugcugacgggcccucggagcggggcugugucuggacacuucugggagccuuggacggcucuggagaggaggcaggagcugcccagggugagugcaaggacccgccgaggguugagaggacuugggggaugugagagcaggagccugugacuguguguguguguguguguguaugugugugugugcuugugucuguguguguccuugugccuguguguguccuugugccccuuuguguguccagcucgauguaugcguggccuguguggcucuccgugugucuuucucugcgugugugguggccgcgagagccguccaugcaugagauugaguguggaucucugccuaucucugugugugcacucaugaguugugugugugucugugugucuuuggagguggccauggguguggcugggugugggucuuggcccucugugucuuucuguuugugcggauguguguguguaucuuaaggagacacaugggugcgugacuggugggucugugugggugcagacacccaugugugcaagucagagggguaugcaugcguguguguaagcaugaguguacacccacaagugugugaauuguauacauuugaacaugugagcuugcauggaggagggugucacguggcagagugaguugugugcauguauuuugcaugugugugcuacauaugagagcguguggacugagcacacguugcacaggagggugugagcagugcucaugugcuggagcaccugugugaguauguaugugagcacauguugcauguguugcauaugagcacauguguggggcacuuccaucuugcaugggggagcccccaguagagcccucccugggcagcucagcuugccaccaaggaggucacuguagacucccagccucuugccucagccccagcuccagucagagccuggaaaacccuccccugucccucugagggcuguggccauuuuuaacccacccuauuccaaccaagaugguuuugucaagauuugccuucuguagcuugggcgauaaaaacaauggguguuuugguuuuggaagggguguugcuuucuaaauaccaaagcauuuugugacacgaaugcgcuuuuucaaggugcacucaccccucgugaugaggaccccugggugacaaugggucagugcggcccgggggaggcuggugccccaggauugguuccugggaugcaccuuccaggaaggcugcccugagcugugugguaagggacucuggccacagcccuggagacugucagggucccccagauggccacaccacagcagcccugcauccugccaccugcagggugugacccccuacagccgcuucuccaggcuagaaaauccaugccuugcagggaaccugguggcugccgggcuucuccacagagccauggagccagaggaaccuccuuuugaucucugucccuguccggcucacugucccuucacugggauuugucauguugugguaucacccucugcagaucugggugggugaguggguagggggagucacaucuuacaaaacagaaaccagguacucugcagaauagaagauggucgcgccagugccagaugcauaucuggagccuggcuucaaacacuguguggccuugggcauguugcugagcuucucugagccuuagucuucccaccuguaaaaugagagucauaacagagccaggcucagggcugucucuuacuuguuaccuuggggucuuucuggaacaaggcagacuuccgugggccagauugguucgguguguccuagcuaugugugauaucaggcaggucacuuuaucugugccucaguuuccuuaccugcaaaaucgggcuaaauacaguaccgacuacauggggauguugugagaguuaaauuucuuacuuuacauaaaagguuauaguaaguacuauagagcaggagcuauuauuguuauuucuggaacgccugaacucagauuaaaacguccugucggcacacaauauccucuuuuuuuaaaaucacacaauguguaacccacucuuucuguagccuugcccacugugugcugcugucaggcagcugcugugugccaggcaucuggcugggcaugcccgaggcaucgugguauggguuaugggguggguguccugcgugggugggccgcgccaaaugcugugccugucucuccuccaacggucuggugaggugggcagggacucagguuaaaucacccugggcagcagccaggugugggagccagccgacaaggaagccaccuggcagcucucccuccgagggaggaucuagcaagcucaggcuuguggcgguugugggcauccgagacuguuuugugcacuuguccaaagccgacugacaucugagcauugguggcagacaacugagaggagaguggcaugagauuuccccugagccuggcaccacacugugcccugagcccaccccaccuucaaccaugucacggacauguugaugaugaaauacucaggcucauucagugaggcccucugccugggccaggccuugugcugaaacagcuugcaugcaugaucucgucuagucuuuguagaaaccccucaaaguaaauccuuauuccuauuuuauggggagaaagcugaggcuuggagacauuuuggagucuuccaaaucuguguagaaguucuaguucuuccaguugccgagugacuucaggacagcuccuuaaccucucugagccucuguuuacccacuucguaguggguagcaaaaguucaaugagacaguguagcuaaaacauuuagcuuggcaguuugcguaguaagugaucaaaaaaaaagcuguuauuguuauuacuauuguuacuaucuuaucuuuuugcaaggugauauuccuuaccaguuuaaugauaccaacaagauuugaaguggaugccuugauguuuacagaaagggguuauuuuuuaggaauaaaacacuuuauuuuuauuauuauuagcaacagauaauuuuguaaguuuccugccuagaggggacacuccucuuaccuugacggucuuauuggaugggggugaagcuuuuucuauuucauggauuuuugccucccucacugggaugcuuugagcaaaaggucugguguauaguagaugcucaaccaaugcuuguuggauggguggacaagcggugcaccaugcucacuguggcuaacgggugauuggguucgggaacgaccuggcaguuucccauaaacagggcgccugauggaagcaucuucccuuugcagaguuguuccugggugcugggaacauaccuuggagucagucacuuaacugagugugauggccagagauaaaggagcuggcaggaaacugagaugcuaucucucaacucgaagaccagggaauggguuagagggagugaauaugaccuugacagacaggcguacaucaacugugagggaaacuucauucauucauucauucagugaacauuucugugcucagugcugggaugcaaggagaugcccuguuggggccaagugaaagaagagaacugguugaugcaugaaucucaaauagacuuuucagggacuuugucacacuuggggaggaucuggggccacugucuacuauaacaggcaggacucuuacgguucuaucugagagaaacuuaucuggagucaacuuaaacaaaagaaaauuuuuauuggcucaugugaccugaaacggucaggugucugccuucaggcauggcuguauccagcugcucaaaugguguuaucucauccuacucagaucuuggcucagcuuuuccccuguaugggugggcuuuguucugagccaggauucuccccuggcagcuguuucaccaccuuggcagcucccagggaaagaaagcagcucuuuccuaggcuuuagcaaauguccugggauucccccugauuggaccaacuuggauccaugcauuugcccaagccguuccgaccaccuggaaugucuuucuuuuaccuaaaccuaaccuauuugugcuuugaguccugccuaagcgccacggcuacuacuaaaagccuccucucuuucugucuuuauuguugucugcauuuucucucucuuggggcacaaucaucuuuuuuaugucuucuaauuccagcauguccuggcugcaccauguucauguuagguagacuaggguccuucauaggccaaagcuuccuuuuucugccuuucacucuuccccccucacauaguauaaaaaacaggauccguguugaaugcaugcauggauuuggggcguuaagaaggauuuaaucgagaagccaaaucucaggauggcucaugggagguuugugggcuaacaaaguccaaagagaagcccaggaauuaucuucugaaccccaucauuugcagaggguuccaaagcuuuggauagucacacuggccagguggggagcugggaaaaggggaagagccugauucaaaagccagguuucccugguucaaauuccagcucuucacccucuggcugugugaugcagggcaaguugcuuuaccucgcuguggcccugguuccucaucuauaaaaugagauaauucacacaacauauugaaggaaaggaucuggcacgcaguauggacugcuggccauuaucuuuauugcuggguuguuuucagagccgccaggccagaagagggguuuuaaaguccguuccugguuaccagaggaggaaacagcagcccauugagcuucagagacaccugcaaguucauggaacaccaagagucagauuggccccaccuggugaccuugacgccuuucaggaccaccugggcucgcagccagcuguggcccucagagaauguggaugcuucuuuugaagaaaggacagggauagggaggggacccuguggcucccauauuggaugaauggggcgugagucuuggugguucuacccgaaacacucuguuucucccagcccgguuuucccaggcaugccuuauaaccuguucuccucuaaggagccguccuuggcugaucuguccagggaccugggcucaucgcuauccccagaauugacucgggggccacauugagggucagggcccugcgcuggggugagccccguucccuggguagugaccuucacugcuucuggugcuaagauguauggccugccucuccccaggcauuuauuucugccucuucagaaauauuugggggugauuaaaaggaaauauucauuuaacuguaaugaaaugggguuuggggguuuuggaaugaucagccauggccucgggggcccgaugcugguugauuugaucacugaguugauaggcaauggcuauugauuucuguccgccuccucccaggaaggggcugacggaagaggugacucagcaaaggggagauguuuugaaauucaggagagggcuagugugggaagcuggaaagcucugugugugugugugugugugugugcucacgcacgugugcaugugagcucucccugccucuccagagccuauacugcacacccccagggagauggggaauguagauugcuuccucuccagcugccuuucccaggaguaucaggagaauaacugggacuuuggagccacacagaccuggguuugaagccugcaucugucauuucccagcuaggugguaaccuugugcaaguggcuucaccucucugugacucaguuuccucaucuguaaagugggugaacaguaauaccugcugcauggcuguucagagacuuaauugagaauuucucuaaugguaauucauggcagcucugauuucacugauauuaacuaauaaugagucuuuuuuuuuuuuuuuuuugagacagagucccucucuguugcccagguuggagugcagugccaugaucauggcucacugcagccuugaccuccugggcucaagugauacucccaucucagccucuugaguagcugggacuacaggcauaugccaccacgccuggcuaauauuuuuauuuuuaguagacauggggucuugcuguguugcccaggcuggucucaaacucuugggcccaagcgauccccccaccucagccucucaaguagcuggaacuguaggcugguaccaccauaccuggcuaauauuuuguaaggauaggguuuugccauguugccuaggcuggucucaaacuccuggacuuaaacaauccauccaccucggccucacagagugcugggauuacaggcaugaccacaguuggaacuacaggcaggugucaccaugcccagccccagcuaauauuuuuauuuuuaguagagauggggucuugcuauguugcccaggcuggucucaaaccccuggacuuaagcaauucacccaccuuggccucccaaagugcugggauuacaggcaugagccacugcccccaguccuggcuaauauuuuuauuuuuagaggagauggggucuugcuauguugcccaggcuggucucaaacucuugggcucaaguaauccucucaccucagccccaaaguauuggaauuacaggugugcaccaccauaucuggccuaauaaugagucuuaauuccugauagaaauaagaaaagguaccagguaggugccaaggaaggggugauagauuuugacugaggcaauccuggaagacuuccgcgagaagggccuugaaugaugacacuuccaacaacaugugacagaaaggggugggacagaaaacacauuucuguuucaggaauucauaggcacaaaggcagggaggcauagaaucucuggugagauggaagaacagaugcuguccauuauggccgggagaggaaagaaggacaggggacaaccuggggacagggagaggcaaggauguaguggaagagaaguguugggcuuugugucagcagcucaguugauaggguugcuggacaggcugugugcaggcaaggcccacaugguggcaagauuguugcauuugaaauucagaagcaaugauaacacgcaaugccaccuuccauuggcuggacagugugugccaggcauugcguuaacuuauaccaucucauuaaauccacacuucuguccccauuuuacaggugaggaaacugaggcucuuuguaacaucuacagguguacccaaauguacaguuuuuggugacagugggccaugucccuuugaaucacaccuaaggucugccaagaccccccgguggccuuccugcucuguggccaagcccacaggccccucacacagccugcccaccuggugugcaccuggaguccuugagcccauguaaguuucuccuuugcaggaacuuuuuugacaucugacuggggugcauccauucuucuucaggauuuccugccucaucuaaucaggcaaagaugucauguacaugucacuuacaauucuuuucuccauguucccagcuaaguucuucuguugccucagggaguuccgggagcugcagguuucaccuggggagggcccagugcugcaguucccaccguauucuguucuugcuggcucuaggaaguugggaguauugggacaugugcccuggcaggcagaaugcccguccucuaggugagggagcagagggugcagggaauggaaaggucugggauggggcuucuaaguuacagugagaaaacaaaugccugaaauuaaaauucaagaggaugaaaagcaaauaaaugagauagggcaguuagggaaagcuuuggguguaauuuauuuaaacuuuuuuuuuuuaacuuuucauuuugagauaauuucaaaaagacugacaaaaaguuacaaaaacaguacaaagaauuccccagauucccugaaugcugacauccagccuaaccacaacacaauuacaaagucagaaaaauuaacguggcugaaacaccauuacauaauggacugaccugacucaaauuuugccaagugucccacugaugucguuuuucugguccagaguccaguucuggaucaugugacgcauggaguuguuauuuccccauagucucccuuaaucuccaacaguucuucagucuucuuuugucuuuaauggccuugacacuuuugaugaaaacuggccauuuaucuugaagaaugucccuccauuugagaaugcaggguguuuacuuaugauucgauucagguugugcauuuugggcuacaggagugauguuguguccuucuccaugcauuggaucaggaggcaccacugcuguuaacuuuggucacuugcucaaggugaagacuggcuggauccucugcuguaaaauuauuauuuuucccuuuguaacuaauaagugcuuguguggaaacauuuugagacaauguaauacucucugucaucauucuuuugcccaauaauuuuagcaugcaucgaugcuucuugcuugaaacaauuauugcuaugguguuugccaaauggugauuuucuguuuccgucauuacuucuacauuuauuaauugaagagcuuuuuuccuucuuccccauuuauuuaucuauucaguuuuuuauuuauaucaguguggacucagauucauauuuuaaucuguuuccccucucucucugccaccuccauacccacugucucuacccacuaucuuuucucucucuucccccaccccaucuccccucucugucuccacccauuuucccccuucucuuugccccacucuccucgccccacucuccucuccuucacuuucucuuucucccucucucucucuuuuuuugcaacuuuuuuucuugcugaagaaaucaggcuguccuguagagcuucuguccauuggguuuggcugagugcaucuucauggugucauuuaaugcucuccuccauccccugggucuccugugaacuggugguaaccccagaggcuugaucagaugccagauugacauuuuugccaagaccacauugcagguggccacaugcccuucugguagaggcacacgaggucuggcuaucucccuuucagggcauggagauugauugguggguucaggagcugucagccgguccauccauugucaaguuucccaucagcuuuucaucugcuggguuucaugaccacugauaaucauugccuggguccaugaauucauuagggguugcuaaaugugcuuacguucuuccugucccucuuucucucucuuagcugggcaauuuucucuacagggaaaccgccccucaucaauuauuuguuuacccugaaggaaaguauguuuacaaaagggaagauagaugcuuaaaucuuucucuuuauuugcugguuuucaaaauaaugagcugguucccuaacauccuccaaagguggccuacgagaguuuuaaaaaauaucauuguaagcccauaguugcaaguguaacagaagugucuuaauccauuucaguuacugcccuuauuuaugcuccgacugucccaucucuggcaugugggggccucugaccccucuggacugccccagcgaccuuggaugcccuucuugcuuucugggaggacaaguugauccaagcucauuccauauguuucccaccucagucuuggacucaggcuuugcuccagggaucccuggacuaaugguauuuagagaccacagucugggugcugaaagaacaaauguacaaaacaucuguuaucacacagguuggggcauuuuugguaguccacaguggauaggaugguggagaaggggaaaggcaauggcuuugaucuuggaucucaucucuuuccuaacccaguugcagguuaaugagccacuggaaaccauuaaauuacuucuccaacuucuucauuuagaaagcaaggguggaucucccccgaucucuaacaacuucuuuuuguuuuuugguuugagauaggaucucacucuguugcccaggcuggaguucagugguacaaucauagcucacugcauccuccaacuccuaggcucaagccaucuuccugccucagccuccagaguggcuggaaccacaggugcccaccaccacacucaacuaauuuuuuuuuuuuuuuuuuuaaguagagacgaggucuugcuuuguuguccaggcuggucucaaacuccuaggcucaagcaauccucccaccucagccuccugaagugcuucaucuccagcuucuuaauuaguauuggcauuuuacuggggaaggucuuugaggucagagacgcccauagacaaccaaggccacuugugauccauccauccccaguuggaugcuacaugcuuuuguuuugcuacuugacaugauacaaucuagcacaaggagcuugucacugcuguuugccucuuagcaucuuagguuugagggguggcagacaacaagagaguucacugagggaccucuucuucccccagcaaauccagaccagacaaaugccauauaauaucccuucgccagagugacucaaacauuaauacgggccuccaaguguuaccucugccuuuaucugagcaggcugcauucuacauuugagguuaaaacucacauuucauuuuuauaugcugugcuuaauccaauaaugauuucuuguuacaaacagaaauaauaucuuucagcauaguuaaucagaauagacuuaaugcugucacuauuuauuaaccuuuguugaaaagcaagaaguuucucucuaaucugugauugcuggucuugucaggcucuaucaagugaaaaaacaguuuuggcauucauuaaaacagugcgaauccugaaaugacaauuggagcuggaugguauuuggugcaugaaaucuucguuguguucaccaggauaacugagaaggcuggggaggcgugaagggggaacccacacguucaaaggacugaguguuucauccccaagucccucuuggauaaagaaacuguucuuacgaauugggaaaguggggcagaggauggggugcaggggaggggaagggugaggccugcuggugccucuugccagagaaacaucauuaguucaagacaauggcuuuuggccaggcacaguggcugacgccuguaaucccagcacuuugggaggccgaggugggcagaucaccugaggucaggaguucgagaccaccguggccaacauggugaaaccccaucucuacuaaaaauacaaaaauuaucugggcaugguggcgugcaccuguaaacccagcugcucaggaggcugaggcaggagaaucgcuugaacccaggaggcggagguugcagugagccgagauugcaucacugcacuccagucugggugacagaaugagacucugucucaaaagaaaaaaaaaagagagacaauggcuuugaacuuggaucucagaugccucaucucuuucccaacccuauccagcgcuaaugaucuacugggagucauuuauucacuuuuacuccuccccacaacuucuuuuucauuuaguaaacaagguugggucuccccgaucuccaaggcccacauucaguuggaguccaguugaagauguccaucaaagcaaaauggcagccaucagaugucaaacuucuacguuaauagaauccuuuggcagugaucucaacugguaguccucaaacuucagcaugcauaagaaucuccuagagagauuccccauucccaggaauuuaauaggcccggggguacuugaacuucugcauucccaggugaugcugaugcugccuaaagcacaccacacucugaguagcaaggcucugucaaauaacaagaaaacccaacaguacaguuggccaauugcugggccuuucuggacuugaauuacagaguuugagucuugcuaacggcagcaaguccccuaaaggcaaauuugccuuuaaaaaaaaaagaaaugaaagcuuugaacuugcagaagccucuugcaaggggaaacgguucucccacggggcuucuccuuucuuuuucccucaaagaacccacagacauguuucucaggaagucccuguggggucuguaccucccaaaggugauuuggagaaaaaucuaaucuaguaaagaaguccugaugcugggaggccugggcgggauauucugcuaagcaaagaaagugguugcucaggacuugggugagggaucgaggucuguggccaauugaucucuccucucacaagaagggucgaguggcucagugaguuuugcccaugucaacggggaggugagcaggugcuguuaauuauuuaggaagaauuaagcagucuggguggguggguuuuaugcucuguuugguaauaaagauugcugcagaaaggaauuuuaaaauucaguauucucauuugccucauauugcaaagaagccgaaccuggguuugacugguggaagcaucuggaauuagugaaccaccuucuuacagugcagaaaucaauguuugcugcauuaauugcaugaugcugaaaccccgcuuuuuauuucugacucgcagagcuauggccuaagaaaucucucuuaagcggcguucuggggcuuuugcuguuuccuuaaucugucugggcguggggaaggaauugcuucaucauggaggugugacacagggggacguggggggaacuuuuggacaagcugugugcuuuggggaccuaauggggagggccugggaagcccacagcaggacuugaggaucuggcuucucuuagguagccguacucuguccugacuuccaucuccugagaguuuccagcucaucgaguucuuuuagguuaaaauaagccuuaauaaagaaguucauguuuuucagcuggacaaaugucccuugcuucuccuguguuuuauauuauaacccuuuuggaauguggacaccuugauccgaggcauaacuuggccagcauuuuccuaaguacugggucauuggacagcaccacugugcucaccccggcuggguucagcgucucugcagacugagccucagugcuuggcacuuuggacagaaagugacgcguaucugaggauagacauauuuggaggauuugaggcauauuuuauuugauuugagccauauuuggaggaaagcauaggagcuugccagggagggaggaaaguaagggcaucccaggcagagggaacagcaugaacaaagacccugaggccuggagccccgaaguuaauagaguaggagugauggaggggagccgggagggguagagaggacccgcuggggaggagccuaggaaggugcaucaggccuugaccaucugacucagaacuugugauucucuccaguagaugguggcaagccuggcaaagugucuaagcaggggaugagaugacugguggaguuuuaauuuucauacuguaauuuuuuuguuuuuguguauauuccaugagcuuugaccacaaucagaauauggaacaguuccaucaccccccgaaauuuccuuguugcugcuccuuuacauccaacccuucccccacccccuacaccugacaacuguucucugaccacauugcuuugccuuuuuccaaaugucauguaaaugggaugaugcaauaugugaucuuuugaaucuaacuucuuuaauuaauuaauuuuuuauuuuuauuuuuugagacagagucucgcucugucacucaggcuggagugcaguggcacgaucucagcucacugcaaccuccaccucccagguucaagugauucuccugccucagcuuccugaguagcugguacuaugggcaugugccaccacacccagcuaauuuuuguauuuuuauuagagaugggguuucaaaccauguuggccaggcuggucucgaacccgugaccucaagugauccaccuaccucagcuucccaaagugcagggauuacaggcgugagcugccgcgucuggccucacuucuuuaauuuagcauaacacauuugggauucauccacauuguugcaaguaucuguaguuuuuuccuuuuuauuacugaaaaguguuccauuguguggucauagcacaguuuguuuauucauugaccuggugaaagauguucaagucauuugcaguuucuaccaguuucaaauaaagcugcuaaacauuugcauauagguucuuguuugaccauagcuuuuaucucucuaggauacauaccuaggagugggauugcuggaucauuugauaagugcauguuuaacuuuuuaagagauugccaaauuuuuucuaaaguggcuguaccauuuugcauuucuaccaguaacauaugagaguuucaguugcucuacaagcucaccagcauuugauauuaucauuuuuuuuucuuuuucaauuuuaugcauucuaauaggggcauagcaguaucucauugugguuuucauuugcauuucccuaaugauuaaugauguugagcaucuuuucauugcuuauuugcuguccgcaugucuguuuuagugaugcuucucuucauauauuuugcccauuguuuaguuggguuguuuguuuucuucuugaugaauuuugaggauucuuuauauauucuggggaucaguucucuguuagauaggugauuuggaaauauuuucucccaguguguggcuuguguuuucauucucugaaagugcagguaaagaugcugcagccgugaaugucucuaacucugccacacuccagccauacuggccuucuuucaguuucucaagaaaaugaaccucuuuccuucuccagggccuuguccuaagcugugcccucugucuggaauacaccuucucucauaucugcuguaagaaaucuuugcuuagcuccaaagauauucuccuauguuucuuuuggaagugcuguugcuuuagcauuuauguuuggguuugugaucugucucaaauuaauguuuguguaugaugugagauaaggguuugagggucauuuucuuuuuucuuuauggauauccauuuguucuagcaccauuugcuggaaagauuuuauuuaucacuuuccauuguuuugauuccuuuauucagaaagcaaaugagcaucuagguguggaucuauuucuuggcauuuuauucuuuuucauugaucaauaugucuauccuuauagcauuaccguacuuuauugauuacuauaucuucacaguaaguucugaaauuggauagauuaagucuuccaacuucauucuucuguuucaaaguuucuuuggauauucuguguccuuuuaauuuuauguaaauuuuagaauuggcuuuucaauuucuacaagaaacaaacaagcaaaccugcugguauuuugauugacauugcguugaaucuguagaucaauuuggagauaauaaaauuucuuuuuuuuuuuuuuuuuuuuuuuugagauagagucuugcucugucgcccaggcuagagugcaguggcgugaucuuggcucacugcaagcuccaccucccagguucacgccauucuccuuccucaggcuccggaguagcugggacuauaggugccugccaccaugcccggcuaauuuucuguguuuuuaguagagaugggguuucaccauguuagccaggauggucucaaucuccugaccucgucaucugcccaccuuggccuuccaaaaugcuggauaaaauuucuuaauaauauugaaucuuccaaucuaugaacaugguauaucuccauuuucuaccccaugcucuuccccugcuuacucuuacuccucuaucaggugccaguuuaaguguuaucuucucaaggaggucuuuguuaucuccugacucgaugauccagcuccuguuauacccucuggugcccccucuuuuucuucuuggaacuaaucacagugguauuaauaauuauuaaugugaguaucuguuuugcauuugucucccccacuagaccauaaguuccauacaggcaaagaucaggucugccuuguucacagacuagcacacaguaaguugucaaugaagauuuauaaaugaaugaaugaaugaaugaacgaauccccuccuauucuuugacauagaucugagaacacuggcuguugucauucacaguuugaugaauaccuuggucucuguuugcugauggagaacccaagcccuaaucccucaccccuuucuuggccuucugccuaaggcuuaguuccugcugauaugcauuauauguugagaacuccuauucauuugacagguagauguguguaauuaugauuuuuaaaaaugaaauuauacaucuacagagaauuuuuagguaaugauuauaauacagaaguuuaauuuaucugggggaacgaaagauguugcuuucacagcaucagucagagcauuggaaaaaccagugguggaaucuugauugaauuaggcugugcuuauaauuaggaaaugccaaggccugcagaauauugagaaguggugaggacaaagugaugcaauuaagagucucuuuuccccccuuucagcaguuuagaagcauuguguuguuaacuaauugguuuguggaugcuacuuggacuuauagauuucauucuacauuuugaucccaagucaauauauaggcccuggcauuaauuaaauccccagggugagcauuucuauggaagacuuuaggaagaacuuucugagaaggagugugauuguugggacaaguucccgaggcauauuacaggauguuggugauucagagcaaguugagagagagaagaagcccaagaauggagaguccuguggaggacucgacuuuuggaagagaccagagauaguuuacucugaauuggaucuggagcugguuaauauaaacaaaacagaaacucaauuggaauuccuucagggcuuuccugaagagcaaugggaaaaaaaaucuaacuuuaucacaaccagagaucauaauuuccuccaacaauaauagcuuauguuucuauggugcacuaucucauuuuaguuggagaacauucugguaaagcaagggcacauacauucauccuuauuauuuucauaccacggacugugacuggccugagguugcagagcuggcaaguggcagauucaaauguaaaucauuagacagcuaauacugugcuccauuccuuacaccuugccaaugaauucauauuaauugaaguuuuccucuuagaggcauaugaucuagguugaaaagaggguaagagguuuuagaugaauguuugugguuuuggagaauauggugauauugcuaauaguagucaugaauuccacucauugagcaauguaucaguaaguacaggcuacauuaugcugcaguaacaaaagacccccaaauuucaguggcuaaacuuaacaaagcaacuuucauacucgcaugacccauucauuggcuacauguccaucauauaugggcaguggacuuggcucaucagugucucuuuagggacccaggcugauggugcagccaccagcucugaugugccauucaccaugcuagaaguauggagaccucuaagggucuuguaccuaugguaaaaugcuccacucuggaagugacacaucacuuacucauuggccaaaacuagcaacuuggccucauucaaccacaagaagccaauaaacacaaucuuaccuugugcaugggagagagaaauccagaaauauuugacaaaacagcaugaaugaugaccauaagcacucaguaaacaacaaggaguuccucugacccuacaacagaccuccaagaugacacugagagcuaaugguuauugacuauuuaccacaugccauguacuguuuaccuacagagcacuuuuaaccccacaacaauccuaucagguagauacucugaguauuuccauuucacagaugagaggacugagauuccaagaggugaaguuacuugcccaagaucacacagcugaggaagcaguagagccacuuggcuccagguauuugaaugcaggccaagcuuggcuacagaacccauauuauaauaaccccauuuacuugaugagaaaucucaggcucagagaagcaaaccaacaugcccaaggucacacagccaggaagcagcaaguccuaguuccuuugccuuaccguauuucccagguaaaggcugggaaaccucccuuugcaguuucaguuggugaugaccagacauccuuccccaacucuuuccugugcaagugacucccaacucuuggccucugauaugaauucugugcuagugcuaguuuauaucaguucacuagagccaaauguuaaauuugcaagacuuuugcaaacuacuuacuaaacacagauauucaaagguaaguuacauaaacuuacuagaguguaauuauauuucaaaccagguacucaaaacucaucacuuccuaauuauuuuacugcauuuuacuauuauaugcucuuuaagguuauuuacauccaccaaauguguaugguggaaauacaacauguuaaagcaugauagagugccccuguacaucucucccuagcugugcgcucagugauguccaguugguagauugaaauuggccaugaugggaauauuuacaccccagaaauuggcaagcauuaccagucagggcuuuuuucccccuguagauccauuguuaaccauuuaccagcauaccacugccugaagcccccugccuccaccaucaagcuguaccauucgccuccaccaucagccucaauccaggaccaccuggcccucccaauggauccaacuggucccagggccggaccagcuuccaugaggcugcugcauugggacaauaguccacauucauccuugcaaacaugcuagacugauauuccucccccuaagacagugguuagacccuuggcugcccauuaaaaucaccugagagagcuuaaaaaaauacagauauacagauuuuuuuuacaggacacaccaccagagauucugauuuaauuggucuggggugugucuggcuuuugggauuuuuucuaagcuuucccaccaauguggagaaguacaacuccaagcaaacucagugugcaaaaaaacaugggcuaucaaaggagaaaacauguuaggaaaauugagaaaguuugccaugaguuaaaucacccaucuccuaaucugggcuccuaucagauugcaaaaugggugauuuaauucaugggaaacuuucucaguuuucccaacaauaaucuggaaggaacagcagcagagggcaaaccuuuucucuagagggccagaugguaaauauuuuuuacauugugggccauagggucucuguugcagcuacucaccucugccauggccauguaaaaguagccauagacaaucuguaaaggaagaugcaugugcagggugcaugccaguccccaucuauggugucccuuacaggguagccugcccugagauuguucuuaaaaucuauguacauuggcuaggcaugguggcucauuaccuguaaucccaacacuuugguaggcugagguggguggaucgcuugaguccaggaauuugagaccagccugggcaacauagcgagaccccaucuuuaaaaaaaaaauuuuuuuucuucauuaaaaaaauagaaaaaucuaugcacauaauuaccuugaauguucccacugagccaacagauuaguugggucuguggagugucccucuggccccccagauucuugaagcaguuuuaacuguacuuacucaucugauaggcaaaaacguugacuugagcauugauggacuggaaguucuuucaaggggaggaucccaugagucuuguucucucagucuagugcccgaccuuugggucucauguaacaacaaaaaaaugguugcaugaauacacugaaaaaauaaauaacguuuacuauuguuaaaaaacauuaugaacugggcacaguggcuugcgccuguaaucccaacacuuuggggggccaaggcgggaggaucaccugaggucaggaguucgagaccagccuggccaacauggcaaaacccugucucuacuaaaaauacaaaaauuagccaggcaugguggcacgcgccuguaaucccagcuacucaggaggcugaggcaggagaauaguuugcaccugggaggugaaguuugcagugagucaagaucgcggcacugcacuccagccugggcgacagagugagacuccaucucaaaaaaaaaaauuuuuuuuaaacauggagaauugcaaaagggaauagccuggagaauccccacauccccauggccuugcuccaucaugauauugaagucacucuuuugguuguguuucucuaaauucuaugaggacagcaacucucuucauuauccucuauaucauugcuaugcccugguguugugcccgggguacaacacguaguagguguucgauaaacuuggguuggauaaauggaagaaugaaugaaugaugagcuggugcacuuagaugugauuuauaagacuucuagggggaucaccggcuauuacuuagaacuauauugugggucaaaucacgucuccuuccccuuaaaaccacaaauagccgggcuucagcaucugccguggacaucagaauuccugagaaccuucugaaccguguuggcucccaggccccacuccugggaguuguugggcuguugaguagacugacauauugggaagccugguagaaucucacagguguaggaaaaucuagcugccuaggguuauaaaggaugcccuuuguccucaacuccuuugacaccuucucucuggagaccugcugaauaaggaagggaguaaccacaaggaaaaaaaaaaaaaaggcaacaaaaaccaacugguguaauuuaaaccccuucaaaguuaccaggcugcuggagauuagcauagagaaaauaugucgggguccacuuugauuugcaauuugagauaaaugcgggaaacguguuugugcuuccucggagaggauuauguugccuugcaaguuggguuguugucacuuuugauuuuagaauacuuacuugugccuccaguaaugaacaaaaaccaaaccacacugaaaccagcccggggggguccugcugucucagaagcucaagguauuccuguuucuacugaauugcuauuuccagauuccugccugucacccgccagacuuuuaaggguucuacgcuugggcugcaucgacgcugguaguuuauuucagacauaagcaaauugucuuaaaguuguuaccacaaaaaaaaaaaaaaaaaacaacccacaacuaacucgauaucuuauuuuugagggggugaaucauucuuuacuauauugauuuaaugugcauuaauaauauaguccucgcuccaauaaccuuucuaugucacccaguugcccucaaccagaguagcagcgaacucggucaaauuuuagaugcauuaaacaugagcauggaacuuaaacuagaaggcagauucugaaauaaauguguuuuuucuuucuuuuuguuuucuuuucuuuuuucuuuuuuuuuuuuuuuuuuuuuuuuugagacggauucuugcucuaucgcccaagcuggagggcuauggcgcgaucuugacucacugcaaccuccgccucauggguucaugcgauucucaugccucagccucccgaguagcugggacuacagguuugugccaccacacccagcuaguagaggugggguuucaucauguuggccaggcuggucucgaacuccuggccucaagggauccgcccaucucugccucccaaagugcugggauuacaggugugagccacuaugcccggccaauaaacguauuuucuauaaauaguacuuuacccaguaauuggacuuuuaagaaaaacaggauuuuaagauaauuuuucccccauugaaauaugacuguauaaguuauaggccacagaugcuuucaugggaggugucauuauagguaugaaucugacaguucuugaaugcaggggcauuugggguaaggucuugccuuuccaaauucuuagguaacuguucaagagccccuuccaccgagaccuaaaauacaugugcuauuuccaggugcuacgaguucucaaaaacaaaucauuccuaggagguuaaauuccguuuccacagcucauaucaaaacaccauccuccaucccucaugcaguccccugcuggaaguuucugguuugacuggcugacugcucuguggucuaaauauagccauuuaaaaagaagauuauggcccguccaccugggacugccaaaaagccuuucacgagaacucuugaaagccugaugccuuuaauccucaacuuuaauuuaaagaaaucuucucaacucauauuccauuuucuacauucucucccccacccguccuccaugacagaucuuuuaauuuccccuaccccaccuuucauuaccgaggaauaagacucuuuacaaguaguuucuagaguaaggaugggcuaagcuguuuuaauuucuugcaaggauguuuuuauagaagaaaaucaagucaacacucaagaguauacacagcccuuuauggagauggagagaauuaaucaggccagaaaguucggaauauaaaacgggacgggggaggggaaggauguuucaucaaaccgaacugcucugggagaugcaaagauaaaaggauuucccucuccgagugccuuaaauauuggcaggcaguagggucaagauuuuuucuuuuguuguuauggaaagccauacagauaauuaaugcuguugaaagaagauuguucuguuggcgucugcaaggcuggcccccuagucugggaucuucuggaaagaaacaagucagggaaaaaaguuaugcaccaggggagauccugccaauuugcacgagcaauaaauaauguccagagagcaaacagccaccggcuaguugcucguggcugcagauauuugauauggggacacaagucagugcaugcagugaacuucaaauggggcaggggacugacccaccccgcccugucacaggcugcuucuuuuaaacaauaauuauuaaagaaaggaaguugcaacagaagcccaggaagguuaugcaucggcuuugauauuuacaguuuuuauuucuuccuggauggauaacuccugcuguaauuuaaugggcaggaaauguuugaucgccuccuuggauguccgaugcagccacaaggucugggaguccuggccaggccugcugggccccaggagccuuccgugucucuggcugacccaguccugaagggacucagaaaacucaauaaaccccagagugauaacagaaauagcuaaugcuuacccggcauauaguuucuuucuuucuuuuuuuugagacagggucucccucugucgcccaggcugaagugcaguggugccaucuuggcucacugcaaccuccgccucccaggcucaagugauuuucgugccucagccucccaaauagcugggauuacaggugcacaccaccacgcccagcuaauuuuuuguauuuuuaguagagacaggguuuugccauguuggccaggcuggucucaaacuccuggucucaagcaauccaccaaucucggccucccaaagugcugggauuagaggcaugagccaccacgcccagccauuaccaggcacuuuguauguguuggaucacaugcacuuucuauacauuagcucacuuaauuuuuuuuuugagacagggucucacuguauugcccaggcuggaaugcgguggcacagucauggaucacagcaacuuccaccucucaggcucaagcgauccuccuaccuccaccuccugaguaacugagacuauagguacauacccccacaccuagcuaauuuuaguguuuuugguagagacgggguuucacuauguugcccaggcuaauuucaaacuccugagcucaagcaaucccccugccucggccucccaaagugcugggauuacaggcgugagccaccgcgcccagacaaacuuaauccucuuaaaacccacagagggugaugcuccuuuugguccccuuguauuaauaaggaaacaggcucagagggguaaaacacagcaaaagucagagcugggauuugaacccaggucuucuggcucuagucaacauuuuuuucuagaugcagugaaagucacauaacauaaaauuaaccauuucagagugaacaauucaguggauuuaguacauucauaguguugugccaccaucaccacuaucuaggucccaaacauuuuuauucccccaaaaggaaaccgcauaccccugagcaguguaggggccaagggaaacuucccuuucacucucugaagguuccuugaaaaucgauggaugaaaggcaaauucauaggagaaaaggcauacaaauuuauuugaucaucguuuuacugacaugggagccuucagaaugaagacccaaagauacagggaaaacuauucauuuuuacgcuuaaguucagucaaguguggacagccauguagaaacaggauugaacaaaaagauaugaugaaaugcucagacacugaguugggaagcccaguaaggccuaucugucuggauucuucuuggccuccgugcagccugccugccuugucugugugaggcaggacccuuucuggauuggggcuccuaugaccuacagucaaacaaggcaggucagaucauuucuuuauggccaguuuuuauauagaaagguagugggaaguucaaguaauauuuuuagguuuuauggcugguuuggggaaaaaggaguucugaguucuuuuuuucuuuuucuuuuucgacuuuuauuuuagauucaggggguacaugugcagguuuguuaccugcuuaucuugccugaugcugagguuucagguacaaaucccaucacccagguaaugaguguaguacccaacaguugguuuuuugacccuugcuucccuccuucccuuccccuuccagggguccccacugucuauuguugcuauuuugauguccaugaguaccugauguuuagcucccacauacaggugagaacaugcgguauuuagucuucuguuccuauguuaguuugcuuaggaaaggguucugauuucuaaugauucaccuuggggaagaggauucuaguuucuguggccagucucagagaaugagggaccagagacaggagggcaggagaaguccggagaagaaccuuugcuucugaggcugcuuuugaggccuucauuuugggguaccauuuucugagcccuaacaggagcaacuccccauucucucagccccuaggagccaccaguuuacauucccucucuauggauuuaccuauucuggaauuuuuuuuuuuuuuuuugagacagagugucccucugucacccaggcuggaguacaguggugugaucucagcucacugcaaccuccgccucuuggguucaagcgauucuccugccucagccaccugaguagcugggacuccaggcacgugccaccgcaccaggcuaauuuuguguuuuuaguagagacaagguuuugccauguugaccaggcuggucuugaacucuuggacucaggugaucugcccuccucggccuuccaaaguccugggauugcaggcaugugccacugcgcccggccuggauauuucauauaaacaaaauccuccacaguguagccuuuuaugucuggcaucauguuuucaagguucauccauguuggcacauggaucaguaauucauuccuuuuuauggcugcauaacauuccauugccuagauauaucacauuuuauguauccauucauuuguugcuaggaauguggcuuguuuuuucuuuuuggcuguugcaaauagugcugcugcagauuccgcauggauaggauaaugagggaagcagagcagaugugaggcuuuagggagugguggagacugaggcuaauuagagaaugggcacccaggcaaauggcucugaggauugccagacaggagugcaagcacaguguggucagaucuuccaauuuuuuuuagagaaaaugaaaauuuagaucuuuauguuaaauaucugauauucaagaaaaagcagaaacuaaacgaaacacaucugcaaaggccaaaugggccaccggguuaugaacuauauuaggguucuccagaaaaacagauucaacacgauguauuacguuuguuuguauguggggugguggcguggggggggcggauuuauuauaaggaauuggcucauguguucauggaggcugagaagucccgaggucuuuuuuuuuuuuuuuuaagauggagucucacucuguugcccaggcuggagugcggggacauaaucuuggcucacugcaaccucugccucucagguucaagcgauucuccugccucagucucccuaguagcugggauuacaggcaugugcuaccaucccuggcuaauuuuuauauuuucaguagagacgggguuucaccauguuggccagucuggucucaaacuccugaccucaagugaugauccacccaccuuggccucccaaagugcugggauuacaggcagaagucccaagaucugagucagcaagcuggagacccaggagagcugauggcauaauuccacucugaaggccagcaggcucaagaaccaggaagagucaguguuucaguuccagucugaaggcaggaaaagacugcuguccuggcucaaguagacaggcaggaggaacuuccucuuacccgagggagggucagcuuuucuguucuguucaggcugucagcugauuagaagaggcccacucacauuaggaagggcugccugcuuuacuuggucuucugacucaaauguucaucucaucuggaggccccgucacagauacccccagaauaauguuuggccaaauaucuggcuaccccaugacccagucaagcugacacauaaaauuaaccaucacaaguccaccccuugucaacuuggcacccauaugcaucuccuuaagccauguuuaaucuccaaguaaagauaauaacaaggucauaaucccacguaaugugauacaacuauccuguguacaaccaaaaaugcacuaacuccuuccuuggaagaggaaguaaaggacuucagugauguuuacucuuuuccuugauacccuacagcuuaaauacugugauguaaaauuaacaauauucaaguaccguaauauaaagucaauauaucuuauguuaccuaauaagggaaugagaagaaagaaaacaaagauaauugcuuaauauguaucuuuauacacacacacacaaauaaggaggaaauacucaugaaaauuacaguccucaguucuguaacugaucauguggucauagcugguauaacuacuuucuuccacuuugggguucccauuccauauucccuuggccuucggcaaacaacucaacuggucaugguucuuuaccugggcaagugacccaacuuucauuccugaagggucugggccauuagcaguccugccuggacuggguuguaguuuuccauugaccuuaguuugucacagggcaugguaaaacuaagggaucuccuauauuccaggcauucuuucuuacccccauuguggccuaguuguccagugacccucugauagggucgucacaucagccagcacaguaacucccuucuucgccuguuguucagaggcaugagaaucccaaaguggccagcuaacagucuuaacuuccuuuucaguggaauaaguguaucuccuaguagaaacagucuuuucucuggaacuaagaccucuagaccagcaaaguauaaggccacagaguaagaagcaaacauuuaauuaguggcucuuuacagguguauuaaucuguucucacgcugcuaagagacauaccugagacuggguaauuuguaaaggaaagagguuuaauggacucacaguuccacauggcuggggaggccucacaaucauggcagaaggcgaagggggagcaaaugcacgucuuacaugguggcaggaaagagcuugugcagggcaauucccacuuauaaaaccaucaggucuugugagacuuauucacuaucacaguaugggggaaacugcccucaugauucaguuaucuccaccuggcccugcccaugacauguggggauuauuacaauucaaggugagauuuggguggggacacagagccaaaccauaucaguggguaauagugaguggugccacucccacuuccaccccuugauucuuggaucacaggcuucguccucaaauuuucuugucaccaauuuuccaauuauguuccuuccaagucccugaccaucgaaccaaaccguuaaccacagcccaucaauugcuauagaauugcaggacuggccauuucuccuucuaagccaaguaaacaacuaggggcacugcuugagguucuguccacugggaagauuucccuucaccgcaguccuucagggaugucccaggaaggagcugucugcuugccaguggugccuacauauccuggagaaccaucuguaaaccagguccgggucaauucugucaguuuaucauagggaauuccccaugaggccauaggugcaggcugggagagagaaggcagugcagcaggaauggggaccaugggcauuugggccacuucauguaacuuacuggugccuucagggccugcuugggcccaaucacauauauaccacaccauuugaugauggaaugcugcugugcaugccccccuuuauggcuuggagggucagauaacacccaguucaugauggguagcucagagcacagggucauuugggggcccauggucaagcauucaaucuccacuaaggcccaguagcaaaccaagagcuguuucucaaaaagcaguuaucuauagaugauauagggccuugcucuagaauccuaagggcuugcacugugauuuauccagaugggggccugucgaagacuccagauagcauccuuaucugccacugacaccucgggcaccauggcaucugcugggucauauggcccaagcaauagagcagcuuucacagcagccuagaccuguugcagagccuucuccuguucugggucccacuccaaacuggcagcuuuucaggucacuccacacauggguggaauuaacacacucaaaugagaaauauguuggcucccaaauccaaagaugcccacuaggcauuuugucucuuuuuugguugcaggacuaacuagaugcaacuucuucccuuuaaagggcuaucuccaugugccuccacacuguggagcccuagauauuucacugagguggaaggcagcugaauuuuuguuagauuuauuuucuaccuucuggcaugcaaaugucuuaccaauaagucuaggaucauugggauuucuugcucacaagguccaauaagcauaguaucauaagugucaugggcuagggugaaaucuuguggaagggaaaggugaucaagguccuugcaaaccaaaugaugacguagagccagagagugcuguaccugagcuaggacagugaagguguguugcuggccuugccagcugaaagcacaaugcuuccauccagugggccuuauggaaaggguuggagaacaaggccuuugccagaucaauagcugcauaccaggucccaggagauucaggcaaugaaaccacaucugcaauugggugugguacugcagcugcaauuggagccaccaccugguuaaucuuacaguaauccacugucauucucugagauccaucugucuucuacauaggccagaucggcaaguugaguggggaugugguggcagucaccaccccugaucuuucuaguccuuuauagugacgcuaaucucugccagcccucuaggaaugcaggauuacuuuugguuuacuaauuuccuacauaggggcaguucuuguggcuuucacuuggccuuucccaccauaauagcacucacuccacaggucaggcauccaguguggggacugugucugcuggguaugucuauuucaauuaugcauuccagaacugggaaauaaccauagaaugcauuugggaccccacucagccccacugugagaugaaccugagcuaaaacucuauugaucaccugaccucuauaagccccuacucugacuggagggcuacggugacauuuugggucuccuggaaucaaugucaguucugagccacuguccaguagugacugaauguucugauuacuuccuuuuccucagugcacagucacucugguaaaaggcugcagguuccuuuguggggggcugggagaaaaauuaacaguauaaacuuuuggcaguauaccaagguccucccuuaaggggacccggccuccccuucauucaaaggguucugggucuauaaauuggcuccagucugugaauugauugaggggcugugacacucuguuuuuaugauucagguuaaacuuuugaucccuugaucuagaacuuuacugcucauacagaucaaguaagaauuuaguagguuuccucuccacuucuaggaacaccaucaccaacuaauuaaugucauauaggucugugugauuacacuauucugacugcugcuuugaugcugcugucuguuacagugaguguccccacuuggccccucccacucugggauccaguuauacccuuuguauuuagguuuccaaauucagugaccucaguucccaugguaaggauuggcuuacagagaagaaugaucucagagcucuucaaggaugauggggcucccccaaaaaauuuauuucucacaguguugguugauaaucaugucucugguccuucccagugugggugcauaggucuuaaauaacaaauccacucuacugucccagucuucaaucucuuccuuuuagguccuugaaucucuuccuuuuagauuaaaccaaggcaguuuuggcaucuccaucccccucacugugagccaccuuuugguccauguuucagccaaccaacccaacacaugguuagaacccuuucuaacucccaggcugcaacauuaaaugcagaaucucugcuuaguaugccuauauccauaaauuuagccugauucaauuuuauguuccuuccaccauuaucccacaccuauugccaugcauguuccccagauuucuaucuuaugaauuagaaaacucaaguuguucuuuuggaguguagcacaccucaugggucacuuuuuuuaugccuccuguauuaguuuguuuucacacugcugauaaagacauacuugagacugggaagagaaagaaguuuaauuggacuuacaguuccacauggcugcgguggccucagaaucauggcaggaggcaaaaggcacuucuuacauggugguggcaagagaaaaaaaugaggaagaagcaaaagcagaaaccccugauaaacccaucagaucucgugagacuuauucacuaucacgagaauagcaugggaaagaccagccccugugauuccauuaucucccccugggucccucccacaacacaugggaauucugggagauacauucaaguggagauuuggguuggggcacagccaaaccauaucuuuccaccccuggcccuuccaaaucucauguccucucauuucaaaaccaaucaugccuucccaacagucccccaaagucuuaacucauuagagaauuaacccaaaaguccacaguccaaagucucaucugagacaaggcaagucccuuccaccuauaagccuauaaaaucaaaagcaagcuaguuacuuccuagauacagugggggcacagguauuagguaaauacagccauuccgaaugagagaaauuggccaaaacaaagggguuacagggcccaugcaaguccgaaauccaguggggcagucaaauuuuaaagcuccaaaaugaucuccuuugauuccagaucucacauccaggucauguugaugcaaaagauggcuucccauggucuugggcagcuccaccccuguggcuuugcaggguacagccucccucucagacacucccacgggcuggcaucaaguaucuacagcucuuccaggcucacagugcaagcugucaguggaucuaccauucuggggucuggaggacaguggcugucuucucacagcuccacuaggcagugccccaguagggacucuguuggggagcucccaccccgcauuucccuuuuguacugcccuagcaaacguucuccaugagggccccaccccugcagcaaacuuuugccuggucauccaggcauuuccauacaucuucugaaaucucgauggaaguucccaaaccucaauucuugacuucucugugccugcaggcucaacacccuguggaagcugccaaagcuuggggcuucugcccucugaagccauggcccgagcuguacacuggccccuuucagccauggcuggagcagcugggacacagggcaccaaguccuuaggcugcacacagcauggggacccuggacccagcccaugaaaucacuuuuuccuccuagaccucugggccugugaugggaggggcggcugugaaggucucugacauggccugaagacauuuucccccaugggcuuggggauuaacauuaggcuccuugcuacuuauguaaauuucugcagcuggcuugaauuucuccccagaaaaugggcuuuucuuaucuacugcaucaucaggcugcaaauuuucugaauuuuuaugcucuguuuccuuuuuuuuuuuuuuuuuuuuuuuuuuugagacagagucucacucugucacccaggcuggagugcaauggcacuaucucaacuaaccgcaaccucugccucccagauucaagcaauucuccugucucagccucccaaguagcugggauuacaggcauccaccaccacgcccagcuaauuuuucuauuuuuuauuagagaugggguuucaccacauuggcuaggcuggucucaaacuccugaccucaggugaugcgccugccucggccucccaaagugcugggauuacaggcaugagccacuaugccuggccuguuucccuuuuaagauggaaugcuuuuaacagcacucaaagcacauuuugaaugcuuugcugcuuagaaauuuuuucugccagauacccuaaaucaucucucucaaguucaaaguuccaaaaaucucuagggcaggggcaaaaugcugccagucucuuugcuaaaacauaacaaaccuuugcuccagguccccacaggauccucaucuccaucugagaccaccucagccucaaccuuauuguucauaucacuaucagcauuuuugucaaagccauucaacaagucucuaggagguuccaaacauuuccacauuuuccugucuuagcccucuaaacuguuccaaccucugccuguuacccaguucuaaagucgcuuccacauuuucaggugucuuuucagcaacaccccacucuacugguaccaauuuacuauauuaguucguuuucacgcugccgauaaagauguacccaaaacugggaacaaaaagagguuucauuggacuuacaguuccauauggcugagguggccucagauucauggcaggaggcaaaaggcacuucuuacauggcaguagcaagagaaaaaaaaugaagaagcaaaaacggaaaccccugauaaacucaucagaucucaugagaguuacuaucaugagaacagcacaggaaagacuggcccccaugauucaguuaccucccuuugggucccucccacaacacgugggaauucugagagauaaaauucaaguugagauuugggugggggcacagccaaaccauaucaccuccccuuuaggggccugcugggaauucagucuaguuacaagucuagaagcaaagaggugguugggggcgggggucuuuaggagacuuaggauugucuuguauggcagcuaccucaggggaggcuguaagaguuuccccaggcagugcaggguuaauucccucaguaggacguggagaggccacuccagcuggugguggggagacuucuuccacuggcaaggaagacucagaguuuagggucucagugugcccagcuucaccagggucuucccaccuguccccauccuaacuuucaggguuccauuccaucacaaugccuucacuuuagcagcagacacccuacaaggcuaggaguucaacuugcauuguaauucagccagucacagaaugagauucugggucugauuuucagcaaucucagcccugcagcuacaggagauuagagucucccucagggcaugcauggaagcuuucaggccauuuauguggcacuugagcugguaacuuaaaucucuaaacucauccuuuucuuuccccauuguguccagagacauuaggaccaaccagccaaugucauuguauuccuaguuugccaaaaauguuucaaaguaucuggcauaucaagugggccuuaaaaagagaaaguauuauggacacugucacccacaugcgugcuucuuaucagugguugauuuggaauaucuauuggagauaguuugcauaucucuauuagggaauaaacaccauggacuaucaguguucucuuuacuacuggaaauagagucauuagcaucuuuauaucuaauugaauuagagagccaaccccagaaaucccaaaaccaugucugaauacucauccuuaaaauucuguuccucucuaaccacuccuggugccaaaaucuguauuaggguuuuccagagaaacagaaccaauaagaucucuuucucucucucucucucucucucucucuguguguguguguguguguguguguguguuucugcugcugguauagucaaaccaaauauguaccuagagcaauguaagcugauauaggugauaaggagaugcccagggagaccaacugaauuuugccuggagaggucaaggaagacucccuggaggaggugacacuugagcuguguuaugaaggauaaaagaggguuuaccagaaaaacugggugggaaagggaacuccaggcagaaggaccaugugugcuuggguuccuacagcuaguucagugugaucuaaacacacgguacauguggggacaugacagggacaugucuggagaguagggcaagguauuuucccuugagggccacagaagccauucagggcuuugagcagagcaguggcugggguucaguuguguacuagaaagauugcucuggggacuguugauugagcaccugcugugugccaggcccuggaguuucaauggcgagacagaaaagguccauuuggagcucuauuuuagagagaaagacuguaaauaguagaaagguaugugugugguccguccacagugauaagugcuaugaagaaaaaaaaaagagaagaaagaauggggugcaggggaggguggggugugggauagguagagcucaugcaguuuuaaauagaguuucacugagacagugacauuugcaccuuugaaggauuugaauaaggcagccaugaggauaucggggaaagggcauuccuagcugagugaaccaccaaugcaaaaugcaaaauggugcagcugcugugggaagcaguuugaugguuucucaguaaguuaaacauagacuuaaccaugugacccagcaauucugcucccaggaauauacccaaaaaaauugaaaacaggugcuccaaccaaaacauauacacagauguucacagcagcacuauucacacuagccaaaagguagaaccaacccgcaugugcaucgcucaugaauggauaaauacaauguggucuguccauacaauggaauauuauucagccaugaaaaagaaugcaucucugacacaggcugcaacaaggaugagccccaaacacaaugcugauuaaaagaggccagacgcaaaagaccauguagcguaggauuccauuuaugcaaaauguccagaacaggcaaauccauagagacagaaagcagauuagugcuuuccaggggcuggggaaaggagaaugggaaacagauacuugcugggucuuggggugaugaaauguucugaaaguagauagaggcaaugguuguacaauauugugaauguacuaauaagugccacugaacugugugcauucagauauuaauaugcacuccuacaauuagugucugguugacugaaggaggagugagggggcaggugggugcggggcccgggugaggacuucagccuuugcucugagugagcugggagccucaaagguuuggaguagaggggugaggucauugacuccgacggccacauggggaauaggccuaagggguguggauuggagccgggaccccaugagaaggaugcaggaacaucgcguguuccugcacgugaugagggugggagggaauggaggggugagaagugacgcgauucucgguagaauuuaaagauggagccaacaagacuugcacgugggaagugagagagagagcggaguccacaauuuggccugaacuaugggaggauggagcugcccuuuccugagaugguggugccugggagagaagagggaggauaaagccaggugggggcucugcuuuggggccagagggggcugcugcauugaccucgccagacccaacaggggcaaggccucuugacagggagaccccagcugcauuugagcagccucuggaaaaauugcaggugcagcagggccaggagguuuugugucaagaaauaaaaugacaggcacaucuaugaagcccucagcucuugguugggcacugugcugagagccuuuugcccuucaucucauuuaauugauguagcgucccaugguugcuacaguuauuaacccauuauacagguagauguggaaggcucagagagauuugcccaaggucacccagcaaguaaguggccagccaagguuuggaucucugggagccuggcuccaagacccagccauuuguuugucaggaguucuugccuuccaggacuggaaaggucaaugccuuugaagucagugcaggaacuuacagggucucacuaaacagucucaaguggcugaggcaggggagaguguaugugucaagauuuggucuaagaauccgcuguuuauuuuuuauggcuuuuuuuuuuuuugagacagggucucgcucuguugcccaggcuggagugcaguggcacgaucuugguucauugcaaccucugcuucccaggcucaaacaguucuccagccucagccucccgaguaggugggaccacaggcacgagccaccacaccuggcuaauuuuuuuuuuuuuuuugguagagauggccaucuuggccaagcuggccucaaacuacugagcucaaagugaucccccugccugggccucccaaagugcugggauuacaggcaugagccaccacucccauccaaaauccacuguaaagggacacuuuaaaguccacuguaaaguccacuguaaagggacagaggcaagagaaguauugaccaaguuggucuuagugcugucaccucucuucugcugauguuguuguuguuguuuguugauguugucguuguuguugauguuguuaaauagaauugaaaucagacacuuuggggaaagguaaauucugaaggggaaaaugguagagcauuacuagagguuauuucugaaugaugggauuuuuauaaacuuuauuuauuuacuuauuuaaauuuuuuuuugagacagggucuuguucugucacccaggcacaagugcaguggcccaaucacaguucacuacagucucgaccuccccaggcucaggugguucucccaccucagccuccagaguaguuggaacuccaggugcaugccaccauacccagcuaauuuuuaaauuuuuucauagagauugggucucacuauguugcccaagcuggccucgaacuucuggccccaagcgauccucuuaccuuggccucccaaagcgcugggauuauaggcaugaaccagccaccaugcacagcccacccagaauuugcuuaggggugagcauggggcaggaaugaagcacuggaccaccaauucccugcccugacauugauggcagaacaguggaacaagcucuggucaugacagaaucaggucaccugaguccagcccugcugucuggcuuugggcaagugucuuaaccucucugggcaucuggaaagagaccguauggguaggccaugugacggcucuagccuggacugcugaaaagguggggucuccagcuguaggaaccccuacucccauccccuuuaccccucccacagaggaucugccacugccaggcuggccgaggggaggggcuuggcaugaggaccagcagaugccagucucgcuccacgcacagauguaucugccaguuucugauagggagaagcgaucugggagucgcucacuucauugauaauuaaauucaaauuaagagagauuugcauuuaucaaaagccuguuugacaaggugucacuguucucauccagcacccgggcgcuggggagccagcagggggaggugcagucauguggggguggggagagaggagggguagggguggaggagaggggaaaacaucagagaggcugccugucagcccuucauuauuccagagggucgcagcuccaugguaaguggcaggaaaugcuguguggccucggucaggcugcuugaccuuucugagccucaguuuccccauggcagcccccaggguucccuccuccauggacugcuaccauuuggcuucugcuuagguuaagaaucccccaucccuaccacccuucuugauugaaugcuaggaaggagagccauagaaucuccaggggacauuguugguggcccacccagaccccuuugccaagcagcacccauccccgcugugacuugacuguucuguucuccagggaauugcaagauguuccaucccaucccacccuaggggcagcccacagccccugagugacuugauucaggggaagaguaaaagccuggcccgcuucccucaaguugggacugcacuaugguaccauucaccccacacagcucccaggggcgacacuggacucucgcugagcccacauuuccacccagcuccucuccugcccccaccugcuucccuuacuccugccagcuuccucuugagggcauauccccgucccccaauaagucacuagcccccagauccccaucucagcccccagagaacccgacccaagacagaaucccaucuggacuacaggcccgucuuugaucgccaugugaccuccagcagguuguuaaacucccugagccucagggacuucguggggggcaugaggauaagauagcccucacucuuugggauggucuacgaggaccaagggacaugauggauuugacauuccuucuuguaaaccagaagguuucauguaacuggaggcucucuuuggagaagagagaaagauccugcuggcccgagugguccacaagugcucaauaggaggagaauggaugggguuugggagagaaaggagagggguaugugauggggacauuuucugccucccuggccugggaugagcugcagagaguggaugaaccacagauggcauuuguggcaaagguuugagcaaugggccuauguucagaaauaaugguggucgaaguuguggucauggagaucguuauuuuuccagcacugcguugggacagauacuuuccaaccccucagaggaggcucuucuaaggcagcgggcauuucuggcuuuaucugauccagcaucaucucagccacagccagcugcuauucuuccuugggaggccuuuguaucaugaacaccugauugacaaaaaucugcuauacaaaguggaugaacaaaggaauaguuguaugcacugcauacaguucauccguuccuuccauggggcugagcuucccaaggucauggcaaauaggauaagcguucagaacaauuuucucccaagaacugccuacugugucaaaggugguggacccaccuucacucugcccgagagccacuuggacuuacagguccagauguuaaaaucggacaaacccaggugcuaauccaaacucagcccugaacuagccgugugaccuuggguaagucacuuccccucucugagcccccaucaccuggucugugaaauggggauauaaaugagggugguuaggaggaucagugaggcagucgugggaccugcccuacaguguaaaugucaguauuuggcauuuccaguaacuucucuguucuuuuucuucccucugcuggcuccacucccugucccucacuguguuccuuaaagacauuuuuucaguguugaaaccuuccaggucagcgcugcuugcaaaaauagcaaaagacuuggggugagcuggaaacccauuuaacaacuuucugaggaccccugcaaggcuauacagggacuuaauuucccaggcagaggagcgagaacagcagguccuguggccauugaugggggacaauugacaauugaaggcaacucucacuuucucaucaauaccauagauugagcuagcagcgaagagauuuucagaguuuuauucuuuuugugagucacagcaccaccuaucaaauugagcacccccucuugaucuaggaauauuaguacagaagauaauauuauuuucccggccauggugaaggcaggucuucagaagcacucagcuuccagcuucguggcugggugcauccuccucuuuuauauuaauagguuucauccacuagauguucuccauuuacacgcgaaacuggaaaaaagcagcagcuaaauauagccccugcacaggcaggcugccgugguccgaagcuaagggaacaggcaaaaucagaauaggggugggggaaugcgcagcccuugucacacuccaguugugacuccaggguggcagaggucccuaacgugaacucgaaagcuguguuaccuuuggcaguuuacacuaccucucugagcuucaguuuuccccucucuaaaguggcaucauuucucuugaugauauuucaguuuuauuuccuuggcucaguguucccaccuggggacgaugccugagaagugagcagggagccucaggugacgccugcaggauauguuucucuggucucauuuuuuagugucguucugaagauugagaggagauggcacgugaagggagauguucuauguggaccaccaaacuuugagaugaagaugagucagauaaagccagaaaugcccgcugccuuagaagagccuccucugagggacuggaaagcauuugucccaaugcagugccggaaaaauaacaaucucagugauuucucaggcccuuugaauuaagacuauaguuuaaauccucaucuuagguacaaauuagggacucaggggcuuaggucaacacacacacacacacacacacacacacauucuucuugguagagguguucuuccuuuugcucuucaaaggagacaaaucuuugguggcaguuaagagaccugugccuguacuuguuugguaaccuggauaaaguauuuccugucuccaaaccucaguuucccuaccuguaaaaugggcacagugcuaacuccucggacuaaacaagaugaaaauaaaaaugauugacauuuauugagcaccuacucuuuaucuggccccaugcuaagccucaucuaaguaucuaagcaccuaagaacagccccauuagauaaguacuaguauuaucccuauguuacaggaggggaaaauggagacucagagagggagugacuuuucccccaggucacacagcaaguaaguagagccaggacauaaacccaacucugggcaauuuuaaagccuagaugcucuugagcucccaagucaugugucccccagugaaugucaaggucuuaguuccaugcaugguaccuaauaggcacccaguaaauauuugcuauggugaccgugacauugauggugauguuuggaaaacuaggcugggcaguggcucacgccuauaaucccagcacuuugggaggcugaggcaggcagaucacuugaggccaggaguucgagaccagccuggccaacaugcgaaacccugucucuacuaaaaauacaaaaauuagcagggcaugguggugugugccuguaaucccagcuacucaggaggcugaggcaggagaaucacuugaacccuggagguggagguugcagugagccaagaucacgccacugcacuccagccugggugacagagugagacuccaucucaaaaaaaagggaaaacuauugccugggggcagggcaauggaauauaggaugccuuuccuagcaagauuuaucauggaaauuuguaaauuuccauuagauuuccaaaugggaaggaucaugcugacaugagccacaugcaaaguauggccccuccaauucaaaauaaaagggauguauuuauauauccacauccucacauuuugguaucucagaaaccaggcagaauacugugaggcaauguacaguggcauaaaagaucgucccaauuuaauccaucuaucuaguguuccaucuaauuacuauauuagaaaagucuucagaccauguauugaacauuauaaaugggaauaaaaugauucugguaauggcuuaauaaaacaggugagguagcuccgucugucugccuguauccuuggaccauggccagacugauuugucagggaaggaaaaaaaaaaaaaaaaaacagaaaugggcuuguguuguugcacuuuggagauugucuccauuaggggccuuugauuuuauucuuguuuuuccuuaugagaagugcuuaucgguuccuuuuguuaacagcaaaauauguagaacugauggaaaaacugacagcagccguuucauauuuuauaaagcugcucccggcuuguaauuugcugguugggaugaaucgaggaacccugaaacuccuggugaauuucuagcugaugacugcagucucauuggagggccuguguaaccgcugggauuuugcugcuguggggagcugcagcugggggaggcagagagagcccagggucaagaagcgaugugccaaucacagagggcuggcauugcccaaucagaagggaucugagauccauguguauuagaucgccuuuucuccgagugccuagaagguguucgcuuuuuuuggaaucucugaggccuucuguaucuaucaaaaaaggacuuccuccuucucucucuacaaaugcccacugucuuugcacuuugugccaugaagucuccuguccccuuuccucaagagcugccauugcuacugagacuugacacauccugucugaauuugcuccuggcuucggggcugguauccagcaaccagcaacaggggggccacaugacuccuuggugcaaaucccuuccagcuuccaaggagcugcacuggaugaaggagcaaaaaacgcccuucucccacaagugccuuggguguuuccagcuccaaacucuaauuucugccuccaaguagacuaauaugcgggugucggagguuaaauuccagcgcaucaaggaggugcccauuuuucacagagcccugucauucgcaccaggcgucguccacguugucauggcuacacaggcccgggaccccagagacgggagugcagaauuaauggcagucccgaguaaaggauuccugucuuggcaagguugauggauuacauugauguaccauuugucauacuguaauuguucuggcaaauguaauacccacuaguauaaacauuguacugcuuugcuaauaaaacccaaaauagggagagaaaggaugauacaguguuaugcucacuuaaagagacaaugccgacuuuccaaguuggagcucacuucuuuuucuggaggccucgccgccugaugccuucuccaucaaugugcgucccugugcuaagcacuguccaccacccggcuucccugcaugccuggcaugggccaucugggguguguggggggguuuuuuucuuggaagcucuggggacucaguuucccucucugucagcaccucccaggauuccucuugggaguuguugcccaaaaccucuuuguguuuccuuggugccugcuugacaucacuagcagagucuguuuauccaaacugacucggcauucaagccucuccucugaaguggcugaugccuccaagaagcccucccugaccagccaggccuucuccaaauucucagacauugcucaggccugugugacaggcaguggaccccccacugccuggugccuguacugcuguaugauccccccuauuagaucaugaggucuuuaaaggccaggccugggccuuuaauaucuccaucuccuccugucucacuaaugaugcccagaacuguguuugggacacagaaggugcuuaauuaguucucaauuauugacucacugguuucccauugggcaugagaggcuuaacugagcagcuucauuggccuaucucaaccuuucaggacccccagacacccacgcugccuuuuccggagccaucaguaaaacccugcuuuuccuccuauucggaacgucucuuuuggccucugccuggccuuuauccaugaucuucccggucacuaggcugccuuuucccagcuuuuuagcugauuaacucccaacucaaaugucaccucuucuggagagccuccccugaccccagauccccacacuggguuuguggggggcuucuccuugggcuucacucugcagaagcacauaucacagugggggacaugcauauuuccucuccugugcaucacugagggcaccucugugucacaucucccucgugcucagcucuggagcccaagcauccagcuugaaauuccugaaugcuuaaagaugaacgaaugaaugccuuuagcuuaccacugcuguccguggguugagcuaugcuuaaauccccuuuguugaaggcagcaguugagggugaaauugggggccggggagggggugccuauccaaggaucuuuaccuggaggccugaggauggaagacugugggccgggcaguagcucuuucucuugucacugggucaggcugugagugagcugggggugggcucucuggucauaccuuuuuccugucccaccgucuuccaccugggauaggcagggcagaggcuucugcugggaacuuggggagugcccuggacgcagcuuggccuccaucuucuuucaucucaccuccuagccuccaggcugaguuucugcuuucccaagaagucuucugagccauaagcauugaucuuucugaucccugcaacccucuuuccucgagcugucagggcacagggacagaagggccugcacaggaucugugaucucauauaaugcuuguccaggcguggcuuggcuuucauguguuaacaugcaggauuucuuuacucuguccaaacccccucuauccauguggggugagcccauggcccuagcaccuucugagguucacuccuaugaggaauguauucagcugcaaguaacuggaaacccagcuaaccagugccuuaagcuucauucauuuauccauugaaacagggucucacucugccauccaggccaaugauuggaguacaguggcaugaucauagcucacuguagccucaaacucuugggcucaagcaauccucccaccucagccucccaagcagcugggaauacagguauacgccaccaugcccaacuaauuuuuuuacuauagagauggcggucucccuaucuguugcccaggcuggucuugaauuccuagccucaagucuuccuccugccucagccucccaaagugccgggauuacaggcuagagccaccaugcucggcuauuuauuuauuuauuuugagacuccaucuugcucugucacccaggcuggagugcaguggcgugaucucggcucucugcagucucugccucccagguucaagcaauucuccugccucagccucccgaguagcugggauuacagccaugcgccaccacacccagcuuuuuuguuuguuuguuuguuuguuuuuguuuuguuuuguuuuguuuuguauuuuuaguagacgcgggguuucaccauauuggccaggcuggucuggaacuccugaccuugugauccacccaccucggccucccaaagugcugggauuacaggugugagccaccacacccggcccuggcuauuuauuuuuaaacaaacuuuguauuuagagaaguuuuaaguucacagcaaaauugagcagagcauauagagaauuuccauauaugccucgccccuacacggcacauucucuaccaccagcaacacgcccacccaagugggacauguguuauaacugaugaacccacacugacaccucauuaucacccagaguccacaguugacauuaggcuucacuguuggugguguacaugcuauggguuuggacaaauguaugacgacguggcuccaccauuguaguaucaugaagaagaguuuuccugcccuaaaaauccucuuguauuccaccuacuuaucccucuuucccccaacguuccugguacccacugaucauuuuacugccuccauaguuuugccuuuuucaguauguuguauaguuggaauuauacugugugugauaugguuuggcuguguccccacccagucugugauacuucugcauggcagccccaggaaaugagaacagaugacaguggggaaagggguugggauagcuuguggguggccaaucuguaguguuugccacagguagauucuguuauuaucacauuuuacagaagagcaagcaaagcgagagaggguuaguaacguguauuugauccaaggacacuaacgugcgggugugagagguuaaauuccagcguggucuagcaugaucaucagaguuuuggucccagagucagaccccguagguuuaaaucucagcuuccccacuaauaauucugugugaccuugauagaguugcuucagcuccuggggcucgguuucuccuucuguaaaaugggcauaauaauagcucuggggccaggugcgguggcugacaccuguaaucccagcaccuugggagguugaggugggcaggucacuuaaggucaggaguucgagaccaaccuaaccaacauggugaaacccugucucuauuaaaaauacaaaaaauuaguugggcauggugucacgugccuguaaucccagauaaucgggaggcugaggcaggagaauugcuugaacucgggaggcagugguuccagugagccgagaucaugccaugcacuguagccugggugacagagcgagacucugucucaaaauaaauaaugaaugagugaaugaaugcaugcaugcaugcucugaucuccaacaugagauuuagaugagaugaacuguggagaauuauuuucagaacuauuuugguagaugcuaacaaagcuggaaauugaaccaguucuaucugauucuuaguccuagcaguguuuggggaggggagaggagguccuagcauuaaucuugcucccccagccagguggcccacucagagcaauacaaaauaaccugggauuuauguccccauggucaacucucaccacauuuguccccacugcccgccaggcucccacugugccccugucuuuucccuagucccugcccaaggggcccccuuucccuggcacaguuccaagcugggauuaagagccuuuuucaaguucaugguucccacccucucgugcucuaggcucccaggauccagcucucauagguugggggcccccagauugcucgauugcauggagcagggugugauaacagagccuggcauugagaggagacaggaugaagauggauggcaagccugcucagagcugggcaccugcaaggcugucacaaggucaccuggcagaggagggagagggcgagggagguggccuggagcagaucucuaugaugccacagcaaagguagcaaaagcccagguaggcaugcccaggaaggcgauguguccagcaggucucagcaaacgaguccuccagggggcccaggcucccagacacaggggcugacuugucaaggagguuucccacccaggcgcccagucauuggccuagcucuagaaauacugcuuccaauacaaugcugcagccacuaugggagacaguaugacaauuucuuaaaaacuuaaaacuagaaggaccauuugauacagugguuucgcuucuugcuacacacccuaaaaauuggaaagcagggacucagccaugcucacagcagcauuuuucacaagagccaaaggguguaaguaacccagguugccaucgguggguaaacagauaaauaaaaugugguccauccauacaguggaauacuauacagccuuaaacaggaaggaaauucugaccaggcacaacacggaugaaccuugaagacaucauacuaagugaaagaaaccagacccaaagggacaaauacuguaugauuccacuuacaggaggucccuagaguagucaaauccacagagagagaaaguagaguggugggugucuggggcggguggcggggaagaauggagaguucguguuugauggguacaggauuucaauuugggaaggugaaaaaguucuggauaguggugauguugcacaauuaugugaauguauuuaaugccacagaacuguacauuuaaauaugguuaaaauuguaaauuuuauguuauguauauuuuacgauaaaaaguacuucuuucauuauuacuacagcuacugcugcuacuacuauuaauacuauguuacugccaccacuaaguaaugcugcagugcguacaugacacaaaguaucuccuguaauuccuccgauaauccugaagaaguagauacuauuaagaaguagguaaggggcugggcccgguggcuuacaccuguaaaucccagcacucugggaggccaaggccagaugauugcuugagcccaugaguucgagaccagccuuggcaauacagugagaccccuucucuaaaaaaauuuuaaaaauuagccagguaugguggugcauaccuguagucucagcuacucgggaggcugagggaggaggauugcuugaccccaggaguuugaggcugcagugagcuaugauugcaccacuccacuccagccugggugacagagcgagacccugccucuaaggguggaaaaaaaaagaagugguagguaaggacacuuaccuacacaaacuuaauaguauugcgguucagagaggcuaaaucauuucuccaaagucacacagccagcagcaaguggccaaacugggccuuacccacagggugucugugucuaagacccaaucuucaaccauaucauccuagcuaagcuuguccaaccuguggccuaggacagcuuugaauguggcccaacacaagcucguaaacuuucuuaaaacaucaugaguuuuguggguuuuuaaagcuuaucggcuauuguugguguauuuuaugugugggccaagacaauucuucuucuuccaaaagauuggacaccccuacccuagaccauccuagaaugacugaggcaggguuuucaaccuugacacuuuugacauuugggcuggauagucuguugugggggguugccuguauauugugggguguucaguggcaucccugccucuccccacuagaugccaguagcacaccgccccccacaaucccaaagugaaaugaccaaaaaugucuccagauguuaccaaauguccccugggaggcaaaaucaccccugguugaaaaccccugcuuuaacgggggcuuccuggcaguacggaggauauuggacagucacucguguuuuaaagccacaccaauccauagaaaucaaucagguugugcaaaagaggucauuugggggcagggguagaggaaaaaugcuuucuuuaccuguugaaaguuauuuuuucacuggagugcaccaucucuucacacccucucucccuuaaaacgccaagacauuuuaaguuuccauuuuggccuaggcuaggcacacccuuacuuguagccugaacaguuuuucauuuggaaauugguuuauuuugcuacaaaaagguccugcucaggucuggguaagugcacagucugcacacacaguggaauuguagccuuuuaguuaaagauguccaggacauccggacagugacuuuguggggugaauaaagccaggaguaauacaugaucauuuugagaaaauguacaugucagcugacacauagagaaaaaccuggaaagaugcagaccagaguguuccaaagguuuguccacugcuacauucccagcgcccuggcacauaguaggugcuugcuucauuacuauuugucgacagcuaaaugcgaaguggcaagacagggcugucagcuuucucuuuguguuuuucuccaucauuugaauguuuuagaaugagcauauauuaacuugauggguuaaaaaaauuuuuuuaaccuuccuccuccccccaaaaaagggccgggaaaaagaaagaaucaugccuugaacuugccuagcuuguccuuccacagugcuccaaacacacaugccccucuugccaaagccacgcaaagaaacaagucugguguuuuaugauccuuguucagcuguguguggguaacacggggcuccgggagaaagcugguucuuuauuucucucacuuugguuuuucccccuugggcuuuuggagugggggaaacacaacaacagaugaguggguguggacaggaaggcaguuagggaagggaauaaggagccugaaaucuucaucuuacuucugccccgggcaggaggcagacggcuggaccaaaucaccucuucaugagcaaccagcgccuauuucuguggcuuccucuuucuguagcuucaggauccuuccagagcugcccaagagcugggaaaagccucggggggugggaggggugggguguguggaggccagggaggaaaauuagaaauuggcaucuuucagggagcaaguuucuggaccacaaagacgagaggucacgucauguuuuauuuuguuauuauuucgcagcaauggugggagggggaaggaaacccccccagccuccugauucccaacaauuccaaaggucuuugaguuuguacaguugcaucucaaacguuuuaaaguuuucaacugaccugauuccuagaaaaagauaaacacccuuccuauguuuggagucauauguaauuuuuaucucuugaccuuuaaauguaagcagcaguaaaaugaagaacuauagcagucauuuaacacuccggcuguacuaacugguuccugccugagagccgugguuuuaaauuggcuaaugcagaauacuugcagagcuaauaauaauucagauuauuccugucagcuauuccgguuucauggguaauuuaguaguugaauaaauuuuuaaaaaaauucauucguuaccaugcgcuguuaugaaucaguagaugguuuaccauuggcagcaguaacuguaagaagauuuaaauugcuacugaaaaggauuugagugaagguaauguuuuauaauguucuaagccauaugcacuacuuucaggccucaucaguuuuacauugauuccuagugaaguguuuaauugcaucaugaaugcaauauaauucaguucuuucugcuaauaugguauauaucucaaagugauauacagcacugacagggagaauucgcaguuucgucuggauuugggagggcagcgagaauugggcaccuacugaaugcguggagggcagacggcagaggaagacgacugacgcuuggcuccaucuugccgagacuuaggggcgguggacugugucugucaccggcucucaaugcugagggacagccagagagggaucugguguuaauuggccuccccuaggaaggcagggagaucucugugcugucugggaggcuccugagggcuggccaggcucgcuccggccaucacagucugaugguucgggcaucuuuguuuccaagcgacuacugaugauugggauuccuguugcuguuuguuuagucauucgaguauuuacugaggaccuacugugaaccaaggccgucagugacccaggagauuggccuggaucgcaucagucauugauuuugcuagaaaccucacgugcucugaagcaaagguuuaagaaagacucaaggccggugcgauggcucacaccuguaaccccagcacuuugggagacugaggcgggcagaucaccugaggucaggaguucgagaccagccuagccaacauggggaaaccccaucuuuacaaaaauacaaaaauuagcugggcaugguagcacaugccuguaguuccagcuaccucaggaggcugaggcaggagaaucacuugaacccgagagguggagguugcaaugagccaagaucaugccucugcacuccagccugggcgacagagcaagacucugucucaaaaaaaauaaauaaauaaaauaaauaaauaaaaagaaaggcucaaaaccucacagcccuggcugguagugcaggcaauagaccugggcgaggugaccagacccugggaccucagcucucagggcaaacuggagcgccuauggcucaucuaaagggacaguagccccacagcuccagcaagcaccaccauuggccuuguguuggcagaguuuuaaauuucacaugagaggcugggccuugggguuucuaugcaaaaucacccauuuuuaaaggaaaauuaaaacauauacacgaugcaggccaaacuaaauaugacugugugcauauucugcccgagggccaccuguuugcaaugucuguuauugggccugauucugcugugaaagcaaaaaccauuugcucuuggggccugaaaaauagacgcauguuagaggcaguagaacucgcaacgccuuggcaggcaggggugcggugcugcgggagccuuggaugugcgugggggacgggggaaggagguguuagcuucccaucuggcagucagggacuggggacaagccgcucuagauggggccugugaggccacuugcugcaucuccagaaacauaaagaaggcaccuucugggaaacagaaccaaagagagaagggacaguguggcuuugggcuuguaaaugggagaugcaggaaaggcgaggugugauuucugcuggucaggaaccccgcaaaacagugguggagauggggugguuauagcuggagcaaaccuuucuuuuuggcuuuuucuucucugaaucccgaaagccacccgagguucagggauauucucacuggggaaggccccuggauucuaguuuuagaggcaucucuggcuuccauccuuccaaaccgcaauguaugaaagcuauugggcgccugcugaaugcguggcauucuuccuggcauucauucauuuauucacuuauuuauucauucaauaagcguauuaugauaagccaggcacuguucuaggugcuggggauauaguggcgaccaagacagauuuacagucaugcaucacuugacaaccgggauacauucugagaaaugcguuguuagucaguuucauugcuguugaacaucauggaguguucuuacacaaaccuagacaguagagccugcuacacaccuggacuguugcuccuagaccacaaaccugaacaucaugcaacugcacugaacacccuaggcacuuguaacuugugguaaggauuugaguaucuaaacaucccuaaacauagaaaagguacaaugaaaauaugauacuagagucuuauacaauggaaccaccauuguauauccauccaucacugagcaaaaugucauuaugugguacaugacuauaccugcccucuuggagccucuauucuacuggagacagaccauaagcaaacauauaguuaagaacacaaauuggcaucacuuacuacugauggccucaccccaggaauguaucucaguauauucguuugcuaggucugccaugaccaagugccacaccuggguagcuuacacaacaaggauuuguuuucucaugauuccggagaccagcaguccaaaaucaagauguuggucggcagcggcgguuucuucuaaagccucucuccuuggcuuguagaugaccaccuucacguucauuucuucuguguuucugggccccaaguucccccuuuuuacaaagacaccaacgauacuggauugaggaccacacuaaugagcucaucuuagcuuuuuuaccucguuaaaagacccugucuccaaauaaggucacauccugaguucuggagguuaggacuucacccauauggauuuguggcaacacaguucagcucuuagcaccccacagagaaagccagccugugugauugcagcaggcucgcuggggcucucggugaaggggacaagaaagcagcaccacauguagugucacuggaauguucuuucuguuaagucccaugaaugaugcaaaagucagaugugccugacgugugcaucccuccuggagcgagacuucagauccgaguucacauguuugcggcaaucugauugucaugcaguccaccaggcaggagcccaggccacagggcuccucccucagccuggcgccacgauguaaucagagccuucuuuuccuccucacucucgaggaaggccagccgggccaccuuuuugaucaucguaaccuugacguggaagaauaauuuauccaugcccccagacaaggaaauugcaaaauauuauuuaugaaggcaagucggcacgucauaauucuggcccugcauuucuggaugugucuggccaagacggggagaugcaguugauguuugauaauaaaaugggaccucgugccugggagauggagcugugcgggaaucagagaggcaacggucuugcaagagagacuccagggaaggacuguuccagaaacugaccugaauuguucuucuguggacucccgggucagaagugguaggacaaaagucuccaugaaaaagcagggaagccagaaugggugggauguuggacaucuguuuggggaggccagagaugugaggaccuuccuuuggggaugacagccuugcuuuggggcacuugggcaguuguguagcacagcgguugugaguccuggcucugucacugcugcugugguaggugcuauggggcaagucaggcaauacuuccaaaucucaauuuguucaucuguaugaugggaauaagaacauaucuaccuuaaggauugccuccagguuaacacgcgauaauacagguaagacauaauugucagugggccugacuucaauuaaguugagugauuaaagaugcagcucuggagcugacaaccuggccuggcaucccagcucuguuccuuacuggcugugugaccuugagcaagucacuucaccucucugagccuccauuuuccucaucugucaaauggguacaaaaagggucucuaguucauacaguagucuugaggguugaaugaaugaauggaaaaaaagaguuuaaaacagugcuugucucauaguaaacguucagcaaauguuggccauuaauauuacuuccugggccaugauucuuagugcucuuucuuugaaaagcuuuacuuggauuuacaagcaccuugucccauugcugaugccaucaaacaacaugcuuaguuuaaaaauccaaacagacuugcacucccaaugaaaauugcaaaauuuugcaaaauuuucauugggaaaauuccucugagcauuggaaagcuucucccagggugaugagguuucucccauauguucccagggaaaccacccuagccucuguccacugcagagggaauggcagacccggacagcucugacugcccgauucacuaaaccgcacacaccaacuccugaaaacgccaccacacgcucucaggcaccagccggaaaguucagccuggcaaguguuuugcaaccucucagcauuuugugguucuaccgaauuagcguuugguauugaauuaguauucauuuucucuaauaugauauaaaaguauaaucacauuagugacuuuuauagcacauuagauuguacauuuggaacacaucccugccugaaacagcuuaaaaaauaaaaaaaaaaaauaaaaauaaaaaccagccaacaauaauaacaagcaaacccgcucacaagcccuggcuuuuccagcuggacugcagcaaccuggauagaaaauucuugcuuucugccuccuggucccuacagagaaagaauuuucauuccaccgcccugauuugugaagcauugaguuuaagacuuuaauagucguuccaaaugaauguuucuuuaaucccggggcagaaacguaggcugugauugagauguaauuaauagcacuaauuacucuucccuugcucuguauccuuucccuccugcccucaucccugcuucccaagaaaccugauggaagcaccaggaauguuccccuuuugcucuaagauguuccccuuuucuuccugcccucaucccuguuccccaggaaaccaguuagcaggcucagagacuauccccauucuaaacuccuuauuucggaauauuuucucugucucccagugguuccuccagggcuuuccagaauguuugauuuucuagaaccuguuuuucagccauccuggugacucagccagucaugaaggugaugcucuaaagaagcagcaguccaucaccugaccccuagcgucuuucucugcagugacagccucacugaugcacugguccaaacaugggaaagacuccugaaggucccugccaccagaugcccaaagcugaggaaccccauucagcagccuggugagcccaaagcacaaccuuagcaaaccauuuuccacuacaaaaaguaaacaaagccgagugcgguggcucacgccuguaaucccagcacuuugggaggcugaggcagguggaucacuugagaucaggaguuccagaccagccugaccaaaauggugagaccccaucucuacuaaaaauacaaaauuagccaggagugguggcgcaugccuguaaucccuguaaucccagcuacuugggaagcugaggcaggagaauugcuugaauccaggagacggagacugcagugagccaagauugugccacugcacuccagccugggcaauaagagcaaaacuucucucaaaaaaaaaaaaaaaaaaaaaaaacagaaacagaaacaaaaaacaggaguaaaacacuuuguacauauuaugaaagaaaauaagcugaucaagggggcuacacugauuuuuuugcacacugcuucauucccaaauagucagagauggguagaaucgcccaguaucagaacagacuuugagggaggcugcauuuugcaugcuaacccugagaauucacuggcagcuuccuggagcucugcguugacaaggauucuuagacugcauucuagaucagcaaaagagagccucauucaaucuauaaacauuuuggagcacuuacuaugugccaggcacuaguugggagaggcugguaauagauacuaaaagaccagcucaugcaaaacucaagcacaggauagaguuggcaucuuauucugaaugcauugagaagcuaugggaggauuuuccuuggggaagugcuaggaucugguuuauguuucaaagauuacagcuuuaaaaaaaaaaucacucuagguuguguauagagaaucaauggaaaggaggaaggaagagaugccaaaaggccagguucaagguuauugcaggugaggaugggugauggauaagaauuuauuugauuugggcuuuacaugaaaaguccaguugaccaaauucaucgaugguuuggauugcagcauaggaguuggugauccauuaguaaugucuaccauggacacgggagguggcagugagcaugcacaugcuacauauuuguuaucucugccucauaagucauucuuagguugaugagagggaguggggaagaugaagaaucacuuagggauaguaguguauagcuuuagcaacagcuacagauauuccaggagauguauuugaagaggaauguucacuggccauuccugcagacauuaagcaaagacauggauuagcacaacauccaugagaccacaugaaugccauguugucuccaccugaaauuguuuaggaaucaguaaagcaacugggacccucagaagauguaaaaauuaaaccaaaucccuggagagaugugcaaaggaccaaugugauuccacagagacgcaaucaggaagguucaaagaaaagaggcaaggcaggaggccaacgauggaacggauaauagaaaaacaguuuucaauuaugucaggugaaaacggaggaucagggauaguccccuucccccucucuuccucaccucacaaacaggaaggaccugguaaggaugggugggguguggagagcaaauagcaaaugaccuacuggaagcaccuuugauuuuuuguuguuguuuucugucaauccccaucuuuuaagaagaaugagcucaagugcgguggcucaugccuauaaucccagcacuuugggaggccaaagugggaggaucucuugaagccaggaguuugaggucagccugggcaacaaagugagacccagucucuaccaaaaaaaaaaaagaauuaauuuuuauuaaaaaaaaaaaaaaaagcucagccaugaucagacacuuggagaaaguaugccauugugugagugggcagugcaaagauagccugggcuggggaagggaaugggacucuggggaggaacagcuguuuugaaagcccggagcaucugcaugaagaugggugacagcagccuggggacccugcauguuuuacacgauuuaaaacaaaacaaaaaaauccuuuaggagaagggaaauguugugagauuauuauauugaauagggcuauaaauguaauuaaaacuuucuacuuaaagaaaaaaaaagauacgagggcagucugugauuuuuggcccggucagcccagcuucccuuccugggaagggucuagaaaaaagcugucaaaucaugagccagucucugcccauguacucuuggauguaacagcagcaguguggccuugggaacaacacucagccacagaaaaacuuauuuccuucauggacagacaggcuggucgugaacacagaggggcgcaggaaaugggagcaaggugcugucccucaggccugggaaggggcuguguggacccccauuucucaagcccagcugguguuccgaucccucaucccacucagacagguguugauaguacccaccugagagcccaacccagcuucuccugccaggauuuuguuguuguuguuguuguugcuggaaacagggucuugcucuguuacccaggcuggaaugcgguggcgcgaucguagcucgcugcaaccccagccaccugggcucaagucaucccgccuaccucaaccuucaaagguagcugagauuacaggugugcgccaccaugcccagcuguuuuuuuuuuuuuuccuagagagaggggucucacuacauuacccagacuggucuugaccuccugaccccaagcaaugcuccugccuuggccucccaaagugcuggaauuacaggcaugagcuacugagcccagccaccugcaaggauuuuagaaauacuucccaaggguucugaagcuggaccaguuugagaacauuuuuggguagcucauuuaaaaauauuaauuuuuuaaggaugcauuauuucauaagcaacugaucuguaauuuuuaaaaaucaagacauuaaaaaugauuucagaauaaacaaugagucuccugaacuuccagcccccuuccggcuauucacauacuucuuauuuguuuucucaggacauuuugacccauaggcaagcaugcaagugcagcccuauuuaaaaacagaaaaggaggccaggcgcagugggucacgccuguaaucccagcacuuugggaggccaaggcggguggaucaccugaggucaggaguuugagaccagccuggccaacauggugaaaccccaucucuacuaaaaauacaaaaauuagccagggagggugaugcacaccuguaaucucagcuucucuggaggcugaggcaggagaaucgcuugaacccgggaggcagagguuucagugagccgagauuguaccacugcacuccagccugggcgacaaagugagacuaucuuaaaaacaaaacaaaacaacaacuacaaaaaaagcaaaaggaguuaggggaugauuccuucuuuccuucaauauucauugagcuccugcugggugcugggcgcugggaauacagcaaugaacagaagaaugucuccugggacaggcagcauaggacggggcuagggggacauuugcuaagcaugucaacaaguugugauagaagaauuacaaauugugauucugcaaagaaacagcaugccaugguuuggagggcuauuaaauggacccccuaaggcugaggaaucagaccagucagagauaggugugucuggccugugugugcagggugcgugucagaguguguaugggcaagcaugugugugcgggcaucugggcguauucgggacguguguguagugcagggugugugugagugugucugagccuucaucucugugccugugugucugcaugugcacacgugcagugugucagggagggcccuuccugguccaagaacucgcgugacccggcacagagggggcgcgagaugcgagcagggagcaggguggcacuuggcuguggaggucuccuuggccacacgaaggggccuggguuuuugucuccauguccagggagccaauggagggcuaugcagaggagugacgcaguccaguggcauuuucaggggauuccucuggaacagcaccguggggggcaggcgguggccuggaggaggaggcuuggugacagaagauggcuuggacuuggccuuaggaguggggcugauggggcuugcggugaugauguaaugugucgggauggaaugaaugaagaugacucccgggcuccuggccugaacagcuggguggacuccgugccgcuuccugccauggggaagaugcagggaggaauagcgggagcagaugggacgugagagugcagaguucccuuuuggcuauggguuugaaaccugagaugcccauggucucccagagggguuaucagguccgcagugggugggugguggagcucagagaccugggggcuggaggugagcccugggcuugaccacagacggggcagacugugucuccuuggcucaaagggccagcccuugccuggcugcccugggcucugagccagagcccuggaucacuggaaggguacuuaagcauggccacuuuauccccaucagcugucucagcacagccccugggcucugaugggcaacacccauuaaagggaugcacccucuggggacucagcccaaaaugaaccagaaucacagcagcagggcuccauagggcugggggaucaugagguugguucccccagcauugaggccucagaacacugggucaccucccuggaggcugggaccagcuucccagagugguucaugucacgcuuaucucagaaaauaaggacacacuuuguuacugaaacacucucuugcaugccuugguugaugguaauccuaacagcuaauguugaguauuuuacuguguguccgcccugacuaccuauuggcucaguuaauccucacaacaaccccaagaggaaaguucuacaauuacucucauuguacagaugaggaaacugagguucagcaaaauaguaguugcacagcaguaugguguagacaggacugaaacagggcaguucaacugcaaaacccguucucuuagcucucacacucuaugcugagugucgcuggaugccauuucuuuucuuuuuuuguuuucuugagacagggucucacugugucacccaggcuggagugcaguggcacgaucacagcucacuguagccucaaccuuccaggcucaagcaguccucccacuucagccucucaaguagcugggacuacaggcaugcgcaaacauacccggcugauuuuuguauuuuucuguagagacaggguauccccauguugcccaauguggucucgaacuccugggcucaagcgauccuccugccuuggccucccaaagcacugggauuacaggcaugagccaccgcaccuggacaggaugucauuucuuaaagucacuucagcaggggcguuacuguuaugcccauuuuacagagggggaaagcugaggcccagagagagaaaaugcuuugcuuagagucgcaccacuaguaagcggcauugccgggccuggugugaagcccugaacucucucucagaggugagaacugccccuggccaccagccccugccuuccuccacuggaagugaaagucucuguuccccuaccccagcccaaaguauuccagugacugccacgggugggaggugggguuucguccuuggagcugugggcuucucagagcucugggaccagagcuggugagauccuguugcaagagaagcaggcuuaucacgggagccugugcauggagcccuggugggugggcuaaagcccauguuggauugcagcuguauugaagccccacugcugggaugugcggccuuggcccacuuugggggcuugagccacccuguccaggaagaacucaauggcucacugggacagcucucuccaucacagcgaugaugggacagugcugaacagcucacaagcagaggaagcucuguggguaauugacuacuuguuuuagcaagugcguguauguuucuugaacccauaauuggaaacucacacccuaauuuagacaccuaccuacugaagcuuccagaagacccuugcuugauuagcagagagacgaagagcauagaauuugggguaagggccaggugugguggcucacgccuguaaucccagcacuuugggaggccaaggcaggcagaucaccugaggucaggaguucgauaccagccuggccaacauggugaaaccccaucucuaauaaaaauacaaaaccuagccaggcaugauggcaggugccuguaaucccagcugcucgggaggcugaggcaggagaaucgcuugaaccugggaggccgaguuugcagugagccgagauccuaccacugcacuccagccuggguaacagagcaagacucugucucaaaaaaaaaaaaaaaaaggaauuuggggucaagcugcugaauucgaaucucagcucugcugcugacuggcugccugaccuugagcuugaccacuccuaaccucuucaugccucaguuuacccaccucauagaauuguuguaagaagcaaacaaaugcuuagaacuauaucuggcauauaguacucacuuggaggcuguuaguuaaguauuauugacggcauugcugucuaaaauagguuuuucugcaaauggccagacaguaaauauuuucugcuuuacaggccgcauggucuguguugcaaugacucaaccauuguaaccgaauagugacgguggacaguaccucaaugaauagaugugguugugcuccaguaaaacuucgcugugacuuauauaugagccugggggagaaaaguguuuuuaccugcgggaggauguaacccuagggcugucagcagccauugucccuccauuccuggaggaagccagccaugguaagagagaagaaggacagcucacagggggucagauccaacagaaagagaucaaacccugccaagguuguuugaacugcuggauccagccauaccugaaacuaccuuggcaccguuuggcuauauaagcagcaguuuccuuuuuaugcuuaagccacuuugcauuaggcugcugcugcuuacaacuugaagagugccaaauaauacaggacucuucuccuucaucccccugaauccagccaggaggagucacuugcccacuuauuucugcugacucacgcccacccaugcuugccaggggucaaguuacccaggggcguuccuuaguccccaacauagaaccaugccccacaccuacuuuuccucuaggaguuuaaaucauuucucuuuucuuuucaagguuguauaaccuugagcaggugacuuugucuccaugaaccuuaaucccuucaucugucaaauggggcuaaucauuggaccuagggcauagggugaguuaaaaagauuaaauggauuaauaucucuauagcacuuagaacagucccuggcauguaguaaguacugucuaagcauaugcuguuauuauaauacuaccuggaaacugaacucacagacucucuggggguuuuccugcaaaauggagggaauugucagcucccugaggcugagauuagggcuucccauauucccagcacccuuccaggccugguauugaggggacacuugguguuuguugaguaggaguuagaacaggggcgggacaugguggcucaugccuguaaucccagcacuuugggaggcugaggcggguggauuacuugaggucaggaguuugagaccagccuggccaacauggugaaaccccgucucuacuaaaaauacaaaaauuagcugggcgugguggcacgugcuuguaaucccagcuacuugggaggcugaggcaggagaaucacuugaaucugggagguggagguugcagugagcagagauugugcuauugcccuccagccugggcaacagagugagacuccaucucaaaaaaauaaaaaagaaaaaaaaagagaacaagcaaaagacaauaacagaaagugagcaugagggauccacacaaauuggaucagccccccaagguguucguaguuagaagucacgcaauaauugcuuugggaguuuaugaaaccuugaggcacagaggaauguuaggggucccaugagcaauuuggggaugugaauguuggggauucacauccucacugcuaacagugugauguuacagugugguccacaguagaacugaauugcucauuagaaauacagagacuugucccugccuguacccccuguagcagaaucuguacuuuaacaagaucuccaggugacucgugugaaaauuaaaguuuuagggccagccaugggggggagaggaggaggacagaucagagggaagcagagccaagagacagaaaucaaacccugcgaauagcauuugaacugcuggauccagccauaccugaagccaccacuccacuguucaauuauaugagcaauggauucccuuuuuuucuuaagcuacuuuguagaugcugucagaagggccucugugucguaagggacuaggggcuauuuaugcggguaaggaugggguggaggcuaugauccuauaugccauuuuauuaggaaaacauuugguguuuagcucucuggguagggaagagaugcaucuuucugcccccugagaaaagagaaguaggaaggucauggagggccauggugacccacauggcaggacgucuucagagccaaaccagagugaccucauugaggcaguggccuccagaaguugucaaacagaguuaagcacagaagaugcaaggguuugguggagaguggacacagacugucgucugucucuaccaagacggucaguguuauugucucauggcggggaauuugggccacgugcagagaacaugaacuuuaaaauccacacagaacuggacucaaauucuggugcugcugccacuugcucacuguaugacccugggugaagaaauauguguaucugggccucauuguccuugucuacaaaauggggguaaaaauagcacugaccucauugggauguggagaguguucgugcagcagugaccagagcuggugggugagaaccagcuauaagcaucgccucccagcuccacguguagugacaucacagcagggcuugaaauugaccauggugggaaaauguacaccauggaaaugguaaauaucagaauuuguccuuuuucuccagagagcugguuguuuaacauuuaccagcauccuacuggugaaaugccaagacguauuuaaauugcuauccacaguguuuggugguggugauuacuaauuacgauuauauuaagcauguuacucuaauauuacuaauaugaaaugguuuucaugauugcgcuuucaguguguccacuuugacucuuuuuuguuguuguuguuuuuauagacugggugucucgcugucacccaggcuggggugcaguggugugaucacggcucacugcagccucaaccuccugggcucaagugauccuccugccucagccuccugaguagcugggacuauaggugugcacuaucacaccugacuaacuuuuuucauuuuuuuguaaagacgaagucucgcuauuguugcccaggcuggacuugaucuucuggccucaagcgauucuccugccuuagcuucccaaagcacugggauuacaggcgugagccacuacgcccagccugcgacauuuauuuuaacugcuuggaagccuuuucuucuaacccucuggcuccuagcuccauucuggaaagcugacauuaucaguuagcugaguucugaguagacgacauaccguagaugguaauacccaaacuaacauuuauugagcauggacuaagugccaggcacuggaaaagcacuuccugcagauauucucauuuaacccacccaacaacucuaugagguaugaaccccauguugugaacacagcccgaggcucagagaaguuaagugacuugcucugguuugcacagcugcuugauggaggggccaggcuuugaacccucgcauuuugacuguagagucugugcuuucaucaggaggaucugcagaggcuaaacguggaaggggccgguguuuggucccugagaguggacccuccuugcugggaggcuugggcggggguagcggacacugcccaggaccgagaaguccugacggcaucaucugcuuggcgaacagcaaccguccaacuuucugggacgcgugccggccgcauucugauuggcgaggggaugucucuguuggaagggaaucuuggccacuugccccuuggcagcaggcugcuggcugccacguggagugccguuuggaggcggugggaauuauucggcaaccuugccugggauagcuuggaauggauuguggcagggcagggcgggggcucugccagucuccuagacaggcuggcagggagagcgagagcgccagcacugucacaagaagcucacagucucagcuucugcacuguccucccugccccugucugucucugucucuugcuaucccuuggccucucuuucugccaggacuugagcugacaggugguuuggcaccaagggaagcaccauccccuguccccacaggccuucuuuccuucaccugcacugaagcuuaggggcuuuugcuucuuccacuguucccuauuuccaucgagauaaaguucacacuccuugacuuggcucgaaaaccucuugugauaugaccccugccucucgguucuguagcuugugccccuaaguagaccaugggcuucucgagggggagggccuguuucauccucaacuuuuuauuuuucuguaaugccuagcccagagcucacucagaacaagugggugaacuugaaaggcaaggaggggugacccccguccaugguagaagggaccgagucacuucaggauuugcagucauagccugugcugcaucuuaaggcagauuuaccacguugucagaugccaugcaaagcucuaaguuuuuucuguuccuaucucauuuaauccuccuaacaauccuauuagguuggcccuggguuuguuuguuuguuuguuuguuuguuuguuuguuucuuuuuugagauggagucuugcucuguugcccaggcuggagugcaguggcaugaucuuagcucacugcaaccucugcuuccugaguucaagugauucucaugccucagccuucugaguagcuggaauuacagguacacgccaccacgcccagcuaauuuuuguauuuuuguagagaaggggugucaccauguuggccaggcuggucucgaacuccugaccucaaguuaaccacccaccucugccucccaaagugcugggauuacaguugugagccacugcgcucaggguacgcccuguuuuauccccauuuuacagaggaggaaacugaggcacagagagaucaccuagagagggcagugauaagauuugaacucaagccaguccggagccaagcuggcuggagugaagucuuucuaaacugcccugacagaugugcaccgucucagcgccguuccuccccaacccauuuccugaggccucaucagacagcaacccaguuuguggcuccucaccucaccccaacucugcuguguucacacauccuugaugaauuaaccugggcaacaccagcccugccugucacacugauaaagguagagcuguggagaucuggguugcagaagaugucacaagcccuucucucugccugucaccuguccccugcagauuccagggcugcucagaaguuuuggagaauagcuggaaugauccuuauugaucugauggguggguguuuggaaacaaggagagacgcacuaaguugguuccuuccaagcaggaccucccaccacaccagaaccucgucccgucggucaaggguggcccauguggcucagcaugcuggggacugauuguuuccacguucccuagcucugccugacaacagagcgacauuccugugccaucacaggggagagucgcauuguguuagugacuccccaucaaacugugucauauugggauuguauuguauucauaguuguuuccacuaaugugauaugaaaguuacuaaucggagaagacuccugcauuguauuagggaaaacaaauauuaauaugagucgauggaaguagcuaauaagaaacgcaaguugcuaauaggacaugauggaucagugggaggaauuugggucgggugcuugaacuuuuguggaaugcucagccggguggggguugcaagauggcaggaacucuauguuauagucgcucagaguaugaagguccauaucagagcccccugccugcccccuccccccacugucaucacuaccccuccaucucaccucuguccugcauugaauggcauccgccaaaauucauguccaccuagaaccucaggguaugaccuuauuuagaaacagggucucugcaggugaaaucaguuaagaugaggccauacuagaguagggugggcccuaaaucuaaugacugauuguacuugucaaaaggccacaugaagacagggacacucagggagaaagucaugugaugacagaggcagggaugggagcgaugccacaagcccagcaacaccaaggauggccgcgaccaccagcagcuggagguggcgaggaaggacccuccccuggagccugcagagugagcgcagcccugccagcccacaccuugauuucagacuuccagccuccagaagcgggagagaagacauuccuguuguuuuaaacuccccuaguuggugguaauucaucacagcguccguaggaacagaacccccuuuccccaccaugccccagaaaagcagggauggccacaaccauacucguuuuauucaaagauagccaaucggaucagggacauucuuccacccucagcgggucggccuggcugccuaaccagcccugaggauggagggcuggcucucucccugacuuuguucuuuuaaagaggaaaaagccuccucaguggcagggugguuggcauaugggcuccgcagccugcuucgcgucacguuaauaugugauuaaaggggucuuaaaacgcccauuagucccccucugguaucuaauagcgcuuuuggauuuagaacagaauauuauuuacucauuagcugauaauagacccugaguacacgccuuauguauugggacaauuauuagagucgauuacacacagagacgugguucugcugggguggcugguggcaggccagggugguccagagggcaugaggguggcagggaaugacuaugggccauauguggacagcagggagcccgcuagagauuguguguggcagcuguggauggaagcaaauucccugugcaaacagggccacuggaugccccaugcaagguacuagggggaagaauuuaaggaaacugccuccaagaauuggggugccaacaguaacagccccuaugcagcaguaagggauugcacuugagcauucguccugagucucccaggaugagaguauuaagaacaauaacuggccaggcgugguggcucacgccuguaaucccagcacuuugggaggcagaucaccugaggucgggaguucaagaccagccugaccaauauggagaaaccccuucucuacuaaaaaugcaaaauuagccgggagugguggcacaugccuguaaucccagcuacucgggaaguugaggcaggagaaucacuugaaccugggaggcagagguugugguaagccaagaucaugccauugcacuccagccugggcaacaagagcaaagcuccgucucaaagaaagaaagaaaaaaaaaaaaacugcccccaccguggaucacaggauagggugaugugcccaggauacacagcuaggaagugacugaagcuggaugcacacccccagcucuucuuuuuuuuuuuuuuuuuuuuuuuuuugagacggugugucacucugucacccaggcuggaaugcaguggcacgaucucagcucacugcaaccccugccuccugaaacccaguucuucugaugacaaagccuggguucuuuucaacauccucuccacuugcugcagaaacugcucaaugauuccagucuuccccauucuccgacagaaagaggaacuuugacaucacuuccucuuaugugugguguguuggaaagaugaaaauagcagguuguuccucuccguggcugggucccugaccucgggcccagcgugguaggaaggccgagguggagggaauaagcauguggaagccaugggagugucuccugggaagcgggagagauuaaggagggauggaccgggcccaugucuggcaucggcaauucuggucaaggugcaugggaaugggaggggaguggggaagcgccagguaggguccagcaagguguucugguugcccuggugaugccucuugggcugugacccagaguggcguuggcauccaaggagagaauaggugcugguaacaccuggagucaucccagcaggugucaguggcugauuccacuugggggugacagagauggagaaguugggcaacccccagucugauggacggggugcagaguauggaaggaaagccucgaguuugaccuucacacacaccuugaccuuguuggcaagcccgaucugcaggucaucaguuugcagugauuuugccagugaacaccugagccccuuagugcauugugcagccugcugagagcaccaaaaaccuccccuuaauacccagacucacugcggcuuuucugagaccggccagaaggacagacgagagggguuucuuaugcaccagugggagugggucucucucugacccaaugcaagcagcccggagacaucuugcuuccuuguuuccauggcuuguggggaaaccccggucccgugucccugugcacgcagauggcuaguggcucagugggucuccggagcacagccaccugacacaucuggggcuaugggacggaaaagcccagagugcccucucugaggagucaucccagccuguggccacagugaugcugaagggguuugcaggccauaauuaggggcucagugucaccuuuguccagugccugagcugagaacagggcucccuggugaaagaauggcagggucccuuuucgccucccggggaaggagccggagagaaggcagagcuugggaaauuggcccucugucuucucccauccagauauguggguccugggccuuaccuguaccaaauaaauaacccauuucccaaugggcaggcagcauaugcacucucugugugugcgugugccugugccuguguacacgugcgugugugugcgugcaugugcaugcaccugugugugugugcaugugccugugugugcgcaugugugugcauaugccuguguguaccugugccugcguauacaugugcaugugcacacgugugugcaugcaccugugcguaugcaugucucugcgugugcauaugcuugugugugugugugcaugugccuuugugugugcaugugccucuguguguguguuuguguguguaugugcauguguguuugccuguuuuuuaauaaagcucaccaggagccagauaucaauuucugucagagagacgcagagcaucugaaccagaacuaaauaaaaauaaacauuaaacaauuauuggaauuuagguuuauuuaaaaaaucagcaggguugagggaaccagccacccauuagcgaggcagaacuaucgggccuuuuaacaacccgcugguucuuggcugccagagagauuugggcuguccaagcuguagaaacuccagauccuauugauuaaagaugaugcaguaacgaacaaauuauaucaucguggcugcuuguggugcuggccaacacuggcuaccuguuugucuugauggaaauggcucuaucugggggacuccgggagggugguucaguguccccaucccagccagcgcuuuccacucugugcaguuccugcagcuggguggaggcuccgaaccucgagcugucugggguucuuguguuuuucuccucucugucccuuccauggacaucuguaguuuaaaaggagucugugucuugucaaccaaaucaaugcaaauaaccagugaacguuucucgacuuuucaguaauaauugaucuucccagaacugauaucguuuggaaaacguaaguaaggagaucagcagugagccagauguccacacuaagagaauauaacugcucugaguuauaggaaaagaaaugauuucccuuccagcuuuagcuccaagagcugagcaaacugccgugcagcaucgagaagcuuccaauaaacucggggcuuaguucgaggcagccucagccucucagccagaagacuugggugagugcgggacuggaaucuuccaagcugaugggcagacuucuugccugcaaauuuuuggucucuagguuuuuaucuggaagcugucugcacagccaguugcugucagggagagagagguuuguuguucuucuugagggauguucaggcuuagacccugagcugggcaucuacugcgugggagucuccccuuggcugguucuuugguugauguucuuguuguucuaauuugauggucauucccauacauugcugugauuggcuccugacuugaccagggugauacucagaaagucaaauggggacggggacaggguugaucugugggcugguggauggaaaauaggaugccagggggcacuuucuuuaugaacacugucauucuuccagaacucauucauuuguucauuugagcauucauucaugugcucaugcaacauauaguuccggggcaccuacucucuucuaggcacgaugaggugcugggcgcacagggguaccugcccuccuggagcuuuuagucuagcuaugaagaggcacagacuugaaauaguuccugaugacaucacaguugccauagugcuucauagaggugaggaggcagcagcaggggcucacgacagcaggaaacuggccucauguugggguguuggucugcuggaaguaauguuuaagcugcaacuuggcugagggguaggccugaguuaggccauugauuuucagacuugagcaugcauuuaaaucaccugaaauuuccuugaaaaaaaucgccaggcucuacccucagaguuucugauucaguaggucuggagcccguccaagaauuugcauuucuaacaagaucccaggugacacugauccugcugggccagagacuuugggaaccacugaacugggcaaagaauugggaggagagggcauucagguagcggaaacugcacguacaaagguccuggggcugguuugggcuuggcaguuuccaggaaccaaaugaagggccagaggguggagcaaagcacaaggacugugggaggaaaugcuguagagaagcaggcagggcccugaccacacaggccuugcagacugggcuggagaguucagauuugaucugaaauggaauggggaguccggggagguuuuaagcagggaaguaucaacauccaguuuacaucuugaaaugcccugucuggcugccaggguggaagugagauggcagagaauugcauggagccagggaggccccugcaagcauccaggcaggaauuggcagugaccagaccaggcugaugacagcaggcauggagaggcacgggacgugucugaaugaguccacgcuccugcuuuccaggaaguuuuccugaucaguuugguuccacccuucaaucugugaacccuaauuucucacuugaagaaguuguccuauguugacgugacauuagcaguuccuugaggguagggcugugugugucauaugugagucacaugcagccccuaguuggauacacaauaccuuauacuagcuggccaaaagcacgggacaguuuaccugcaaugguuaccacauccaguuuuccaaauacccugcaggaaagguggaguugugcccauuuugcagagggggaaaacugagauucagaaagggcacgggauacucccaagcuccccaaggugggcugaaggaaaagcaagauucccucuacagacuggggugcccucuggugaccagacaaagggaacagggacaucaccacccgugaacccuagacagcaaccacaauucucuuuggagguaucagcagccuuccccaggaugaugaucaggccaccggaaauauuaagcagauagagaagaaauugcaguuuugaagaagucaaaaauggccaaauagcagcaguuuccugugguucaacugaaaucaaaauauaaagaggaaaucuuacaauuccagaaaauucugcuacagcaugaggaagaggagucaccaugcagucuaaauugucucuggaagcagcucccccccacacacagaagagggggccguacagggaugcagcaucuuagaaucagucuauaaugcaaucaauuuuguacaucccuggugaaacagcaacauuuauuuaacgucuuuuauagagcagcugaguuuuaucacaaaucacauuccauuucuauucaucugggacuccuugaaggcuaaaaugcacuuacuuuucuccgaggaaauuuaccaauuccucaguaaagacccauuugccucuguauguaaaauugacacauuuauugaauauuaaacauuuaagguuuuuuuuaccaacccccuccccacccacaccuuuuuuuuuuuuuuuuuuuuacacuuuuccacaaagcuucauagucauuagggaaccuuccucaaaguggugagaaacacauauuuaugggcagaaaccagccgacauuuaaauuuggggcuuucugauuacugggaaauggucaagugacaucauaaauuuauagagcagcaccccaugccuuugaguggccucucuaagcugugugcuuuucccaucucuuuguggcaggcuuggucacgcggcaauaucguguuggguucucaacaaaaguuuuuuugucuacacucauaacauuugcagaagguagggacugccucccuggcaauaaauugugcuaauuagcaugagggccuauuaauaaagcaaguuuucuuuuauccauguuacugaauggucggagacaucaguuaaaguguauguucaagacaaugucuuuuucaccgccgguugcaauguuuuuguuuaaaaaaaaaaaguaagcggggaucugggcagcuuauuguacauguuuuugugucuuuaacaugagagacggcugaacuguugaacuuaggucuugaauguuggguccagaucuccuaccucugucucuaaaucaaggcauuagguggcaggggcgggaaggcagugggugcuuuucccuagauuggggggagaacugaugggguuugaggagucucuucuucuucuucuucuuuuuuuuuuuuuuuuuuuuuuuuugagagacagaguuguuucacucuguugcccaggcugcaauacagugaugcgaucacagcucacugcauccucaaacuccugggcuuaagcaauccuccugccucagccucuugaguaccugggaacacaggugugcaccacaccuaauuuuuuuuuuaauuuuguagaaacagggucucacuauauugcccaggcuggucuugaacuccuggccucgagcaauccucaugccuuggccucccaaaagugcugagauuacaggugugagccaccaugcccagugugaggaauaucuuccuaaugagcuuggggaucggggagacucaggcuccaguccugacuucccuaccugccaucuuuguaaccuuaagcaagugacuuuuaccucuugaagccucaguuuccucuucuauuacauaaggauaaccacagugcccaugucauggggcugugggcaggauuaaaugaacuaauccauggaagauucuggaaggaaccccaaacaucauugcucuuguccuggggacuuuauucagugccagguuuggauggggaaaaaaagguuguuguguccaacccccacuccaggcucuauuuucccuccacaggaucuaucaggucaccaguauaugcugggccaccuuuggggacagggcuccugaccaucagggcugcuuuccuuuguugggcugaaacuuguucacaugugacuuccuuggcccacacagaucugaacuccucucccauucauuccccaauuccuccagucuguucaccggaggaaaugccugcagguccuuugagauccaguuuucucaaccucgcacaugaagggcauuuuggacuggaaaauuucucauugcagggucguccugugccuuguaagauguuuagcaacaucuccagccuccacccacuagacgccaguaguacaccccuaguugugacuaucaaauauaucuuuagacauagccaaaugucccccagaggacaaaaucaccccugcuugagaaccacuguucuagaguuuugggucuuccccgugcugggcuccuucaggaugucuuaucucugugcccucuggcaugccagcaccccuguggcuuaugcauccaaaauguuuuccgugccuacuugggagcagggcccgcguuuacuuggcacaagcuaaaccuuguugagagccugagaccccaaaagcaaacaucaugaaaaaucaaauaaaauugcccccacuuuuccccccugcagccaucucugcaaaagacagguaccaccgggaccaagggguggcuggggcuuccuaguugcaguuuucauuuugaagacaaggaugauuuuuuuuuagcggagucucacucuuucacccaggcuggaguacacuggugugaucuuggcucacugcagccucuaccuuccaggcucaagcaauucuccugccucagccucccgaauagcugggacuacagguacgcgccaccacgccuggcuaauuuuuguauuuuuaguagagaugggauuucacuguguuggccaggcuggucucgaacuccugaccucaagugauccgccugccucaacuucccaaagugcugggauuacaggcgugagccaccgugcccagccgaggaugauuuuucugguagcguucaucugaacagucagagcuaacuuuucauggaauggaaggucaguggucauugaagguuucugaccagggcuggcccgaggccuggguuagcauuuggguuuugcuguugauuguccuagugacgauaccucuguggaccucaguuuccucaucucuauaaugggaauaaaaauauaacugucucaaagcauuguugcugccauucagagaaucaccccauacaaaaugcccagcgcguaguaagcaaucaauaaguuauagcugucauuguuuguucuuauuguuguuugccaauaagaaauacacauccaaagaaugagaguaauucacccaaggucacucagugguucuguguaaaaacacugggucgagcaucuuuuuuccagaaacccugggguuuucugcaaaggucugucugugucuagaagaagagauuccaagaugaucuauuuuaugugauucucaccccauuaacagccugcagcuuugccagaauauccucuuuucacuuucauuuuaaaaaccagccaguguaauaaaucuugccccgaaaucucggcagcacaucuuggcuggaguguaugauaaaucuaauauacuguggccucucuguaugagagacccuaguacauaucuguauuuugggcagacagcccuguggucuggcaggaauauaauuugcugucacguugacaaguccagcccucugacuggguucauccuuguuccacaacuuccuuggcucaaggguggacuuaugacccgguccagccacucccccucccccauuuaaaacacagaacgugacugagaacuagaacuggauuugcaagggaccagcugggauggaaagggaauggucacgggugggacacugggagggagggcagggguccccacuuugaucagucaaugaauauuucuuaaauaccuacuaugugccuggcaucaugccaggggcuggguacacaggugaacaagaccgagucaggguuuaaugagggagauggacauuuaugggauggccguuuggaaugaaguccaaugauuuaugccugugaugagggcucagauggaagcgcaggggccgugggggcuuggggauguccugugguggugauaucccagggcugagcuggaagaccgugugcaugugccagguccaggagcgugucuggacucuguaacggggaaugacagcaagggggucagcggucggcgcaggggaaagcagggcugagagaggccugggagcagacugugcaggaccacacagggccuuuugcucaaagccagcagcagccaagggggguuuggaaggauuaguuuaccuuucagacguucccugagcuaccgcacagagaucagacuggacagggcaauagugggagcccuagaggggaccguggacuccccuccucauugaggauccccucacagggagccuagcaggaccccuggaaggccaggaaacagugcccaaaagggucaaggacuuuggaaugcauuucagccccagcccugccccugacugaccuguuuaaaucacuuccccucucugagccuugguuucuucaccuguaagaugggcauaauaccaacacccgccguggaggaguauuacaaagauaaaucaggagaccacauauaaggugcacaggauggggacaccaagcacccaagaaauguucaugaugaauucuguuuacuagcugugugaccuggggauguuuaacuucacuucuuugggccucaguuuccaaaucugcagaauggcauuaauaacgauccuacuucauggugguguugagaggauugaauggguuagaauggugcguggcacagaguucauuccggcugaucugagccaucgccgugguuguuguuguuguuguuguuguuguuuugccugcccuuuccuuuaguuucguguaugacaugauuggucagcaggggccaugguuuuguuuuuuuuuuuugguguugagucucacucuguaccccaggcuggagugcaguggugcgaucucagcucacugcaaccuccaccucucggguucaagugguucuccugccucagccucccgaguagcugggacuacaggcacauaccaccaugccaccaugcccagcucauuuuguauuuuuaguagagacaggguuucgcccuguuggccaggcuggucuggagcuacugaccucaggggaccugcccgccuggcccaccaaagugcugggauuacaggcgugagccaccgugcccagccccugggacuguaauuuuuacccugaccccggaucaugccauggcacuaguccagauccugucuugugcuccacugcaucccuggcagaauuccagcccccauggggcccccugaccccacccuccccccaccucacccugcugggcuucugaccuugugucccuccucaccuuggacaacaagcucaucagaauuaaaggagucuucgggaacccuccacaccccugacuggugccugcagguguuccucucuacagucucauucauucccucacuacuuccucccucuccugcuuuccaagaagcagaaucaccuuccacuucuccagcgcaggacaugagcagaucccucuacagggagggaaaccaauuccacggacccuuaagaauugcuccucucagccugagucugcagaccuccaccgaagaacccuugacauguggcauucaaaucuugggcuaagaaaugauccuucagccgccagcugucccugcaaaggagaauuugggccuuuacgacaggccgagaaauaauuucuuuggauucgugucaacauagaaaaguaaaaggaaagguuaggggacacacaguuuggaaaacgcuggcuuuggcucucauauucuggaacuuucuuccucccagucugauaggaacaaagggccucugaggaucuggugggacugaggccuccaguccucuccucuccuggaccucucagcuccugcagcugugguggccccaugccugggucccagggaaaaccuaguccucccccagccuccccagacccaagguugccuccccuccucaaagugagaaggccggugggcgaggcuccccugaguuauugagggaagaaauauggccgagaacccuuucuguaaaaauaaccucccgggcuccuccuuuaugggugagggaaagugcuuaaaaugcuuagagggaauaaacagcuuuuaaugaaguuacauugccacauaauggguaucauaaaauugccuucauacuacagggucccaggauggcauuuauuaucgacugcgccggaauagucuuugcagagcuccggcagcugcagagagaagaaugcaaaagucuccuuaaauuaccugauugaaauaaccaggcggaauauuccgcggggccgccgcgugccagggaagccgccuuugggguggucugucagaggcgguuugugcauucugaggaacacaggaguuucauugcagcaaaacagauguucaucuuguuucuccaucggcuguuugaugagaaauuuauugcucuuccgcugggcaggaggccccucucggcuguggagucuauuaggcaagccagcagcuggcgggaagccaaggugaggcuguuuugaugaaacccaugaaaagcuuuggcuuggaggcgccgguaauaaugcacuggcuagacucuccugauugggcgauugauuggccugauuugauuuauugaucaauacccucaaauuuggcgucugagaagcugcacuaaucuuuaacuguugugaacaucucuaccugcuggagaauuagauccugauaaggaauguaugaaaggaaucggggcuuaucuuaaucacacaccgggccccagcacugcccgagccggcgagggccucugugcaccagcuccauugccaggcaggccugcgcagaucuauaaauugauggaauucaaagccuccagcaucgauuaccguuauaacaaacaguggugcacagaaugucugauuauuuuuagacaaagauucuguucucucagcagcaauuuugcugaggcugucacugugucagaugucuacuguugauugcaauuagaugcaauacaaaaaaaaauuaaacuaucugcauccucacucuuauuuccaguuauuaaaucucucucuuuguuugccauuuccucaugauaucuacagcuggaugaaauauuugguuggcaagagaaauccuuguaauucauggggggugcaaggacccacugacucaucggauuaucuccgacgggugcaccuaaucugggaggaggggaggcgcacagggagguggggggacauuuguuuaaaaaugugcaaagggaagacuugaugcaaagauguuucagggcagggucgggggauaaaaaucaaucucugaagcccucccgaaugacugugauggguuuaaucuguguuccguucccuuccacauagagcaggaccuaacuagagacaugcccccauccuagggccccggggagguuauccauagugaucagagcucaaagguuggcaccacuugaaauaauuaauuccucuaaacagaggaccacuuccacgcuaaaucauaccugaagagugggcuccagguaauugcagguaugaacaaauuaggcauucucuuuuacauacagcccggcggccagcauccuggcguugggcaaauccauucaucauccugacguucuccaguugauccgucuucucagagccauuagcccccacguccuugacgguggaacaguuguaaacucgagaccauccgugggguggcugagacugacaauucauuacgcaguuggauggagaaggcggcucaggugacaaugcugaggccucccaguucccagaagcuggcuccgcuuggaauuggcaacugcuggcuaauuuuagaacagucaucguuggggauggagaaggaggaggaggcagcuuugacuuuggggucagacgagcggguccugcagaaauuggcugagcucaguaacacauugaucaccaaggcaaguggucaucuucguucaggugggcaugggacaguggucccugagccagcccaggauacauucaagugcccccaaaaggacauuccaggggagccaaugaagggacucauagcucccuggugacagggaaagggccagucucguucaauaaucggaauagcaccagccauuuauucgccaccaacugccccggauccuguaccaagcauuugacaugcaccuuccuccuucaaucugcccggguaccuugggaggagguuauaauucuaccuguuugggagaugcagaaacugaggcucagaggccuugagcaacuuguccaaggucacacagcuaagaaugggugaggcuggaagucaaauucaggucaguuucugaaguuuaugugcuucaccccaguugagaacucaaugaauauuuguggaauggcuggaugaauuacugaaugaaugaaugauaugugaacauccagucgggacucagcugggcucugggauagccaagaaugacagggucaggcugucccucaggcaggccuggcauuugggccuccaagccugcuggggguggcuccugcuucaucuucaugggcauagagcugugcccaggcuccaguccccucaguuggaggagccaguuuaacaucaccagagaauucugugcaaggaaaucucagggucugaggggucuggcaauaggcagaagcaacaccggggucucagaggcagggugagguuguuguuuaccuggcugggagccagauugcuucgagccaggauagcauggggguuaaacgcucaaacccuaaagucaacagaccuugguuugaaucccagccucaucacauucuuagcuuugugugaccuugggcaagugacuaaaccucucugggcgucacuucuccauccugcagguagggcugaugacagugcaucccuguccaggugacugugagauagaaugaggucauacacaucagugcucacauagugccuggcgcguucuguuugguggcaguaauuauuggccuagggcauuuggggagucccaccacccccugcagauauuugugacuaacaagcuuauuuagcucaaggagaauuccaggucaaggcaaagagguaucaagugaccuccuugaaguuacugugagacuuuuuccuuggguggcuggcacccauugcuaccuauugucaccuauugccacccucuucuggacacacuucaaucguccguauccucugccuuuucccuuuuacauccucgacauccugacccucauccucggcauggcugcaggaaagaggcagucccuugcgggguugaugggagcagccaucaauguggucccuuugaggggcaagcuggcaacaucuaugacauuuacauaggugcagcugugugacccaguccuucuuugucuaagaacuuauucuucagauacacccauaugugacuaccaagauguacaucucaguguguugguguggcauuaauaguaagaggaaacccuggaaaaaaccuaaguauccaugagucggggauuggaaguaaccuguuuccacaagguggggacuggaaguaaacuaagugucuaugaguggggaauuggaaguaaccugaguguccaugaguaggggauuggaaguaaccuaagugacugaauagauaagacucauccauacaaaauauucugcaaccauaaagaggcagaaggaugcucuugauguacugauaaaaaggagcagacaauaaauucuaugaaaauggcacacugucagccuaggcaacauggcaaaccuucucucuaccaaaaaaaaaaaaaaaaaaaaaaaaaacagaaaaauuagcuggguaagguggcacgcaccuguaaucccagcuacuugggaggcugaaguaguagaaucacuggaggccaggaguuuaagacuguggugagcuaugaccacaccacugcacuacagccugggcaacagagugagacccugucucaaaagaaaagaaaaugacacauugcggcugggugcguuggcucaugccuguaaucccagcacugugggaggccgaggcgggcagaucacgaggucaggagaucgagaucaucccggcuaacacagugaaaccccgucucuacuaaaaauacaaaaauuagccuggcaugguggcgggcaccuguagucccagcuacucgggaggcugaggcaggaggagaauggggugacccaggaggcggagcuugcagugaaccaagauggcgccacugcacuccagccugggcuacagagugagacucugucucaaaaaaaaaggcacauugcauaacaagguaugggauauccucugaguaaaacaaaggaaagaaagauucugcuucuguauuugcuugaauauaaguaaaguaucuuuagaagaacacagaauaaaggugggcaccucuggaggaagaagacuuugauguugaauucuucugugcuguugccauuuuuauccuaugcauaucauacuuuagcagugucaaaaugguacuguuuuuaaaaugaguaucauggaaagagaaccuggauucuugaagucaaauuuggaagcaaguacuggcucuguuauuuacuggaggggugaccuucgauaagcaauggcagcucucuaugccucacuuuugccaucuguaaaaugguggucacccagagcagggacaggugucggcguaaucguguacugaaaccgcugagccagccugcgcuucacccacaguuccuagcuguucuuaucgccagcugcaggcuggaaggaggugcuguuucuggcugugcuaggcccagagcccuucguggggguguccagcacuggcugaguagggugcugaggacagaggucuggcccugagccccgaggggaccccggcacacacucagugcagccccugagcccauuagccuggguaggcucaguaauggagcccucccaagaggcccagccccuacagucacagcucuucuaaugaggcccagucccagcucagccuggccgagggggacaagcugggggcuugacaguaccugccugugucagcuccacgguccgagggggcugccugcaauguaggagcugcuaggcaguaguuggucucucauucucccucucucucucauaccucaucccucccucccugucuuucuguuugucucugugccugucucucucucccccucucuuucuguauuucucugucuuucacucugucuucagacucuguuuucugguccucucucuuucacucucacucucucccucccucccuuccuccuccugcccucuguucugcccucgcccccuuucugucuccgucucacuagauuucgcuuucacguccucucucggcauuucuccucuuucccacucucggcauccauccugccuucccuucccuucucuccuuucccacaucagcuaucuaagggcugccuuaguugucacuguggaugcuuagucaggugacacuuauggggaccagcuguguacugagccaggugcugggaauaggaggcaggaaugugguccacccaggccccugccuucagggguggacacuccaugggggacgcaggugcugagaaaguggcaugagggccuuguggggaaggcuaaguugcuaugacguuaagcugagacccgaagcauaaacuaggcggggaacaggggagcgggaagggcacacgcgcagguccugaggucggguggggaagagggaacugagcacauucuggccacacccggccaccaggacccaugguugcugagagagagaagggcgacucuguggcgugaggcucgcagcugcacagaggcagggucccugggcucgccuucagcgccgccaucugccagcugugugaccuuguaugaccuugccacucugagccucuguuuccuucucugcgaaguggagauggugauggugcauaccugagagggucgcugagacaugugcagguauuaaaaucgauaugauguguguauguuuuuuuuuuuuuugagacagaauuucaccgcaucacccagacuggagugcaguggugcaaucucagcucauugcaaccuccaccuccuggguucgagugauucuccugccucagccuccugaguagcugggauuacaggcacgugccaccaugccuggcuaauuuuuguauuuuugguagagaugggguuuugccauguuggcgaggcuggcuucaaacuccugaccucaagugauccacccaccucggccuccugaagugcugggauuacaggcaugagccacugugccuggcagcaugauguauauuuuuacgcucuaaguaugaaugugcuuagaacuugccagugcagagcuggggcuauccagauguucacuuaugcuacccuugguggcguuauucgugcuuccugcucacagugcaaugccaggccuccauaucacccagcagccugcagguucagugacgccggcaucaggacccauccuucccuugcucgugacuccuguagcauuggggccuuugcaccugcugugcccccucauaacggacucuugcccagagagucacauggccugaguccccgcucguuuaggucuuugccuaaaagucaccucuuccaugacccuccccuggcccccccacugcucugugugaaauugcagcucucuaccaccaccucccccuacuccugaccccuuucccugcuugaguguccucccuccccauguccacaccuaaacgcauuucaguggcucauguggcucauagguuggagaccuggcuggggauugggguacccuggccuuggggccugccaccccugggcacccccgugccacuggugccuggaguuggccugucugugcacaacaggccggcugggucuccugaggugccacucagucuccugaguggcaucuguccaugcagagcuccagccugggguuucuguggcccccuguccaggugaccauggacuggcccacuggccugcuucuucacugcuggcuuuggcccacagaugucugugcugggggcaggggugauggggcugagaaugggccuggagugcuggcucagaucuguugaagagccagguccaacagagccccaggugggcacagcugccaggcacccugcaccccagagccaucgaucacaggcuugcacugagucacucuguuuuuaaacuuggccuaucucauuuucuuacgucccucaaggacauauuucgaaaaccuucagugggcuggccaggcuguguggcauagcccuggaaaucgaugacagcugaguggcaggggggcucaggaauacuaugcaaaugcaucauuuggcucuccaggccacuucuggccuuguuccuucagcaagcauuuauugagcaccuacuguguguacuuuguggaauggauuuuucuacgucaauagacagguuacuaacacaagugucugcaacaucagaaaucaagagcaggugagaaauggcggaggaagaggacgaugcaguguggaggaggagcaggugcugugugccaggugcugcccugggcugggacauggcaagagagacacggacccugccaucagcauugggcaggagagacugcuggacaccagcaaaggugcuaucaaagcagcgugcagagcucugugaaggaagccaccaggggccgagggagaggaagaacaggggucccauguagcaggauggccagggaaggccagcaggagccaguuauaggaaaaaucuagggagaaagagguccaggcaugggaacagcaggugcaaagguccugagguagccagaugcuuggccaaagaacgucagagugguuggaacccagagagcgggggggaaaggagggcagagaagugggcggggccaggucacacucagcuugcuggcccuggggagcauuuggugccccagccucaggagcaaugggaagucaccccucuugucacggcagguuuuaggcugcggagcgguaggaucugauucauguuugugaacgcacccaugguuguuggaagagagggcagcaggaagaccagcaagcagucuccugcaccaguccaggugagagaggaugggcuuuguggccguagagacagcaagaugugggcagauucaggaguauuuugggcagaaggaaaaaagcugauccucccucccuuuacccccagaauauucacacagaaaggugcacagaccaggcacaguggcucacaaaaucccaacacuuugggaggcugagacggguggaucacuugagcccaggaguuugagaccagccggggcaaaguggggaaaccccgacucuacaaaaaauuagccaagugugguggugugcgccuguggucccagcuacucaaggggcugagcugggaggaucuccugagccugggagguugaggcugcagugagccaugauugcaccucuauacuccagccugggugacagaaugagacccugucucaaaaagaaaaaagaaacagaacauucccugcuacccagaaacaucccuuguacccauucuaguccaugucuaauccacccuacccugccagcaacauaaccauucuccugccuccgaacuacacaggcuugauuugccaguuucuguuucuuacguaaauggaaucguacagugugugugcccuugcacugggcugguuuuguuccacauugcauuuguaagauuuaucaauauuguuuguugugguaguugauucaugcucguggccacaccguaguauuccauugggugaguagaucacaaauguauuuauccauucuccuguuaaugggcauuuggguuguuuccagucuggggcuauuaugaauacugcuucuaugaacauuccagaccagcgcuucucaaacguuaauguacucaugaaucaccuagagaacuuguuaaaaucaagauccugauucaguaggucugaguguuugcauugcucuuagguucucgggugaugccgacgcugcuggccugugaccauacuuugaagacuggggcuguauuuuggugaacauauuucucugggguagguacccagggguggcauugcuggagcacggggaggcauauguuuagcuuuaguagacgcugcaaguaguuuucccagauacugacacuuccuccagcccuguaugagguuccaguugauccacauccuugucaacacuugguauuaucugucuucccuuguagccauucugguggguauguagcacuaucuccuuguggcuuaaauuuucauuuccuuggugacagaugagguuaagcaucuuuucguguguucauugacuguugggaucuccucuuaugugaggcacugauuucagucucuggcccauuuuucuauuugaucaucucuuccuuacugaauuuuuaggagugcuugauucugcacacaucagauaaacuguacauuccuucucucucucuguggccuugccuuugcgcuuuuauugcacuuguucuuuuuaaugcaacaauuacugcucaggacucgggaguagggugcagagguucccauuuugcccguccuaaccagauuacaguauguugcuggugggauuaucuuucagcuaguuauucacgcacacaccccacacucuuguuccugaccuuucucagggagacaucuccccaaauucaugaacauuccuccaccuagccuggccccacuaucuaagcugcucaagccaggguguccacuuaaccauggucuuccuuuugcauuuucccaccucuugaugcuuuuugacuaugagaugaguucaucuuuccuggacauccagagagacgccuggcauuuuuagcugaucaauagacccuuuguggccuaacagagacacaccugaaggugguuggucccagaugcgaggagcaaaggcaaaagagaggcaggugggcaucugccucuauguguagcuugugcaagauugauuucauucuugaucagugaagaucucucacuguugggucugcugcuaccccaaagcugaaugccccggcuuuuaaucugugugcguugacuccugccaugaaacugacacccuccaaggacccuccucacacucaccuccuguucgaugcuggucuccagccaccuucacuccugacccagcagcugagcacagccgaccugcucgcagauccagcacgccaggaggguccugcuguccagcuucccacgggacuccacccccuggcaucccuugaggacaaacaguagaggggcaaaacuuggagccuccaaagccccucugcaggggcuggaucugcagcuacgccacucacagaucuuguguaccaggcaagugcuaaccugucugagccucaguuuucccauguauaaaauggggauaauggugguacucaacugguagagcugcagagggggugaaaugaaguuucacggguaaagugcuaagaacgugccuggcccacaggggucauuguguggcugucuaccacuauuauuguucuuauucuuuuauuauuuauuuauuuauuuauuuauuuauuuauuuauuuauuuugagacagagucuugcucugucacccaggcuagagugcaguagcaugaucucagcucacugcaaccuccaucuccugcguucaagcaauccuccugccucagcuuccggaguagcugagauuacaggcacacgccaccacgccagcuaauuuuuguauuuuuagcagagacgggguuucaccauguuggccaggcugcagaaccugaccucaagugaucugccuaccuuggccccccaaagugucgggauuacaggcgugagcccccauacccagcccugccacuguuauucuuaugacuggucugcccgugcccagguucucuccaccugccuucucccaucucauaccugcugauauccacugugccuucucccacuuccaggccuuuggaccugcuguuccucuugccuggagugugcuuuccucuguucuccaccuggggacccccccacuuuguucaugcccagaggccagugucaccccaccuccuucggggcaccucccugaccccugguacuggugcucugagcuugccagugggauggaugguuggucuucagguuguggggagcaggagucagucucucaugaugcuuauaagggaggauauuuauugagcacuuacugcauaccaguuuaauuaugggggcuuuuuauugagcaccuuaucuuggucuuacuaacacccugugaccaccagcaauagaggcccacgcaugcaaagccccagguucugcagugagaagguggcugaggggauuauuauuauuuguuuauuuauuuauuuauuuuuggagauggagucuuacucagucaccuagguuggagugcaguggugugaucucggcuuacuacaaccucugccuucuggguucaagugauucuucugccucagccuccugaguagcuaggacuacaagcacacaccaccgacgcccagcugauuuuuuuguauuuuuaguagagaugggguuucgccauguuggccaggcuggucucgaacuccugaccucaagugauccucccaccucagccucucaaagugcugggauuacaggcgucagccacugcacccugauggcugaggggauuugaacccagcccugcuccuccagcccuuucuuuuccccgagaacuacauaaccugccuuccagcucaugccuuuuuccugcuuucacuagaucuucaucagguguggcugcuaauaaccccugcuggcugcucucuucccccaccaggaacccuaggaaaggagaacuugucuguccaguucaucaucgcagcccacccggggucugacacagagaaggacccaaaaaguccugguuaagucagcagcucucagggugugggucagugaccccuggauguccugagaccuuuuccuugggguuugcaagaucaaauuacuuucguaacaauacuaagcugcuacuugcccuuuuuacucauauucuuucacaaacacaugguggaauuuuccagaagcuauccaaggugugaugacaucaucguuccuauggcuaauagcguguguguuuguguaucuuugugcuuuaaacaugucucaguuuuaauuuugaauaugaugacuauugauugcugugaccuacccagacaaagcccuuuagguuccuccaucauuuuuaagcaccuaaaagggucccaagacacaaaaguuuugagagccacuguguucaaugaauaaaugaaugaguugggugaaggaaagagugaauggagugugagccaaggcauuuggaccuggcuugucuuuaaggguugguggucaggguggcggaaaauggauucaagggaggaaagagcgacacaggaguccaggagagagggagacguggaauuacccaaaucccaccugccugacugcgccccauagcccugauuagucccuccaaauacccucugaccuggcacaagcauccccggcacagccggcggcugacuguucugagguguuuucuacagcaaaacaauuugaaauaauuagaacuuuacaaaaugucuuuaaacacgcugguaaugggcauaagaaaacacuugugaaguguaaucaguuauuagcagcugaucaauuauccucauggauagcuguugggggggagaaaagaagcaauaauaagccccuugauuaacuaauuugaauaucuuuggggaacaaauucugaaauuucuuucuauuuucucccucgcuauuguaauuguaacgccggccgcacaucugcuggauaaagacggauggaaaugguaaugaguguucugcugugaacaggccccuuguucgggauccaggaaugaaggcgcuggaggugugggggcugcgggggcugccggcugggccuggggaccucucacuggcuggagugggcagcacugccaugggcuuggccuccgccuccugaugagaugucaaggucgggggaagccggcugcgaugggcaaagggcaugcgcagacaggugccccucugggaaacauuacagauucuccugaagacccucuagggccagcugggauggagacagucugucccaggauggagcagacagugaaggaaaccaacauucuggaugccaagguugggcuccuccgcaaccuugcugggugauaggcuuacaaaaggcaggggugacucagcuggacagcauuaaggaccuccacauuccugcggggucuuuggucucacagugcaacaugaacauaucacaccgguggccaccuggguagcaguagccuugucacuaaagcgaaucucuagagccagacucuuugucuugaauccagcucugcccccucagcugugugaccuuaggcaagugacuuaaccucucugugccucagcggugcucaucagcgaaacaggaauaauaacagcaccccccuccugggguucuuguagcacagggccacgcacgugauaagcacaaaauaaauggaagccgucacuguuauuauucucuccauccugcauaauuaacaggcuagacccgaguuugcaaacuggcaggccgggguccaacuccccaguaaaucuguuuuguuuggcacaaacugcauuguuaaaauuuuugucugaacuuguugccagugauuacaguucaggagauuuucacaucaaaaaucuggauuuggggccuuucuggagaacuagacucccgacccugcugggcccacaguuccaugcagcaccgaucggccagagcugagcauugcagccuccuguagcagggacgcuggucuuuccuuugccauguccccaucccacccagucauuccagggcaucaccucgugggccccugcccucaccuguaagccccaggaggucaacugggaacaggucaccucggucccugauguacccggugcccgucacacagcaggugcuuaaagcauauuugaaugagcgugucuucagacgagaggcugauuacaugagcagauccaguucgcgagcagccccagagccuggguggucuugccugagcgaggcagcaaacuccagccuugguugugucuaucuggggacccccagcuguccagcuccuguaccacccaguggccaucagaagaaaguccugcugccugugaacucccaucucccucuccccaacccuacaggagauguucuggagacccacaugcgggggugucaaacuccuaucccuuaagcagcagaucugaggcccaaagugcaccagagaagccacaaacagccccguggccagccagcaccugcagucacugguccacguuccucucauucagacaaggccuuuucuguauuuuguuugaagcuguucaaaaaagagcaugugaaaccacuuuuaaaaucccucccucccuuuccugcccaacgcaccuuuuuuucccuccccugacuguuccaucgcuuaaaaauggcuuaaccaauuuggguuauuuuuagaaaaaugcugguauguuggcugacaaccuauauucuaaguuucaaccugauauggaaaagacagaguuuauaaaccccuaggagaaaaaaaaaagaaacacaaaacauugcuuuagaauagaaaucaucugaaacugaccccaugggucccggccagcggggcaucacugggcaccagccuccggugugagauuucaaggguacagaaugaaauugguucuugcaagcuucugccaacaucgcugggagaacuggguggagcaucuuguggacugacagacacgaguuggaacccugguucuuccacgcucuguccuugagcuggggaagcgccuucccugagcccuugggucugccaucugugacauggggauacugguaaucaccguagcuagggacacagagcccaacacuaaggacuuguccauaauguuuguuauaaucuugauggaccaaugcaaagacaaggcucucaaagccagcacaagccuuaugaauaugaggaguggcugcuaagccuagcuuccccuaccuccucauuucuuuuuuuuccagcagcuuuauugagauauaauugauaugccaugaaauucaccuauuauacauguacaacacaaucgauuuaguauauuuauggaguuguacaaccaucaccacauccaguuuuaaaacauuucugucaccccaaaaaagaucuuuuggguccuuuuccagucacugucugaucccacucccagccccaggaaaccacaaaucuauuugcuguauccauagauuugccuuuucuggucguuucguacaaaugggauuauacaaucuguggucuuuguaucagcuucuuacauuagguauaauguuuccaagguuugcccaugugguaacauguaugaguauuuuguucucuugauugcuaaauaauauuccauuguauggauagaccacguuuuauccguucaucgguugaugggcauguggguuguuuguacuuuuuggcuguugugaauagcacugcugugaaaguuugcacgcagaucuuugaacacauguuuucgauucucuuggguagaggaguggaauugcugggucauaagauacauuuaugucuaacuuauuaagaaacugccaaacuguuuuucugaaguggcuguaccauguugcauucccaccagcaguaucugggcuuaguauugucuuuguugauauuugagguugcauuuuuggucccugguuucaaugagaauuugggcugggaauucugggagccacuggagcuugaagaaaugaauggcagguggggggcauacaacaaaaucgcacauccucagguguucuaaaacagcacugucccauagaacauguagaugauauauaucugaaccauccuguacgguagccacuacccguugugguuacugagcacaugacuauggcuugugcaaccgaggaacugaauuugugauugcauuucauuuaaauuaacguagaaguacuaaauuuaaauaacuacaggaggcuaguggcugcuguauuggacagugcaguucuagaaguucaggaucaccacucaguauguucuggguccuugaaucuuucagaggauugagcagaguucaaaccuuuuaaucauacauagcuggaauaggcguggggcucagggacuaggggcugcauguacaggaauauugugucuagauggugcucagugacucagagaagaggggauuuaaauuggggcaucuuguagaggcacuaaaagagaguggacgggcucuggagcuaggaggacccaggugcaaauccuagcccuguugcuucccaagccugagaccuggggcaacugaccuauucccuccuagccucaguuuucucaucugcaaaauggaaguacuaauaucucucucgaaggacugcugugaggcucagagaauaauuccucuaaauccccuagcucagugccuaccacuuagucagugugggaaaggaucagcuucuguuauuguuaucuuuauuguugguacuauucugccuggcccccaggacuggaucaaugccaugucagcccagaaucccauccucauccgugaaagcugggauguuagacugucagcaucacacaggcagggacuuugcgguggccacuguuggauccccagugccuggaacagugccuggcacagaggggaugcuccuuacauguuuguugaaugaauaaaugcguacaugcuacuggcuuguuggcaagcagcguguaggcaucuugaggguuccuggagaaaacaacacccuccuucagaaaugugacuugaaaaauagcacuggguucaaugccaguggcggccugucuugagugaaggcagagacagcuucccuguccuuaaauggcuucauccagcuggagcguggcuguggcucaggccagucuaaggucauccaaggcgggugguagaaugggugaggcuuggccaggucagauccaccucccaccaccagggagccauaggagagguucacacagugaaauaacacagccccaaaaugugcauggguuuacauacagguaauucucccaggcccuaaaacaucaggaugugcucacuuuucccacagcagugcccccacucaagccuguuugggggaacccagugguuucaucccuuucaucuggaauuuccugcuacccucacuucuuucuucccuuucuugcugcuguucuugaucucuccuuccccacccuggacccuaaagugagauauuuccauucuuccagaauuauaauuuuuuuguuuuauuuaugugaaauauucuuuaguuaucaaaaucuuuucauacucauuauugucauuccgugggcagagaaacuuggugaggugaauauucauuuaaaaauugucuauuaaggccaggugcggguggcucaugccuguaagcccagcauuuugggaggccgagguggauagaucacuugaguucgggaguuugagaccagccuggcuaacauggcaaaaccccaucucuacuguaauacaaaaauuagccgggugugguggugaacaccuguaauccuagcuacucaggaggcugaggugggagaaucgcuugaaccugggaagcggagguugcagugagccgagauugugccacugcacuccaaccugagguacagagugagacccugucucaaaaaaaaaaaaaaaagugucuauuggguuuggaccaggcacuggccuagaugcuggagcuauggaggugaacaaaacagacaagagucccugcccucccggagcuuuaguccuaggaaggaggcugauauuaaauaugcagauaacuaucuuugcaaaugauguugaaugcccuguggaaaaggaggaaggagaaaguggaucugcuuuagaggcaggggugccaguggggccagcgagggcccugcugagaagguggcagcacugggggggauggggagggauugcaggcugcagguacugcacaugcaaaugcccugaggugagaaagaggcuggcucaucggaggcccaggagcagcagguguagcuggagugcauagaguugggcagagaggggccccccuaagguauaggaagcugugagcaguagccuggcccucuaggcccagugagaagucugauuucaaucuaagaccauggcaaaaaucauggacaaguuucaagccaaggaaagagaagagaugauucacguuuugagcgacucacuccauccaccauguggaaaaugcaggcaagggugggugcggagagagaagggaggaggccucggaaauaauccaggcaggggaggguagcagcuuggacaaaggcggcagugggaguggguauuauuucuggacguuggcgggauugaagagacguggcugggauucguucaacaucacuauuauucuagugguacaagugaggacacugaagcucggagaggcacgcugacuugcccugggguuagagcuagcaagagcagcaagcaggauucgaacucgggcuuuccuggugcuggaaucugcauucuguacuucaguacuacucugggcagcucagugugguauccagccccaucucucuagcugaaaugaugcccacaaacauuauccccauugcgcagauuaggaaacagacucaggcguuaggauuuccuggcuggagaacaccaaagacaggauuugaacccagcccacacaccuaaguugggaaugugcgugcccugcauccugggccucuucaggcucugcagaaacaaagggaaugagauggguggagagaaggucacggauccacaggcccuggucuagggcaggccggucugucaugcucagguuuucucuuagucaauagaguaagaacucaauucugcugagacgucugggugcaucuguguaugugugugucuccaugugaacgugucugucugugguaugugucucugugucccggcgucccuguaucuauguuuguacguguguuucuguguguuuguguguuacauguauggaucucugugugucuguguguauguaugugucugugugugcauuuaugugucuguguguauuuaugucucgugugucuguguguccaucuacagucacagaggaaaaagcccgcaggaaggcucuuuucuacagcacucuguuugcgugcugcgugguacccugcucuucgguuuuucacagaugaacaugcauuacuguacuguuagaaucaggaggggaggugaacagagauaaaagucuccucggguugcgggggagagagcauuuggagagaaagcuuuugccuguguuguuuugggaaguggcuuuuuaugguuuggggagaggagaggacacccccucuugcagcaaggauccgagcccugucuuugaacucucccacagcuggaucugcaccugcccuguguagcugucccuggccauaccuuuauuuacaggggaggcaguugggggucucgggugcagcuucagguaauuaaagucagcuggauaggcauuucacauucauguugauaauaagcacuuuaauaaaauguagaaagauaaaaugggauuuuuuuuuuagguuguguuuuucuuucccucccucccccauucuuuccuuucuggaaguggcaagaacuguaucucaggaccccguacagcuugaugugaaauacacccgggacagggaacggcuacuuggacacuguuuguggagugcuggggggaggcuaggaugggagcuucugucguggggucaucugggaagcaggagccucauggcagacucucggguaacccuaccuggccagcccccauucaauccaggccucccucccggaggugucgucacuuggcucagugucuucagaccccaaaagaauagccaugauguacguauaggaugcagccaaauuugggguguccccaggagucaggaaguccagcagaauugguggggggcaggaacauuuaguucgaccucucauucucucuuccuccuuaucaccccuacgaaaauuuucucuuuaugaaugcuuccaucuucgugcuuacaaacuagccuccgcgggggcauuuauauuagcagugaugcuucccauuuguuuaggaagaaauugcaucuacugguuucugcugggccucuccguaaacccucgaggcauccuugcucucauuuaaacaauaguggggcagggggaggucaggcacucggcaaagucaacagcaggcaggggacaagccuguguagccccugggcuaaaauggcuugugaccacccuggccgccccucguuugagggccuccccucucaaucucaccuucagccucccuggccggggcuucuaguugcugggaggcauuggcuccuugccagucccugaaauccaucagcgcccucuccugccugaugccuccacccaccuuccccuccgcugguagcaggggauggugugucugcucugccagccucuaggcucagucucuugcccgcacgguucccugcagcugccuggagguggggguggcaccucugcucagccaaccccucuggcucccaaucgcuucuugccuuggucccacaacuucccaaccuaauccccacgaggcuguaagauacauccagauggucacccauuccccaacagccugacgguuccagccccacucaugcccacagcucccuccuccucuagugccuucccccaggccccacgugcccuuaggcgcagcucucuccaggugugcuuuucuugggacuacgccugcauauuuguguggcaguccuccccaguccuccccagagcccaaggcucucggaacccuacccagcauacagugggcgcuuaauaaaugcuucccuaccuggcaccuucucagcccugcaccuggcaccuucucagcccugcaugccagagaauuuuuccagagcuuccugagguucccacagacuuucuucccacccccagaugcucccaaccuugaaaaagaggcugcugcaagaaaugaguuagagaaaagauguugaaaguggcagacuucagagaggaugcagugguuuggagaagaguggaccagaguucaaagcccagcucugcuuuugccugauugugaccuugaggcagugacaugaucucucagggacucguuuucccagcugcaaaaggaauuauuaggaacacagaccucccagaagaugcagugggccaaggcguuaaaagugcccucaugcaguaggcguucagcuucugugaugugagucauugccacuguggccccuagcaaaagccuggcauguaguaggugcucaguaaacauucauugacgaaugaaugagugaaugaucauuuugugggaucccuuuccccugcccccauuuugccgggggaagcacucucuggccucucacccaguuggaccagacgugucagcccuaagaggggcacaagggguccccagccccucaccugacaccugucagagugggggcuauuuuguuuuccuggugcccgugugguuuuaaauuccgagaacuccggaauauaaaucagcaaucaagggcaggaggaagugaucggauguggcucugguuuucggggcuugccgacaagauaauuaggcguuugauuggcauccucucucaaggacagccaccuccaggucccgccugcacaggagcaggcuuguuuuccugccugaugcuuguggcaggggacugaugggggugacgggugggauuggggacccagaguuagccagucuuucaucuguucauuuguucauucauuaauucaaaguauugagcaccuagugugugccaagcaucgggacacagcagugacccaaacggacaaaguccuugugcuuguggagcugacauuggagggggcaggaggcgggcagggaaagcaggcaauaaacaaauggagaagugacuacauaaaugugucaacggcaagggcuugggagaaaaauaagcagagggcggcugagguagagaggaggugcuuacuguuuuaaauaggacggcaggacaggcuucugggagaaggugguauaagagcuaagccuccgagcaggugaggaaagagggagcagccagugcaaaggcuccgagacagaaacgugcuuaguguguucaagaaucaauaagggcugggcaccaugguucacgacuauaaucccagcacuuugggaugccaaggugagcggaucacuugaggucaggaguuagagaccagacuggccaauguggugaaaccccaucucuacuaaaaauauaaaaauucgcugggcgugguggcacacgccuguaauccuagcuacucaggaggcugaggcaggagaaucacuugaacccaggaggcggagguugaagugagccaagaucaugccacugcacuccagccugggcaaccgaaugagacucugucucaaaaaaaaaaaaaaaaaaaaaaaucaguaagggccaggugcaguagugcacuccuguaaucccagcacuucaggaggcugagccaggaaaaucacuugagcccaggaguucaagaccagccugggcaacuuagugagaccuugucccuacaaaaaaauaaaaaguuaguugcacgugguggagcacgccaguaguccuagcuacucagaaggcugaggugggaggaucgcuugagcccagaagguugaggcugcagugagcugugauugugccacuguacugcagccugggugacagagcaagacucucucucaaaaaaaaaaaaaaagaaaaaaaagaaaaagucaagaaggacccaugugccuggagcagagugggccggaggguguagaaggaagugaagcccaacacgaaucauaugggaccuugacucagacucacaugggagccauggaaggguuuugagcagaggaggaacaggauaugaguuggguuuaacaggaucucuguggccgccaaguggggaaggggcuguaggagggugaaagugccaguagagagcccagugaggaggcuccuguggucaccuaggcaggcaaugacaguggccuggcccagguggcaacaguagagaggaggagaaauuguuagaucaggcugacaagauuugccaauuuacaucagccugaugauaccuaaggcaggcggagcagcugcugccucccaacucccagggccucagggcugguggcagccccagcccaagugccagccuuggcccaaagcauccagcccuucccaggcaccucccauagccuggaaccccugcaguccaccagccugucguccugccaguccccagagagaggugaugcccuggcugcauuuugcagcagugagaguccuagauacagagaggccacaggucugccuaagcucacagagcuggcaagcaagaaggucaggaccugaaccuagucugccugccaaaugcuggcucuuggccugccucaaacuaaaaaaccaaccacugccugggcuuucuggaagccugagcuacggagcugccaggugggccugaugucccacaguuguaauugccuguugugcuccccauguaaccacaugcuccaugugcgcaggaccugggucugucuugucccugguaacacuguaggcacacaaaaaguaguuauugaguggauagauggauggguggauggacagacagauggaccaggccuggucaugcuccuggucuucaggccacggcagaccuuguagagacaguuuagggaaagauuguccuccagggaaacaacccagaggaaaaucagaaaguuauagguucggguccccaugauggcacuuccucgccgugugaugugggacgaguggcuuugucucucugcagguaccgugcaucagaugacaccugcauccuaagacccuucauuggcucccucaacagauguuucuagagaauccacugcacucuagaugccacugggagagggaaaugaacuuuuguagugcuggucauuguggaccuagucgacagccagcccucuauggggcaguuguuauccugcuguucucacagcacugggaguuugcuaagaaguuguuggcagucuuuuggcucacacacaggccugaggcuuggcucuuugauccgaaugugaacuguccaucacccuggcccagcugauagaacgcggggaagccagcuuggcugggaacuguuucucauaggcaccaccccuugcccuggccucggauaauuggcccaauacaucuuggcaucugaaauuuacauacggcgcagggagugauggauggcucugguaacccgggcugucucccagccacggcucaguuauccaucucggcgggcugcggagccauccgucuugucuugucuugucuccucacuuauggcaggccggcgggugcccuccaucccgggucaucccccagcccccucccagagcuggcccucugaggccccucugaaggcgacacucccaaccugccccgcaguagauagaacaagucccuuugcucugaacauccccugaagcccuccucaguguuugccggcaacucugauagcaaaauccugaaggaccuccaugggcccaagaugcagaauaggacauuugcucccacaaaguugucccuccauccccccgccacaaggggcuucucauacuuacuccacuaauagucauuccacaaauauuuauugaaugcccacugugcaccaggcguugaacuagaaccccuggauagcugugaacaagaacuguaucacccagucaugcacacagcccccacccuugagggacugugugccauuggugguugucaacacucugaagacccuagacaccaagccaagcacuugaccugcuuacagucugguucucaagggguccugacaacccuaugggcacgaauucuuagccccauuuuauagacacagaaacggaggcugagucaccuauccaaggucacaaugcuagugaggcaucaaagccaacguuugaacccaggucaguggucugugaaccaugucacuguuucccagacagaccgggcucuuuaggggucucuggccuugacacauagcauucacucauucauucgaccaacaaacauuucuagaaugccuacuguguaucaggaacucuucuaggcacugaggauaucuuguucucauggagcuuucauuuuaguaaagaaguaaaauacacaguguauuugguagugauacauguuaaggagaagaaaacucaagacaagaaccggaagaccaggacaaguguaguuggugcacaccuguaaucuaagcacuuugggaggccaaggcagaaggauugcuugagcccaggaguuugaggccagccugagcaacauagcaaggcccugucuuuacaaaaaauaaauuagcuggguguggugguuugcacccauggucccagcuacuugggaggcugagaagggagcauugcuugggcaugggagguugaagcugcagugagccaggauugugccacugcacgccaggcuggacuacaaagcaaaacccugucuaagaaaaaaaaaguuaagggcuuuugcaacauucccauuuccucugccuggguugcuuggcuucuuuaucugacagauucuucauccuuccagacacaggucagaugguccuaucuuggcaacucuuuuucccaaucacaguaaguaaccuugcucucuguguuccugucauacuguuuuuauacuucucauaguguaugucggcacauaguguuagaauggcucuccuugucuaccacacuguacugugaacuccucaaggacagagacuguguugguugguuucuguacaccaguaccuagcacugugccugacacagaauugggccagugauuaguuggaugguugauuggaugggguuagauaacuaacccaccuauccacccaaggauggaugacugcuugagugauuggguaccuggaugcuggacaagaucaguugggugaauagaugaauggaugauccuuuucuagaugaucaacuguuggauaaauagaugguugguuagguggguagacauauaauuggaugaauagauaaaggcaugguugguuggauggguagauguauaacuggaugaaaauggaugguuugguagauagauguaugauuggaugaaugcauaaauggauggugguuggauggguggauguaugucuggaugaauggauaaauggaugauuaguuggguagauagauguaugauuagaugaauggauaaauggauggugguuggguaguuggacggauguuggauaaagggcuuccagccugguuagcacuucagugguuacuggcagccccugcccaacuugggaccacacuaugauuuaauuagaagagguagauugaagcucuaccucuccuuugccugaucaguuuccauacccacccaaaggcaauacaaaagacauguuaggguuucacucuucuccaagccugcacuaaagauaaugucucugcaugauggccuuugucaccuuucacuaaaauuacuuauacccaagcuugucugguuucugagcucuuggaggauccaggcuauaucgggcuuaucauuuccauccuccuuaugaaaugccuagcacaucagagaccaugaaugcauugauggacgaguggauggguagaugaguggguggacagaugagguccaacaucuucgguugcaucccccuguaguaaggugaaagcagagccccuguuuggauuugggggguuggugacuguacuggaagucauaaucacugcucaucuuuguuucugaaaccuggccuggaaucucgaccaucacuucacauacauauccuuacaagagauacuguacauaaagugcuuagugcacucaauaaauauuaguauauaugguguaauagacucucaauaaauguuaacuaugagcuauuguuuccuauaaggaacuucuguguaaauguucuagggcuuaaaaaaaaucugguagcaaauaucagaaagaguuaacaggggcucaaagcagacaccuaacuuggaggggugucugggaagccuuucuggaagaggagacauuuaagcugacacacaaagagaugaguaagaucaaccacaaagacagaaugaguucaucugagcugagggaaaggagacuguggaaccacggagucagaagguucuggugcauuucgguuucugcacggaauuugguccagcugggaaggaaacaaggagaaggggaagugggagggacccagggacacccaggagugaggagauuguccuaggccagguuuuaaaccaggagggacauacugagaaagagauuguuugucuucauggaaucucuuuaaagccuaggaacaacugagguccucaauuccuuaaacccagcucccaacaaucacuuuuuagguuucuucucggagguggccuuagggggauaugucugagugugagguguccuuggagcugagaagauugugggcacagauaggcgggaucucagguugugucuuaacauguguuccccucauaagaacacagauucuagcccaaggcucuucauauagcugacacuuugggaucaggugugaaauuacuuuaaaaacuaaguguucuuguaaaauucccagucccuccugguuggggaaacccagacgaauugagaaugcuagacuugcuuccccauagauaaccaaccauaggauccuucccuagccaagacccacccuccccucugagaaaauccaaccucuuaacuaugugugauguggguggguaaccaaaaguaucugugccuccguuuucucaucuuuaaaugggagacucagauaugauucauauuuacugaagugugggacacauacccacugacgggacaugaaauuguaagcauucaguagagccaguguuagaagggauugacuuggguucugaggaacaguucugccuuaucucuuccacccuucuucauuccaacaagcagaaagucucuguaggggacugcauuaacaccccuccagcacuugcuaaccuuuuauaacaaacacaggcagcaaugauuuguuuuugguuauacuuuuguuuuaauggcuaccaucuguuuaugguacaugauucucuagugacaagaaaguguccuuuuuaaauacacuuauuuagguuuaaaaaaagggaaggagucauuagguaaaagucaggaauaggaaaaaugugucugugaugccaggguccaaaucaucguuacuuuuaggggguacugacaaggagagaguacucuagggaguuuucacaggcacuaggaacgugaacguucuacaucuugaacuggguagugcuuacucagguguaaaccauucacuaagcuuucacuugagccuaggaguucgagaccaaccugggcaacauggcgagacccccaucucuacaaaaaauaaaaacuagccuggcgugguagcacaugccuguagucccagcuacccaggaggcugugggagggucaccugagccugggaagugaaggcugcggugagcugugaucaugccauugcaguccagccugggugacagagcaagacccuaucuaaaaaaaaauuuuguaauucacuaagcuuaacauugaacuauggaacuuaaagugauccauaucucaaaaagagaaccauaggagucccuuugaagagaaauauuaauuaaucauauuuuagaugcuauaucaauaugacaaaauucacacagagggacaugaguggucaaaguuuggacagcagugaccugagcgaccuugaggauuccuucuagcucauauguucugagugccuuggaggacuaagucccaagacuguucagcacaccaauggcaaacccucucagagacaggggcucucacuaggcagugggcacuuccaggggguacugcagaucccaucagaagagccccuuccuccaagcccccggcuucuccugcagcacccggucccgggugcagcucagccccggccuccuuucucucugcacauuggcccgagccucagcugcaucuaucaucugcuucaggcucauuaaaauuauuucuuuuuaguugcaaaugggcuguuuaugaugaucauuauuugaauggucugcgccgggcuccgggcugucugucugcugcugauggccaguuaaucagaugagucuccucccugccugggccuggcccaaagucuggggcuguguuaaucauggcucccccagggcuggggggcugguggggccagcaggggcuggguaggagaagauccugauuucuuuuugauuaccagagcugugugugugguaguuuggacaugcuuucuaaaacucaguuuuagaccagugcugguuuauguuugugacagaauuuuuuuccauuccuucaaaauagauauagugccaugagcuuuuuaauuuuagcuguguguauuaugaaagacccgugccgaugcugucauuggcccucuugcuuugcugauauucaaauauccuuucuuuuagggugggagggagugguuuuuaaugucuuugcuugauacaguaacauuuggcaauacucuaccggucuuccuuucauuuuaaaacagaauuuuuacugagcugugaaauccaaaauucuuggaaucauugaucuggugggguguuuucuuagcugucaguuuaucuaaacauaagauuaauaucagccaaggccaggcacaguggcucacaccuguaaucccaacacuuugggaggccacagcagguggauugcuugagucuaggaguuugagaccagccuggcaacauggugaaacccugucucuaccccaaaaaaaugcaaaaauuagcuaggcaugauggcacaugccuauagucacagcuacuagggaggcugagguggaaggaucgccugagccugggaggucgaggcugcagugagcugugacugcacuacugcacuccagccuaggugacaagagugagacccugucucaaaaaaaaaaaaagacaacauuuauugaacacuugaagcuuuacacauccauaucauuuaaaacaaaugcccugaacaccccccagcugauggagacgcagagcagaagcccgcugaagagaagggcauuaaaaaauaugccuuuauaauccaccaaggagauaauccacaccucaguuauuagaauugacuguaguauauuuccaagccccuguuugaaucaccauacagacaagacacauuaauguguuuguuccaugagaugauguauguuaggagcuuagcauagugccugguacauguaagcuuuccauaaaugguaguuaugaguauuuacuauuauuauuauugguguuaguguguuuaccagugaacuguggcaagaauucaggguugaaggacaagcauagauuuaggcaaaauugagaagaacguggaugucagugacuucgucugcucgaggaaagacaccaagggcugggcuugcaguggggucagggugaggggacuggugauaucccccugccuucccuggcucuguucucucugcaguguggacacagcagacauccugccugucagauuugcacccaccagcagccugggaggugcagguggagggagucaggcauaauugucugugaggacacaucaggugguuggacuuauccugcucugcaauuuccuuucagaaccugggcuggauguuuuuaaugagaggcaaaguucacccccaccagguauauugguugcugcauugugggaaggcaccagugucccugcaauaagaacauagugucagacacggccgggugugguggcucacgccuguaaucccagaauuuugggaggccgagguggguggaucaugaggucaggagaucgagacuauccuggcuaacacggugaaacccugucucuacuaaaaauacaaaaacuuagccaggcuugguggugggugcuuguagucacagcuacucgggaggcugggaggcaggagaaugccgugaaccugggaggcggagcuugcagugagcugagauggcgccacugcaccccagccugggcgacagagugagacuccgucucaaaaaaaaaaaaaaaagugucagacacacaauaauccaagauagagagcuguaaacccaugucccaguucuguuuguccuguagcaaugugaaaaucacaucuuugucuucaagagagaugagaaaaacuaagaagagcugggaguacgcugcugcaacucaaauugacccuggcccuccaguuuuuuucucuccugccaagugagauucuguccaccuggccgcgccagucuaccuuugucuauugcugcaaacacugaucucuccugucacuggauauuucgguuguggucaguuguaguuucuguauuagaaacugugauuaguuuuaagugaugaugaaccagaauucccccuuuuugcucauaacaccuuguuccucaccuggcuuaauccugauaaaaaccgggcuuuuaaacuggaagcccccauguacuuucaagugggaguacccugugcuucggcaagaauugguuucagcaccuuggagagcaccuguuuccgcucccccaccaaaauagagacagggucucucucugucacccaggcuggaaugcaguggcaccaucacagcucacugcagccuugaccuccugagcucaagcaguccucccaccucagccucccaaguagcuuggacuauagguaauuguucuauuuuuuguagagaggaggccucacuauguugcccaggcuggucucaaacucuuggccucccaaagugcugagauuacaggcaugagccacugcaccuggcccuugccucuauuucaaagcuacuuuggugccucuaccuucucccuucuagucucauaauuuucuaaagaaguuagacauuucuccagaaauagaaguuccuucuuggauuucuacaaagaaauccauaggucagggacacucaucccagcuuggggugccagguuuauggugcucuggugagcugcuauugagcagauuuacugacucucagacaugauauaagacaauuaccaugcauuucgucucuuagagggaaaagaauuugcaguggguuaauaguacuuuuauuucauuaucuaauggcaaaaguguuucauugugugugcaagaggaauguguauuagugaugacaaauggggucuuucaacacggugccgggccucaucauacauauguuagauuaaagaguucacccuagaaauacacucccgcaucugcguguguguuuuuaauaaaucugauugcagaaauuuauugcaucaccggauuuaggaaauuauggggcuugauugcugcaaauauaaucggaugauauauacagaaaugcuccucgaguuaugguccagaaaaaaagcccaucucgggauggugcaaggaagcagccgaccacauaaacagagcauuucuugaauuaugcaaaugaaauccaugacaacucauggugaauuguacuccccuugugaaacugccaccauuaaagugaagaaagcuucaagaggggugaucaaauauacaugcacgaccagcagacauugucugugaugugugugagccgaagcauccccccuuccaucucucucucuuuuucccucgcugguacauccuauaaaaaccuggucugauaccuuccuugcauauaagccagcaaagcaccuuccaauccauuucuucugaauccaggagucuucaaugaaauauuucuuagacuugaagugaaccuuaaaugauuuacugcgagauacacaaaaggucagcuuacuucuuauuggcaccuucauuuuuccaaaaucuacugaaauuaaaaagccaucuauaucuuaaaaggcguauuuaugaaccuuuaaguguaaguaagucauaguuggagccguucccaccucugauauaugaaagcugucgacagcacuuucuuccacuauaauaugcccauacaauaugccgcacuuuacuauuuugacauggucuggagauguuuucuacaguuacugacaagcuuaugccaucacuccuuuggaaauuuaagagguggggcaggggguggggggaagagauggaaaaaaaaaacaaccaacuccacccaacuuuauagaagauuauugaucuggccugacuuccgacgagcaaaaaaagcuguccuggauuuuuuuucaguugcaucccaguuuuguaaauuauuuauuugugccaggagucaauauccugucuuuucucagcuuuguaaguuaagaaaacuuguucagaaugcuguuuuguacagugguuaaaaaggaaaaaaagaagaaaaaucuuuuucuuuucucucucucucuuuuuuuuuuuuuuuuauuguuccagaaggagcuuaauuccgucgcuucugagcugucugcacggcaggaggagagugaacauucucauaaacauuuaauugaacuccgccgggaauuuaagaaaaauguaccugagguaugguauauuugccguuauagaauuaacucaguaggaaugcagauuucucuccauucaaacuauauuuugaaaacuguagaugcaagugacuaacaagaaaagaagcuaauuagccacaaagaaaaaugacagccccuaaccuuucgggguuucuuggccuaguggugcucagcggugccuacugaagggagggcggggcguuucuccaucaacgucauuguuuuuugagggcgcugugaaacauccauuuucccccaacauucauauccaagucagaugccuggccuugcuggcaaagacaaugugccuuagaguucuugauuuuauuuugcuuucccguuggcgucuggaagaagacagccgucgacucucuaacacccucucggggccugccggcacucaucgucucugaaacucggccucucacccccuuuacguucaccucauucuuccccuucaccgccucccuugcagucccagcaaccagcuaugccuuuucuagcagucauuacagggagcuuggugggggacagagaaugaccagcccccagcaauguaagggccccccaaggaacagacuagaacagacaaguuucuguuauuuaccggcccggaugugugaauucuuuuccauccucucgcaggccccccuauugcuucucaaauuacaaaacaaaugaugagaauaaacauaaauagagaaaauaaagcccucugacucuauauaaaaaggauguggcacaucagggcugugacagggaacagacaucagagaucucugcggccagaucuccccaaagccaacuguguuucauucuggucggcagaagguuaacaucuguccuuaccugcucaggugugcuggaggaagguggggcagaguuuagcauucagaugggagacccugauuccagcaguuacacucugccagucugauaccgagauuggugggggguccuguugccaucucgcuggucagggaggggaacaugggaagacagggaauaggcagacccagccagggaucaggucauaugagcacagaggggagaagccucagguccaccucaggcucuuagcugcaaaauccaucucacacaagucauaaaugucuuugguucuucaaggcaagagaagggacuaggaucuagcuagaauuuguccauggagcaagucuggaaggaagagagugucuacauggagaaggggcaugaaucucaggucuaaaagccucucccauguuguggcuucagaaaagccaagccaggccuuugguuugacuccaagagccaagaaggcaucagugaugccgagaacccuuccuucgccuuuuagaacagagcucagcuuggucuggaaacuccccagaaugagguuaccuuugacucuccuuugacuccaggaaucagagcugaaucggccccacaucuucacagcugcacaugcccucucccuggucagcuuagacccucuaucucaucuuccuucuagcccaacugacuuucuucugaggccaugugggagcccccaggugaugagggaaauccaggccauguuuuaagccucugaguucagcuuacauaauuuuaauacugcauaauuaugcaauuauguaauuaagaggaauaaguuuccauuccuauuauagucgugccucugaaaauucuccuuuuuggagccagucucuccugauggagaaagucacgccgaggcuuuauuuaagagcuccucuggcuggugcccagcucaccuccugcucgcgccugugcucggcgucccccagccgugaagcagaugaggcggcaugcuucuagaaaugggcagcauuagcacgaagucccgccaaacccaucccucccagaaugcucagauacuugagugugggguuuugaaaagggccuguuuggggaguccagugaccugggcucaaauucuagcugcgccauucacuugcugugugaccuugagcaggcuagccccucuugggaccucaguuuccccuucuguaaacucaaggaacugagagaugguuucugagaggucccauccagaacuaauguuuccugaacauggaccagaggucucccgccaucacauuuuuauuuagucuguaaagucuuucgaacuuuacgguggguugccaauauuuagcaucucagaugauuucaccuaaaaacuggauuuccggugccuuuugagaauauuugguagauugugcaacccagagguuccgugcucaugcugccgucauaagcuagagcagagcacgccaccccaucgguggggguugcauugucccagccucccucguagcugcuuccugccuagccugguaggcauuugaguucaccaccugugacccagauucucagaaguuuccuuauccauggcucagccucgcacccauggccccuuauggucaagucuacuaggacugugucuccccugaagguccccaacauacaucagucuaucaaucaguggcucaggaaagcccuggggaccuagaaucaggggcaggagcaacacaguguuauuugcauaaugaagggguuuauucuuuaccugcccauaagucuucaacccaucucuuccuuuucugcucugucuggggcaaccccuccccacccuaucuagucccucagugccucccauggggauuacugguaauuguggcugauugugaugggggagucacaccagcagaucucacaggaaacuggaggauuaggguuggagucucgggacacaugguucuuaagguuucccucuuacgugccggggagaagaauacauaggaguuugccaggcuagcccaaguugcugggaaccucaggucacuuaugaaagccaggaaauuagagucuggaaauaggaggcucaggguggcugugacaaaccuccucugaagacagcccacguccauagaguuccucagacauuugcagagcucgaaugggguauaaacccagccuagacugcagaaacugcacguucuggugaggaaggagagucaguuacacaaguggcauugcuaaaaugcaaaaggcagucuuugcuggagagguggcuacaggguagggucacggagaccuugcaaccugaaagaggcagccccgggcgacaccuugaagggcagaagguuuuuaaggaagggcuuucauguagugcugagcauggagaauugggguuaccucuccagcccccaccccacuccaaagugugaccugggauggaccaccuaucucacaagauauuucgcauaaaagaccauucuaugaucacauucauuugagaaacgccacuuccuuugucuucuggaaauucccaacaugcauuauaugaaagacuccagaaaguccugcaggaaagaaaccccuuggacuugacguuucccagucugguguggcuugguaccccuguuugcgugugucccuugugaaauccaauggaguucaggccccacgggacaugcuugggaaaugcugagccagggacagcagcgagcuacaagcaggggccacgggggcgucccaccuggcacuguagugaacucuuugcugaucucuuuuucaggaaaucagagagaugguggcuccuguauuaaaaagcuuccaagccgagguaagacccagggcccacagcaugucagaaaagugcccccaauggcucccccuccuaucccaccuagaguugcccaggggggccagcagccuccagaagcuuuggagaagcuucccuguccccauugcaaacucugugcccuucccucuggucucccauccgaaugguauaguaaugagaauugguucucuguucauuuugacagaauucaagucugaucccaagaaaucucccucucccucgacuuugcccagccuuacaauggcucugcuacaugugagaucugugaccuuggggcguacacaguggcucacaccuguaaucccagugcuuugggaggcugaagugggaggaucacuugaggccagaaguucaagaccagccuaggcagcauagcaagacccccaucucuacaaaaaaauuuaaaaauuagcuagucaugguggcacgugccuguggucccagcuacuccggaggcuaaggugggagggcugcuuaaacccggcaaguugaggcugcagugauucaugaucgcaccacugcacaccaaccugggugacagagcgagacccugucucuaaaacaauaaaaaaauaaaauuuaagaaagaucuaugaccuugaacaaaccuaccucaccuuccagccuugguuuccuauuuuuaaaaucagagguugguacuagaugaccuuugcccucucuuggcauucugcuguccuuugauucucugaggcagccuugcagauaaguccacacaguuaccagcccaaccagaaauucuuugcaccagcccacucuuugaguauaaaagugacauuguccacauucuuuccugccgacccgcugagcccuaguuccuuugcuguccucaguaaauaauuucucuugcuuuuuggaagcccugugaucagggugaacccccgccccaccccgcccauuucuccucuuugcuugacuucguaaccaagagucugauaauguccacuugucuggcuggcacaggaggcaggccaagaaaagacuggaaucauguggguccagggauuucuaaagcguuccaucuugagggggcucuucucaggcuucccuggacucaggcaggaccccagaaggauuggccguacucggaucucaccagaggggaugcauuuuaagucugucauccaccaagcgccacauuacuuuaaaucugucucuuuggaaccacauaagcacauaaggcaauauuaaaguaaacaauaacuggauuuacacaaaugucgcugauuuccauauuuuucauccuuucauuuuauuaccuaguugacugaugugcuuauuuauuuauagggccauccaguauugguucauuugguugcaaggugccugggcuuggaagaaaaaaacuagacagaccaauaauguuaggaacuuuguguuccuauauaaugucaugacuuuguguuacaaaaaaaaaaaaaaauagagguucccaucuaccaacuccuagucccaggagagcugcucagcacacaagcucccuauagcagcugaucccucugcccaauccaaagacaggcauucagcuguuuguagagagcaucacuuucucagcuguuuccuugcuugaguuggugugaacagagcaucccuuggccucuuagagccucaguuuucccuaucuguuaaaugggaguauaaagacacugacaagucuuuucauguuguuuugaggauuaacugagaucuaaugcagggaaaggguuuaauguaaugucugacacacgaagagcuguuagcgggugaagaguacagaugcuggagccagccuggguuggaaucccaccucucccacuuacuagcugugugaucugaggugagcuacuuaaccucucugugccuccauuuccucaucuguaaaauggaauaauaauuauacauauuugaggcccggcaguggcucaccccuguaaucccagcacuuugggaggccgaggaggguggaucacuucaggucaggaguucgagaccagccuggccaacauagugaaaccccaacucuauuaaaaauacaaaaauuagccaggugugguagugggcaccuguaauuccaauuacucaggagucugaggcaggagaaucacuugaacccaggaggcggagguugcagugagccaagaucacgccacugcauuccagccuggacgacagagcaagacucugucucaaaaaaaaaaaaaaauuaugcauauuucacagggugagauugaggaagaacaaaguuaacacugaugaagugcuuaaaauacugccuugcauaugagaagucuuggauauuuuauuccuaugagcagugaccuccaguacagguuuacugggucucuaguauggcugagcugccaucugccacuuuccuaacuagguguugaaggcuuuuuaucucaaagauggguuucaggguuuuuuuuccuguaggaaguggguaugacuuauguuaucuuuucaauaggagaaauccuagguuugggugauguucgggagaagaccugacugaagcaugguagaaaauacaugcaaaucugacucaggccuggucaaaaccucaacucugcuccuaaaccagcuguguggccuuggggaaauuccuuaaccucucugaacuucagcuuuccuccucuggcaaauaaggcuaacaauaaggauucagaagccaggugcagucacucaugccuguaaucucagcacuuugggaggcuaagguaggaggaucacuuggggccaggaguuugagaccagccugggcaauauaaugagaccucaucucugcaaaaaaaaaaaaaaaaaaaaaaaaaaaaaaaaaaaaauuuaaaugagcugggcaugguggcuugugccuguagucccagcuacucaggaggcugaggugggaggaucacuugagcccaggaguucaaggcuguagugagcuaugauuauaccauuucuuucuaguaugggcaacagagcgagaccuggucucuuaaaaaaaaaaaaaaaaaaaaaaaaggaaaaaggauucaaacacuucagcagcauggaggcagucccagggucuggcacaccguuggugcucaguaaauacuaggacagagaaagucuuaggccaaaaggaaagacaaagcagaauucucauuuucaaaacccauguggcauauugaauagaugcugcuuuaauagcuggagaccuuaaagaacuuuguuaauuuucuuaagagggcuuuccaucgucccuuuaauguaccaagaagacuacauuugucuggaauuuuauucccgaaaccccugcuuuucucgugaucuauugacuaagccauuguggccucuguguccuccuugugccucaggggagagacgcugccaaaggaagguguuaauaaaaagcaucuucuucguccagaaaaagcugcacaugcacaggccauuuauaauccaaauuugauuuucauuuuaauuuuuuuaaugaggccucauccuuuaugccgcuguccucuugcaauccaccaggcucugggcuggcacugcgauucccaaguggguauuaaucaccuccuggaaauauucccuggagcaaauaccaucccaagucacauaaacuagcccauaaaacgccagggcagaauaucaugcccgucauuccuucuucccagugcaggccuuuccuugaaauauaccauguucaguuucaugguaaguaccaugaaauauaccauguucaauaaaauauaccauguuauuccugaauuuugcuucaccagcccugguguguucagaaucugggcauacuucuuaucuuuuuauauuauauaugugugggucucuuuucuuucuuucuguguguguguguguuugugugugugcgugccggugggaggggguggagaggaagugaauuugcccugcugugaaucaaggaagcuucucugucugccuugauugcuuaaaggacaguuuagauuucuccuguucagggaaacaaagacagccagagaagguggcuuaauggagacagcuugaaauggccaaaguuugaauauccuugcguacagagaaaagagcaagacgaaagccucgcuaauuauaaaaguugcuuuaugaaagauaauucaaagcaauaauuuagcaaacauaaucaagucgcacagaugggguuguugauggauggauugcaacaugcaauuagcaguucucgcaguuacauaucauuaacccuccgagcacaaaaauuauuuucucauuauuaguugaaaagguaaaauuaagcugacuagacaguaaaggaacaaacuacaauuaauuaccuucauuuauuacagucauuauuuuaaacuuauuuuuacuuggagggagacaugaaaacaucuaaauuaaaaguuuuguuaugcuaacucggaggugaaacuuuucugaagcgcgugugcacugucccagcuugaaagaccacagggccacuguugggagauuuucuuuuucucugccgccuuuuucuuccaccauaaaggggauguggccuguaugguggaaaaccuuuuggguuggauuggaacagagacauucaccugggccugauugaaacacaguaguuuggagaccaagugggcugaccuggccucugacacccaggagagguuagacaccuguggucugagccccacccucacacugacaagcuuaugugaccuuggcgagugacuuuaugucucugagccacuguuuccucaucuguaaauagggucagcucauaggauugcaugagauucagugacauucugugugucaaguggccagugagucacuuguugucaccauggugggcgugcaugguugugugggacugagaacguucucccucuaaucacucagggucugggggaauucguguggcaugaucaccuucuaggagcuuagagaaggggguaaagaugcauuagaucaucacuugagcccauguaaucauuuagucaccucaacaagcauuuauugaauagcugcugcauacuaggcaggguuccagaugcuggcccagugauggucacaacccaguggucaccucgccuccuuuugguaugagggagagcaagcauuuuugcaguacccggaagaaggacuucccaaaggagacaaggccacccuucuauuggcagcgugcagguccgcucaacagauccuuguggagaaccuucuaugucccaggcucugugugaggacuguugcagauccaaagauggugagacaccaucccugcccucaaggaugucccuaggauuccgcauggaauccuuuaaagaaagaaaaagaaaaaaugucuguaggagccaagucccugugauucugaaauaauguccagaagcccaagggaggccgucgguuccaucccagagguucuauuuguuugcugcgcuucacauugacacccugccccgaugacagccacggcaguaucuccaucccaugcacaucugccgugugucccugcauuccccugccaagagauggagucugugucuccauccuuugaaucugggccugugccuacuuugaccaguagaacaugguggaggugacacugugccaugauccagcauagccuuuagccuaccugcuggcucuccccaccacaucucuccaaacccauccuuuaugugagaagugugacuaccuggagaccacccugcauggagagguucugggggauaagacagcacauggcggagaggccaggagugcugagguaccagacuggagucaggggccaugguggacauccaacccagucaagccgucagaugacugcagccccaacugccaucugacugugaacaccugguucauucgcaccucagggugucagugcuugccaugcccucugccugaaauucucuucccugcaccaucucuuugcuggaugaacuccuuucaaaugucagguccugggggaguagggaacccucccugaccacccugacccuccaucaacccuggagccccuggcauucacuggugcuuagcaucaucugucuuuaugcaucugccuaaagcuaauggcuugagacuacuguaaggacuuugacugcaacucugaauaaggugggagucaugggaggcuuuagagcagaggagggaccagcucugacucagauuuuaacaggaucccucuggccacuaaucugauaacaugggggcccuggucucucagagaugaccgagaggacagaccauucccccguccucccugccccaggcccagaugcuuucugagacacugagauuuuucugauucucccaccaagacaaucgucgguggggaaggguaguccuaaccuuggagaagaccuuucuagugggucacuuccugugcuugcagccaggcuuccugagaggggaguggaggguuuccucacaguugagaucacccaagaugugcacaucccucccugcucuggccccgagcccccacccagccccaugugcugcguccuucuuugguuccugugccccccuucugcuccgugucugccugcaaacucuugcucuuccguuugagcugaaauuuaauuacagggcuuuuuuuuuuuuuuuuuuuuugccuuuuaacguuauuugcucuuccagcugucuuugauggcauaauucucucacucccuaaacuacccuuuucccuggcacuccuggcacugguaugacuaucccuuuguaaacagggcccccuuagaaccacaacagauguuagaugcgugcaguucugacagcaggggagggcagggagcaggggaggccagggagcaguggccuugcuggccggugaggccacccugggggaugagcaguaggggcaacuguggguuuuagggccaaauuggcucaggcuuacauuuuagaucgucuguuuccuggcugugugaccuugggcaaggcacauaaccucucuggguuucacuuuccucugcuuuuacuuuucuuuuuuuuaauuuuugagacagaguugcucuguuucccaggcuggagugcauuggugcauucgcagcucacugcaaccuccgccucccaggcucaagugauccucccaccucagccucccgaguagcugggacuauaggcgcacaacaccacacccagcuaauuuuuguaguuuuuguagagaugggguuucaccauguggccugggcugguccucuguuuuuaaauggugguaauaguacccacuucauaggagugaugggaguccucaaugaguugauacuugaaaagccccaagaacaaagcccaccacauggugaguguucagugagcaugaguuggcauucccagcaggugagcugaaacugagcacaucauguuuaucccucccaugagccccaugaugaaguuucugcuccuacccauugcucaggugaggugacugaggcucagcccgcagccccugauggugagugggaacucgggcagggacaucagcuggcaagguuuauccaucacuuagcgggaugccuguugugucaccuccucucagcaacgcagccaggaaggcacagcugguauuguccccuuuuauagguguaaaacuggggcucagagaggucaagugacuugccugagcucacacagcgguucaucagcugaacagagagcagaagaugcaaaccucagcuuggagggccaaacgggccccuugaggggucugggggugcagaaggagcugaggauggugauucuagauuuagggacccagcuggagaucugcaggugguuagggccagaaaggagcucaucacucagccaggcccaugccuuuuagauguuucuuugcugaacuguucuuucaggcagaaucugccaggaaagcccgccgcauacaaagagcugugauucgagcccaagucuguguauccagcccagaacuugguacauaauaagugcucaauaaacaagaguguugcuugcagcucacgucagauauaaugagaagaaggccucccauccucucuacugcccccgacaugcacaugugcacacacaugacccacccuuuuuccgcugccggagugcagcagcgcaaucucagcucacugcaaccuccgccucccggguucaagcaauucuggugccucagucucccaagcagcugggacuacaggcgugcgccaccacacccagcuaauuuuuguauuuuuuguagagacuugguuucaccauguuggccaggcuggucucgagcuccuagccucaagugauccuccugccucggccucccaaagugcugggauuacaggcgugagccaucacaccuggccuucccauccucccuccucuuugauaacagaauuccuuugauggugcaugcuccuuggcugcccauaaccaagucuugccccucuggaagucugcccugcccagcuugggguaaaacuuaacgaugaacugaaugaacauccuuccgaauuuaauauuaagaacccaccaaagcauuauugaaccugucacgccauauuacaaccaaauuaagaaccagcagcaauccucuuucauucaguauuauaugccuuauaaaguaaauuauuaaugcuuuuuuccccccaguuaaguaguuauuugcaguuguuccggguauuucucauuagaaauaacaucaucuaaagaacgauauugacugauuuuuuuaaucuuggagucauggacgugaaccacauauuuauaugacauucccuuuaacuagaauucucgcgcuuuauuuuuauauuauugaucuuuuugacacgaauugcuuuuuggccuugugcgaauguuguaagcuuuccgccugcagaggaaugggcuggcgucugggccgggcugggaagagugaucgcuccagccgcguggcaguaacauucccgcacauuuaacaacaauuagucugugccgacgccaugguaggcuuucguguaugaaaauuuacaaggcuuuuaauggacugcauuauggaaggccgugcggggccagucgguggggagauaaggccgcugggcgugcauccaucucauggcucagucggcccagugucucucagugcucacgucugccuccugggaggugggagacacaagauggaagcuaccgcaacagccccaccgacaccagcauaggucuuguagccacucuugcaguccugcauuuaucuggucaguagauguuuguugagcaccuacuaggugccagguguggcgcuagaugcaggggcugagguggugaacauuacuauuuacucaugcguucaggaaggauuugaguaccgacugggugucaggagcggcacugaauuccgggggugaaagggugagugcaaauuccucauucaucuggagccuguggcaguggagaagugacuuaagccuagagucgccuggagcuggguucaaaucgcagcucguugcccauugccagguucuucagugaaccucaguuuccuugucuguaaaauggggaccuaccuccuagggaggcuggcaggauucggugcagaucaagaacuugaugcagaguaaagaggaucguggugauucaguguugcuaccagcugagcucuggacacucucucuguucucuccaaaaccuaagguuccaggcguacaucccgccuucccauugggcugcaguccucauagcuucugggguuggggcagccuugugucccccuccugcgcacucuggcuuucuccuauauuuucuuguuggaaaaccagccagggcagccagcugggggcagggagugauggaggcuccccuagagggcacacccccaccccaggggccagcccucuucuccccaagugcccucaccccuccaaccagcuccccuagagcacaccccugccucccuccagagaccuuuauuucgcagcauguauuuggcaccuguuguauacaagggugagugccagccuucagggauguggcaacagguggccccagauaccuuuccuguccucacagcacacauggccucaugggagagacagauggacccacacaccccuacacagcgccagcggcaaucacguuacgguugaguuucacaaggucaggauauggggaugggagagagucaccagcccacccauuccuucauugagaaaugcuuucuggagccccacuauaugcagacccugugcagugcccuggggauaggcagggaacaagacacaugcuccugucucuaagcuaaaaguacagugagggacaugcauacuuacaucaugcacaggaguuaccucaaagauaguauagcacagugguuaggagugugguucuggaaccagacugccuggguucaacuccccauuuugcuacuuauuauagucaucccucaguauaugcaggggauugguuccaggaccugccccauacccaaaaccaugcaagucccccugcauauaggaaaauccggcucugcauauaugcagguuucacauccagugaaaacuaugguguguguguguguguauaauuuccugagacagagucccgcucugucucccagguuggagugcauuguugcaaucucggcucacugcaaccuccaccucccagguuaaagcgauucuccugccucagccuccugaguagcugggauuacaggcccgugccaccaugccugguuaauuuuuuuauuuuuaguagagacagggcuucacuauguugaccaggcuggucucgaacuccugaccucaggugauccacuugccucggccuccccaagugcuaggauuacaggugugagccacugugccaggccuuaaaaacuauguuuuuuauugcauuugguugaaaaaaaaauucugugugucagcagacccgcacaguucaaacuuacgcuguucaagggucaacuguaaucugugacuggggcacuuuucuuuuuuucugugccuugaugucuucaucuauaaaaugggacucaucgucaucuguaaaaugguccuugcaagccacugcaggcugaccccaguaaaccaccauagacaaucuuuguaccaagugagaacagagguacaaauggcacuucaucuuauaggugaaggugaagaucagaugagguaauagauauaaaggcguagaacagugccuggugcagagaaagcuuagaucagugucagaggcugcgauuaccaugauuauuacaauuaagaugauuaugacucuaaaauaaucccccgguguauuaacuaauuguggaggugccgaaugcugccuccacaaaggcaaaguacaguugcacccagaaaggcccccacucuuggccuagcucagaggcagaggggcuggacugcgugacccccuagggucauugccagaauggggcuccugaagcaacacccccaaauuuagauacaggagaaggaaucuuucuagauguggguguccucucugaggugggcccugcaggaggccuucagacauccaauaucagucaaaccucccagaugcccugagcagcaggaaucaggcccagagagggugagaaacccaucuuaggucacacagccaggagaaagaugggcccaggucaggucacuuucccucuagccugucuccuguuccauaaaauggguucuuguaacauccaccuuguuuauccuggggggaugggugaagaaccaaugugaucacccaguugaaagaaauuugccuggcuggguaugguggcucacaccuguaagcccagcacuuugggaggcugagguggaaggauuguuugagcucaggaggucaagaccaggcuuggucucuacaaaaaaaaaaguuuuuuuggccaagcacaguggcucacgcuuauaauccuaacacuuucagaggccaaggcaggccaauugcuugggcucaggaguucaagaccagccuggguaauauagugaaaccccaucucuacaaaaaaguuagcgaagcgugguggugcacgccuguagucccagguacuagggggccugaagugggaggacugcaugagcccaggaggucgaggcugcagugaacugagaucgugccacugcacuccagccuggaugacaaagugagacccugucucaaaaaaaaaaaaaaaaaaauuuccagcuacuccaaaggcugagaugggaggauugcuugagaccagcaggucgaggcugcaacagugagccauuaucaugccacuguacuucagccugggugacagagcaagacccuaucucaaaaagagagacagagaaggagggagggaaggaagcaggagagggggggaggggaggaacggggaggggaggaauggggagagggaagaggugaaaggaaaaagagauuugccaaccaaagugggacucacaggugaguuccagagcugagugugaggcugccugugugcugccuacagcggugucuuucucuagaaucuuucacuauucaguguggucaccaggccagcagcauccacaucaccuggaaguaccuuagaagugcagucuccaucccccaccuccaugucccagaccucuaaaaccaagaucugcaguuuaacaagguccccuggugauuaugggcacaugaaaguuugagacacucgaccucagagcccacuggcuuccgacccuggcugcccaguggaauccccugcaagcuuuaaaaaauacuaagaccugggucccagcucacaguggcugguguucuuggucuagcaugaggcuugagugucaggauuguaaaagauucuggugauucacauguuugagagccccugcccugaaacucaccaucuagcggaagagacagaccuguggaaauaaccagggcugugcugguaaaugcugaacaacuagcuggcugggaggagcccugaucuguagcaucugcucauuucugugguguaaauauucccaccguggccaauuucaagcugcaaacaugaugucguugacagggggcugggaagagaugugcagaacauuauagaguguuuccagcacacacacaguagauggaaaaaaccucagagcacagacagcaguggaauguagucaaauaauuaggaagucaugagcauugaguauguauugccuuuuuuucaaauuuuguauucugguaaaauacacguaacauaaaauuuaccgucuuaaccauuuuuaaguguacaguucaaugaguuaaguacacucgcccuguugugcaaccaacaccaccauccaucuccagaacucuuuuuaucuugcaaaacugaaacuuccacccauugaauacuaauuccccccauuccucucccccagccccuggcacccaccauucuaccuucugucccuaugcauuugacuacuccagggaccuccuauaaguggcaccauacaguauuuguccuuucgugacuggcuuauuuggcugagcuuaauguccucaagguucacacaugugguauuacauuuauguuuaacaaaauuuguuuaguuguagguuuauaugauuuaauuuuguggcuguguuuaacaaccagauugcaaaauuucugaaaauguaaaauugcuuuguaagccacugcaggcugaccccaguaaacuaccacagacaauccuuguaacaagugagaacagaggugcaauugcaugcuuuaggucagaagucagcagacuguggccauugggcuaaagccuaucuuuguaaauaaaguuuuauuagaacacaguccauuuguauccauggguuccaugaacucaaccagccucagaucagcaauauuuuuuaaaccacuaaaaaauaauaguacaacaauuaaaaauaauauaaauuuuaaaaauacaguauaacagcuauuuauauaacauuuacauuuuauuaggaaucauaagucaucuagagaugauuuaaaguauacaggaggggccaggugcaguggcucaugccuguaaucccagcacuuugggaggcuggggcagguagaucaugaagucaagagaucaugaccaaccuggccaacauggugaaacccugucucuacuaaaaauacagaaauuagcugggugugguggugcgccccuguagucucaacuacucgagaggcugaggcaggagaauugcuugaaccuuuguaaaagaacacaauauucucaggauucuccagaauauucaacaacagcccagaugucagauaaccagcccugaguaugacacucaaucagugucauacagaggcagagguugcagugagccgagaucgcgccacugcacuccagccuggugacagagugagacuccaucugaaaaaaaaauauauauauauauacaggaggguugggcacaaugguucacaccuguaaucccagcaguuugggaggcugaggcaggaggauugcuugagaccagcaugggcaacauagugauaccccuucucuacaaaaauuuuuuaaaaauuagcugggcgugguggugcacaccuguagucccagcaacucaggaggcugaggugagaagauugcuugagcccaggaguuugaagcuacagugagcugugacaaccacuguacuccagucugggcaacagaacaaaaccuugucucaaaaaauaaaauaaaauauaaauaaaaguauacaggaggaugugcguagauuauaugcaaacaauacaccauuuuguauaaaggauuugagcaucggaggauuuugguauccucaggguguccugaaaucaauuccccauggauacugagguacggcuguugauagcucagaaccuaucuagcccacaaagaugaauauaucugaccccuuacagggaaaguuugccagccccugcuuuuagguguggagggaaugggagaaauuuaaucaccuuauucauucacauauucauucauucauuuccuuagcaaauauuuacagagcaccuacugccaggcacugcuauagacacagaagcaaauaagacaaagacgagucccucacagagcugacccuuucgcgggaagacaguuguaauucagacacucgcacaucaaguaaauauauaauuccaacuguaccagggaccuuccuggggcuaugagagcauccugggaugucaaggagggcuuccaggaggaagugaccuguguaugaauugaagcaagaguagggacauucuagucacaggaagagaggaacggcaugccagguaaaaggaauagcagguacaaaugccccaaggcaggaggcaagugggaauugcagggccugaaagccaaugagagguggucugagcucccaggucugcuccugugcccuggcccccagucucuccauaucugcucugccaagcacagcaucaucuugagccaggugucucuggcucgcuggccaccauugccucccuacccuugcagaccgccucuuaaauucuguuuauucucccuccuggcccuggaguccacacugcaacagacaaagguucuuauuuauuucauuccugagguuuauaaacuccugcccuauaauaaaaucacucucaccacaagcacaaaauaauaacacuuaauuaaaauacauaaaaccaaagacuggcagaauccagugaagauuaaaaucaacugaauccuacggcccagaacugagcagagguccugcccugagacccagggacugagacacagagauggggugagggagaugggagggggcgggggagcaaggggaguuccuauuucuugagcacugauugagugucauacucagggcugguuauccgacaucugggcuguuguggaauauucuggagaauccugagaacauuguguuucuuuuacaaaggggaaacugauacucugauugagacaccaagaucacauacugagaaguugaagagcuagaauuugaacccaggccugucugcauuagucaaaaugggcucguuucuguuguaacaacuucaaacacagaugagguuacaucacagucuagcgcugguugauagaaguuguggugggggaggcucugauccaugcagucauucagggauccaggcgucuaccaucaucugguaggugggaaaagaggaaaacaugauggcccuccuaggagguucucagggaccaaaacuggaaguggucacaucauuucugcccacauucauuuguccagaacucuguuacaaaaccauacccaauuucaaggcuauagucuaacauuauaugcccaagaguggguaaaaaaacagaauuaaguuagcacauaacccugucugcugcccuguggacucccucacagauagagcaccucacucacugucagggaauaggacagagcccugaauacacagccuugcacacagugguacauuuuggacaggugaaugggaaugaaacccaagaggccugccaaauucagggagcagcaaagcaggagcaaggagggacuguuaacaauuuggcagauguuauaaagcuccuacuaugcauucuucccugugcugagcuggcuagagaaagagaugaacucuguucagcaaggaggcugagccaccauugggaucccaugcccaagguccacuuaaaaaaaagccagugugcaguaggaacaaaugucccagguguaccaaugagagugguuauuuuuugggcaggcaaucagagaagacuucuggaggaagugaggucccagcugagauuaggaagauugggcaggauggaacauggggaaugaagagugguggugagcacaggucuuggcaucaggcagaccuggguucaagaccaguuugaacaccggugaggugaucugaggcaagccacuuccccuuucuuuuuuuuuuuuuuuuuucugagacagagucucccucugucacccaggcuagagugcaguggcgugaucucagcuuacugcaaccucugccucccaggcucaaacaguccucccaccuuagccucccgaguagcugggacuacaggcacacaccaccacgcccagcuaauuuuuguauuuuuaguaaagaugggguuuggccauuuuggccaggcuggucuggaacuccugaccucaagugaugcccccaucucagccucccaaagugcuggaauuacaggcaugagccacuguccccagcccacuuccucucuuucugacccucaguuuucucaucaauaaaacgguaccuaguacauagguuugucaagagguugagugagcugguaaugcauaucaaguguucagcaugauacuagcacaaagaaagcuuaaaaugaauaauuauucccggauggcuauuuagugagcagugcugggaggcggggcugggggagaggacaaggccaggaaacacacaugggcaggacaccaggguccugaaugccaaguuaagucugcaguuugucugugggcagagggagguaccacagaagcuuuuuggauauauaaggaaggaugaccggaaaccaaguuccagaaagaucucucuggagguguacaggcaggagggggcugacucagaguuggguugugcuuuggagcacuuaagaaugagacgagcggccaggcacaguggcucaugccuguaaucccagcacuuugggaggcugaggcugguggaucaugaggucgggaguucgagaccagccugaucaacaugguaaaaccccaucuguacuaaaaauacaaaaauuagccaggcauggugguaugugccuguaaucccagcuacucaggaggcugaggcaggagaauugcuugaacucuggaggcagagauugcagugagcugagaucgcgccacugcacucuagcccaggcaacagaguaagacuccaucucaaaaaaaaaaaagaaugaggugagcacuaaugauaaccuggccugggacagcgacagaggagcagcaaaguggagacagguuugaaagaguugggaaguggggauccagguugauguggcagguggagacagagggucuggggcucagguuuugggggccagugggacaugacaccauuagcagaagaggaccuggcuucagggaaacaagccccuuuguuggauacccaaccugugagauucagucugggaauccuccaggagccagugggaccuggcacggccccaggucugccucucgucagccauaugaccuuaggcaagucaucuccccuccuugagccucaucuuuccuaucuggaaaaggggggauaguauuuguccuucccugauaggguuguuguuggaggauuccaugacacuaugccuagcacauaguagaugcucaagaaaugauccuuguuaucaccaucauuuuucccauugagaccaaacacugggcuaagaaagggcucgugcugaaccaacagauuccucaaacacgcugcagaccaagaauacuguuccuaggaacaucaguagccacagcagccagaucuccugggucucaguauauaucaggcucucugcuaagcuugcuacacauacugacuuuagaaaucauugucacaagccccugggauagggguuauuauuaugccuguuguagagaugagugacugaggcguaaagaccaggcagguaggagaugggacgaucagcgcaggggccucaguuacacagagcagaucugcuugcaagguggauaaucaugcucaggucacauggagugucagguccagcucugaaccccgugcccuggggugagacagggagagagagagucuacaggaggcuucaggaccacaggcugaggccugauuggcacugguucaagagaaaugcccagaagacaagaaaaagaaauaaauaauacaucgagaggcaauaggaauuuuauguucaauauaauagggggagaccuggguucaaacucugccacugcacuagcagcuuugaguuaucaaucugcguuuuaguauucuuuuccaugaggauuucaaaaauaauugucugagaaauguugccuccuaaaagcggcaaaagcggcugggugcaguggcucaugccuguuauccagcacuuugggaggccaaggcaggcagaucacuugaguccaggaguuugagaccagccuuggcaacaugaugagaccucaucucuacaaaaaauacaaaaauuaguuggguguggugacaugugccuguaguccuagcuacuugggaggcugagguaggaggaucgcuugagccugggaggccaaguuugcggugagccgaaauuacaccauugcacuccagcccgggugacagagcaaaacccugucucuguaaacaauaauaaaauaaaaauaaaagaggcaaaaguuuuccagcauccaacauaaggaaggguuauuauauccaucccccaucaccugacagcuugaccccgauuuaucccagguagcgagcugcugugccaggcuucugagccuuuguacauucuguucccuucucccaggaugcuuuuccuccucuaagcccccuggcaaauccucaauuguccuucaagacuccacucaaauguggccuuggcugugagacuucaugauccccuaggucccuguccucaccugggccuccugaaugaugggcguccccaccuugccuucacaaccgugcccgacucgaagggcaacagugggcuguccacgucccugucucuccugaacauaacucaggcaucacagaauccagccccuugcuucccagaugaauuuauccagcagcccaagugagcuguuuagaaacagguaucacauggcacgccucccuguuuaaaaccucugggaacuuccagugguacccagaaugaaacccagaccuccggccaccaccuccaagaccaucugcucuccagccccugccuugcugcccacuugugccccuucccucuucucacccgucauugcacuucuuugaaaaugcuguccucaacucagggccuuugcaccuguucuucccucugcucuuccccugcccccguuucucccccugaaugcagggguucugagugcuggcacuauggacacuuuggacuggaugauuccuuguggugggggugcccuguacauuguaggauguuagcagcaucccccacuccccacuagaugccaggagcaccuuccucagcugugacaaccgaaaaugucuccagacguugcuagauguccccucggggaccaaaucaccaagaaccacugaccuaacaccuacgugucuuucagaucuuuguucaagugucacugccuugggaaggccuucaugacuuacccaaauucaagcagaccuccccaguacaugccuucccaggaccuuuuacaacgcuuagcacagucuguaauuauauguuuguuugccuaauuacucacauaguacuugucccucccacuuaaccaaaggaaggaggcagcauuuuguagacugugauguuccugggucccucacggugccugacacacaacaggugcugaguaaauaguuauuaagugacuguugacacauaauaauguuggcagacauugcuguagccguuucuauguuccagacaacacucuaggucuuuugcagauaccacuucauuauccuccaugacuccccuuuaagggagauguuguuauucucaacauuuuacagaugagaugaaugaggcacagagagguuagguaacuuacccaaggucacacagcugguggcauguggcagagacaagauuugaacccaggcagucuggcucaagaguccuugcccuuaacuauuauuuauuaagugccuacuaugugccgagcucuggggauacagcagugaacaagaacuacauaaccuaguuuuuauguauauauaaauacauccacauacacacacacacaugaauuccacucaggucucaaaagguggcucuggccaggcaugguggcucacaccuguaaucccagcacuuugggagaccgaggcgggugggucacuuuaggucaggcguuugcaaccagccuggccaauauggcaaaacucugucucuacuaaaaauacaaaaaugaguugggcaugguggugcaugccuguagucucagcuacucgggaggcugaggcuugagaaucccuugaaccugggaggcagagguugcaguaagccaagaucacaccacugcacuccagugugagugacagagcaagauuccgucucuaaauagauaaauaaauaaauggcucaauuuacaggugcagacacucaggcacagagacacucaaacguuggccaagaucacacagccaguuggcagcagaacgccucuccuuauucuagucuuugugugugucuccuacuauaccauguguccacaggcuagggacacuuugacaguuuaaccagucaauuacaauaauauuuuucucucagaauguuuaaaagaaaaaaaaaguugguuugcagaaguauaaucauggcucagaggccaagcugacauuaguuauuaauuaggccauuaugcauuccacagugauaauugccuugcugcagagucaccaagcaugaaacggacccagcacagaaacacaaucuaucaaucugagaagucgcagcccaguugcguucucucaccuugagucggguguacgccuuagcaggaaacaaaaagaaauuaaugauacaucgacaggcaauaggaagccggaccccucaccaguccuggccccagggugguuuuguaccuggcuguagggauggcauuuaagcaaaguuuaucaucgaaaauggccaauucccuuugauuuagcugguggcaaucuuuucaucuccuucccuuuuuuucccaucuuguuauuuagggagagagggaaaagccauuucucuuccaucuguuugucucgccuguugcuuucuacaaugaguggggugggggaauggcaccugccagggcuaccugggccaucaggaguaagugcagcaucucugucuguguucugugucugucuggguucuaucccugguguuggucggggagggaaggagaccccccugcaccuggagcauuauccugggguccuccacaaagacagggucauugucaagggcagcuggaggacaguuuuaagugaaaacuuuggggugcaagaaacaaaaaugcggccaagugagcuucacagcagaauugguuauaauauuagcugugcgccagcuaugcagaccguauccuucauuuaguccucagcaguccugugagggaaguauugcuauucucgccacuuuacagaugaagaaacugaggcuuaucaaggugagaggauuugcuugaggccucacagccaaugguggagcugggauuugagcccaggcucacuagcacagugcuguccuguggcucucuggcaugagaggccagacaaagcaaaacugggccucccagagggugggacaagcacccaggugaacagcccagaaccaaggugggugcuucccccacaagggcuaggguccccccuccagcccucucucuagucuggcuuucucagcugccccauagacuuugguggaagguacccccugacagcagcugcuuaccuucuggguucccccacagcacucaagcuaacaacccagaccagucaaaaucaaccaguucuaaauacaaacucccgaguuaaugaguaucaccggucuagccugagaucagugucagccccugguccaaucggcugaggucaggacaaugccucggugcaaaaauggccaccacagccaaucuuaggggaggaaagaagaucacaaaugagcagccuggccauccaccucauccacccucaugucacuuaccacagaguuguccuaaaauugaguaugaaugccuuggauggaguccagucuccccucagccucucuucucaucuccucugggcuacugcaccuccuggacuuagcuaccugugagguuccugaagacauuuggguuuuugcucucuggaggaaugguggagugauucucagcaaacagaaauguuagguaucuauuaauaccucagggucuagaaagcucugcaggugugccgaugccaaccagccccaugucagcaguugggcagagaugccaccagguagagccacccaggaggcuaguggagaggggccugucuuaguccguuuuguguugcuaucauaaaauaccugaggcuggguaauguauaaagaaaagaggguuacuuggcucaccguucugauggcugcaaaguucaaguuugggaagccgcaucuggugagggccaccuuccucuuggggugguagguggaaggggagagggcguaugcagagaucacauggugagagaggaaacaagagagagaaaccaaggaagcaagacucuuucacaaccugcucucaggaaauaauccauucccaagagaggacauuaaucuauucaugagagauccacccccacggcccaaacacuucucacuaggccccgacucccaauacugcugcauuggggaucaaacuucaacaugaguuuugauggggacaagccauguccaaaccauagcagagcccaauagucugcaguuuguccagaagucaagauaaagaaauacaugcugcugagaauggguugcuuccaguucuagcccauuggagccaagcccugaugucaucuuguuucauucuuccacaugcuuuuccuaggaucaagacuuaacacccccaccccacccccagguucccugugaaaggggagcaccugcuccaaggagcccuacuccaacaguugagaguuaauuuucauuucaaacaacauggcggccaagacuggauguagacaucccacguuggcccgaccccauggcucauucaacccauguuucuggccaggcccuugaggggcagcuggagcaaucugcuucuuccaugauacugaucaucagaacuugggcuggccagcuuccugggaccaccccugacagcgugacacuuuacaaaacucagccuucagcuaugcagucuuaggaagcagaucucaugagcugacuccuuauugugugaaguaggacucaugucucuguucuaaguuuuccucuuucaauguacaagaugggcugauaguuugaaaagucaugaaaagaccauguuuucucauccuugcuuucuuugcuugacaggggcagacauaauuguucaucauuucaacaaauauuuauugggcuucuauuaugugccagaugcuguucuaagcagugaacaaaauguucuagcagaguaugacagaucaauaacaguaucaccugcuauuuguugaggaccuacuacucacuuugacacugggccaagcccaauucauuaucgcauugaauccuggccugauacagaacuguuauuauccccaucuuacaggggaggaaaccuuaaagguugagugacuuuccuaaguugcaacagcaaauaagugaugaaacugaauccuucaagaccagagguuggcaaauuauagcccgugggccaaauaaaguuuuauuggaacacagccaugcacauucguucacauauuuccugcagcugcuuucccacgacaagggcagaguugaggaguugcaacagagaucagguggccugaaaagcugaaaauacuugcuccguggcucuugaugaaacagguuugcugaucuguguuccuagauuagauuuguaggccagacaugguggcucacgccuguaaucccagcaguuugggagaccgaggugggcagaucaccuuaggucaggaauucaagaccagccuggccaacauggugaaaccccaucucuacuaaaaauacaaaaauuagccaggcgugguggugcaugccuguaaucccagguacuccagaggcugaggcaggagaaucgcuugaaccugggaggcagagguugcagugagucgagauuccaccacugcauuccagccggggcagcugcauccaucaacccaucaucuauauuagguuuuucuccuaaugcuauccuuccccuagucccccaccccaugacaggcccuggugugugauguucccuucccuguguccauguguucucauuguucaacucccacuuacgagugugaacaugagguguuugauuuucucucccuguguuaguuugcugaauaugaugguuuccaguuucauccaugucccugcaaaggauaugaacucauccuuuuuuauggcugcauaguauuccaugguguauaugugccacauuuucuuuauccagucuaucauugaugggcauuuugguagguuuucuuuuacucuuuauuauggaaaaaauccagcauacaaaaguaaagagaauaaaauaauuggucagucccauggacccaguuucaacaacuauuccugcauagccaccuuccucucacaccucuagauuauuuugaagaaaacucaagucauuguaucauuuuaccuguaaauauuuuaguauauauuucugaaaaaaggaaucucuuuuuaaauguaaccacaauaugaucuacccucaaaauuuuaauaguacuuucuuaaugucaucaaauacccagugucccugguuagcccucccauuuuuugaaacagauuuuuguuuauaucaggacucaaauagguucacacauuaugauugguugaugugccuuuuuuuuuuuuuuuuuuuuuuuuugagacagggucucgcucuguugcccaggcuggagugcaguggugcaaucauagcucacugcagccucaaauuccugggcucaagugauccucccaccucagccucccaaguagcugggacuacgggcaugcaccaccaugucuggcuaagauguaccucuuaaguagagugaucaacugucacagcuuggcccuggacugagggguucccggcaagcagaacuuucaguuuuaaaacugggaaggucuugaggugcacaaauuuccaugcuaaaaccaagaaagucccaggcaaacugagacaaguuggucaagccaugucuucucaucuguaagcucccuguccaucccuuccuguaugugugugugcauguguguucgugagcacaugugccugcucuuuguauguggaagugaccagaacaguuuuuccuaaaaacuuuccucugacugcagcugauuggaccaggggcugaugcuggucucaagcuaagccaaugauauucauuaucccaggaguuugaauucagaacugguugguuuugacuggucuggguuauuagcuuuuuggguuuuuuuuuguuuuuguuuuuuuaaagaggcagaguuccccaggcuggucucgaaauccugggcucaagcaauccuccuaccuuggccucccaaacuggguuguuagcaugggugcuguagggugaacccagaagcugaggcagccauugugaugggcacuuuccacccaggaaguguguggggcagcugagaaagucggccuagagagggggcugcaggagggaccucaccccuaguggggaaguacccaccuugguucugggcuguucuucugggugcuugucccguccucugggaagcccagcugugcuuucuccagcuccccauguugucgcuagauagcacugugcucaugagcuuggguucaaucccagcucuguccggagcugcaagacauugagcaaguuccguuaccucuagcugagauuuugcugaucacgaccccguggugucauuuaacuuguucuuccauccuuguauuugcuauguaugagcaguuggaucuagaggcaugaucagguucagguucaauguuuuuagcaaaucuacuuacagguaaugcugggcacuuccaucaggauuuucccaguguacagccuagucaaucccaaggcaggggcagggggcaauugguagcaaggucaggacugaucagaacagaacaguugaggcugccugggguugcauaaacuccucucccccagggugucaggaaaccucagcccaugucauuggucauuaaugaaagcagaaaccagauuucauugcugugcaagguaauuaaauuacuucaaaaaucuacucacacaugauuauuuccaugcuucccaccaaauacaugccucucccucauuugcugccauccugggcucuuagcugggagcaaugaaggcuguugugggggcuucucaaggcugcuugucuuugagaaacagaaugaaaaaugggguccccauccaagccccccuacucugagaaauggaagcaacuucuccccacagagcauaggggauacagcaccauuuguauuuccaacccaaggugaacuguucuugguauuuuuuucccuuauaaaucauguuguuucaaaguuuuguucuaugguauggcaggaggugagaaggagagcagaaaaaaugcuuauauuaaauugguggugcagccaggcacagugacucacgcucguaaucccagcacuuugggaggccaaggcaggaggaucacuugagcccaggaguuugagaccacccugggcaacauagugagacccccaucucuacccaaaaaaaaaaauuuuuuuuuacuuuuuucuuaauuuuuuuccauuguuuugaugcuaucuaucuagucauccagaagcacaauuuuucuuuuuuuaauaaaccagacaugguggcacaccccuguguucccaccuacuccagaggcugaggugggaggaucacuugagcccaggagaucgaggcugcagugagccaugauuacaccacugcaccagucugggcaacagagcgagacccugucucaaagaaaaaugaugcugcugguauuccugggaaaaagagaaugagaaaacaauaaggagcauucgagcuaagagguuuucucugcguuuugugucaggugcaaggggacaggguagggacagaggaaaaggagcuggguaugccccacccaagugccuccuguuuguguccagguccacaaccuggacacaaacagaaaaguaggaccaggguggcguuucauccccaaagcagaguugcaaccucaguuacccacgggggccuggcaggugcacaaaauggacaacgcaggcacagaugagacaacagggaggcguggggacuggggcagguggggacucuguaagccaucugaaggaguggccuguaccccgcucaggcagauuaaagcagucuggucuugcagcucauuucaggagcugagagcacaaacuucagggccaagcugcucugucucccgaucccuacucugccagcuuuccuagcugcaugacccggggcaagucucuugacuucucugcgccucaguuuccucaucuggaaaguagaaaugauaaccgcaccugccacuggugugacacagagauucauauagugaacgccaccaucagugacacugauugcaugaaaucugccauggugggaguauuuacaccacagccauuggcagacacuacaaaucagaccuuuuuuauuuuuucucaccagucagccacuuguuaaaccuuuaccagcacaggcaccuuccucacagggcuuuuaggaugauuucuagacuuaauacauauaaagcacuuaaaacggugcccagcacacuggccacccuccaauucacuguauuccucuuugugugaucaaugugauuauaaugggggaacgugacacuacuguggccacaucuuccaauucuuccagagaagcuggaaaucuugauuuuuaugcaaaaaacaaaaaucuccggauucuuaaagauuggcuaacaucaaucauuuuuaaaaccugagcaaaacaaagugcauguggaauuuggaccacagacuccacguuugcaaaguuggacuuagaggaauggacuguggguguugucuggcaaggcgagguccuuucucaccucucaccuuuguaugcaacugcucucccuccuguugaaucaacggccugccucucuugugugagccugugccucuuccuccuugaagcccuccuagcugugcccugcaggguacaugacuccguccuugacugucccuccucaaagcgcugcuucccugccacccucugcuguggucuaugucuuucugacucuaggacugaggggcuggggcuguguuuuguucaucuuggcauagggcuguguacaucaaggaucauaaugauaauaaaaucaacaucuauugaguaucuucuguuugcuaggcuaugugcuaagcaccuuuuauguaucaucaccuuaauccugaugauaacccucagauguggauauuugugcccaaggccacaaagagggaggcauuuacugggaaucaaacccaggcuccucaccucuggagcccacugcagacggcugaguccauagcgagcaccgcacguggaaaguuaggcagcaaggaccccggcuagacugggcugggaucagacaguggagggcaugcaugcccggcugaggcucucccggggcugucuccagccacacuccacagauacguccagaaaggacgcugcuauauuuaaaagccugggcaggguagcacuucagugacauuugggcagccgccuuuccagaaagggcagacauguucuuuuagcuccgcucuucugagcugguauuucggagaacuugucaggaucacugcaaaggggaggccgcugccacuugggaucccugcagccuucccagagacauggcuacugcagcacagggcugagagagcacaggguggcgagaguucaugggccaggucaggaucaccaagccaggucagggggcagcaggugucacuggggccuggcauguagacccuggacagccccaagucucaagagggcgccuguugcugggggcaggauggggagagggguucuuggcauugcugacccucugcccacgcucugguuuuuuggcuucagcccucauguuccaggggcguccaccccucauguucccccuagaugaugucaucuucucacacacccucacaacccuuuggccagaaauuccaagaaccgucuguggccuggccaaccucacccuguguuuaacagugaacaaagcauaucuuuuguuuguuuguuucuuuguuuuugagacagagucucuugcucugucacccaggcuagagugcaguggugcaaucuuggcucacugcagccucagacucuggguucaagugauucuccugccucagcaaccgaaguacaggugcccgccaccacgccuggcuaauuuuuuuuccauauuuuuaguagagacaggguuucaccauguuggccaggcuggucuugaacuccugaccucaggugauccacccaccuuggccucccagagugccgggauuauaggcgugagccacugcgucuggcccaaagcauaucuuuuaacugcuggugucuucacaccccagcugggucccgaugucccugcucucuagguggggacacugaggcacagaguguuccaggaaagcugcuaguucuuucuccaccuaggcaugccucaccacccaggaagucucacguuccugcaggcaccgcaaauggccuuuuucuccaagcccagguuggaacugagucagaagggccucuucugugugcaggacucacauggagguucggcuggcaguuugccagccauagggggaggagguggaugcugccuggaagcagaaguaggacaaggaccagcccuccuguugcagcauugucugucugucacccggcuaugcaaucacuccuucagggugggggaggggcuggugggcuuugagaaauuucaaggaggggggugaagccaggauaaagggggugucggucuaggccacagagaaacgcuaaugcucauggggccuggacgggcucacacccauacggggagccaaaugcagacccucagccugucccaacagacggcugacacccagcuccagguggccgcugucgauggaaacaugggcccaggguggccagauccucuaauuucccaagagaagccagcaauuuggaacucuucugguuuuuaaauacuggcucaauauauaugcacauauuuucaugcucacaggacuuuauggagguauaauuuacauacaguaaaaugcgcaaaucuuaaguguauaacuugaugaauuuugacagcucaaauauuuuuaaaacacuggaggguccaagaaaauauguuguccauggggugcaucuggccguggacccaccauccauggcccccagucucgugugucgugugacccccgugaacgaggugggacacacaugugcagggagcacacauggcaguaucccauggggaggggcaggcuuuggcaagagcccagugaucaugcaucaucccuuuacucacacagcgcagagaacaggcucuggagcccgggcuggaaauccgagcucugccacuugcugugugacuuugcacacguuuccccaccucucugaaggcucauuuuccccaucugugaaaugaggaagagaaggauacggaccccagggcucuugcacagauucacugaacugacaugauaagcacugagaaaaagucccgggugcuauugccuuuuuuuuuuuuuuuuuuuuuuuaaauuaauagacccuuuuuuuguuuuuuuuuuuuuuuuuuuagugggguuggagacagagucucacucuauugcccaggcaggagugcaguggcauaaucucggcucacugcaaccucugccucccagguucaggugauucuccugccucagccuccugaguagcugggaucacaggcacgcgacaccaugcccagcuaauuuuuguauuuuuaguagagacaggguuucaccauguuggccaggcuggucucaaacuccugaccucaggugaucagccugccuugagccuuccaaagugcugggauuacuggcaugagucacuacgcccagccuagacccuauuuuuuagagcaguuuuauuugggcuuagagagaauuugagcagaaaguauagggaguuaccauagacucccucuucccccaccccaauuccccgaugacuaacaucucacauuagcguguggugcauuuguuaccgugaugaaccagugucaagacacaauuauucacuauaguccauacuuuacgugaggggccacucuuuguguugcaaaguucuaggggcuuugacaaaugcaugaugucauguacccaccaucacagugucacauaggacggugucacugccaucgggaauauuucuuaguucucauggcugcuacaaaaaaaaaggccaaaguggcugacaaagagcuccuggugggagcccacccccuuucccuuccacucagggaaucacagcacauucaggugacagaagggacauuuuaggggugaaccugaguuuguucugaauuacccaaaauggaagccacuugcccacuucaggugugggggugggggugucacacagauuccagccccaaauuccuuaccacacaacuggcucugaguccaaagacagccccccgccccccaauucacacccugccuuggccccucguguguguauauuggagccgccuucucagccucucugggccucuaaaacaagaggacccagggcugccccugggagcguuuggaggcucagaugcgcuaauucccgugaaaggucuuuguaagcuauaaaaagcucuagauuaaaauuggaagguauuaugauuauaaucaguuaggcagaaaaacugaacuguuggcaaaacgagccuggccuucggaggcugagccuugggaagacauccucaucaguugcacacagggggcugguggcaauugucugugguuuguuccucugggaggagguggcccaaaagacacacagcuggaaacugcuucuggcuggaauggcaaggucagagccggagcacccacucuagguuguuccugcgugcaugaccugccagccacaugccaagcagcguggggccaugcuuguggcaucagcagcucccaaaaagagaaaacuggacauagaugcuucccagagcccaugaaaguggaucuggauucccagcuucauguacuggccacaccccaggcagggcaggaaacauaacuucugcccuggucucaucuccauauaugaccauacaaagaauugauacugcagcuuucggcucauuauaugagcguauaguguauuuuuuuuaauacccaaaagcgaaauuuauuugcaaggcgcuaaagaaagccuccugucccuuuuaugccaggagcccucggaagagaagagaaauuguggauuuacugcuaaaaaaagcccuggcuuauacaauuuuaacaauagaaaaaugaucuuugugcuucggugcauggaugcuucgaggaaaacaggcagucuguucagguagcuggugaauuacaaaugagugauuccccuuuguuuugagugacaagcaauuuaaaugcagucuuacguggaggccuggaaauuguuuuucccccagaagagagagaacgagaggaaaaggaaaagggaaaaaagcuuccuuuuggaacugagcgauuauauuaguugccaccgagcggaggugagaaguuagaacuucauuugauaauuauaaaaucagcaguuugugauuggacauaauugaugauuacacuguugcuaauagcaggccugccagccauugcuugugggacauuucauuuuugcacugcuuccaagccgugaaagccagccuggcacggaacaccacucgcgguaucuccgggagccugacauaaaugcauuugggggauuguauuauguuggaucaaaaguguucuuaaugccgacauuugaaaacacuuugcucugugccuuauuuuuacccugggaauaauuacaaauauuagaauaaaauugcaugguguuccucuuccugcagacccuccccucagccagagccuggguggguaggugggcuuccuaggucuugcacuggccucauuaaaaucccagcggugguccagaggggugcaggggauguucaugugaggacaagacaauaucugucugucucucugucucucuaucugucuguaugggccaggauuacaaggcucacacguguaaucccggcgcuuuaggaggucaaggcaggaggaucacuugaggcuaagaguucaagaccagccugggcaacauagcaagaccccaccucuacaaaaaaagaaaacgaaaauauuagccaggcaugguggcgugugccuguagucccaacuacuugugaggcugaggcaggaagaucgcuugagcccaggaguuugaggccacagugagcuaugauggcaccacaccacugcacuccagccugggugacagagugagaccccaucucuaaaagauauguauauuauaucugccuuggugaauuagaaucuagaaucaaugcacaacugaguuugaaggagccuucggcccauagcccagcaccuucacuuuacagauggggaaacugaggcucugaaagggaaaaugacugcccaaggugaauggggaugcaggccccaguuaaaaccagaacccaggucuccucacccccaggcuaguuucuccucuuuccuacccugcuauuugcuuccucaagacaagugcugggacuucuggggcacauccugggccucuguccccucccuaccagggagcuugcaagaggucuccacagagcagucaggaccucagcugaguuugagcuacuaggagggcaucauucuccacuguucucugggaagccucgggguuuuagguaaguuuggcagcuuggcaggauuagcucagggaggcucuuaaguuccuuccuuauauuauucaugguuuguucauucagucaguguugguuuauugcccacucugugcccagccccgccugggcucugagggagaaaaauguuaaugucauagcaggagccauugaagaucaucuaguaggccaggcguaguggcucacaccuguaaucccagcaauuugggagacugaggcaggaggaucacaugagcccaggaguuccagaccagugugggcaacauagggagacccccaucucuaaaugaaugaaugaaugaaugauuauccaguuguuaaagccccaagcuguggagucauccguggccccucuguugcuuuuaugccuccaacauccacucuguguucccaaggagcaaauccuguggcucgaccuucacaaucccagaauccuagcaccacugccaccauccugcucugagccgccuggguuguucuccuggaacucggcaggagccacuucccuggucucccuguuuccaccccagacccucagucccuucuccgcacaacagccagauggguccuguuaaaacgcgugucagaucacaugaaucugcucuccucugcacaaaacccucccguggcuccucagaccccuuggagaaaaagacugggcccucgcagugacccccagggcucuuccccccgacucaccucccgacccccuuucuucuuccccuucgucuaccaucucccgccacaccagccucucugcuggcauucaaacaagccagacagccccugccccagggccuuugcaccugccguucucgcugucugcaauacucuuucccaaagcuccccacgacgccuuccccuccuguggccccacaugcccugcccaggacuccugucaccucccuacuccauucuccuccccugcacuugacgacugucccacauucucuuucaugauuuauuucauugcucgccucugccucuaaacaugucagcuccacagagguagguguuugcgccagucuugcuuggugcugaaugcccaguaccuagaacagccccaucccuaggagaugccugauuaauaucuguuaagcaaauaaauguauuaggcaucugugaugggucaagcaccgucuuaaugcuuugcauguaugauuuuauuuuuauuucauuuauaaaauacuguuuuuuuagaaacagccuuuuuuuuuuuuuugagauggagucucacucuguuuccucaaaaguaguugugguuuuugccauuuuuguuuuguuuuguuuuuguuuaguagaaacggaguuucacuauguuggccaggcuggucucgaacuccugaccucaggcgauccaccagccucagccucccaagguacugggauugcaggugugagccaccaugcccagccauauucaauuuuuuuaaauguuagucucuacccuugggaugcccacuggcuaguugaggaaauggagcaguguuuggauagaagcuagcauuccugcagcccugaugucagcagaugcugacggaugcgugggugcccuguguucagagguagggaugcucagaauccagaccaagcacaaacaccuccuuucacuaaaacacaaacacaaaucagggugccuggugcuucuccagacaucccuaaggaucacuauguauuuaggcacugggggagggcuggcuugauucccugggcaugcacauaguaggugcucaguaugcaccaucugcugcuguugcagaguugcugugcaccccgugcccaucaucauugcagguugaggcauagagggcagaaucuggaagcuggaccugcacaucugaggagagggggccucagagcucaagcucugaaucacugacuuacacaugaggguucaaaaugaauuaaugacuuccaccugugaguucagaaugaauuagugacuuacaccugugaauucaaacugagugacuuacaccugaaugcucaaaacgauuuaaugacugacacuugaggguccaaaaaugaauucgugacuuauaccugaaaguucaaaaggaauuaaugacuuacaccugaggguucaaaaugaauuagugacuuaccccuaaggauucaaaaugaauuagugacuuacacuugggaauucaaaaugaauuagugauuuacaucugagaaggcaaaacaaugacaaugacagguggccaaaugcguuaauucuguuccagccaagcagucuuuuuuuuuccuuuuugagacggagccuugcgcugucacccaggcuggagugcaguggcacgaucuuggcucacugcgaccucugccucccggguucaagagauucuacugccuuagccuccugaguagcugagauuacagguacucuccuaauauuuguauuuuuaauagagacgggguuucacauguuggccaggcuggucucgaacuccugaccacagaugaucccuccgccucggccucccaaagugcugggauuacaggcgugagccaccgcacccaaccuuaaucagucuuuagaaccagcuagugcuggcuccugaaacaggcuaggauggggccucucugggaccccugggugacccuccagagggccagagagggucuccaauuucugccccauuuuagcaggagacugagaacccaguuugacaacaguagcuaucaaaaacaaaagucaaacuuauuucuuauuuaaucccugacauuaaaauguaauuuucauuugcucagcggcaucacugauggauggcagagagcacguuagcacucgccagggaacgggggccccagcagacacaccuggaggcaggcaggguugaguccugcagcuccuccuggccucccgucccccaccuaccugccggccuggcuccuccagcucuuuugguuauuccaggugcuuccaccagcccccaaccaaagaaucgauucugaguggaggcugagaagcaugggcuuugcugucagacuaagcugccucugagucucagcucccagcaccauguggccaucacccucugugccucgacaucuucaucuguuaaaugggauagucacacccgcagcgugaugaggguuaagcuaaugugcauccaguacauagcacagugccuggcacagagucagugcucaguagucacuguuaucaucaauaauaaugcacaaaucagccaaucgaaguagcuguuacccccauuuuccgggugguaggaaaucagaagggugcuguaaagaaaagggaucuuucacagggacugucagagugagugggaacccucaggauagucuagccagaccuccccacaugugggucucccugaguaccuuuacagccucacagauacaggggcauguacuuggaugccuccccugguggggagcucaguaccucccacccagaccccaaagcaccccugaguggucaacaggagccccucccccucugguacaucugagcaagucucggcccugcuucauggcuuccagggguucucaucgcuccucuccacggcccaucggccccuacccaccgcaccaaaccuaucucccaccacagccccccuagcucuccauggcccuccuuucuucucugagccccccucguacucuugccucucuuugccuucuguguggcccccugaucugcaugcccuaaaggaacaaccagccuucagaggccaucaagggacaccccuuccccucugaacccagcucauuccuucauuccccgaucucuggguugccuuuccauugcccgaguucauucugagacccuccaagcaccugccuccucucgcuuguccaccagucuucagcuucuucuggaauuccugccacaucagacguccaccccccaucaucucucagaaucacccuacccucuccagagcccaggacccagugguagagggaggcugcucucaaaguauguuccacggaacccagggaaggaguugugcagucucgauggcaggucccccuuuucaugcccacagcacuuggagaagcacaguuugcagcugcaagucugggcccuggagugagaggcaccugggcaccgauaccaccucugccacuaacuagugcucucaucuuagccaagugacuuaacaucccugccccuuaguuucuuucuuccucuguagaacagggccggucacaaugcucacauccuaaaggugugcuugggggaaggcggggauuucaaagaagaugccuggagcacauaguaaggcuuagaacuuggcacagagugguucucaguggcucccagaugucccugcgaccucagacagcuugguggagcucagccuaggggagggggcccaaauuuucuguuuuuaaccaccuggcugaaaagagcuauguggcuagaacaggcuugacucgccccuggcagaagcaguucuacaccugcugcguucauccucgggggacuaaacacauugucaccccucguaucacagugggcugcguaaaugccaugugcuuccacagaugcugagcuauuccugacagugaccuucuugagggugucuguggauggucuccaccuccucccucuucccuccuccucccucuccuuccucccccucccacuucuuccuccccuucccuuuucccccuccuccucccuuuuccucuuccuccuccuccucccucuuccucccacuucuuccuccuccucccucuuccuccccuuccuccucuuccuccuccgcuuccuccuccuccucccacuucuuccucccccucccacuucuuccucccccucccacuucuuccucccccucccacuucuuccucccccucccacuucuuccucccccucccacuucuuccucccccucccacuucuuccucccccucccucuucuuccuccucccuccuucuccuccucuuuccucuuccuccuccuccccuucacucuuccuccuccuccucuuuccucucccuccuccuucuccuccucacucuuccuccucccugcucuuccuccucccucuuccuccuccuuccuccuccucccucuuccccccucuuccucccuccuccuuccccuuccuccucauucuccaucuuccuccucuuccucuuccuccucuuucuucuccucuuccucccucuuucuccccuuccuccauccuccuccuccucuuccugucuuuuucuccuccuuuccacauggccuucaaggguguuccugucauagggcaaaucugucauucugggcacuuugcugcugcccuucugugugguugggcagagccaugagacagaaacacacagccuuuuauugaacauggccuuuuaugccaagcucacuuguucucagcaugugggugaaaugcauugaguuucagcccuuggaaaagauauccuaugugauuagaagaagaauuuucugauuuauuugaaagcuuucaucagcuuccaugggacucuuugcugcauguuagcucauccugccccaacagcuuuguaggcagguagagguuauucuucccacuugaugcacggacaaacuggggccaagagaugcucauagugacauuaggcccaguaccaggucaggcucugaugccaucaggaauuuaaggaccgcgguggcucacgcguguaaucccagcaccuugggaggccaaggcgggcggaucaccugaugucagaaguuugagaccagacuggccaacauggugaaaccccgucucuacuaaaaguauaaaaauuagccaggcgugguagugcaugccuguaauuccagcuacucaagaggcugaggcaggagaaucacuugaaccugggagguggagguugcagugagcugagauugcgccacugcacuccaaccugggcgacagagcaagacuccaucucaaaaaaaaaaaaaaaaaaagaggaauuuagggaccuggccuuccacagacagccagucauugccuugaaacgagacugaaugaggcaggaaaucuacacggcuccugucuuugaaaguccguugacuuugggaagcccuaaacaugaacugauucacacugagugccaguccaggauuucuuuugauuguaaagauagagucucauucuauugcucaggcugaugugcaguggugugaucacagcucacugcagccucgaacuccugggcucaagcgagucuccuacuucagccuccugaguagcuaggacugcaggggugcaccaccacaccugacuaauuuuuucaggauuauuuuucuuuuuuugaaacagggucuuuuucuguuguccaggcuagagugcagugacacaagugcacuuagagugcauugcagccuaaaccucccagacucaagugaucccccuuucucagccucccaaguagcugggaccacagguguagaccaccacacccagcuguguguguguguguguguguguguguguguguguguguguuuguguguguguguggagauagggucuugcuauguugccaggcuggucuuaaacuccuggacucaagugauccucccaccuuggccucccaagugcugagauuauaggugugagccacuguaccuggccucaggauaauuucuuaucucuguuuuuaaaaauauuauccagcuguuagaugaaccccuaaagcaaggaucagcuaacuuuuuucuguaaggggccagauagaaaauauuuuuagucucgcgggccacaaagucucuuucacaacuacacaacucuguccuuguaacauaaaagcagccauagacacguaaaacagugaccaugccuuuguuccaauaaaacuuuauuuacacaaacagaugaagggccagauucacaccaaggaccaaagauugccaaccauugauccaugagaucaacaguguccagcaggaaaagaacacaagccacauuuguaauuuaaaauuucuaguaguuacaauuuaaaaaguaagaaguguagcuggacgcagugccucacaccuguauucccaucacuuugggaggcugaggcaggcaaaucacuugagaucaggaguucaagaccagcuugagcaauauguugaaaccccgucucuacuaaaaauacaaagauuagccagguguguggugcacaucuguaauugcagcuacucugcacuccagccugggugacaaagugagacucugucucaaaaaaaaaaaaaaaaaagaaauuaagaagugggugaauuuaauuuuaauaauauauuuuauuuagccugauauguucauaacacuagcauuucaaaauguaaucaauauaaaaauuauuggcuuugggaggccgaggcggguggauugcccgagcucaggaguuugagacuggccugggcaacaugguaaaacccugucucuacuaaaauacaaaaaaauuagccaggcgugguggugggcaccuguaaucccagcuacucaggaggcugaggcaggagaauugcuugaaccugggaggcagagguugcagugagccgagaucacaccacugcacuccagccuaggcaauacagcgagacuguccaaaaaaaauuuuuuuuuaauuauugccgggcgcgguggcucacaccuguaaucccagcacuuugggaggccgaggcgggcagaucaugaggucaggagcucgagaccauccuggcuaacacggugaaaccccgucucuacugaaaauacaaaaaauuagccaggcaugguggcgggcgccuguaaucccagcuacucgggaggcugaggcaggaggauggcgugaacccagaagguggagcuugcagugagccaagaucgugccacugcacuccagccugggcuacagagcgagacucugucucaggaaaaaaaaaaaaguauugggguauuuuacauuccuuuuucuuucuuagacuuagaaaugcuauauuuuacacuuacaacccaucucaguuugaaaucguugcauuucaagugcucaguagcacauggaccgguggcugccuuauugaacagcuccgcuccaguggggaaaacuuaagaccaaaacugucauccuccuuauaauguuagauuuagucuuccccacuggaagagauaaaucauggaccauuauacacugauaagugccaugaagggaaaguagggggugcucuaggcagggacagggaaacauuaaaggaaucuuccagcacuuguccccacccuugcucagucucucauuggaggccagugccuuuccucagaccccagccaccacaugcacucagcucaggcaaccguaaaauggaacauugagucauucuucuggcuggucuuugauaauucuccuucuaagacccaugagaugaauugcuuuuguuucucauuguuuucuugggugccaagucaccagcaccgcagccucucgcccagggcagcuguaguuggcuuguaaggcagcggcauccucaugggcucugaacacccggccccacuggcugggguaauuuuucuauccaggacaaaaggaaggcagcauuugaauucagaguggcaauuugaauccccagaccuggugugaaucuuggcccugccauuugcuaaccgggugaccuugggcaaguggcuugacguccuugagccuccguuuucuaaucuguaugauggggcagguggcagcagccauucggugauugauguguccguggagacagacucucaugaauaguaaaagcuucuggcacacaguaaacggucgaugccauuuguuuuuauuagcccaucagggaugccccccgcccccgccccaagauucugaaugaauugcccccuccucagggcucacaggagccaccaguguuugcaccuccuccugugcauuuguuuuguuuguaaagauagggucucauucuauugcccaggcuggugugcagugguuacgcuuccuacuggccauagcugugucucccacucaauugcauguccccagaaacucacucuuguccaucuaagcaaggacaaaaaucuacccacagggccaggcgcaguggcucaugccuguaaucccagcacugugggaggccgaggugggcagaucacuugaggugaggaguucgagaccagccuggccaacauggcgaaaccucaugucuacuaaaaauacaaaaaaauuagccagguaugguggcgggugccuguaaucucagcuacuugguaggcugaggcugaggagaauugcuggaacccagaaggcagagguuacagugagccaagauugugccacugcacugcagccugggcaacagagaaagacucugucucuaaauaaauaaauaaauaaaauuuaaauuuaaaaaagaccuaccuacagcuuggugauuuucccuuugucuagcuucuagaacuuuuuuucugcccucccccaagugacuuccccuucucagggagauaauuccugauguucuguuaccaaacugggucagccuccccccaauuuacacacucccaaggccacccugugcuuuucugccaagcguuuagcacuuguaauuaaugagucaucuggggaagcugccuuaaugccaguguccccaccggacuguaagucccauaagggugggacaugagucugccuuauucauggcuggguucucagcccacagugcuuggugcauagcaggugcucaggaaacauuuguugagggaaugagagacugucauccaugcuggaaggugagagaccagggacuuucucagacuaacaaugagagaaauuacagagauuuuguaauggaucuuuuuuuuuuuuuuuuuaagauagggucucacucuauugcccaggcugaagugcaguggugcaaucauagcucauggcagccucgaaauccuggccucaaacaauccucuuaccucagccuccugaguagcugggacaacaggcacgagccacccugccuggcuaauuuuuuuaucuuuuguagaaacagggucucacuauguugcucaggcugguuucgaacuccugagcucaaacaauccucccgccucagccucccaaagcacugggauuaaaggcaugagucagcacucccagccuaaaacuaaccuuuuuuaaucacuuuaaucaccaauacauuuccaccucuuuuaaagaggguaauucuguuacccuccaacauuuguuaaaguuguuugauaucuuacgagagcuuuaacaauuucucuuucauuuuuaguggcaagaaauauucucuagacgugucccacuuuccuccuaaaacauguaucauauuugaacuuccagucuacccuuuacuaauaagaagaauaacaggugucaccaacacaccgugugccgggcccugugcuuagcacuuaggugcggcuccauuuaaucccaacaggagguagguccuguuauuuaccccgcauuuuacagaugaagaaacugagaaucagagaggggcagugcaaggucacacagccugcacacaguggagcugggcuuucaacccagauuuucuaacuccagagcccacacuuuuaaccuucauuucuccuucuugccccuccccuaucccauguuugcacaaguagaaaaugacuaaggccaggugcggugguggccuguaaucccggcacuuugggaggccgaggcaggggaaucgcaggaggucgagacaagccugggcaaccuguagcaagaccccaucgcuuaaacaaacaagaaaaaaaauacauggccagccaugguggcucaugccuguaaucccagaacuuugggaggccaaggugggcagauaaccugaggucaagaguuugagaccauccuggccaacguggucaaaccgucucuaccaaaaguacaaaaaaauuagcugggcaugguggcaggcaccuguagugguagcaggcaccuguaaucccagcuacucaggaggcugaggcagaagaauuacuugaacccaggaggcggagguuacagugagcugagaucauucuauggcacuccagccugggcgacagagcaagacucucucucaaaaacaaaacaaaacaaaacaaaacaaaacaaaaaaccugcagauguuuucuuguggaaaaaaaaaaugaugaaauuugcuugcagacacagaugccaugguuacacgugacucuuucucuuguugucuccaaaggugguggcccuuaguaagagaagucaggaggcggaggcugcuuuucugaguguuuacaagcaauuaauugaagcaccagguaagaaaugcuugggcuccguaauugaauaguuaacgacaauaaauagccauuaggacugugacacagggacuuugaggugggauguggggacaugccugggcuccugggugaggccaggcacucuguauagggcagggggagcuguggccagucuggugugacauguccccccagggcuccccccaucuuccuucaucauguugucacaucagccaggagccugcuuuagggggacuccugaugagauaucccaccuggaccuacuuggggagcugaaaucuuacccacuagagcccccaucccauuagcacagaagacugagggcacccagugcucucugccugcagguggcaauagaggcaagaccuccaguaccucccccagaauggcacagccaaccccaaaaaucugcuguugaguaaaagccagccccagaagagcacauccuguaggauuccaccuacagaaaaucuaaaaacagacaauuaauguuacucaguggucaaaagggggaagcaauccauauggccaucaauggauggaugcauaaacaaaauguggccuagacuuacaagggaguauuacucccuuuccaugaaaaggcauggagggccggguacaggggaucacgccuguaaucucagcacuuuaggaggccgaggugggccgaucaccugaggucaggaguucgagaccagucuggccaacccagcgguuuuaguagaaaucccaucucuacuaaaaauacaaaaauuagccaggugugguggugggcaccuguaaucgcagcugcucgggaggcugagacaggagaaucgcuugaacccagaagguggagauugcagugagcugagaucaugccugcacuccagccuggaugacagagcaagacuguccucugucucaaauaaaaaaggaauggagcugugauaugugcuucagugaagaugaaccucgaaaacacagugcugagugaaggaagccagaaaccaaggccacauaguguaggauuucauuuacaugaaacauccagaacaggcaagccguagauaagagucgauuguugguugcccggggcuggggagggagauuggagagugacugcuuaaucgguaugaguuucuuuuugggggauaaaaauauucuggaacuaagugaacaagugguuguagaacaucaagaauguacuaaaugucauugaauuguucacguuaaaaugauaaauuuucuguuguaugaauuucaccuuaauugaaaaaaaaagucaaccuguacuauuggaaaucaagauagugguuucaaacacuugaagggggccaagaguuccugggaggggccucugggugcugggacugugguuucucgguccugguuuggguuacaguuugagaacauuugguuguacacaaaggaucuauacauaugccagacauccauaaaagcuuccccuauuuuauuuuauuuuauuuuuauuuuauuuuauuuuauuuuauuuuauuuuauuuuauuuuauuuuugagacagggucuugcucuguugcccaggcuggagugcaguagcgcgaucucagcucacugcaaccuccgccucccggguucaagcaauucuccugccucagccucccgaguagcugggauuacaggcaugcaccaccauucccggcuaauuuuuuguauuuuuaguagagacaggguugcccuauguuggccagccuggucucaaacuccuggccucaagugauccgcccaccucagccucccaaagugcuaggauuacagaugugagccaccgcacccggccaaaacuuucccuuguuuuaaauggcccauccccugcuaccuucucauuuacugacccagaaacaggagcccaaagaguugaaaugaucugcuuaccaauggcagagcccggaggaggccuugcugugcuaacucuccccacccagaccucucccaguccuuucccccauccuuccacacaguggcaggaaucagcacuacgggagguguuugaggcugggggccugugaagaggaaaaugacaucccacccucagcuguccgacugcaaaacccaaaccacagagaacacagagucauuuagauuagaugucaaggucauuucugggaucuuuguauuuggggugggaaaguccacuguuccucugucuggggcaacuguaguggguuggauaguguggccuccaaaauuuaugucuacguagaacuucaaaauaugaccuuauuugaaaauaagucuuugcagauguaauuagcuaaggaucucaagaugagaucauccuggcuuuagggugagcccuaaauccaaugacugguguuguaagaaguauggggccaggcacaguggcucaaagccuguaaucccagcacuuugggagacagaggcaggaggaucacuugaggucagaaguucaagacaacccuggucaacauggggaaaccccaugucuacuaaaaauacaaaaauuagccaggugugguagccuguauucccagcuacucaagaggcugaggcaggagaaucgcuugaacccaggaggcggagguugcaaugagccgagaucacaacacugcacuccagccugggugacagagcaagacccugucucaacaaaaaaaaaaaaaaaagagacgaggguacagagauagccacugaggaaagcuguguaaaaacagaggcacgguggaaaugauguagcuacaaggcaaggagcaccaaagauugccagcaaccaugagaaacugggagagacaagaaggauccuucccuagagucuucagaaggaguacagcccugccagugucuugauguuggacuuaugguccccagaacuacaagacaauaagugucuguuguuuucagcccccaguugguggugcuuuucuacugcagcgcugggacacuaauccagcaaugcugacaaagcuugcccuccgacagcguguggccuggaugaagagggaggucuucuggccuguugcuacucaaaguguggucuguggaccagaaacaucagccucaccugcaagcugguuagaaaugcagaggcucagccgcagguggcggcucaugccuguaaugccagcacuuugggaggcccaggugggaggaucacuugaagccaggaguuugagaccagccuaggcaacauggagaaacccugucucuacaaaaaaaauacaaaaauuaucugggcauggucgugggcgccugugguccuagcuacuugggaagcuguggugggagaauugcuugaacccaggagguggagguugcagugagcuaagauugugccacugcauuccagccugggugacagagcaagacccugucaaaaaaaaaaaaaaaaaaaaaagaaagaaagggagggagggaggaaggaaggacuacagagucucaggccccauccccggcccacagaaucagcuucugcauuuuaucaagcuccccugugaucuuggagcaugggaaaguuugagcgcacaggccugauauagaaguugccuuuguucugugcucugcguuucacacgccccaugggagcagguccaagcaacucgcuucucuguggcacagagagguugagcccgaugcccaaggucucacaggcagggagagaugugacucgggucucaucauguauaacaaauauuuccagacucugcuccgugugacaagcuggcugcacguggaaggcugaguuaguuuccuacggcuguuguaauaaauuaccauggaugccuuaaaacaacagagauucauuccgucccuguucugaaggccacaggcccaagaucaaggugucaacagggcuauacuuucucugaaggcucaggggaggauccuuccuggcuucuuccagcuucugguggcuccaggugucccuuggcuuauggcuauaucacuccaaugucuccucuguaucuuugucucaaucucccucuccuuucucucucucucuccuuuuaaaaaauauauaugaggucuugcuuaacaaagcccaggcuggagugcaguagugugaucauagcucacugcaaccucagacuucugggcucaaacaaucuuccugccucagccucccaagcccagcuaauuuuuuaaauuuauuuuuuguagucccaaagucucacuauguuacccagacuggucucaaacuccuggccucaagugauccucccaccucugccuccugaauagcugggauuacagguguaagccacuguacccaaccuccuuucucuuauaaugacacuugucauuagauuuuggggccaccuggauaauccagguugauuucaucucaagauccuuaauuauaucggcaaagacacuuugguuuuuguuuguuuuuuguuuuuuguuuuuuguuuuuuuuaagagacagggucuugcucuguuucccagguugaaguacaguggugcaaucuuggcucacugcagccuugaccuccugagcucaagugauccucccaccucagccucccgaauggcugggucugcaggugcagccaccaugcccagcucaaagacacuuugaauaaagucacauucacagguuccaggcguuaggacacagagguauccuuuuggggcggacguucagccaguacacaugugccugcugccuggucccaugcuccaccccaucccgcgcucacaggaacaguccagccacgugaguuuucccagugaugagaguggaaggaauggcaagagcugauggcacagcugcaggcuguggucccugcgaggacauggcgcuauggcacgaggccgagacagcccaugugucugcagcuggggucauuaucacccucacugccggccauaacguacucauggccaagaggcccaguggcaccauuccuugccgccuuuuugcuuauaaugucuccgcucucaucagugauaucuagaaaaagacacccucuuauuucccacccuuuucgauccuuugggucccacugugucagcgacaaaugacacuggaggaugacccuguacagaccccagagaugccucccagggguccccaggcagcgcucucccacggcaccccguaguaccucaguuguaacacgagggggcagcgcugagauaugcgugugcuuucaggcucaaagacccagauucaaauccuguuugugucacuuacugcgugacugcagaggaauuaauucaccuuccugagcugcagucuccucuuccauaaauugagaauaauauuagaaccugccucgugcuguuauuuggaggcaucaagguucacaguauacagcaggugcuuacuaaguguuaacuauucuccuuaucauauauguguccagcuuuccuaggagaugugaaaugcaccaggccucggacuaaaucauacuaaauucguauacccagaaccugguacacaguaggcaccuaauaauuguugaauauuagaaauaagacucagcagcaaaaacgggaggaaagguuauuggagcaaaaagauacuucaucagugagaccccccuuccaugcacaucuuguguuguuuacucagauagcauuuauugagugccuacugugugcccggcacuugcuggacacugggaacacagcugugacccuacaaacacagacaugggcccagcccucagaagcuuaccuuugaguggcagaagugaccagaucaucggucacauagccugucaucacagucacagggggacaccagcaugucuagugcuuggggguacagacaggcaggaagacaaagggaaacagaagggucuuacggccccccacuuggaaacgagcccucauuuugggggguguucuuaugggacccucaucuuucuggagagaagacuguuaaaacagucacaggccaggggccacucaaggucccaagauugcuguggaaccuucuggaagguccauauacccucucuccucuuuccccaaagcccgggagcaggaaggucauuccaagcccagugcugacuccaggagucugauuucccaacucuccuccccagaaaugcaggggcgggagagcuguccccagcugucaccgacuuagagaacaaggagccuuaacugauggagacguaccauacgaacagccccuuuagggccucuaauucauuuucgagacauuuaagcauaacaaaauguuuuaaugauuucuuaggggaauuaggaagacauauuuuuguucucauuaaauuuuauccucagacacaagaaccaaaugucaaauguguguugggcgcuuccagcuuccccgcucacugccggccccccagcuccaacccccuccauaaaaauaacacuccuggaaaauucgcugggacgcgcacacuccuguuuuuauauuucuugacaggcaaauuauuugucgaaauacuccuccccgccacccgaagccacacaaguccugauucaacauuuuuguuuugagugacugcugccaacacagaucuuuggcagagaauacgacagagccugauggcucagcaaguauuuugauaagugugcagccuggaugucuguaauuacgaaagaaaaccguaaaucuuuuggauauuguucacacagauguggcgugaagugagaaaaaaaaagcaguaaaacguguuaaaagcauaauuaaugucauuguugugggugaugaugugauuuaaaccucucugacuucuguauuggugauggcugauuccuuuaucgcacucguagagucacuagguacggacccaagcuucagaaggcuaacuuguuaacugagugauuaguuaaaaggaaaaaaaaaaaaaaaacaaggaacgaggaaaugagagggcaggcagaugaacauugcugaggagauaagagacaggugagugccccaaaauguuguuuucuacugugcuuugguuuuuacaaaucugaugcagauuugcaauuccuggcagacauuucucaccuugcuccuucucuugggggggaggcugaucaggaaggugcucagugcccaggcuauagagguugacacaccuggguggaacucucaguuugguguuuugugcugugugaccuuggccaggggcuuuaaccucucugagcucugguuucugugucuuuagaagagggauaguaauagaaccuacucagggguggacgugaggauucgcuacgcuguacaugaaagcauuccgcagggcugaguaaucagcagcccauugacaucaggguauaacaguuauaggagugacaagcgucugcuauugauucuacgagguucggucuguugucagggacauuggauaagcaguggugcaggcaacaggguuccugagccuauagaauaggaaaaugcucuacaacguuuaaaauuuuuaaauuugucuccucgauuauaaaaguagcauaugcaugcugucaacuucagaaaauagagagaaacagaaagagggaaaacgaccagcuagaaaagcauuuuguuguuuuucuuuuccgugauuuuucccuguguacuuuuucaaaacaguugcugauucuacauguaccguuuugaauuguuuccuuuaucugacaugaagcacucauauuucccugugugauuacagaucccaaguaacuuugauucauuguacaagccuaacaaucccuuguauagcuguauuguaauuuaccuaaccccucuccaacucuggacaguuaaggugcuugggaacacauccccuauugguacugugcuguaccaagaagaaaauuugggaaggaaaaguacauuguagccuuguauugaccacaaaccccaggaucagugaccagaauaagaauguuuuucuccuugcugauuuuauauugcaguccuuuacuuacuaguucacuaaauaucuuuucauauguuauaaagcauucauauuuauacuuuuagaaaucucugguuuaugucuccuuagcccagagaguggauuuuuucuaccagagaguagauuauuuucuuauugauuuguagacacucuuuguauaugggggauauuaaccuuuguccagguauacauguuucauauauucuccccugguuugccuuuuguuucucaacuuaguguguaaugucucuugucuauuguauguagcagguauucaaaaaaauauuugcagaaagcaagaaaucuuagcaaaucuuugcuuuguagcuucugaauauccgguccuguuuuuaaaaaucuuucucgccucaaggguauaaggaguuuuuuuaguacuuuugugaucuuaauuuuuaaacauuuacauuugaaccagcugaaauauaauagauauugauagaaguagcaggggaggugaagcauuuagcuuuguuuuugucccaaauaacucguuucagugccaucuaguggauaagccaccugcacagcuacaggaaauagagauuuucuacgauuagaaaguguugucugugcuaaccuucccuccuucccuccuccucucccuccuccaugcccacgcuucugcucaguuagucccauaauggucaguggaacacugaagguuagcauaaaacaguauuucacccguuaaaaaaggaaaaacuuaacaaugucaauuuuccugaagaugacaguuaacuuuauuauuauuauuauuauuuucugagauguagucucacucugucacacaggcuggagugcaguggugcaaucucagcucacugcaaccuccgccucuaggguucaagcaauucucaugccucagccucccgaguagcugggauuacaggcacaugccacuacacccagcuaauuuuguauuuuuaguagagacaagguuucaccauguuggucaggcugguaucgaacucccgacuucaggugauccaccugccucggccucccaaaguguugggauuacagaugugagccaccacacccaggugacagcuaacuuuagaaggcagugucgcaccauuuccugccacaccucugcccaugccguuuccucagccaggagcacccuuuccccaugacccccuggcuaaacuuugcuccucccagcagcucaggguuggagagcggacugaaugaaagcauccagccgggugcugcugccugggagguguucaguaaaggccagucccuuucagaagggaggacaggcauucgagccguggcgucucauuagcuuaugcucugagugcuugcuaugugccuagcccugugggaacucaagcucaaguccaggccugcccuuggagacucucggguucagcaaggacaacaugacccaaagacagacaaccagaauacacaacagaaagcaggcuucaaggaaggauggcuggcagaggccucagagagggaggccuuuggaccugguuuuaaagguugaagugccaccauguggaggucauuucugggguacuuucugugugucaggcaguguguucggcccuuacagauacaaauucacugauuccacacacacccauacccugggagguagguuccaucauccuuccucacugggaagcugaagaaguacaggcucagauaauucaagccacuugcccaaggucacacagcagagaagugacggagccugaaucuagacccgccccgacccagcuccuacccacuaccccaguugcaagaggaauuuaaaaauccaaggagcuuggacaaaaccacuggagauuugagcucuaaaaagagugaaaaacaguuaaagggucuuugcugccaguagauugaaaaguuccaggcuggaaggaugaagccuuugcugaaaugcagaugugugcucgaggaagaacaaguggaacuuucauucuggggagacagucacacagcucccaaccuggcaaguggaggaagaaaggagcaagacuccagguugaagaaccucccugcagagccaggccaauccugugcugccauuuugcuucccacaucacacuugacuucuccgagccucaguuuccccaauguaaaauguggauaaugaccuccccucauuauaagggccauuggauggguucagugagcaacagagaacacuaaacauggugcccagcagucauugccccaugcaauucauucaguaaauauugagugccuacuguuugccaggcacucugucagcaacaggggcacaauguugagcaaaacagacaccaccccugcccuccuggaacuuucuguacagcucaguauauaagaacuugauuuuuuguuguuguuuuuggggguuuuuuuguuggguguuuuuuguuuuuuauauuuuuaguagagacgggauuucaccauaggccaggcuggccuugaacugcugaccucagaugaucuacccaccucggccucccaaagugcugagauuacaggcaugagcuaccgcgccuggugaagaacuuuauuuuuauuguaaggcauguggguuugaguccuggcugugcuauucccuggcuggguggccuugaguaacuggcucagccaaccucucugagcagcuguuuccuccuuuggaaagcagacuuaccucccagugccacugggagggcugaguaaggugaggacuguaaaguccuuagcugggugucuggcacauaguaaaugcucaguaaacaguggcugcugcuguuggugcuggugguggugguauuauuauuaccaucagcacccagugccaagaaagaagacccucauucccagcccucugucccuguccaagccaggaggaaccccccgccagccccacugccaacugccccaagaaaggaguggguagacacauggcucacagcugcauauaaaggcuuggcaccccaucugcuauugaaaaguuuagauuaaaggaucaaaguuagucucgcugccaccaucaauagccugagccucccacccccgcaggcgcccggagccugggcccagaugggagaaggcuucugucucgaagauauuuuggaggggugcacgcauacuucugcauaaauguguuucuaaacagccucucggacagccuuuccggcucuguguuuccuaaaaaagcuccaaaugccacuuuccuucagauggacauagugggaggauagagacagcucuagauuccccaacccccuccaugauucaaaaaaaaaaaacaaaaaaacaaaaaaaaaccaccaauagcaucagcuaguggugaaagauggaauaggcgaaguuguacccaccucccugacagugccuuuagaaagccugguguggucuucagauauuaucaguccuuugacuguguucucuauggguuuggaucccauguaaccaaaugaauuagccauuuuacuaaguaguuugugccccagagcagguugaugugugucggacaaaggcggguacacuuccccacggugucccccaucccugcacgcccaucaggaccugccaucucugauggcucauaguggauccaagucugccacucaucagcucaucagaagggucuguuguauuuaaacacuuuagauuuggggucuguacauccagguuggaucugaggcuguuugaucaucguggccacugcccuggucugucuauugaccaucuguguauugugggagugaguagggaaaugaagucccgcucacaccccugcguggggcuggcagcucugggcagccgcaugugucggcuggaaggcuuccgggagaagugcugagcccaacagaaaccugcaucgcuggcuccaggcaaggagcugcacggaugcccugucacuucuccugacacuaggauaccaggcuugccagaugcuggagugggggcaugauuuuagaggucgggggcuuggcagcaccuaguauuuccccaagugcggaguccacaugauacuggagacagccuggguguacccggacccaagacugaaacuuugaacacauugcaggaugugcgggugccaccuuucugcuccccucugaguaaagccucagccagguacuggagcaucuucaacaccuccacgccaccagcucuccccuuugaaccucaggagaggcggcccaggcucaaggucuugggcaggccacagggucuaacgaaaauucagauucaguaacauccauuuucuguuuuguuuuguuuuucuccuugccuuuauuuuuaugguugaagcaccuucuacuuaugauacaagaucccgauuuucuauuuaugaaagugagauaaaacauuacuuuaaaauauauauauuuuuaaaaagugagucagcccgggcacacuagcucaugccuguaaucaaagcacuuuggaaggcugaggcgggaggauugcuugaguccaggaguuugagaccagccugggcaacacagcaagacucugucucuacaaaaaauuuuaaaaauagcugggcauggugacgcgugccuguaguccuagcuacuuggggaggcugaggugggaggaucacaugagcccaaggggucgaggcugcagugagcugccaggauugcaccacuguacuccagccuggaugacagugugaaaaugcugucucaaaauaaaaauaaauaaaaagugagucacauagggcagaugucaaguuaaucaucuuucggaggcauauggacacagcagaaguuauaaagggaauacaccagagucuggcauuugggucgcauuggcuugguggaaaggccuggguucaaauccaccucugacuuuuucuugccuagugaccuugagcaaguggguucccucggcuaggccucaguguucucaucuggaaaaggggggugauagugauagcucacguaguuguuuccuuuuuguuuguuuguuuguuuguuuuguuuuguuuuguuuuguuuugagacggagccucacucuguugcccaggcuggagugcaguggcaccaucucggcucacugcaaccuccuggguucaggcgauucuucugccucagccucccgaguagcugggacuacaggcgcgagccaccaugcccggcuaauuuuuguauuuuuaguagagacggggugucaccauauuggcuaggcuagucucgaacuccuagaccucgugaucugcccgccuuggccucccaaagugcugggauuacaggcgugagccaccgcacccggccaguuguuuccauauuuuaagugagauauagagauaugcaaagugcuggcacuuguuggaggugcggucaagaaauuccaguuccucugagcucuuggcucaggauaucaggugggggucucaucugcccccugcccuacccaaccuuguggaugugggggccccaucugccccaggaugaaugguugcuggaguuugagggaugaagcccagaaacucacauauggagggccgcagcccacucugaacccagcugccacccucggccauagcaccccgcccucccagccugcgcagggaggggaaaggagauuggcacugggcguccccugggccagccccacauccccaucugugaaauggguuggucguuaugaagauggagcaaaguuguauuucugggacgguaaccccaggggagguuaguaggacggucagcugccauuuccuuaucugaugcaagccguuucuccugguauuuccugugucuaguauacucccccgcgaccccccugcuagcugccucauuagggcuccgcggagacaccacuccccucaccaggcugcccauuuagcgccacccagcccacccucucccccagcccugcuucauuuugcuucugagcccaucucacuccaguugccucacccauccuuuguccaucauucccucuagagugucagccccaggagggcaggaauuuucuaucauuuccugcuggaccuccacggcccagagcuuucccugacacacagcaggcacucgggaaauauuuggcaacugaagaaaugcugucaacacguaguggacugguggcuaaaugacgacugcauuagggacucuuagucaccugucacggcuguaacaaauaccaugagcuuagaggcuuaaaacaacacacguuuaugaucucaccguucugcagaacagaaguccaagaugggucucacugggcaacaaucaaagcauucgcagggccggguuguuucugaaagcaggaggcugcaggggagaagucauuuccuugucuuuuccaccuucucgggcuggggcugccuauguuccuuggcucauggccucuucuuccaucuucaaagccagccgggcagccucuucagucaaucucugacugugauccccuuccaucugcaaccuucagucccuguuccauguaacauaacacucacgggcaggacgugguggcucacaccuguaaucccagaacuuugggaggcugaggugggaggaucaccugagcccaggaguuugagaccagccugggcaacauaguaagaccccaucucuacaaaaauuaaaaaauuaucuggacgugauggcaugugccuguggcccccagcuacuccagaggcugagacagaaggauugaucgcuugagcccaggaagucgaggcugcagugagccgugauugugccacugcacuguggccugggcgacagagcaagacccugucucuaaaaagaacaacaaaaaacacucacagguucugagggucaagaugucuuugaggagccauuauucugccugccacagagaugcccccauggaaaacucucaaacucuguggcgcccuacccucucacccagagcucuaauaauuucaucacuuaucacacauuucaaacaacccacguuaauugagcaccuacuaugugaagagccagagcaggacccagggaaggaagggaagacucgggaaugaaaaacaagauucccuugguguuccauggcugucagguucucugagaaacguuuuccaaacauuuuaaagauuuuuugucauuucucucucuuucaauuuguguuuguaagagcagccagugacauuuagcugaugcaucgaauaauaccauuggacaaaguaaacgggaggcccucagguuugccaagcugcccggcagagcauucuccuccauagaaguuggcagaauccuguaauugucuggauguuaguaauuuuuuccucccuaccccagcucccagcaagguagcucagggcuccaugaauuccugccagauagggaaggugggaagaaaugaguucccuguacaauguaaaaucugggaacacagcacugugcgcugggggaggaaacaaggaguggaaaauacccagggaaguaaaugaucaucguagcuguguacuuucuagagcagccaacugaacccacagcccaguuccucaggagucggagagaaugaggaggcaggaggaccagugccuaggaacugucagguccccuuauggcaugggcuugucucccugaaaggcaaaugaaauggguauagcaggagagaaguagguuagacuugagugaggacuuccuuccuaugagacuuggagccuuggcaguuccucgguccugccugucucacaguuuguauugaguccauugccacauguuaugguuugaauuguguccuccagaaagauauguugaaguccuaaccaccacuaccucuaaauguggccucauuuggaaaaagcaucuuugcaggauauaaucaagguaagauuaggucauuagaguggccucuaauccaguaugacugauguccucagaagaagaggagaggccaggugugguggcucaugccuaaaaucccagcacuuugggaggccaagauggaaggauugcuggaacccaggaguuuggcaccacagugagcugugaucauggcacugcccuccagucugggcaacagagcaagaccccaucucaaaaauaaacaaggagcugggcucgguggcucaugccuguaaucccagcacuuuggaaggccaaggccagcagaucgcaaggucaagagaucgagaccauccuggccaacauggugaaaccccuucucuauuaaagauacaaaaauuagcugggugugguggcacaugccuuuagucccagcuacucgggaggcugaggcaggagaaucacuugaacccgggaaguggagguugcagugagccgagauugcgccacugcacuccagccuggcgaaagagcgagacuccgucucaaaaauaaacaaacaaacaaggaccaggcgcaguggcucgugccuauaaucccagcacuuugggaggcugagguggauggaucacuugaagucaggaguucaagaccagccugacgaacauggcgaaaccccaucucuacuaaaaauaaaauacaaaaacuagcugggcaucguggcuuacgccuguaaucucagcuacuugggagucugaggcaggagaaucgcuugaacccgggagacggagguugcagugagccaagaucgcgcuacccuacuccagccugggugacagagcaagacucugucucaaauaaauaaauaaauaagaaucagggagagacagaaggucacaugacaacgaaggcugagaucgaagucaugcagcugcaagccaaggaaagccagauugccagugacaccagaagcugggggaaaggcccaggucuccccuagagccuuggagagagcauggcccuacugacaccuggauuuuggaccuccagccuccaaaacacagcagagcagauuccucuggcugcugugccccauuaccacaaacugggugguuuaaagcaacaaauguuuucuuucagcugcggaauccagaagccccacaucaagaugucggcagaguuaguuccuucuggagacucugcaggggugucacacgccucucucccagcuucuggggcugccagcaauccuuggcacuccucggcuucuagaugugucauuuccaucucagcguccaucuucacauggccuccuucccuguguggcucugugcauccucucuucuucuccugaggacuccaaucauugcauuagaauccaaccuacuccaauaugaucucaucuugacuugaugacaucugcaaagacccuauuuccaaauagggucacauucugauguuccaaauucacaugaacuuggggaaacacuguucagcucagugcaccaggucccaccaacauuuccuguguaacucuugaaucugagugcugcucccacuucugccaccacugugaccacagccaucaucauggcugccaggacucuugcaguagccgccuaucugacgcccucuacacgccacuuuucacagagcagccagaugagccuuugaaaaaggcaaauuagaauguguccucccacugcccuuaggauaaaucccaacccucaucuacauuaucaacagaggggcuuuggcaucuacgugccaccugucccccccaucucccccaacuccacuccagccacugggaccuggugucuuguccucagaugccacugagcuuugcacagauuccuuccagccaccagccuuuugcacaagcggugccucccaccuagaccucucucccacagaucuucccugcuucucagcagcaccccuaguuccaugucacugaggucuuucccaaucuccucccuaaggugagucgagauccccccagggucgguguugauggaaacauucucuauggucccacugagcaccuuugcaaaggagcagcaucugucucccccacugggaagucggcugcacaaagacaagggucucauuuaucucacucaccaucaugccucccacagacgcucaauaaacgggcugagugaagcaggcgcaaggacucaggugcccugaggaucucugccagcuucagacucaucacugcagaaaugcaccagcaccagucacagauuucauauccacagacuccuagggggagggucuguguuuguccuuguuuuacagauggggaaacugaggcucugagaagcaagugauuuggguucuccaggaggcagaugccaagacagcuuuagauaugcaagggauuuauuaggggaaggcccgugaaggaaagaggggagagagaaggaggaggcgggaugcuggucugaugccugagaaagaagggaaggaggagggaggauuagccagggugagccucggacugcagcacggcucugagaaaaucuuggccagggugguggggaguuucagagcaagguguauuggucagcuccagcuaccauuaaaaacauaccacaggccgggugugguggcucacaccuguaaucccagcgcuuugggaggcugaggcagguggaucacgaggucaggagauggagaccauccuggcuaacacggugaaaccccgucucuacuaaaaauacaaaaaaauuagcugggcgagguggugggcgccuguagccccagcuacuugggaggcugaggcaggagaauggugugaaccugggaggcagagcuugcagugagccaagaucgugccacugcacuccagccugggcgacagagcgaaaccccaucucaaaaaaaaaaaaaaaauaccacaggccgugcgccuuggcucacgccuguaaucccagcacuuugggaagccaaggcaggcagauugccugaggucaggaguuugagaccagccugaccaauauggugaaaccccgucucuccuaaaaauacaaaauuagucaggugugguggccugcgccuguagucccagcuacucaggaggcuggggcaggagaaucacuugaacccaagaggcguagguugcagugagcugagaucacaccauuacacuccagccugggcaacaagcgugaaacuccaucuaaaaaaaaaaaaaaaaaaaaaaaaucacacagaacaggaggcuuaaacgcaagaaauuuacuuccccacggugggguaggcuggaaguccaagaucaaggugccuucaggguugguuuccaguagaaccucccuuccuggcuugcagacagcugccuucuuacuguauccucacacagccuucccucuauuggugcacagaaaaaggaauggucaaugggucauuuaaauuaauguccgcaccuccccccaccaaaggcuguucagaaagucagggaugcuucugacaaucuagaggauaccauaggucgggugugguggcucacgucuguaaucccagcacuuuggaaggccgagacaggcggaucacuugaggucaggaguuagacaccagccuggccaacauggugaaacccugucucuacuaaaaauacaaaaaaaaaauuagccaggugugguggcgcaugccuguaaucucaucuacucuggaggcugaggugggagaaucacuugaacccaggaggcagagguugcagugagccaagaucgcgccacuguacuccagccugggugauggagugagacucuugucuuaaaaaaaaaaaaccuauccccaaauguagucacauggggggcagguuaggccuucaggaugugggucugcagcagacagggucacaguucaguccaugguacaaccgucuguuccagcaucgggcaggacuacccccgccgugcucagccauuggaagaugccacaccuggaaggugucaccaaugccucgagggagguuuucucuugaagggagcucugaguggcaccuuccacagcugccacgagucauaauaauaagagcagcacucauuuggaguccacagaugacgggcacugaagcgggagcucggcgugcucagauaaccccagcauaaccccaugccguagguccuuuuguuaucucccuuuuacuaauggggaaacugaggcuuggggacgcuaagugacuuucccuggugauguuacagccaggguuugaccuccagccucccagccuggcuucauuucccuuucucuaagcgugucuuuggggauuuggggaagucaguguuccccaauuucuguauuuuuaguagagagggguuucaccauguuggucaggcuggucucaaacuccugacuucagacagucugcccaccucagccuccuaaagugcugggauuacaggcgugagccauggugcccagccugugguauguuuuuaauggcagcuggagcugaccaauacaccaugcucugaaacuccccaccagccuggccgagacuuugucagagucgugcugcaguccgaggcucauccuguccaauccucccuccuccuucccuccuuucucaggcaucagaccagcacccugccuccucucucuccuuccccucuuucuuuugugggccuuucccuacuaaaucccuugcguaucucuugcaucaaguucaacccugagggugucucauaaucacccucccugaucaucccagcuguaagggauagacccagggccaaagcacccgccuccaugggauccugccucuaucugaugacaccuaauguugagugcaugccuaggauauauuguaaugggcauuuggacaggggaaccagagaauucagugcauuguccagggucacacagcaggccagcagcaggaccgagggcagccauacgacuugugcuccuggucuaauaguaagaagccagggcccucaugcuccgucucaaagcagccugguccaggagacaaggccgggcaggagcacagcaaagcuuggacacgagcauuggucccuucuggccucccugggaaucagcccauuguucuuuacugagcacuuagguguaccaggcacuguguuaacugcuuuacaaaacuuagguuucacaucuucauaguaaccuugguagaugcaguuagugucaccauuuuacagaagggaaaacugaagcuuaaagggcugaaaugcuuacuuaagaccgcacaaugaguaaguggcagagaugggauucuaacccagauggcucugccuacagagccgcacuuugagcucaccucccgcuucuugcucucgcucuaaucaaaccucugcucaagugacgcuuucaccucgugcagcucggaagggccucuggucucuucgccaaccucucauugucucaguuagugagcagauguuuaugaggcaccuacugugugucagcaaacaagacaaaccuuagagccuguuuccuccucuuuccuuccuggaggcgcacugcaggaguccaccccuccugguugcuuccuggccaggcugcccugcaccagcccugucuaagccacaggguuuccuuucucccccaaaccugugacgacguccgggaaagcccaggguacaccuggcccugcacccuccugagcauucaguccucagucucuuuauuauuaggcccaauuuuuacccagucuugaaaugaaccuguaucuuaggucuccuuuggcccaaaaucacucaucacauguauccaucaggguucuuuagugucaugcagcagaagccagcucugcaaaacuaucaggcacgaaaggaauuuauuagaaggcagaaggugggggagaauggugagaccaccugggucagaugggaccagagcagugaguagcugggccggcugagggauucauucaaauucccagggcagagcaucugacccucugccaggggaaggcggggcaucuuaauugacagcuccauuguaucuaagagagaauggaaaucacccauuaguuagaaggucuaacggccgagccaugaaccaccccaccugcucccugaaaggacuaagauugacacaugugagaaucuuuaggacugagucccugagauguuugacaaauuccucaggggacucugaugugccccugcuuagagccagcaaguucucucaagcaccccauucugccaagcagggccagugucccuggauggcagcccagcccucccugccucacccuggggaaaugacuucaccccagugccuccauuuuuccgugugggaaaucgggauccagcagugccugccuccguguuguggugaagacugaaugaauucuaauccguggaaagggccuuggccguuaggacuccguugcagcccgacuuuggccaaggcaucuggaugucaccgccaccuucucccucaaguuggggaauccggggcagcacagugugagaggaagaggucuaagggcccaucucagccugccaccaacucuccagcggauuucagggauaauaucagaccccacuguguccugggguggaagggauguuggccagauugaucugauagaucccuccccagugugacuuucuaagcuugaaucuuugggucucagaguagaguuagcucaaagcaggauuauuagacucugggucucugagggacugaugcauacaggugaagccauacccugucccgaguuccacagagcauaucugcccagacagccagcgcccagaaugccagcaccuggugugcugccuugucuaggggugaugaaagcacacaacgccuagcaaggcccacccugugccuggcacuaugcaguucucugcacaccuucucucccccaguccuuaaccacccuacacaugcacccccauuuuacagaugaggaaacagaggcuccaagagguuagcuuggccaguugcaguaagagcugacacccgaucccuaaaucacuacugccucucucaauaucuuuuuuaaaucuucccaauaagaauuccugggaaggccaggugugguggcucacaccuguaauccuagcaagccuaggaagccaaggcaggaggaucacuuuaggcagggguuugagaccagucugggcaacauagcaagacccuaucucuacaaaaauuaaaaaauuaguggccaggcgcaguggcucauaccuguaauucuagcgcauugggaggccaaggcagguggaucaccugagauugggaguuugagaccagccuggccaacaugaugaaaccccaucucuacugaagauacaaaaauuagccuggcauggugguagcuguagucccagcuacucgggaggcuaaggcaggagaaucgcuugaacccaggaggcagagguugcagugagccaagaucgagccuuggcacuccagccugggcaacagagcaagaccuugucucuaaauaauaacaauaauaauaauuccugggaauuaggaaguuuccagguuauaaguggagaaacugaggcuccaggccccaugggaucuggacccugagcuggacuuuggauucugugagcuuaaugacuguuuuacacuguaccugcaaaggaaggcaaaaagacagagcuuugaaaucuauggaccugaaucaaagguccagccagccccuguucccaccagccucucuggggagccaccugaggccagccuccccaagacagagcacacagccagcaaggaaugacccagagggccucggaguagaacgaaaugucaauaccuaaucccugcgaacagggugagugacagacauccuuuaucaccaaguauagucguuuggcucaaugggcucauggccagcagggccccugggccacgagccggauccucccccuccuuggaaccggagcaagcccuccguggcccugcgcaguccgcguggcaccgcaccgucuuguguuugucuaacuucccugaccccggcgagugcucguugccuuuuuuccuccugucucaaaaaccgggacacaauaggaagcguuuccuugaacuuauuaaaaaauccagacuuguaaauuaauuuguucguguuguacaaaggcagugcagauggacucauuagcaugcacacaacaaauaauuauagaugaauuuuuagcuggccugccuaaugcgcuugcuggguuaauuaugucaauguauaauuacaucagcccggggagacauaauggcauacccugcugcgcaggcccugccuaaugacggggcgugggggcugccggcagaugaaagccaccgccgccuucccgcgcaccugcuuaccucggcauggacgcccauuguccaagccccugccaccuaaacaaacaggccacagcagaguaaaacagggaagccgccuuguuccagccggaccugaaggccccauguacaggcauugccccguuucuuccaucagcagaucuuuguuggguuggacugugggucauacuucaugguagguagaagaauuccagcaggguagggguggaagggagugcaaaaacaugcagucuggccuugccuugucgaguuugcaguccaguggguguuaauuaggugaaccugcaaauaaacaugcauuagaacugcaguggguaccgugaaggaaagguguaggcaguucauaucagaggacagguuagucgaggagggcuuccuggaagaagugacauuugaguuguacuauggaaggcaaguaaguguuuacuagcugaaagggguaggucaggggaggguguuccuggcaaagguucucgugcaaagggucugaggugggaagguaagaagaagccaaugugacuggagcucagaaagaagugagggcuucugcuuacucugagcuaaccaagugucuggugccauguggagcauuuuacaugcauccuuaccacagccccaugagguugcuacauuuauggugaggcacagagagguagagucacuugccaaagucauacagcaaucccaagaagcaaguauagauuagcagacuccagggauaccuaaccuugagguccacacucuugaucccucugcuucccagcagagagcaagggccaagcagauacuggcagaaaaaucugggggagcgaccaggcacgauaacucaugccuauaaucccagcauuuugggaggccaaagcaggcagaucaccugaggucaggaguucgagaccagccugaccaacauggugaaaccccaacucuauuaaaaauacagaaauuuggccgggcgcaguagcucaugccuguaaucccagcacuuucggaggccaagguggguggaucaccugaggucaggaguucaagaccagcuuggccaacauggugaaaccccaucucuaccaaaaauauaaaaauuagcugggugugauggcgcgcaucuguaaucucagcuacucaguaggcugaggcaggaauguugcuugaacucaggaggcggagguuacagugagccgagaucgucucacugcacuccggccugggcaacagcacaaaaaaaauaaauaaauacaaaaauuacccaggcguggucgcacacaccuggaaucccagcuacucgggaggcugagucaggaacauagcuugaacaugggaggcagagauugcaaugagcugagaucacgccacugcacuccagccugggcaacagagccagauucugucucaaaaaaagaaaaaaggaaaaaagaaaauucugggggagagaccaggaagagacagggcuuccaugcauuagaaagaacugaaccagacuaggccccuuggucuauauccaggacccuggcuuuccugggugccauggacaccaucugcaccugcuggggcugucaagagcaggcacuaggacaggaggccuuugugauaucaaagcaagagacccagauucgagucucacaucuaccuuucagcaagucaccugguuucucugagccucaguuuccucaucugugaaaaugccuuggauccaagccagccuccaggggaugccgugaggaugcugggaagccaguccugugcauggguuuuguagccuggaaggugccaacacaccucugagaugauccacauuucuuagucccugcccuagauggggacuuggggaaaguguccuggaagaagugaggcaggacuccagaguguaaggaagcggaugugcuugcgguguaaagggcugggagagggaaccgaauuccaggcagaaggaccugcacguuccucaccuuugagugauuggggaauugguggacaucuuacaucuagauguguguuuugcccccgaaaaaguccuuaaccaacaacgugugucacaaaugauggugucaccagguccaccgagaagcacaccaaggauuacaugggagaggauauuggugcaaaauaggaaugcagggagcaggaaggcugggagagcucgcggagagguggggcagcugccugggagcaucuagacccccacauagccuacagaagugcuggccgaggccaugggggagucaucacuccaaagucaguccucagagcagucccaccuugguauccccgcuucacacaggcaugguuggcagaggcggugggaagauuggccucagagcgauggaucucagagcagcagccagauccuugcucagugccccucgcuguaguuggaggucugcaaggcacagucuuaaagugccacagauagcaucauaaaaucaagaaaaugcaaugaagccagggcaacauggugagacuugucucuacaagaaaauacaaaaauuagcugggcaugguggugcacacccuugaucccagcuacucgggaggcugaggcaggaucacuugaacagaaucucacucuguugcugaggcugggguacagugaugcaaucuccacucucugcagccucgaccucccaggcucaagugauccucccaccucagccuucuaaguaacugggacuacaggcaugugccaccaugcccagcuaauuuuauuuuauuuuuuugagauggagccuuacucugucccccaggcuggagugcaguggcaucaucucagcucacugcaaccucugccucccugguucaagugauucuccugccucagccucccaaguagcugggauuacaggugcccaccaccacacccagcuaauuuuuauauuuuuaguagcaacgggguuucaccauauuggucagguggucucaaacuccugaccucaggugauccaccugccacagccucccaaaguacugagauuacaggcauaagccacugcgcccagacuauuuuuuaaaucuuuuugcagagaugagaucuugccaugcugcacaggcuggucuugaacuccugggcucaagugauccucccaccuuggccucccaaauugcugggauuacaggcguuagccacugcacucagccaaccuuuuuuuuuuuuugagauggagucuugcucuaucgcccaggcuggagugcaguggcgugaucucagcucacugcaaucuccaccuccuggguucaagcgagucuccugcuucagccucccgaauagcugggacuacaagcaugcaccaccacacccggcuaauuuuuuuguauuuuuagcagagacgggguuucaccauguuggucaggcuggucuugaacuccugaccucaaaugauccgccuaccuuagccucccaaagugcugggauuacaggcaugagccaccgcacccggccuggccaacuauuauuauuguuaguauuauucccagcugggcaggauacccauacccuggagauagcaggugcuccccugaacaagugccuggacaagccugcucccucguagagcagaaaguccaugcuacuuccuguaagccagcggggugacuccgauggcuccuguggaaccugccaggcccugcagccacagcccgggugucccuauccaucaggcccucacuaucccugucuuucucucccugcacagaccccgugccuguguuugaggcggcacgcagccuagacgacagacugcagccccccagcuuugaccccagugggcagccccggcgagaccuccacacuucguggaagaggaaccccgagcuccucagccccaaagguacugauaaggccuucucggagcgucuacaauaaacaaccaggcugcagaucuucagagccaaacucagccagccuuguugcgggguggcuggggcagggaacugggcaggugaaggccuuugguaaccaucuaguuccuggguauauauugauccuggugcuggaaaugcaguuaggaguaaaagagaaaaauccugcccuuguggugaugaucuucuagaaggggagacugucagugaacaaauuaguaagacucauaguguggcagguggagagaaaagucaacagacccguucagguucccacccuccauggccagccccaaagcacccucugccccagugacgaauucagcaccaaaagcacccaccaagcccugggaugagcccuugccgagcuggacaugacgcaggugaggccagugauggcugaguguccacaugggcgcccuccacaguagggaggggaaaaugucuggcaguccuucaguaaguaaaacacaggcucaccacaugacccagcagcgccacggcuagguguggaccccagagaauugaaaacacaggcucaaaacaguguacacaaauguacauggcagcguuacucauaacagcaaaagcagaaacaacucaaguggcuuucaacagcugaauggacaaauaaaauauccauagaauggaauauuacucggccaugaaaaggaaagaagcacugauccaugcuacaacauggaugaacuuugaaaacauggugcuggccaggugcaguggcucaugccuguaaucccagcacuuugggaggccaaggcggguggaucacaaggucaggaguuccagaccagccugaccaauauggugaaacccugucucuacuaaaaauacaaaaauucaccggguuugguggcucacaccuguaaucccaacuacuugggaggcuuaggcaggagaauugccugaaccugggagguggagguugcagugagccaagaucaugccccugcacuccagccugggugacagagcaagacuccaucucaaaaaauaaauaaaaagaaaacauggugcugaguggaaaaugccagacaggaaaggccacguaauguacgauucuguuggugugaaaugucaaaacaggcaaauugguagagacagaaaggagauuggucguugccuagggcugcaggaaggggaauggggaguuguuuaauggguaugagggguuuccuuuuggaaaauugugaauauacuaaaugucacugcaaaauggugguuaaaauagugaauuuuggccaggcacguuggcucacgccuguaaucccagcacuuugggaggccaaggcgggcagaucacuugaggucaggaguccaagaccagccuggacaacaugguaaaaccccaucucuacuaaacauacaaaaauuagccaagcaugguggcaggcaccuauaaucccagguacucgggaggcugaggcgggagaaucgcuugaacccaggaggcagagguugcaguaagcugagauugugccacugcacucgcaguccagccugggcaacagaccaagacuccgucucaaaaaaaaaauaaaaaauaaaaaaaggugaauuuuaugugacguauauuuuaccacaauuuuaaaaguauaauaaagcaggccgcggaggcaugagcaggcaaaagaaggucugcgugugcugacgcuggugccacaguggaaaugaccugugugcugaggacaugcggcccgcagggccccacagcugcgcucucuccaaggcccaaguuugggaaauugaucacaaucaaugaucgauccgguuuacagaaagcggcucuggcugccacguugcucucuuggcaauggggguuuucccucuuuuucucccugcagagcagagagaggggacgucgccugccgggcccacgcugaccgagggaagccgccucccaggcauucccgggaaagcccuccugacagaaaccuugcugcagagaaaugaggcggaaaaacaaaagugaggaagggaaggugggugggagggaggaaggaaugggcagggcuccugcugccccaccuggcugggucguggacggggaaagucuccuaccagaauccagaugcaggcuggagaccgagaugagaaagggccgagggcuuuggacuccaaccgggucuggguucaaguuccacugcaggaacucaguggccagcccugggcaagucacaucauccucugagccucaacuucccuaccugggaaauggggcuaagggugguccauuccucagcauucucuagagaaacugaacugguaggauuuuuuaaaugauuaagacauguauuccuaggacuuagcuuaugcaguugugggagcugccaggugcaaaauugguagagcaggaguuggugcugcaaucuuuuuaaauuuuauuuuacaauaauuauaauguuuuagagaugggaucuugcucugucacucaggcuggagugcaauggcacaguuauagcccacugcagccuguaaucccgacacuuugggaagccgaggcaggaggauugcuggaggccaugaguucaagaccagccugggcuacagagcuggagugcaguguugcaaucuuggcucacugcaaccuccacguuccggguuuaagcaauucuccugccucagccucccgaguagcugggauuacaggugugcacuaccacaccuggcuaauuuuuguauuuuuagcagagacaggauuucaccauguuggccaggauagucucaaaauccugaccucaagugauccucccgccuuggccucccaaagugcugggauuacagguguaagucugugugcccauauauauaugcacauuuuuuuuuaauuagccaagcaugguggcgugcaccuguggucccagcuacaugugaggcugaggcagagcagaggaucacuugagcccagguggucgaggcuguagugagcuaugauugcgccacugcacuccagcuugggcaacagagcaagacccuaucuuuucaaaaaaaaaaaaaaaaaagaaagaaaacaggccgggcgugguggcucaugccuauaaucccagcacuuugagagacugaggcaggcggaucacuugaggucggcaguuugagaccagccugaccaacauggugaaacccugucucuacuaaaauuacaaaaauuaagcugugugugguggcaggcgccugcaaucccagguacucaggagguuuaggcgggagaauugcuugaaccugggaggcggagguugcagugagccgaguucgggucacugcacuccagccugggcgacagagcgagacuccaucucaaaaaagaaaaaaaaagaaaacggaggaaauauuccucccccaggacaguauaaguaacucacaauauugcagaacuauugggggcugagcacaccacugagcaugcuucacaguacccccugaggcagacccuaucagaaaccucauuuuaaaaauaaggaaacugaggaccagagagguugcuugcuacuguaaauuuugccccuaaaaauccuggcagaaacuaacaggagcagccaugacaggguccacauaggcaguggagcagcaggacagccaggugccugaaugucgugucuaaggacuugcagaaagacagaggugcagguuacagggagugggcaagggguaggaagcaagauggggcucgacucgggggccccaggcaaggccugucccugcagccagcacaagcaggccucgucucuccgcaggggccuucaagaaguacagaucacuuuggcggccagacugggggaggcagaggagaaaaucaaaguccuacauucagguaugugucggcaccauguggccuagagggaggacugggaggggacgguaaugcugucaacgaggggucacggcuuggggucugccacauccagguguuuuagaaucaagagggcaaaaugggaguuugggaagaauaaucuuacccaguggggggcugagccucuaugccccagaggccacauugcuguggaaagaggauuugagacagaauuaauucaggugauggccaggcgugguggcucacauguguaauccuggcacuuugggaggcugaagugggagggucgcuugaaccccagaguuugagaccagccugggcaacauggcaagacccugucucuaauuaauuaauuaauuaauuaauuaauuuaauacaaccccugcaggggccaaaacgcuaccaagccaccgacuuaggggaggcguuggggaggggugaggucuggggcaaacuggagaaaugaggccucaucuaaagagacagccacugcuuaguaccagccaggcgcuaccauaugguccccuguggccaggcccuuccauuuucccagagaaauuagaaaucuggaguuguaucaaaaacgcucguucauuguaacacaugaaucuguucauuguguggaucuucccugucuuccggccugccagguuggaaccucggggugguugaacaccucgggauggauggcccugcccagguccugaaaugacuuaaggguguuggggggcuuauaccccaggucauggggcagacagcaccacgccuccaccccccaaccccggccuggguccccugagcuaccuaggcccauggagagaccucaucugccccgcacugcccaccccagccacugcacaucccucucaccagccugagccccuuuaggggcaggaaacucacucaccgucaccaguucugacugagagaaagaucucccucacuacccgagcucucauucugccugcugggcuucgcagaaggagugggcuccaccucccugggagacccagcuccuucccacucggagguggggccucacccugccucugcuuucucccagcgcuaaaggcuacgcaggcagagcugcuagagcugcggcggaaguacgacgaggaggcagcauccaaguaagugagcccugcugagguguaccuccucccuuggaggccucccagacaggccuccuccuucugacccuccaguacuugccuccucccucugacccucccagacacaccuccucccucugacccuccaguacuugccuccacccucuggccaucccagacacgccuccacccucuggcccucccagagaggccuccucccucugacccuccaguacuugccuccacccucuggccaucccagacacgccuccacccucuggcccucccagagaggccuccucccucugacccuccaguacuugccuccacccucuggccaucccagacacgccuccacccucuggcccucccagagaggccuccuaccucugacccuccaguacuugccuccacccucuggccgucccagagaggccuccucccucugacccuccaguacuugcuuccacccucuggcccucucaggccuucucccucugacccucccagacacgccuccucccucugacccuuccagacaggccuccucucucugacccuccaguacuugccuccucccucugacccucccagauaugccuccacccucuggcccucccagacaggccuucucccucugacccucccagacacgccuccucucucugacccucccaaacacgccuccucccucugaucaucccagacacgccuccacccucuggcccuccaguacuugccuccuccuucugauccuccaggacuuacauccucccucugucccuccagacaugucucuucccucugaccucucagacaugccuccucuuucugacucuucuccuuccucugagucucggcuggaggcccccguuucauuaagcaccucugcuccucacccccaaaggcacacagcugucauuugcugugccacucacacaccacagccauaaauaauguccugggaccugggcugagugaggggcugcuuggugggggccucccccuuugcucugggccccugggacuguccccgcuccccagcuccacacuccaauccucaggggcugagaggcauucaccuaaauuacucuggacucaagcguuucuuuaggcuuuaagaaaucauucauucugcaaacacuuauugagcaccugcuguuuauccagugcuguucuggguccuuggaggaaacaugagaacaugacccgguccucagucaaggagaggagacaaaaacugaugugcagugauacauuuguucauucacacauauugagcacuuacgguaugcccagcacuguucuuggcacauggcaaaugcuacaaagggaagaacuggggaugggaaaagagaaugacaagcagggguagguccuuuauccaggguagucagggagaacucccuggaggagguggcuuucagaaugaggagaaggccaugugaagaaagcagggaagggugcuccaggcagcaggaacagcuugagccaaggaaggcccuaagcaugcaugaagcauguguguggccuugggucacaaagugcuccccacgugccccccgcgucucccacccccugcuaacagaggggaugccucucccaagccccuccaugcuggcagccugcagggggcugggcagcgcaguaaacaagugaccacuggggacagugcagggcggccuccccggagaacacugugaucaggguuuuaaagccgggggcuguucucuugaggaugggcauuccaggcacuaccaggacaaaggcuuggagguggaguucagagaguggccccugggggagaggggaggccaggcuguccugaagaggugcagugcugacgcccuacucccuuuuccucgaagccuaggcucuuuucuccccagcccgauuucucuccuguagcaaggccuucagcccuccccugggcucaggcaggggcugggggugucaggaggggcgggggccuggagcccgccggaagcccuuccucagggccucaucuuugugucucagggcagaugaagucggccugaucaugaccaaccuggagaaagcuaaucaggugaggaggcgcaguucccacccgugggugccagaggcucccucugccuggggugggggucucgggccagaugaggaggaagggacugagcuucaucaauauuuauucaacugugggucuugugcaugccaagugagggagccaggaggagucugggccccaggcccugcccuccccaagcucccagggugggcccaggguaggggguugggguagggaaugcagacagacacacuuggaaauagagugcuccaagcagcaacaggcaggaaggggccgcugacccagacugcgggaguccaggaagacguccuagaggaagggauguggagcuaagacccaaagaauaaaugacagcauaucuaggcauggauucuaaguggggcucccgccuccugccuuccuccggcucagaggugcugccaucuggugggcagagucaggcaggacuuuaaaagaagggcagccacagccagggggcuccagcccggagucuugagugcccaccaugucugucccccagcucccugcaaugccaccagccagagacauggccaggagaggccagcagggccuugagcccucugucccuuggcucaucuuccugccuguggggugggagaagaugcccacccgcccugaggucugcgggcccgcacuguggcagggagagaggucauuuuccccaggggcaguuaaaaggggccucuuggaagacauuuugaagcuggguuucagaguccugaugcuguccccugagggagggcagccagguagaaggcucagcaggagcagaggcccgagguguggcucuuugggcgcagggugggggcacucccuccuacagaggagacuuggauaaaagggcugauucuaugucccugggaagccaccagaaggugcaggccugggcuggaagugcugagacucuaugagccccuaccccuauagaagcaguguccccuaggagggucgggaaggccaaagucagggcuagguuaccgugguggugguaaccgcaguggcuucccugagcuuagguccagcauauuuuucugaaaugaucauuaaguaagccccauuuuguauaggcuacauagccuuuuuagaaugauuuuuugaauagguaaugcauucauguaguucagaacucaagaagcuacacaagggccugucuaggaaaguccagcucuccuccgaguucuccuccccugcagcagccucucucaccagccccuggguucuccuuccagagauggucaauccauucacaagcccacgaauauaucuuuuuguggggggcaagggggacagggucauacucugucgcccaggcuggagugcaguggcacaaucauggcucacuguagccuugacuuccccggcucaggugauccucccaccucagccucccagguagccaguuagcugggaacagaggcgugugccaccacgccgugcuaauuuuuuguauuuuuuuguagagaugagguuucaccauguugcccagaauauaucuauuuuaaccagcggccucuuuuuguugagacaggcagggucucacuuugucauccagucuggagugcauugcagcgaucacagcucacugcagccucaaccucuggggcucaagcaauccuccugccucagucccccaaguagcugggacuacaggcacgcaccaccacauccggcuaauuuucauauguuuuguagagaugcgguuuugccauguugcccaggcugaucucaaacucuugagcucaagcaguccacccuccugggccucccaaagcacugggauuagaggugugagccucugugcccagccaccccuuuuaaaaacaaaaugauaauauacuaugcauaccauugugaaccuuacuuuuccccgucuauaucuuugagcuccuuccguaucaguauagaaagcaguuccuccucuguuuuacggcugugugguguuccucagcagggugcaccaucgucuaacccaggggagggcaaacuuucuauaaagagucagagaguaaauauuuucagcugugcaauccauacagucucugacacagauuuucaacuuugccauuauagcaugaaagcauagacaauauguaagugaaugagcauggcuguauuccaauaaaacuuuauaagaacaggcaagacugcacacaauagcucaugccucuaaucccaacacucugggaggccgaggugggaugaucacuugagcccaggaguuugagaccagccugggaaacauagggagaccucaucucuacaaaauauuuaaaaacuauccaggcauggugguguacgccuguagucccagcugcucaggaggcugaggugggacgaucaccugaguccaggaagauggaggcugcagugagcuaugaucacacuacugcauuccagccuggacaacagagugagacccuaucucaaaaaaaaaaaaaaaaaaauccagcuuauaguacuuggaauaggaagcacgucuaauaauguuuuccugaguccaaaacuaaaacccacacauuauggagacguauagagaagaaaauaaaugucaguguauuagguuuuuaaucucuguauuuauuaauacuauuuuaaugaggaugcugggguacagcagauccauauuauuacuuacaggauaauaaccacaccaguuugccccaauucuuacuccuggggugagaaaaugagaaccagcugucaucccacauguacuuaaguuuguacucuaggcgaggaccgccccaauucugaaucuaggugguuauguaggagagggaccuucugagagaggaagggaaagaaucuaccucccaagugucauguggacagagacaaggacgcuggcuguuagccucuggaauguagacacaucucuggagggggagguaagacuaguagcuuuuuuuuuuucuuuuccaagagacaggguccagcucugucacccagacuggagugcuguggcaagauccuagcuuacugcagccucaaacuccugggcucaagggauccucccaaguagcaaggacuacaggcucacaccaccacagccguaauuuuuucuugcuguugucaagaugguaucuugcuauguugcccaagcuggucucaaacucguggucucaagcaauccucucacaguccuggaauuauaggcaugagccaccaugcccagccccagcuaauugcuuuaaaacccagcuuuacuguucaggggcugucuccaugaugugggucucacccacccuugaugucuaaacacauaaaccuccagggaaggaaaccucugggguucucaguagcuaaucagccaugaguugaauuuucaaggcuuguccuuuaguccagaucucagcuuucaaucagauaugcucaggguucccuaacuguacagaaacauaaaaauauuuccuuuacagucccacauaccaggaaacucuucccaaaacaaaauugacuugaaccauuucuggaacaaggcaagauacguauaaauaaauaauaaauucaaaugugaacaugaauguguaugggucucaauaugcauacauugggcauagcauccugauuguccaggucauuauguaguuaaacauaaucacuaugaccugcauuaccagccaaaggcaaaaauacagccacagcucuuuuaauucucuaaguaauggcucaaguaauauacccucaugauguuaacaaaguuaaccaauuauugaugcauuuauaugugccaggcaccaagcaaagauaucuaccaaauugcauuuggccaaaccacuucauuugcagaacaacccuaugagauaguugccuuuauaauccccauuuuauuaauagggaaaccgaggcuggggagaugaagccucuugccuaagaucgcauaaccggaaaguugcaaagucagaaugugagcccagauuucucuccaaagccacaagauuaaauguauuaacauuugaaugcuuccuuccagguagaaauuuuuuaagaauuaagaucuaccagcugggugugguggcucaugccuguaaucccagcacuuuugggaggcugagguggguggauugcuuaagcccaggaguuagagaccagccuggccaacauggaaaaaccccgucucuacuaaagauacaaaaaguagacagaccuggcaucacacaccuguaaucccagcuacucaggaggcugaggcaggagaauugcuugaacccaggagguggagguugcagugagccaagauugugccacugcacuccagccugggcaacaaagcaagacucugucuuaaaaaaaaaaaaaaaaaaagaaaagaaaaagaaaucuaccagcugggcacaguagcucaugccuguaaucccagcacuuugggaagccaaggcaaguggguuacuugaacccaggaguucaagaccagccuagccaacauggcaaaacccgucucuauuaaaacuacaaaaauuaacccgucaugguagugcacaccuguaaucccaguuacucaggaggcugagaugggaggaucaauugaucccgggaguuggagguugcugugagcccugauugcaccacugcacuccagccugggugacagagcgagacccugucucgaaaaaaaaaaaaaaaaaaaaaaaaaaucgaccauagacccaguuuagugaacugcugcauucugauuuuaaccacucaaaaccucuuuguguuagauguuuucauugcuccccauuucaaaaagagaaacugagcugggcacgauggcucacuccuguaaucccagcacuuugggaggcugaagcggguggaucaccugaggucaggaguucaagaccagccuggccaacauggugaaaccccaccucuacuaaaaauacaaaaaauagcugggugugguggugugcacuuguaaucccagcuacuugggaggcugaggcaggaaaaucucgugaacccaggaggggcagcuugcagugagccacgauugugccacugcacuccagccugggugacaagagugagacuccaucucaaaaaaaaaaaaaagaaaagaaaagaaacugagacccagggagaggaagugacuugcccaggggcugcaauaaccuguggccugggaaagcaccuuugcagaugccgugucugggacucauuccauaccagguggcaugagaguuggaacagcucuugccuucagacuagccaggccugaaguuaauguggcagacagaaguaucuagaaaugugugaaaaccugccagucccacccagagagccucucucauccugccuucauagagcaggaauguucugacuccucugggggucccaggcaccccacgagaacccagaaccuccucagaggggcauuucuuccuguccucucagcucaggaguaaccccagaggcugcuauuucuuguccccagcccagacagggcucugugacuggucuucauagcuccaggacaggguccgggacuaggaaggcaggaccugaggcccucggaggucugccuccccaaccccugccugaaacagugcagggagaagguggaagugcagagugggcucaccucucgcccacacuguccccuucuccccagcgagcugaggcugcccagcgggagguggaaagucuccgggaacagcuggccucugucaacagcuccauccgccuggcuugcugcucuccccaggggcccagugggguaaggaugggguuggggaagugagcagggagggcagagggaaagaucgggaauggcugaguuugcagguuucagcaugugggugacacuuugugguugauugugugcauccauuugaaacugggagugugaaugugugugggucucugugcauacggugagcauaaucacuaugaccugcuacaccagcugaggauaaaaauacagcuacaguucuuuacuuuucaagcccacguuuccauauacccuuuauuaccaggaguuccaguaucuuccuuuggaggccucccuuauccccaauuauccaagaaugccaggaacuuccucagaccaaagaucauucugauuuccagaugcaccagcaaagacaugggggagagggaguuugaggcaauacagcagcaugcaguuuugguggcugccaccaggugucgcuguugaacaccggucauagcagcuuugugcaugcuugggauggugaugccccugcugguuuucagucccaaaacuggguacuuuuaggagugugagccagccaacauaucaacaggcagucaucaccaggacugcaguggggccacauaccaagauaaaauuuaacauucauacucagccauugguuuccaaagcaugccaggugauucuagggggauuucccaccccagccacaugcuaugaagagccagucuucggugaucaacccugagguucuuguguuaggccugauuaaucaauucaucuuucucuuuccuccugguuugugccucuuugggguccuagugucauuucuugacaagagacuuucaucaaggccaccccaaccuacccuucuguccuauauuagcagucuccauccuggcucucccagagagccuuggguucauuaugugaauuggucugccuuauuuccagaucucuacauaccaaggggugagauucaugauuccuuacauaauaacaggucugcuccagggugacuucccucuccacccaugaaccugaacuugcgagcauaauuuucacuucaccugacacccacauauacaggcccaggugucuaugucucucuuucuguuugaauauuggaaugagucucuaugaauguguuacuguguaugugugucucuacuugugaccuuugggcaacugacuguauucuuaaccugacugugccucaguuuccucaucuguacaauuaacaucuacuuuauaggguuauuaaaaggauuacaugagucaggcaugguggcacaugccuguagucccagccucuuaggaggcugaggcaggaggaucacuugagcccaggaguuugaguccagccugggcaauacagcaagauccugucucugaaaaaaaaaauggauuauguguaaagugccuaaaauggugcuugggucauuguauaugcucacuaaguacuugaugcuacuguuauaauuguuaaugugucuuuggugugucugggguguuuuugcucaugagagcauguggcuucuuugagcacgcgcaugucuguugugugugaugauguguccuugugagugucucucuuugaugcguguguauuugugugugugugucagcauauuugggaaacugcauguguuagugugugcuguggcuauagguguguccuugugugucagccugugucugugucccaggagauucuguguguguccauguuccugggugacggcauaacacagagagagugaacacaggagagagaggcuguguggagagagauggagagugagagcccaugaggaugccucguagaggaauuugccaaugguucuuaauuaacccccguggaacccggcaaaugccugugcuaaucagccccagggaacuuugcugguuuggggggugugcuuuucugagcacaacaguggcacucgaugcuaauuaauuuaauguauuaauggcauccgcuuccuguuuuaauuggcauuuaucuccauggaagaaagcugggguuggguuggggcuuuuuguuuguuugguuuuuuuuuuuuuuuaauguuucuuagauuuauuuguaacuaagccugacaucagccugacuucagguuccucaaacagcaaccucuccaucuucauccaggacagaggguccauuuccuaaaauguggagaagccaugggucuuggggcuaucagcaaauuaggcggaggaaagagccgcccauaacgugguccguggcuccaaggugucaagucuaauccugagggucccuuauugccuagaauggggacaucccccuggaguaggagccagaccugagaaagaaacucaaacuuuuaccuaugcuguuuccucuggugcgagcacccaauccccaaccucagcugacuccuuccuuuugucauggcuauucuuuuuuaauaaaucuuuuaaucaaaguguaacuuaauacauaaggaaaaguguacaagucauaaguauacaacacuuugaauuuuucaacacaagcacaccccauaccaucauccagaucaacaaauuugcauucugcuugggauucagggguggggaggccagaccuguggacccccaucccucaccucucagccccucaaagaccccuuugccugcaggauaaggugaacuucacucugugcucgggcccucggcuggaggccgcgcuggccuccaaggacagggagauccugcggcugcugaaggacgugcagcaccuccagagcucacugcaggagcuggaggaggcauccgccaaccagaucgccgaccuggagcggcagcucacggccaaguccgaggccauagaaguggguccuggggaggaggcaggcgggcaggcggccccaugcagaagcacacagaccagccucaccaucuuucuuugcucuucuagaagcuggaagagaagcuccaggcccagucugacuaugaggaaauuaaaacggagcugagguaccaugugggguggggcuccacagacccucagugcucuucccuggccaggagcucuuggcaaaguucaucaucuuccucccuccuacuaaaccccauuuguucuucucuccacuaacacuguggauaucaaaccuuaaccauccucaggccaggugcaguggcucaucccuguaaucccaacacuuugggaggcccaggcaggaggaucgcuugaggucaggaguuugagaccagccugggcaacaauggggagaccccaucucugugagaaaaaaacaauuuuaauuagccaggagugguggugaugcgugcuguagucccagccacucaggaggcugaugugggaggauugcuugagccugagaggucaaggcugcagugagcugugguggcaccacugcacuccagccuggacaacacagugagacccugucucaaaaacaaaacgaaauucaaccaucuucaguccuuuuccauuaagagcugccuguacgggcagaucaccugaggucaggaguucaaaaccagccuggccgaaagggcaaaacccugucucuacuaaaaauacagaaauuagccaggugugguggcgcucaccuguagucccagcuacuugggaggcugaggcaggagaaucgcuugaaccugggaggcagagaucgugccacugcacuccagccugggugacagagugagacuccaucucaaagaaaaaaagaagcugccuguagaccauacaagggaacuuauuauaggcaugguaacuggaaggugauucauuaaccagcuaaacucaagcuggccagaaugggucaguucaggcagcaccccuccagguaacaucgccaccuguuaaugagccugcuacuucaggccugggguugcaaugacucuggaauuaaugggguucuggggaauggagcagucauugucagggagguaagccgggucagugccucuugaaagaccucuccuccagcccgggggcuggcugaccucagacccucuccacuugcucuggcagcauccugaaagccaugaagcuggccuccagcaccugcagccucccccagguaagugucccugccaccaucccugcagggcaggcugccccagugagccuuccgcccaccaggugcccucucaaccugccucuugucuccuagggcauggccaagccugaagacucacugcuuauugcaaaggaggccuucuuccccacgcagaaauuccuucuggagaagcccagccuccuggccagcccugguaggggaggaggauacucuggggcugagggcuggggcgggggcugccugugggucucuggccuucucaugcccaaggaccacugccuuccaugcaggcaggagaacgacagaacaacaggugugcauugauuuggcaccugcuguaugccuguccugcagggcauccacaaacacccacgucaucguuggggucacacagcugguuugggcccuuccaaggcccccuaaagagcuccacuccccacugagccuucuugagcugcagcggcuuucaugaaguggucacagggggacaagcagggcauugucauuacaccccccacagccgaccacuguggggagcaguaggcugcggacaugaucacccugucagccacccgcugacuuuuuuuuugagaccgagucucucucugucgcccaggcuggagugcaguggugugaucucggcucacugcagccuccgccuccuggguucaagcaauucaccugccucggccuccugaguagcugggauuacaggcaugcaccaccacacccagcuaaguuuuauauuuuuagcagagaugggguuucaucacauuggccaggcuggucucaaacuccugaccucaggugauccgccugccucagccucccaaagugcugggauuacaggcauaagccaccgcacccagccacccacugaacuuuuagccuuguggccccaggcaggacacugugcugccucuguuuccucauccauaaaaugggugugaccuuggggcccacuucaugggugccauguaggucuagugagucagcuccagggugggugcccagcaagggcccaucugcaggugguggcaaguucgacuucccaccccaggccaaggugcugggcccauagcaaguucucagcugaugcucuuggugauggggguggggcgcuccccagaacuggcauuuggauggggccuggaagagugggaguuggagaauggaggggguagggcagaaagagccaaggucggcgcuuccagcugcuggacgccuauagcacugcuccccacccccaccuccccaccaaccccuucccuccuccuccuccuuccuuccucuauuucugacuuucugucucuauauaugucucugucucucucugucucuucccccccgacccucucccugccucucucugucaugugguuuuucacucugucucuuugucucuuuaucucucucucucucucucauguggucucucugucuugcucucccucucucucucucugucccucucaugugauuucucucucugucucucucauugucucuuucuuucucucacauguggucucugucucgcucucccucucucucucugucucucugaugugguuucucucucugucucucuuucucguugucucucucugucucucucccccucugguucuuuuucucccugucucucucuccccucaucaucgucuuccccgucugucugucugucugucugucuggguguucuagaggaagacccaucagaggacgauuccaucaaggauucacugggcacggagcaguccuaccccuccccucagcagcucccaccuccaccagggccagaagacccccugucucccagccccgggcagccccugcugggccccagcuuggggccugacggcacucggacuuucucgcugucccccuuccccagccuggcaucaggggagagacugaugaugcccccagccgccuucaagggagaggcgggcggccugcugguguuccccccagccuucuauggcgccaagccccccacagccccugccaccccggccccuggcccugagccacugggcgguccugagcccgcggaugguggugggggcggagcggcggggcccggggcagaggaggagcagcuggacacggcagagaucgccuuccaggugaaggagcagcugcugaaacacaacaucgggcagcggguguuugggcauuacgugcuggggcugucgcagggcucggucagcgagauccuagcccggcccaagcccuggcgcaagcucacggugaagggcaaggagcccuucaucaagaugaagcaguuccugucggaugagcagaauguacuggcgcucaggaccauccaagugcggcagcgaggugagugcccaagagggcccguccccgcuggccaccacgccagguccagggcaucagggcugggggcugaggacacgcgcucuggguucaaagcccagcucuaccaccaccuggcugugugacccagggccaguggcuuugccugucugugccucaguuuccccucuguaaaagcaggaaauacauccucgcucucuccuuccuggcccuggccagagacagucugcccuuccuggggcacucaggguaaggguggcgggaaaaggcuccaggcgcugcccuggcagguauucauccagcacuuccaagccucaguuuauacauuuguaagaccgccaaccuuaccagacuugauuuuucagguaaucaguaugaagggucccagcuguggccucacaaaugccugaguuugagucccagcucugcuguucacccacugggugaccucagacaacuccuuucaccugugccccgguuucugcaucugucagccuccaggaggcaccaugaggauuaaacgggcaucaagcacugaccacagcaccuggcaugcagugcugcuugagaacuguuagggguggugguugccauagucauugucgucaucauuucuuuuuuuuuuugagauggaaucucacucugucacccaggcuggaguguaguggcacaagcucagcucacugcaaccucugccuccuggguuaaagcaauucugcugucucagccucccuaguagcugggauuacagucacaacgccaccaugccuggcuaauuuuuacauuuuuaguagagacagggucucaccauagugaucaggcuggucucaaacuccugaucucagguaauccacccgccuuggacucccaaagugcugggauuacagacauaagccacuguacccuauuucuuuauuauuauuauuuuuuuuuuuuugagacggagucuuguucuguuacucaggcuggagugcaguggcacaaucuuggcucacuacaaccaccgccuccuggguucaagcgauucuccugccucagccuccugaguagcugggauuacaggugcaagccaccaugcuuggcuaauuuuguauuuuuaguagagacaggauuucaccauguuggccaggauagccucaaacuccugaccuaaagugauccucccaccucggacucccagagugcugggauuacaggcaugagccacugugccuggccucguuauuaugauucuuauuucacaccagaaucacucacaggcccacaguuuguuacauagacuaagcaguggcccugccaucucacugauggucugacccucacucuucugggaggaggagacagccccccuaccccaccaggcuccggagacugagcccaacaugcagauccugccacagaugccuucuugccuccccaggcagcaucaccccgagaauccgcacgccugagacaggcucagacgacgccaucaagagcauucuagagcaggccaagaaggagaucgagucgcagaagggcggugagugugaccccugcaggcaaagccugaggcccccggggccagcugcgaacaggagaugaggcuucgucuaccuuuguccaccccagagggaauccaagguggaucagaaccaccagaggccagagggaccugucuagagcgcauggguagcuguggcacugcucagaacccugccaugguuccacacagcucucaacauaaaaucucaacccuuggccaggcgcaguggcucaugccuguaaucccagcacuuugggaagccaaggcaggcugaucaccugagaucaggaguucgagaccagccuggccaacaugguaaaaccccaucucuacuaaaaauacaaaauuaccugggcauggugauaugugccuguaaucccagcuacuuagaaggcugaggcaggagaauugcuugaacccgggaggcggagguugcagugagccgagaucacaccacugcacuccagccuaggugacaaagcaagacucugucagaaaaaaaaaaagaaaaauaucccaagacucgacaaggccuacaggcccuacagucuucaggccccuccaugccugucacaugaacuguucauagucaugcccagcugccgugcacuccacccugcgccucugaugcuguccuuaccccagacaccuuucaccuggccaacuccuacucauaccuaugacucaacucagaagucaccuccugcaagaagauggguuggacacugcacccgcuucccuccacccccaccacagugaccuguuugcuugguguaguggagcuggacuggccacaaauucuggcucugcuguuuauuggcuaugugaccuugggcaaguuacuuagccucuuugugccuucaucgucuuuguuugagacagauucucacucugucacccaggcuggagugcaguggcgcagucucagcucacugcaaccuccaccuccuugguucaagcaauucuccugccucagccuccugaguagcugggauuacacgcacgcgccaccacaccuggcuaauuuuuuuuuuuuuuguauuuuuaguagagaugggguuucaccauguuggucaggcugcucuugaacuccugaccucgugauccaccugccucggccucccaaagugcugggauuacaggcgugagccaccgugccccgcccaucuucucaucuuuaaaauggggacugugggaggccgaggcgggcggaucaccugaggucaggaguuagagacaagccugcccaacauggcgaaacccugucucuacuaaacauacaaaaaaauuagcugggcgugguggcgcacgccuguaaucccagcuacucaggaggcugaggcaggagaaucucuugaccacaggaggcagagcuuacagugagccgagaucacaccacugcacuccagccugggugacaaaagcaaaacuccaucucaaaaagaaaaaaaaaaauggggacuguauuaguuuuccuuucuuaggguugugugaggaucaaaugaggucaguguaauccugaaagaucagccaucauuacagcaaauauuaucauuauuaccucccuguugcaguucugcgcugucacaaacgacucugcugguguggcugucccuccgucugcugugggggcuucuugcagccagggaccgaguuccauccucacacccagcacagcguagacugacugagacccuggacuccgguuucaaagcccucuuccauuuuugcagugucugcugcccccugguggcugcuccgagcagguguccugaaucccuccaguugccgccaggagccgagauguuucccaaucaauggcccucccuccugccugguccccgggaggggugaggggauaagggauuacccggcuacccugccccaccuguaaaauccccugagccuaauuucccucuuggucaguuccaguagcaagagagaugcaagacagagaaggauguaauuaugcaguaaacauuuauuaagcaccuacuguggucuagacacagauuucagauaugggugagacaugauauggagaugaaaagaaccaugagaaauaacuagccagggcuggguguggcagcuaacuccugaccucgugauccaccugccucggcucccaaagugcugggauuacaggcgugagccaccgugcccagaccaucuucucaucugggccucugggaggccgaggccaaggcgggcagaucaccugaggucaggaguuugagacuagccuggacaacauggugaaaccccgucucugcuaaaaauacaaaaauuggcugggcauggugguaggugccuguaaucccagcuauuuggaggcugaggcaggagaauugcuugaaccugggaggcaaagguugcaguaagcggagaucacaccacuacacuccagccugcgcaacaagagcaaaacucagucuaaaaaaaaaaaaaaaaaaaaaaaaaaaaaccccaucuccucuaaaaauacaaaaauuagcuaggugugguggcacacaccuguggucccagcuacucaagaggcugaggcaggaggaucaccugagcccaggaggcagagguuguagugagccgagaucucaucacuacacuccagccugggugagagugagaugcugucucaaaaaaaaauaauagaaaaagaaauaacuagccaaagucucccacuaaaccgacaggacaacugaggcuagggagggaagacaugaguucaguuacacagagacagagggaaaccccaggucucucaccucuuuauacagcacuuucuccugggggucggaagcaggcaccagggcaaugucaaagacagcaucgcagcagaggaaaacguuugcucuccaugggccagccaguagucuuauauucagggucuaggaguucagcaagaggaaaaauacaaagguuauugccccauaccccuggcaaaaaaaaugaaugcuaagcagugggcacaugagccgcugccagggaggaaaugaaugugacuaacugcucaaucacgaguucuacuucugggauuggaaggaaauguccagaauggggacagggguuuauauauaagcuguuccaucauuguucauaagagugacaaacuggaaacaaaacaaccuaaguguccagcagugggggaucugguaaguaaagcagauaauaucccuuuagcagcaugugcagcccuuaaagguagaacuuuuaaugauaagaaaaaauggggccgggcacaguggcucacgccuguauaaucccaacacuuuggaaggccaagacagauggaucacuugaggucaggaguuggagaccagccuggaccacauggcaaaaccccaucucuacuaaaaauacaaaaauuagccaggcaugguaguaggaaccuguaaucccagcuacucaggaggcugaggcaggagaaccacuugaaccuggaaagcagagguugcagugagccgagaucgcgccauugcacuccagccugggcaacagagcaagacucggucucaaaaaaaaagaaaaaauuuagcugggcauaguggcaaaugcauguagucccaacuacuugagaggcugaggcaggaagaucgcuuaaacccaggaguuugagacuagccugggcaacauaccaagacccugucuccaaaaaagaaaaaaagaaaaaaaacacucauguugauacuaaauggggacaaaccagacuacacuuccacauaucgaguaugaucaugcgaugcauguaguuuagaaaacagacuggaagggaauacaugagaauauuucacgugguugcuccuaagagacaguaagggugacuuucauuuugaucuugacuuuuugugcuuuuuuuugcaugcuccucugugcucccauaguaggcaaguaugaguuuuuuuuaaucgagguaaaauucucauaacauaaaauuaagcuuuuuuuuuuuuuuuugagacagaguugugcucuuguugcccagacuggagugcaguggcgcaaucucggcucaccacaaccuccgccuccuggguucaagugauuccgccucagccucccgaguagcugggauuacaggcaugugccaccacgcccgguuaauuuuuuuuuuuuuaauuuuuaguagagacgggguuucuccguguuggucaggcuggucucaaucuccugaccucagaugauccgccugccucaaccucccaaaaugcugggauuacacgcuugagccaccgcgcccggcacuucuuuuuuuuuuuuuuuuuugacagagucuuuagcucugucgcccaggcuggagugcaguggugugaucucggcucacugcaaccuccacuucccagguucaagcaauucuccugccucagccuccugaguagcugggauuacaggugcgugccaccacgcccagcuaauuuuuguauuuuuaguagagacgggguuucaccacguuggccagacugguuucaaauuccugaggucaagugaucggccugccucagucucccaaagugcugggauuacagacgugaaccaccacgcccggccaaaauuaaccauuuuaaaguguacaauucaguaguaguuaguauagucaguguuaugcaaccaucaucucucuccaguucacacauguucaucaccccagaaggaaacccuauacccauuaagcagugcuucuccuuuccacucuccccccagccccuggaaaccacugaucugcauccuguuucuguggauugaccuguucugcacauuuuguguaaauggaaucauaucauaugugcuaccuugcgucuggccucuuucacucagccccauguuuguaaggcuuauuccuguuguagccccuguuagugcuucauuccuuuuuaugacaaaauaauguuccauugcuauauuacuuuuuaauuggaaaagcaaugaaaauuauuuuuaaugggucuaagaggacccacuaggaugaaagcuacacagagauaaugaagaagggguuacauugaucuggcuuucugcagagcuagagagacucuggugucgggaacgcuucucugagggcagagggaagcaccuuuucauuuacugguuaauugucauuccucagggcacagauccaucuauuauccuugguucaugacacacucucagggcugccgccugcauggccuucucucaggugucuguguguauguguguacacacgugcauauauauauauguguauauauguguguguauauucaugcauucauucauucguucacucauguaaaugacagaaugaaccucugggaacauauugcccaacccaagauuuagaaaauucccaauaacugagaucuggcauuuuccuccccaucccaccccugccuuccucucccagagaugucuuucauccuaaaauuuuguccuguuguuccuuuguguuugccauuuguagaaaagguuuuucacuaaaucauauaguguuuauguuauuuguuauggaacuugauagaaaacaugugauaccgaccgggcgcgguggcucacaccuguaauccuagcacuuuaggaggccaaggugggcagaucauuugagcucaggaguuugagaccagccuggcuaacauggugaaacccgaucucuacuaaaaauacaaaaaaaaauuagccaggccugguggcgagugccuguaaucccagcuacucgggaggcugaggcaagagaauugccugaaccugggaggcagaaguugaggugagcugagaucacgccacugcacuccagccugggcaacagaacaagacucagucaaaaagaaaaaagaaaaaagaaaacgugauacugagugccaucuuauuggacuuguuuuuguuguuguuguuguuguuauuguuguuguuuuuugagauaggcucucacucuguugcccaggcuggagugcaguggugcaaacauggcucacugccaccucgaccucccaggaucaagugauccuccugccucagcugggaccguaggcauacaccaccaugccuggcuaauuuuuuuuucuuuuuucuuuuuuuuuuuuuuuucacuuuuuuguagagucagggucucauuuuguagccuaggcuggucuugagcuccugggcuccaguaauccuccugccucacccucccaaagugcugggauuauaagcauaagccacugcucccagccuucaccugcuuuuuucacucaauauuauguuauuaggauucacacaaagggcacgguagcucauaccuguaguccuagcuacucgggaggcugaggcaggagaaccacuugagcccaggaguuugagaccacagagagcuaugaucgcaccugagaucgagccacugcacuccagccugggaagcauagcaagaccacaucucuuuuuuuaaaaaaaaaaaaagauucauaucugauuuugcauaaggacuuccuuuuucacugcugcauaguguuccauugugugaucaucccacuauuuuuuuuucuagagauggaugucucauucugucacccaggucggagugcaaucuugguucacugcagccucgaauucccaggcucaagcaaugcucccaacucagacccugagguacaggugugagccaccacgccuggcuaauuuuuguauuuuuugcagagacugaguuuugccauguugcccaggcuggucucgaacuccuaaacucagacaauuugacugccucagccucccaaagugcugggaugacaggugugagucacugugccuggcccaucccacuguuuuugauccauucucugcaugggcauuuggauucauugcuauuagaacaagugaagggcugggcacaguggcucgagccuguaaucucuacacuuugggaggcugaggagggcagaucacuugagcccaggaguuugagaccacccugggcaauauggcaaaaccccgucucuacaaaaaauacaaaaauuagcugagcaugguggcacaugcuuguagucccagcacuuugggaggcccaggcaggagaaucacuugaagccaggaguuugaaaccagccugggcaacauggcaagaccccaucucuaugaaagaaaggaaggaagaaagggaagggaaaugaggaaggaaagaaauauuuuuaaagaauuuuuuuuuuaaaacagaacaagugaacaagccacuuuucugugccuucguguuuucuuugucuuugaacauuuacaugguuggaucauugccuauguaaaagucaggucaggccgggcacugugguucaugccugucaucucagcacuuugggaggcugagguguagaucacuugagcucaggaguucaagaccagccuggccaacauggcaaaacccugucucuacuaaagcuaaauagcugggcaugguggugcacaccuguaaucccagcuacucaggaggcugagguaggagaauugcuggaaguggggaggcagagguugcagugagcugagaucgugccauugcacuccauccugagcaccagagugagacuccaucucaaaacaaaacaaaacaaaagucaggucuguguuugcauugcauuauccgcaugagcauguucucugcauaugccaaaaccucacugucaaccgaauuuuggguggcugccuaauauucugccacagggagggaucauaauuuaguuagccaauccccaguugcuggacacagagguugccuggacaccgugcuggcaucaacagggaugcugugaacaucguccccugcaugccgagcccugacccugggccucgggccguccugucccccuccccgcaggcgagcccaagaccucgguggccccgcugagcaucgccaacggcacgacccccgccagcaccucggaggacgccaucaagagcauccuggagcaggcacgccgugagaugcaggcgcaacagcaggcgcugcuggagauggagguggcgcccaggggccgcucggugccccccucgcccccggagcggccaucacuggccaccgcgagccagaacggggccccggccuuggugaagcaggaggagggcagcgggggccccgcgcaggcgccgcucccgguccugucccccgccgccuucgugcagagcaucauccgcaaggucaaguccgagaucggcgacgccggcuacuucgaccaccacugggccuccgaccgcggccugcucagccgccccuacgccuccgugucgcccucgcuguccuccuccuccuccucuggcuacucuggccagcccaacggccgcgccuggccccgcggggacgaggccccugugccccccgaggacgaggcggcggcaggggcggaggacgaaccccccaggacgggcgagcucaaggcugagggcgcgacggccgaggcgggcgcgcggcugcccuacuacccggccuacgugccgcgcacccugaagcccaccgugccgccgcugacccccgagcaguacgagcuguacauguaccgugagguagacacgcuggagcucacccgccaggucaaggagaagcuggccaagaacggcaucugccagaggaucuucggggagaaggugagugcagggcgggcccccggugucugggcucugggagaagaugucggagaaguaggaugcccacccaagcaggcuggcgggaccccaggggcccaggcccuucauuccugaguccugcugucccugggucccgcaggaaggagggccacuguucugcuccgugguuguuaaaaccaggaaaugcuuccauccuggccagcaaacagccacuuaacuccccuccuccaggccccuccagaucgccugagguccagccacuaaaggguuaaguggcaggacuugguggcucacgccuguaaucccagcacuuugggagacggaggugggaagaucucuugagcccagaaguuugagaccagccuggccaacguggugaaaccccgucucuacuaaaaaauacaaaaauuaagcugggcacgguggcucacaccuguaaucccagcacuuugggaggcugaggcgggcagaucaugagaucaagagaucaagaccauccuggccaacauggugaaaccccaucucuacuaaaaauauaaaaauuagcugggcuugguguccugugccgguauagucauggcuacuuaggagacugaggcaggagcaucacuugaaccugggaggcagggguugcagcgagccaagaucucgcuacugugcuccagccugggugacagaacgauacuccaucucaaaagaaaaaaaaaaaaguguuugggaucagccugggcaauguagcaagacccccaucucuacaaaauaaaaaaaauuagccaagugugguggugcacagcuacucaggaggcugaggugggagaauugcuugaacccagguggucgaggcuacagugagccaugaucacaccagugcacuccagccugggcaacagagcaagaccucauccccccaaaaauaaauaaaaauuuaaaaagaaaggguuaaauaaagcucacccuagccaggggaccucaguguuuccugauugguuggugccccugcaaugccaguuuuaagugucaccucuaccuuuagcaagggaauaggcaaagggccaggcaagcucggaggagggagaaaugacuuaagugggaggucagggaaggcuuccuggaggaggggggcacugaaggauuuuuacauguagggacauuagggaggguacuggaggggaagggcacagcaacagcacauggcaggcaccuaugaggaacaaaugaaggccgccuggacuccaacagaggggaggggaggggaugggaggcugggcaugguggcucacaccuauaaucccaacacugugggaggcugaguuggguggaucacuugaggucaggaguucgaaaccagccuggccaauguggcaaaaccccaucucuacuaaaaauacaaaaauuagccagacgugcaccagccugguacaagucccaacuacuaaggaggcugaggcaggagaaucauuugaaccugggaggcggaguuugcagugagcugagauggugccacugcacuccauccugggcgacagacaaagcgagacucugccucaaaaaaaaaaaaaaaaaaaaaaagguuggggaggagagugagggccaggcccaugucccaggggccugcugaccuaccccccuggcccgccccucgcaggugcugggccugucacagggcagcgugagcgacaugcugucccggccgaagccauggagcaagcugacgcagaaggggcgggagcccuucauccgcaugcagcuguggcucucugaccagcucggccaggcagugggccagcagccuggugccucccagggugagugcgggcaggagcaucucagggggugcuggcaaacuucccaccugcgcaguggcauguccgccuggcuuuacugcccgagucuaccuaucucucccucccugcugcccuggcuuucaucccagucacugucauggcugcacuggaacauggcgggggguccugggguuucucugcuccccuuucuuccuuccuccaaccagagggaggcuucuagaagcugcacgccugaugcacuggguccuggcuuuaagccuccaaguggcuccauggugcucagagcagguggagaauguguuuugcauguggagucccacaucuggaauugcucaucgaucucagcucuguuuccugaagaccuagcgugcagccucagacuccuucuuagcacagggccuugggcagugccacccagcugcccaugauagcacgagcaggcuggagugucagcuuugcccgggugaggaaacggaggcucagagggaugcccaaagucccagaguccggaagugcuagggggagccccagcucccugccacuguggggaccagcggauaagucugccagggcccuggugaggcaccuacccgggcccugcacuggaaugagggcacgugacugcaaggagaggacaucagaccugcccacugagaagggcagagaccaggggaggccagacccugaguccaaggaucugagcucagucuugucaauaggacaaaaccauaucucagguucacagaaacgagccaggucagcaggcccauaucaacaggaauauggacuggaaacauaaugucaagugacaaaagccuccaucccagugacagugcuuacuauagaagcuaacaccuacaggaugagacugcacacugguguagcuguauggcugcagacuuaugcauuaauauuuaaaaagaggcugaggacaggcaugggggcucacgccuguaaucccagcacuuugggaggcugaggcuggaggaucucuugaagccaggaguucaagaucagccugggcaauagagggagaccgugucucuacaaaauauaaaaauaaucaguuggaaugguacguaccuguggucccagcuacucgggaggcugaggcaggaggaucacuugagcugugaucaucccacugcacuccggcuugggugacagaguaagaccuugucucagaaaaaaggaggccgagcacaguggcucacgccuguaaucccaauacuuugggaggugaaggcaggaggaucucuugaagccuggaguuugaaaucagccuuggcaacauggcgaaaccucaucucuacaaauaaaaaauuagccggguaugguagcaugugccuguaagggugaggcaggaggaucgcuuaagcccagaaguucgaggcugcagugagcuaugaucaugccacugcagugcaucucacacugcacugggcaagugagaccaucucuaaaagaauuaauaaaaugaaauguauaggccgggugugauggcucacaccuguaaucccagcacuuugggaggccaaggcgggcggaucacaaagucaggaguucgagaccagucuggccaacauggugaaaccccgucucuacuaaaaauacaaaaaauuagcuggaaaugguggcgugcacauguaaucuuagcugcuuaggagacugaagcgggagaaucacaugaccugggaggcagagguugcaguugaacugagauccucaccauugcgcuccagccugggcaacagugugagacucugucucaaaaaaaaaaaaaaaagaaagaaagaaaugcauaaggaggcagccccccagcuggggagggagguugcacugggcagggagggggccaggaagaggcagggcguggugacuuugcucugcuccuuuccuauucuuuuuuuuguuuuguuuuguuuuuguuuuuguuuugagacagagucuugcucuguugcccaggcuggagugcaauggcaugaucucggcucacugcaaccucugccucccggguucaagcgauucuccugccucagccucccgaguagcugggguuacaggcgugcgccaccaugcccagcuaauuuuguauuguuaguagagacgggguuucuccauguuggucaggcuggucuugaacuccugaccucaggugauccacccaccuuggccucccaaggugcugggauuacaggcgugagccacagcaccuggcccuuuccuguuucuuuaaaacaagaaggaagauuggaagugacgggggugaagugucagcaucgauuacggugauggguggaagggaggggaggacuuacauauuguugucuguauauuucuauauguuuuuaauaguuuauaaauacaaugauuuaaaaacuccucuccauaaggcuguaacgaggauuaaaagcagccaugcuggccggguggggugccucaugccuguaaucccagcacuuugggaggcugaggcaggcggaucacaaggucaggagauugagaccauccuggcuaacucggugaaacccgucucuacuaaaauuacaaaaaaaaaaaaaaaauuauccgggcgugguggcaggcgccuguagucccagcuacucaggaggcugaggcaggagaauggugugaauccgggaggcggagcuugcaaugagccgagauccugucacugcacuccagccugggcgacagagcgagacuccgucucaaaagaaaaaaaaaaaagcagccaugcuaaugcuaaugaccgcugccacuuaccacacauagcaccaaguggucaaagugcuuuguccuguaaucuucaugucagucuccaccaaagggacuguuuaucauuuccauuucacagaugaggaaauccaggggcaugguagugcagugacuugcccaaggccaucauccagugaguggcagaccuaggaugagcacccugggcugugggccaucaggcuuccugcccccuagggucccgaaaugugucuaccccagagccuaccugggaaaagacuuccauccuuuuuuguuuauaguguugugguggggagggguggguuuuguuuauaguguuguggugggggagggguggguuuuguuuauaguguuguggugggggagggguggguuuguuuauaguguuguguugggggagggguggguuuuguuuauaguguuguggugggggagggguggguuuuguuuauaguguggugggggagggguggguuuuguuuauaguguuguguugggggagggguggguuuuguuuauaguguuguguugggggagggguggguuuuguuuauaguguguugggggagggguggguuuuguuuauaguguguugggggagggguggguuuuguuuauaguguuguggugggggagggguggguuuuguuuauaguguuggggugggggagggguggguuuuguuuauaguguuguggugggggagggguggguuuuguuuauaguguuggggugggggagggguggguuuuguuuauaguguuggggugggggagggguggguuuguuuauaguguugugauggggagggguugguuuuguuuauaguguuguggugggggagggguggguuuguuuauaguguuguggugggggagggguggguuuuguuuauaguguuguggugggggagggguggguuuuguuuauaguguuguguugggggagggguugguuuuguuuauaguguuguggugggggagggguggguuuuguuuauaguguuguggugggggagggguggguuuuguuuauaguguugugggggagggguggguuuuguuuauaguguuguguugggggagggguggguuuuguuuauagucuuguggugggguagggguugguuuuguuuuauaguguuguggugauggaggggguugguuuuugguuuuuugagacauagucucacucugucacccaggcuggaguggugagccacugcgccuggucugugguguuagguuuuaacuaacuuuuuuacuguaguaaaauucacauaacagcugggcaccguggcucacaccuguaaucccagcacuuugggaggccgaggcgggccgaucacuugagcccaggaauuugagaccagccuggccaacauggagaaaucccgucucuccuaaaaguacaaaaauuagccgggugugguagcacgcaucuguaaucccagcuacucgggaggcuaaggcgagaggaucgcuugaacccaggaagcagagguugcagugagccggauggcaccacugcacugcagccugggugacagagugagacucugucucaaacaaagaaacaaacaaacaaaaaucacauaacguaaaauguaccuuuuaaaccauuuuugaaguauacaauucaguggaucuaauacaugcacaaugcgugugaccaucaccucugucuaauuccagaauauucccaccgccccaaaaaggaaccccauacccauccagcagucauugcccauccuccuuccccccagcuccuggaauuccgcuuucuuucugucuggauuugccucuucugaauguuucauauagauggaauccuguacuacuuggccuucuguggcuggcuucuuucaguuaacguguuuucaaggcucauacaggcuguaguaugcaucagaauuuccuuccuuuuuuauggcuaaaugauauuccauuguauggauagaccccauuuugacuauuuugaauaaugcgccuaugaaaauuuguguacauauuuguguuugaacccccauuuucaguucuucgaacauauaucuaggaguacaguuggcuagaucauaugguaacucuuguguuuaacuuacugaggaaguucaaaggguuucuguuucuccagguccuuaccaacauggguuaucucccauuuguugacgcuagccauccugguggguguguaagugguauuucacuguaguuuuuauuugcauuuccccaaugucugauuguuuugguuguagauuuuauugucauggaaggauuugaccacagguaggauagagguaagcagagaagauggagaauggugcuccuuguggaaggaauggcacaggcagcggcuaggaggugggaccaugcacggccugggaagggaugugaguagagguggcgggguccccugcucucccagaauaggaagccaaggcuaggcacagugcgucacaccuguagucccaggacuuugggaggcuaaagcaggcggaucacuugaggucaggaguuugagaccagccugaccaacauggcaaaaccccuucuguacaaaauuacaaaaauacaaaaaucagcugggcaugguggcaggugccuguagucccagcuacucaggaggcugagguaugaggaugcuugagccuaggaggucaaggcugcagugaacuggagugagugccuuccagucuggacaauagagcgagacccugucucaaaaacaauaauaauaaugaugagggaaucaggccuggagguggcuacuguagcugcuggcccuagggagagaguggugauggcagagccacccucacagccucugcuuguucauaacccacugggccuggaagcaaaaggguguauccauugcccacaaagucccacagagucuggcuguggggcugggugucaggaccuguccaagccccgcuuguguaugcccuggccacuggggcgggcagggaccggcacuggaacccugaccauaccuguuacugaaguugagccagaugccacgggaggguuauaaagcacgcccuuauccccacguccacugccaggcgcagccccggguauaaucggcgcuaccuaccguggcagcaucaguauuccagacccuuccauccgagguuucucagaauucucaagcagucaaggaagcccuguccuguccccauacacagucccugucuucccucugucucucuccugaucucugucucucuccuccaauuucuuuugugugugugugugugugugugugugugugugugugugugacagagucucacucugucgcccaggcuggagugcaauggugugaucucggcucacuguaaccuccggcuccuggguucaagcaauucuccugccucagucuccgaaguagcugggauuacaggcacccaacuaauuuuuuguauuuuuagaagagacagguuuugccauguuggccaggcuggucuugaacuccugaccucaggugauccacccaccuuggccucccaaagugcugggauuacaggcaugagcuacugcacccagucaccuccauugucuucuuucuguuuuucucacucugcauuuuuuugauucaccuaucucucucucucucucucucucucucucucucucccccucucucccucucucccucucccucuccuccccccaccccacucucucucucccccugccucucucaccaucucucucccccucuguuugcucugucucuuccucccugacccucccugucccuccagugcucucuuuucaucucucuugcaccauccuuaucucuccaggagagagagauuucccaggaucuggaacuuucuguaguaaaauaaggaaagucgcgggcagacugggauggguuggucacucugcucucucuccuguccccagcugcccacagcccugucuggcaccccacccacaagcccagcaaggcaagaagacccugccucucccugucgucgccucccucuccaaauaacccaguuguucacaugugacucccccagcccuguaauuagcacagucuuccugauagagauaauuucugaaucuuuccaucacuucgucagaagcgauucucagucagaggagucagaaaggcgggguucucccugggggagugggauugggggguggcuguguucuuuccugccaaucaucuccaugucauccuguucgcuucgcuucuuggcccucuagguugggacaugggugcagauaguuuuccaagagggagaugccuucaaagacccucaguuuuuuguguuuuuuguuuguuuguuuguuuucgagguggagucuuguucuuucaccuaggcuggagugcaguggcgcaaucccggcucacugcgaccucugccucccagguucaaccaauucuccugccucagccuccagaguagcuggggcuacaggugugugcaaacacaccuggcuaauuuuuuguauuuuuaguagagaugggguuucaccauguuggccaggcuggucucgaaccccugaccucaggugauccacccgcguuggccuuccaaagugcagggauuacaggcgugagccaccaugcccggcccaaagaccgucaguuuuccagcuggccccagccccucuccugcugccgacagugggcagacaccuaggacagacucucacuuucccagacuggcccucccacaccaacauggcaucaguguugguaacagugagccuggaacaugcccacgucagccuuggcaucacauggaugcuaccugaauggccaggaucagcucacuuggggcugggggcacaguagacuucuugagaccucacggucacaaagggccaugaugcugcuacuucgaacucgggggcuucaccuugcccucuucaggaguacucagggauccuggcugaaauuacuccauaggcaucugcccagagccccugccccacccccaggcucuggggacucaccugugacuaacuuguaguccuugccuucaaggggcucacaguugguagaugagaggacaguguugggcauaacccaaccccagcucaaguccugacuuugccauuuauugcugugugaucuuggacacguugucuaaccucucugaaccucgguuuccucacccauaaaaugggaugacauagcacuuaccucuuagaggugucaugagggucacuugagaucaugagcauuggccagccacagugacccaugccuguaaucccaacacuuugggaggccgaggcaggaggaugacuugagcccaggaguuugauaccagccugggccacauagugaaacccuaucucuauuuaaaaauacauauacauauauauauauauauauauauauauauauauauauauauauauauauauauauauauauauauaaagagagagggaucauaggcauaaagcacauaauacuacacugggcauguaguaaguacucaauaaagggaauuuauuaacaucaucaucauugucaucaguaaggaagagaucuggcccaagcaagaaauuauagcaaacugugacaauauauauucaaggugcuauuagaccccaaaagucuaauagaccucagggaagggacauuuaggacuggaucuugaggaaugcauaggaguucaagauuagaaggaaaguccucaggauggcaagaccagccugagcaaagacauaggggcuuagagaggagccuagauguuugugaaggggagugagggaaaugcuguagcuccaguuggcagggacaagggaguucagagccuuaaucaccaagacaaggugauagacauuucuugcacaaggggcaauggggagccauugaugauucuggagcauaggaguggucugauccgagugaccaacucacccacgacagagaaggaaggaacccauccugggcucaggaugucucuucugaaaguaaagccguugcucccuuuucuuccagcugucauacauuuuaaugguuauuuuaacaaguuuccagcagguggcaguugaaugccucaaggaagaggcaucuuuuucuaaugugcugggauuagguguggccagugcugggauuccuagaccccacaccaugcuugccaacccauuaggggugccucccuggggaugcucccaccuuuccugguuucucaggaggcucagcucacacugggacucccaugggugccucuaaugccccaggagguggaggugguagaggagguggagguggacccuugccccacguuaucucauggaggucucucgauggccccaaguaguauguauaaugcuacgugucuuauggccccauuuaacagauggaaggacggaggcuuggcaaagucauccacccgagaucacaagccccagauaucuuucaaaucauuuuuccaauauauagucacacaaaaugucuuuugaaaaaugaaaaaugggcccggcaugguaguucaagccuguaaucccaguacuuugggggcgccgaggaggguggaucacuugaggucaggaauucaagaccagccuggccaauauggcgaaaccccaucucuacuaacaauacaaaaguuagccgggugugguggcaaacgcuuguaaucccagcuaugggggaggcugaggcaggagaaucacuugaacccaggaggcuagguugcagugcgccaagaucaugccacugcacuccagccugggcgacagagugagugagacuccaucuccaaaaaaaaagaaaaaugaaaaauguaguuuaaaaaucugucuaccuuuuuuuuuuuuuuuuuuuuuggaaacagagucuugcucuauugcccaggcuggagugcaguggugugaucucggcucucugcgagcuccgccucccagguucaagcgauucugcugccucagccucccgaguagcugggauuacaggcaugugccaccaugcccagcuaauuuuuguauuuuuuaguagagacgggguuucaccauuuggccaggcuggucuccaacuccugaccuuaggugauccucccaccuuggccucccaaauugcugggauuaugggcaugagccacugcacccggccccaaucuagcuuuuuaauguggcauugcaccauggacaucuuuucauuacauuuucuuucauugccucggaagagcccacugcagggaucccccauauuuuauucagccaaucuccugugguugaacuuguagaucauugcuggaucauugcugacuucuuuaguuguugccguuuauuuaacuuuucguuuugagguaacuucuaauuuacagaaaaauugaaacaguagaacagcaaacucccugcacuguacccaguuugaacaguuauuaauuuugccauaaucgugcucuuucucugccauuugaggaauucauugacaucuugucccuuuagcccuaaaugcuucaacaagugcuuuccaaaaacaagaaauuuuacagugguaaaauacuggcauguaucccaccaucuauauucagguuucuucaguugucccaauaauauccuuuaugagcuauauaaauuuuuagauacaauauauaaaucuuggccaggugcuguggcucacgccugcaauaccagcacuuugggaggcuaaggcagguagaucacuugaggucaggaguuugagaccagccuggccaacaugguggaaccccgucucuacuaagaauacaaaaaauuagccgggugugguggcaugcaccuauaaucccagugacuuaggaggcugaggcacaagaaucucuugaacccgugagguggagguugcagugagccaagaucaugccacugcacuucagccugggugaaguuuuuugagacagagugaaacucuugucucaaaaaaagaaaagugagccaggcaugaugaugcacaccugugguccgagcugcuugggaggcuaagguggaaggaucacuugagcccaggaggucgagguugcagugaguuaucaccaagccacugcacuccauccugggcaacacagcaagacccugucucaaaaugaauuaauuaaauaaaauauguaaauuucuuuucccugugcaggaugagauucaagaucacuuguguuuaguuuucauguuuugauuucgacaguucugccuuucuuuguuuuccaguguugcccuuucugaagaguagaggcuguuauuuccuggacagucugaguuugguugccugauguucccuugaaaucagauucgggcuguguacuuggggcugggaauaucacagaagugaugccauguccuucucaggccauccucucaggaggcccauguugcugacuugcccugugauuggugauaguaacuuggaucauugguuaagaugguauccaccagugccuguaaucccagcuagucaggaggcugacgcaggagaaucgcuugaacccgggaaagagguugcagugagccgagaucgcaccacugcacuccagccugggugacagagagaguccaaccaggucucuguacuguaaaguggcuacuuuucccuuuguaauuacuaagcaucggccaggugugguggcucaugucuguaaucccagcacuuugggaggcugaggcggguggaucaugaggucaggagauugagaccauccuggcuaacauggugaaaccccgucucuacuaaagauacaaaaaauuagcagggcguaguggcgcaugccuguagucccagcuacuugggaggcugaggcaggagaaucgcuugaacccgggaggcggagguugcagugagccgagaucacaccacugcacuccagccuaggcaacagagcgagacuccgucuuaaaaaaaaaaaaaaaauugcuaagcaucauguggggagauacuuggagacuuuguagaaaucccaguccaguccucaucaaacuuucauccacuaguuuuagcauccaggguggucccuaccugagcgauuauuacuacagugguugcaaaauggguguuuggcaacucuuggcuguaagaagcaagccucccgaaaguggaugugucugugccagauuauaguaaccaccuucucuuucucuguggcccacagccagucccacagaaccaagguccucaccauccccaccccccagccccacagagccugagaagagcucccaggagccguugagccugucccuggagagcagcaaggagaaccagcagccagagggccgcuccagcuccucguugagcgggaagauguacucaggcagccaggccccagggggcauccaggagaucguggccaugucccccgagcuggacacguacuccaucaccaagagggugaaggagguccucacagacaacaaucuagguacggagcgggugggaaucggagaggcugccucccaccuggguuggcuccuacuugccuugaaaaggugucuggagcugggacccaguggcucauaccuguaauuccagugcuuugggaggccagggagggaggaucgcuugaggccaggaguuugaggccaaccugggcagcauagcaagaucucauaucuuaaaaaagcuuuuuaaaauuagcugaaaacuccaugcauacaaacuucacacguguuggugcaugccuguaguccuagcaacucaggagccugaggcaggagaaucgcgugagcccaggaguucaaggcugcagugagcuaugaucaugccacugcaugccagccugggcaacagagcaagaccuugucuauaaaauaaauuaauggcugugcaugguggcucacaccuguaaucccagcauuuugggaggcccaggcagguggaucaucugaggucagcaguucgagaccagccuggccaacauggugaaaccucgucucuacuaaaaauacaaaaaaauuaaccaggcgugguggcacaugccuguagucccagcuacuugggaggcugaggcaggagaaucgcuugaaccugggaggcagagguugcagugagccgagaucacaccacugcacucuagccaaggcgacagagcgagaccucaucucaaaaaaaaaaucagucaaucaguaaaauaaaaaacaagcugggcccggugccucacgccuguaaccucagcacuuugggaggccaaggcaggcgaaucaccucaggucaggaguuccagaucagccuggccaacauggugaaaccccaucucuacuaaaaauacaaaaaguagccgggugugguggcaugcacuuggaaucccagcaacucaggaggcugaggagaaucguuugaauccaggagguggagguugcagugagccgagauuguaccacugcacuccagccugggcaacacagugagacuccaucuccaaaaaaauaaaaaauaaaaaagcuuccuaaaauuagcugcaaacuucaugcaaacaaacuucacacauuguggugaaugccuauaguccucaggaagcugaggcaggaggccugcacgagcccaggaauucaaggcugcagugagcuaugaucaugccauugcacuccagccuggacgacagaggaagaccuugucucuaaaaaaguuaaauuaaaaaaaaaaaaagacaaaagugcccacggugagaucccagggcacuggagucagccccagggcauccaggacccugugugaggcaucuggcucugaccugggucugggauaggacaaagugaaugcaggucugagaggaccuggaauucucagcccacggcuuuaaaaacuuccuuccaggaagacguggagaaccccagucacugcggaacuccagcucaguccucacccggugcugaagucuuugcccucuugggccacaguggaaaaaucucuucuagggcucuuucccuuuuugggacacaaauuccucugagucuuaaaugcgggugaugccccccuaccagagggauguaugcaaaccccaacauuuucacuacaauuccuguuauaaaaauaagacauauucauuguuuuaagguauaccgaaaaguacaggaaaaaaaaaguuacuaaaaaaguaaauaaaucccuccccauuggccucucagacacuucaguguuguguguguguguguguguguguguguguguguguuuaagauggagucuccugucacccaggccccaggcuggagugcagucguacgaucucagcucacugcaaccuccgccucccagguucaagugauucuccugccucagccacccuaguagcagggauuacaggccugagccaccacuccuggcuaauuuuuuuauuuuuaguagagacagaguuucaccaugcuggccagacuggucacgaacucuugaccucaagugauccucccgccucauccucccaaaaugcagggguuacaggugugagccaccgugcccagcccacacuucaguuuuuuaaugucucuuugacacuuucugaacacauauaagaacauauauacacuuaauuuccucuccuuuuuuuucuguguagacgaaaugauacaaauauugcguugcaacuugcuuuugaaaaaugaacacuaggcuggguguaguggcucacaccuguaaucccagcacuuugggaggccgaggcgggaggacuguuggagggcaugaguuccagaccagccugggcaacacggcgaaaccccgucucuacaaaaaauagaaaaauuaacugggcaugguagugugugccuauagucccagccacucgggaggauaaggcaggaggauggcuugagcccaggagacagagguugcaaggagccaagaucacaccacugcaguccagccugggugauagagccaaacuuuguccccaaaaaaaugaaaaauaaaaauacaaaaauuagccaggugugguggcuuaagccugugcucucagcuacuugggaggcugaggugggaggaucacuugaaccugggaggcagagguuauagugagcugagaucacaccacugcacuccagccuaggugauagagugagacccugucucaaaaaaaaaaaaaaaagaaaagaaaaaugaacacuauuuugugggcacccuuccacccacguuagaauaauucuauuacccgcauucuuuuucaccacuggagaguguuucaggccauggaugcgccacaguuuuuuacccaacugaugggcauuuuggcuuuuuccacuuuccugcugccucuaaaaauaagucugugugcaucugugugaacuugggcaagugcagcuaucccaggcaguggaacugcuugcuccgaagcugugcacauuuaaaacugggauggaaucugucaaauuauccuccaacacggugauacaaauuuguguguaugauguuggcagacaauuucagggaucuccuaggaguaaagaaccucuuaaauuaaaaaagcacuuuugggccaggcccaguggcucacgccuguaauugcagcacuuugggaggccaaggcagauggaucaccugaggucaggaguuugaaaccagccuggccaacaugggaaaccccaucucuacuaaaaauacaaaaauuagcugggugugguaguacgugccuguaaucccagcuacucgggaggcugaggcaggagaauugcuugaaccugggaggcagaggcugcagggagccaagaucaugccacuacgcucagccugggcaauagagugaaacucugucucaaaaaaagaaaaaaaaaaaaagcucuuuuguugguugcugccucguccugcccccaaaucucuuuuacagacagaccccccucggcuucacaucagguguggguccuccgccgucucuggcccucccuucggagucaguggagauagccucgaggcucuccccugugucucuggccuauuccaugucucuccugggaguaggcuucucugcccagccucggguaacagauugcuccccuccccuauccccagggcagcggcuguuuggggaaagcauccugggucugacacagggcuccgugucugaccugcugucccggcccaaacccuggcacaagcugagccugaaggggcgggagccuuuuguccgcaugcagcuguggcucaaugacccccauaacguggagaagcugagggauaugaagaagcuggagaagaaagguaagacuugggcagaggaugggccccagcacugggucucagauuuuccccagaaccauaucuagcuguaacccacauaaacccagggcucccaugguccagucucagccuacuaugggacugcaugaaauagcaaccuugaaaaacaauguaacaaugugauugaaagcagugaagauauuuacagccugucgcaguggcagggcauggguaguccuggcugcuugggaggcuaagacaggaggaucacuugggaggcuaaggcuugcagaucacuugggaggcuaaggcaggaggauugcuugaggaucacuugggaggcuaaggcaggaggaucguucaaggcugcaaugugcuaugaucaaagcugugaauagccacugcacuccagccugugcagugcaguaagaccccaucuccaauuuuuaaaaaaguugguaaauauuuacuaccucucccaugaaaagccaauacucugccaggugcaguggcucacgccuguaaucucagcacuuugggaggcugaggcgggcagaucaccugaggucgggaguucaagaccaauuuggccaauauggcaaaacccugucucuacuaaaaauaaaaaauuagcugggcaugguggugcacaccuguaaucgcagcuacuugggaggcugaggcaggagaaucacuugaaccuaggagguggagguugcggugagcugagaucacgccacugcacuccacccugggcgacagaacgacucugucucaaaaaaaaaaagaaagaaacaaaaggaaaccuaacaccccaucucuuguuguccuuucacaccucugaagcuacaccaaagucuguugccagccccaacugucuauuucccaaaacucuguguaccucccucccuccucugccucagcccccuguuuuguagaucagcccuuggcccauuacccagauucuacauaacaaaggacaggaccaggaaccgucucuuguagggcugggcaaggagauugcaaguucucacauugucugacauuauauccugauaagauaagcuggcauugucuacagccauaccacccggaaugcugaucucagaagcuaagccgagucaggccugguuaguauuuggauggaagauaagcuggcauugagcugggcacccagucucaugcuaugcaucaaggauuccucuauauuuccaaagguucaaaguccauuggaagauaagauaggagcaguugaaguugccauccaggucgugagggcaggucgugugaugacccagggacacgccagacuguggagagcaccuagggcugggccaucaucaucagacaaugcugugguugagaacuugaccuucuaccuccuugccgugugacaaccucaagcuaguuacugaaaauaagagagcuggcugcucucuauuucugaaaacaagagagcuggcucaaugugguggcucacaccuguaauccuagcacuuugggaggccaagguggauggaucacuugaggccagaaguucaagagcagccuggccaacauggugaaaccccaucuguauuaaaaauacaaaaauuagcugggcauggugaugcaugccuguaauccuagcuaccugggaggcugaggcaggagaaccgcuugaaccugggagguggagguugcagugagccaagaggaucgugccacugcacuccaaccugggcgacagagcgagacuccaucuaaaaaaaaaugcauuuucagagccacaaagcauugcugugaggauuaaguaagacccucauaccuucuuucauucugaagugggcuuuuuucuccccaacaucuucaugaucuggggucaagaugcaccaugcagucaguaagucauuuaaguuacugucccuaccuauugcccacugaaggcuguucagaaauucagggaugcuucugacaaucuagaggauauuguaggcuagauguggcggcucauaccuguaaucucagcacuuuggaaggccaaggugggaggauugcuugaggccaagaguuugagaccagccugggcaacagagugagauucuaauucuuauguaaaaaauaaaguuuccccuucaaagacuuuccuccccauuuaauuaggaaaauaguaacuucucuuagaagcaaaauuuauucaaagaccugugcuaacauucuuaaauaucugcuagccgugauaaagacaucaauguacuuuacguucuuagcucccacgauuuagccuaaauauuugcccuggcaugcuuauagugguccaagcaagcauuaggucauagccuguuccucuuccuuauuuaaggggguuuuuaccuuucucaacuuuuuccacaaguuacuuccuccuuccuuuguucuccucugccuuuaccucuuuuaaaaaguucuaaguugcuagccagucaggacaaacacagcaugcgaaguccuguuccagccaguggaaaccggacacagcaguaggguggaagcaucagguuauaaaugacccugucuccuuuguucgguguacucucguggcaaaacugcuggcgagcguacccuuucuacagaaaguauaaaaauggccucacugaguaaauuaaauuuauauucaagugcuauuucuuuacggcaccagggaacaagcauuucaaacacucuacaaaacgaugaaccaggcaugguggcgugcaccuguagucccaccuacucaggaggcugaggcaggaggauugcuugagcccaggaguucaagguugcaaugacuugugauugugccacugcauuccaaccugggugacagagagagaccccaucucuacaaaaaaaauuaaaaauuagccagggguggugguucacaccuguaaucccagcuacuugggaggcugaggcaggaggauugccugagccuaguugguugaagcuacagugagccaugacugcaccgcuguacuccaggcugggugacagcgugagaccuugucucuacaaaaacagagagaauacuguagagcacccuguuucaagugcuuccuaugcgugaggaaugcuccugagucuucgcucaugccagggcucccgggcgggcgagguuaggcuagcaucuuguggcgggggauuggggguugggagaugcagaaggagagugaggagggagaaaggcuggggggcgggccucuaagcuuagggcaugauggccuccgagugggccugacagaugcacucccaccauggaacuccugcuggccaggaacuuuugggauggggacaccaccucucagcccucccucucuuccuggccccagccuaccugaaacgucgcuauggccucaucagcaccggcucagacagugaguccccggccacccgcucagagugccccagccccugccugcagccccaggaccugagccuccugcagaucaagaagccccggguggugcuggcacccgaggagaaggaggcacugcggaaggccuaucagcuggaacccuaccccucgcagcagaccaucgagcuccucuccuuccagcucaaccucaagaccaacaccgucaucaacugguuccacaacuacaggugggacuaugggggcguacccacaggcggguggcagaauccaggugggaccccuuccccaucccagggccuggagggagccccacauggccucugggagauggaagaccccaucacauaggcacuuagauauagaacacaggcccaagugcagugguucaugccuguaaucccagcacuuugggaggccaaggugggaggaucacuugagcccaggaguuugagaccagcccuggcaacauagggagaccucgucucuacaaaaaaaacuacaaaaauuaguugugugcgguggcauacaccuguagucccagcuacuugggaggccgaagugagagggucacuuaagcccaggaggcggaggcugcagugagccaaaaucauaccacugcacuccagccggggcgacagagacuccaucucaaaaaaaaaaaaaauuuaaaacacaggcaaauguggaagaaaucccagcuccaucacuuucagcuguggagccuucuucacuucccugagccucagucuucuaaccuguaaaaugggguggacaguagcaggaucuacuucauagaguugcacagaggauuugauagacuaacauaguuacauaaaauaccuagcguguaggccaggcgcgguggcucacaccuguaaucccaacacuuugggaggccgaggugggcagaucaccugaggucaggaguucaagaucagccugggaaacauaaugaaaccccauuucuuugaaacauacaaaaauuagcuggacgugguggugcaugccuauagugucaacuacuugggaggcugaggcgggagacucauuugaacccaggaggcagagguugcagugagccgagauugugccacuguacuccagccugggcaacagagugagacuaucucaaaaaaaaaaaaaaaaaaaaaaaauccagcacauaguaugugguggguauugauaugauuauugucauuauuuuuauuauuauuucacccuguuugccuugcgucugccucaaagaagggacagggaaggguauuuggggguacaggccugaggaacccugacuauucauugagccucaggguggaucccugauuuggggcuccuggccccuccuaccccugaaaccgaaagaaaaacccccugguauccucuucaggcuccaccaccucagagagugggugauuccuacuucaauggcugcuucuuuccauagcucuucccacucuugacucccuggucucacaagucacuggccugaaguagguugagcuuccuaggaguuuuagucccagggcuggcucugaggagaccccuguaaagaacacuuggggggauuucaaggaccaucucugaggaacaucccccaccacaccccugccaagcuuccugagcaggaaaagucucuggugcccacaugguaccagagaagaaaauccacucauccauuccagggggagagaaugucucuugauccccaaggaaucaaggaaagaggagauuggugggaggagcaacucagcaucuccucucuccugggcaccaggguccuauagaccugaguccauacccucucucaguccccaauccccccacaagucauuuuacuucuccacgucucacccuuauuuuacagaugaggaaccuaauaccuaucccacaaugcuugauuguagaucaaaugaaauaacucuggguauaaacacauuauaaaauaugguuuugaccgggcgcaguggcucacaccuguaaucgcagcacuuugggaggccaaggcaggcggaucaccugaggucaggagcucaagaccagccuggccaaaaugaugaaaccccaucucuacuaaaaauacaaaaguuagccaggcaggggcuuguaauuccagcuacucaggaggcugagacacgagaaucacuugaacccaggagguggagguugcuuugagccgagaucacaccacugcacuccagccugggugacagagugagacucugucucaaacagauaaauaaauaaaauaaaauaugguuuaucaucuggcucagagcagagccugccaaauaacaaaugacauagguccuuaaagccugcucauuuccuucccucccugggggauauggggacaucuucuccucucugauuccccacaggaacugagcacuccguuauuauccaacauauucauucaacaaacauuucuaauguaugcauagugaaccaauccccgcccuuaaggaucuuacagucauaaaacagaacauuucacuauaaucuaauaaaugcugugaaacaggaaggaacaaggggccaagggaaaagggaauucugccuggggaggacuuuacagaagugguauuugagauggguuuugagggaugaauaggaguuugcacaaaggagaagagagaauuccacucucaaaagaacuaucaaaggguuauaauuacagaagaacacauuauuucauuugguaaauguuuacugagcaucuacucuguaccagacgccacagaaaacaagacaaagucccuccccaucgaagcucuucccacuggagggagcugagggaggugggggagagcucuggaaggugggcaaggucaccuuuuuggagggauuggaggggaggguacggacuaggugaccccucacaguuccuccaggcccaggauccugggauggggccccacaggaccugagcagggaggcaggggcaagaaaauauaagccagacugcuagguucagagccuugagaccaugccaguuccugugcccucucagccuggucuccuuuaucagugcaaaucagacuaguguaucauaaugagauuauuauauuagguuggugcaaaaguaauugcaguuuuugccacuuuuguuucuuuuuuuguuuaguagagaugggguuuugccauguuggccaggguagucuagaacuccugaccucaagugauccaccugccuuggccucccaaagugcugguauuacaggcaugagccaccacgcccagcugguuuuugccauuuuuuaaaaaauguuuuuugauccauuuuaaaggauuugccauuuuuuaaaaaaaugguuuugccauuaaaauaaaaagucacaaaaggccgggcgcagugacucacgccuguaaucccagcacuuugggaggccaaggcaggcagaucacgaagucaagagaucgagaccauccuggccaacguggugaaacccugucucuacuaaaaauacaaaaauuagcauggugacgugcaccuguagucccagcuacucccgaggcugagucaggagaaucacuugaacccaggaggcggagguugcagugagccgagaucgugcccccacugcacuccagccuggcaacaaagugagacuccaucucaaaaaaaaaaaaaaaaaggccgggcacaguggcucacaccuguaaucccagcacuuugggaggccaaggcgggugggucacgaggucaggagaucgagaccauccuggcuaacaugguaaaaugccuucucuacuaaaaaacaaaaaauuagccaggcgugguggcgggcgccuguagucccagcuacucgggaggcugaggcaggagaauggcguaaacccgggagcuugcggugagccaagaucgcgccacugcacuccagcgugggugacagagcgagacuccgucucaaaaaaaaaaaaaaaaaguuucacgaaaaagaaaaaaaaaggcagaaaaugcaauuacuuuugcaccaaccuaacagaaaaugaaauaaacaggcugggugcgguggcucacaccuguaaucccaacacuuugggaggccgaggcugguggauugcuugaggucaggaguucaaaaccagccugaccaacauggugaaaccccgucucuacuaaaaaugcaaaaauuagcauggugacaugcaccuguagucccagcuacucaggaggcugagucaggagaaucacuugaacccgggaggcagagguugcagugagccgagaucgugcccccacugcacuccagccuggcaacaaagugagacuccaucucaaaaaaaaaaaaaguuacacgaaaaagaaaaaaaaggcagaaaaugcaauuacuuuugcaccaaccuaacagaaaaugaaauaaacaggcugggugcgguggcucacaccuguaaucccaacacuuugggaggccgaggcugguggauugcuugaggucaggaguucaaaaccagccugaccaacauggugaaacccugccucuacuaaaaauacaaaaauuagccuggcaugauggcgcccaccaguaaucccaguugcucgggaagcugaggcaguagaauagguugaacccgggaggcagagguugcagugagccgcgauugcgccacugcacuccagccugggcaacagagcgagacuccaucucaaaaaaaaaaaaaaagaaaagaaaaccgcaaaaagugcuuagccuagugcccaacacaugauaagcgcccauuauuauuauguuuguaacuauauaguugcuaauagucuauauuaguguacuuuauuguuaacauaaauggccagggagccacagcauugaaggugcugaggaaacagaaaccccuguuguucuaugaccuuggacaaguuacugaaaauuucuugacuucauuugcuguaagaaaauaauuggguccaggcccaguggcucaagccugugaucccagcacuuggggaggccaagguggguggaucaccugaggucuggaguucaagucagccuggccaacauagcaaaacacugucucuacuaaaaauacaaaaauuagccaggcauuguggcacaugccuauaaucccagcuauucaggaggcugaggcaggagaauugcuugaacccaggaggcagagguugcagugagcugagaucgcaccacugcacugcagccugggugacagagugagacucugucucaaaaaaaagagauaaaauuaaucauaaucauuuauuugauuuagcccaauauaaacauuauuaaugagaucuuucacuuuguuuuguauuaagccuaagaaccgguguguauuguacccuuacagcacaugucaauguggacuagccucaugucaagcacucaagagccauguauggccaguaacugcuguguuggccagcacaggucuagaucaugagcuuugggauucaguagucguguguucaagucucgguucugccacuuacuagcugugugaccuggaacaagucacuuaacaucucugagccuuguuuccugugaaguggagauaauaauagcgcccaccuuguggcguuguugagaagacuuaauaagauggugcaaguauggaggcuuagugccuagagagccccagggcagugggugggaccaaaaugccauguaugcagauggaguccaggguuugggaguccccuguccagccccaggcucaccgccgucucugccccaggucccggaugcgccgggagauguugguggaggggacccaggaugagccagaccuugauccaagcggggguccuggaauccuaccgccaggccacucccacccagaccccaccccgcagagcccugacucugagacugaggaccagaagccaaccgugaaggaacuggagcuucaggagggcccugaggagaacagcacaccccugaccacccaggacaaggcccaagugaggaucaagcaggaacagauggaggaggaugcugaggaagaggcaggcagccagccccaggacucaggggagcuggacaaaggccaagguccccccaaagaggagcaucccgacccuccggguaaugauggacucccaaaaguggcucccgggccccuccuuccagguggauccaccccagacugucccucacuucauccccaacaggagagugaggccggggagcgacuucacccggacccuuuaaguuuuaagucagccucagaguccucacgcugcagccuggaggugucacugaacucgcccucggccgccuccucaccaggccucaugaugucugugucaccuguccccuccuccucagcucccaucuccccauccccaccuggcgcccccccugccaaagugccgagugccagccccacugcugacauggcuggagccuugcaccccagugccaaggugaaccccaacuugcagcggcggcaugagaagauggccaaucugaacaacaucauuuaccgaguagagcgggcugccaaucgggaggaggcccuggagugggaguucugaaggcagggugagggggcaagggacauacccugguaacuaccuuccuucucgcacuuacucuccucaacaggaugggguaagggagggaggaacucaaccaucaaaauguggacagcaauguuaugccguuuacguuuuuuguuguaauccuaguucuaugaagcugugugagcaggugggucaaaugccauugccuccacuuuucugcaccccccugcuccucuucacccugaccccucugcaggaggcagaagcaaaauggcaccacauauucaccugaaaacuccaaacucuuuuagaaaaauaaauaaauauuuauagaccucuuuuagauauuuuaauaaaggauccuuuggaauuuaucccagcugaugcuguuuugauauuacagagaguuauaaaaucaggaugcugucacaacuguugcgaaguauacacugaaguugugucguuuuugccacuagaugagauuaaaagaagacaauuauucaaagccaucacaaaacacuauaagacugaccaaaauuuagauaaccuuugaaccacgauuuuuuuccacaucugucugugagacacagcgcaaugcuacugcccuuccagaaacugugcuaaaaagagaaaguccaaaagacucuaaacaaaaaccucgacgccguugaggauguguuucauucugguggucuguuuugcaagcuugauaacagaauguccgugccauuguaaauguuguagagaugugggccguggcccaaccguccuauaugagauguagcaugguacagaacaaacugcuuacacaggucucacuaguuagaaaccugugggccauggaggucagacauccaucuuguccaucuauaggcaagaaguguuuccagauccuuuggaaaggugggcauggggcaggugcuuggagaguggcguuugagccagagcgaccccauuucccgugugaaccauaggcacaacccaggaaguuuccccacuuguaggaguguggguauuccagagcaagacuguggccaccaucuuccccucuugguguuuuccgaaagugacaguguuggucaucccaugaccacugaagcuuaguaaccagcgccaaaaaguagauucaucaaacuagagaccccagcuccccuucucgccaucuucuuucucaaguugaccguggugcuguuucuggaaggcaucugcaacuccaaguccaugcagaacucuggaaggccaaguucaucgcagcauguucaccauaucccagccuccaaaucuauccuccuaccuuccaacgcaugaccuguuggggagcagagacuuaacccccaacucagaggaacccuuccuccagcgucuuuggcaugguuucuagggugagaguucccaauuuggauagaacggccaccauauugguuacugaaucucucucccuuguuuuuauuacguuuccuuuuucaaacuguccaugggaaggcugaauugagugacuccccagaaugaagaugagaaggugaauauaaucaaugccaauguaaugccagcgggugagauggccgauggagguuucaaagauguagcuagcauuuugaaaccauaugggcaaaacccggcaaccagaaggggacagauaaggaccguuccagaaaucccaacucucacacccagcccaggcugcagucuccacaccaaacagucaacaaaacacaaacccugaaggaaaaccuuuuccauacacccaggcuaugcauugaagaguuuuccacuguauacauuuuuauccagaugaagguauuuuuauauuuugacaauaggaaacagugaccauuuucagaguaaucaaaucuggaacaaaugaaacaucuuuuagccaccaccacccuguugcaauuaagacaaccgugggggaacacaccacuuuuuacuguugaaaccaacacaacguugaaauccaggcuuauacgcagacuccgauuccuagagaacuaaauuuggcuuuagugugacgggauuugauuaagcacuuaguauagucuuuugaacacggaaauccuguuguacuuaaagcuagcggacccgugaacaacuuugucagguucacguccuauaacgguuaaaaaacacacacacacauacacaaaccguuucuaugagagauugaugaacuuuguuuaaaauuuuaaaaaaaggaacacguucuguaaacgagucgcuaaauacagaauuguauaauaa

SEQ ID NO: 191518 - RNA, 23171 nt, Homo sapiens
uaaagaagucccggccgggccgcugcacuccccgcgcgcauccgugcgccgcccgaggcugucuaaggagucggcggccauuuuguucuucucgugguuccaguggggagagaaggaggaaguagggagcgggguggcaggggggggacccgccgcggcugcugccaccgccgccaccaccgccucugcucguggcgugggaaaggaggugugagucccgggcgcgagccggcggcggcgccgcugcgggagggucggcggugggaaggcgauggcggauuuagauaaacucaacaucgacagcauuauccaacggcugcuggaagguaaggggggcggcgggcggcugaagggggaggcgggccugagggcggcaggcggccccgggggcucgagggaggggaguugggaggccgguugggcuugcagcaccguggggagugagcuccucgaguuggcccacgggccggggacugcagccggagggaggccagcccgggauucccaacuugucgccagcugcggacccuccaggcuccgcucauucauugcacgaggaugcaggcuuccucccggccguggaauuugaaaacuccgcuccccacccccacguuucccgccccuacccguuugcccccgcgcacuggacgggucuuuggagcgaugguuggggaucccaguccagccuccuggacgacgugugccgugcugugcgagauggacuuuucggugcucguccucucggaaggcaguuugaugagggcaugaguuccgccggguuugggggcucuuuuccugcuugcuuuuauuuuuauuuuucgugguucuggggucuuggggggcccauuucuuguuacuugguaacaagcguucaugucucaagaggugugagaaccugucuucgccugcccuccaaauccuuuuaaguuguucuaaucuuggagaggucuccgcgcucuuuuccugagcgugcaucugaagaggaagccaacgaggcugacgcuaucauuaucuuuccaaugugccaggcucugucuuaagcacuuugcguccaugaauuauuacuguaaucauaacugacgcuucuaaagcgcuuacugugugucaggcauucuuugagcacuuaagacagauuucauuuaauucucccacccauugcaagauauuugcaauuuuuuuuguuuuuguuauuuuacagaagaaacugagaugaagucacuuaaccaaggucacacaguuagugacaguuggauuucaaauccacauagccgggagcuagaacccucuacagacaacacugucaccuuauguaggaaggaagguggccagugguuaaguaaagguuaauagaaagcuuuaaauuucggcucaucuaagacuugugaggugccuggcaauugauucauguugaugugggagaggggcgagguucagcuuuuaaagacggaagcugaaaugagcugcuuucagauucaagggcaugucaacggaugcuaacaucuuauccaagacuuuguaagaauucagucauauccccuaacuuggacacuucauaaugggaacuuggcaguuucaacugcuuuuugccuuuauacaguccuaaaauauuguuggacuauaaaugcugugagugguggagucgagggcaugaacaguuggacagcucugguguuagaauuuacagaucuuuuaaaguaaguuauuaaaaugaagcuccugaaaauaucucguccuuuucuuaaucugugcauucuuuccuuuuaugcugucuuuaaaaaaaaaacaacaaaaaaaacacuaaaugucauuaaggaccccugaaaugcucuugaaauguuauugcaggugaaaaccuuguauuguaggugaaaaccuugucauucuuuuaaugccagguauuuauauaagaaccauacuuuuucauacuaguuaauauaguucuuuaauuuauucgaggcagcaguuggucagaaacugauuaaaauaguuugcuguaagaaaggaacuuuuuguuaaauauuuucuuucuaaauuuuaaaauucugcuuaucucugcagggauauguguggcuuuauuucucugaggaaacaggaaaaguuggaauuugcauggauuagaaacauuagaauuuuaagaucaucuaaggcuugcuaauuuaaguucugguuugcccauaacugccucuauucauaaacagcuuuuguuaauuuugaucuuuaaaauuguaauaaguacuuugccugguaaguaaugauacaucuaaaaugagaucauuguuucuuaauaguuccucuuguuauguggcacuugaaaaccagguuuucuuauauuucauuuuuugcugaaauuaauaaagcagugcauuuuaaugccuugggaauaggcuaacugcaaaguauacuuaaauuucuuuuuuucucguggguguuaaauuggcagagaaacaguugaagaugauccauugaggauauguagauaucuaaguuaaaugauguugguaauaaauucuguuuuacaauuuuuuauuuaaaaaaauuaaauuuaauaauuuaaaauagaaaugagagucucacuguguugcccaggcuguucucaaacuccugguuucaagcaguccucgcaccucguccuccccaggugcugggguuauagucaugagccaccgugcccggccuaaauuuuauucuuuucauaaugcccccaaaaccuuuuuuuucccuaaauaagauguaaguauaucugaaaguagagggaauaugacuugugacuuuggccagauuuuuuuacguguuuagaauugaucuuuuaagcuugcgagcaguauaaccuaguugagaaguagcugaguaauaguacuaaaaagcuaacugaaaagugaagucuuaagaaaaacagcauguugguuuagaucuuagucacuaaccuuugcaguucuuuucuucucugaacucugaguauuucuguaagcgaggcaucaccucugcaacccaccauggaugcuuuuauccaagcucugccuugcugaugauaaaacuuaagguuguuaacuccuuaguauaacugauguuaguuauuuaaauaacuacacaguaaaacggcauuuugagagaaaauaagccagcuguugauuuggucugauguauugaagacaagugagauuuggggcaguuuuacuuuguaaaugaccuccuucaaggagccaugguggcuagcauuuuuuuugcauagcaggugguuguaacuuacuucacaucuugguuugcaagaagcaucuuugcuuugaagaaggccauugucaaagugcaagaccaugucaggcucugcagaauugccugacuuguuuuagugauuuaaauaugaucucugcccuggcucacagaaagugcuuacagauuuaauccucugauacauaaggguuguucugaagguagggaguguucagauauucugaaacucuaagauuguuuaaauaacccauauguucaucuuuuugaugcaguauaaaacguucauauucugguguuuagccaucccugguccuaaagauaauaaaggacaaacauaaugguuuaaaaaggggaagguuucuuaauaugcuaaccaaaaaaaaaaacaaaaguaaucuuuccuaaugaacaccuguaauuauuuauuuuuuuauuuuauuuuggagacagagucucacucugucacccaggcuggagugcaguggugggauccuggcucacugcaaccucugccucccggguucaagcgauuuuggugucucagcccccugaguagcugggauuaacaggcaugcaccaccacgcucggccaaguuuuuguauuuuuaguagagaugaggccaggcugguuuugaacucgugaccucaaguggucugcccgccucagacucccaaagugcugggauuacaggcaugagccaccgugcccagccuguaauuauuuguuuacagagcagguaauuuuuacacucacauccaaguugucaguuucuaauucccucauugauaagaacucugaugugagcccuugcccuuccuuucccaucaguauguuggucauaugcccacuuccucuccuccuaggcaaggugggaaagcucuguuggagacagaugaucugcagcuugcaggaguccuuuuuuaaaccacagcauugaaaaaggauuacucuccuugugcccgcagugcccucuugccugucaguagcaggaggcagcagugaaaucugacagaauugugugugacguugugcuugcgggggaugugacacacaggagcgcucugcauucugagccuaggguguuccuccucauaacugggcaaauggacaugcaguuguagcccagcaguggucagcuguagaaauuagugaggugauuugaugucuuugaaagcacaguccuauuacaaccuguaaccuguugugcagaaucacaguaccagucagcccacuugacuaggugaggauuccugauggugaagcagggaaauuauugauguuauguggacuucaccauuuaacuuaauuuacaauugaggccauuaguugaccugagagauuaaaauaugaaggagauaauauucugggugucagucgcuuuguagauaaagaacuggaaagucauucaagaccaagaaggaaggauuucauuuccauggagcuuauggaauuccaggauagaguuugauauuuuaagaucauaccucuguauccaaagcaucaagaacagaugauguguuuguggaucuuggugauuugucugaaaucuccagcuuccccacuucacugggguuuacugucaucccucuucuagaagguaguggucaucaccgacaguaaagcuuacagcaaaugaaaacucaaaauguagucuacucagugguauauuaccgaaauguguucuuagacugugaaaauuaaaguuuuuaauggauuggcuuuacucgagguguagaaaacucaagaugcuuuauugagaacaguagacaguguuuugcagccacauccuaucugccuugaaaaaaauggugucacuuuuauuuuuuuuacuagagacugggucucacucuguccccaggcuggagaccugaacuccuggguucaagcgauucuuccuccucauccucuuggcuagccggaucuauaggcacacaccaccacaccuggcuaauuuuuuuuucuuuuucuuuuuuucuuaaagacagggguguugccuaggcuguucuuuaacuccuggccacaagcaguccucccaccucagccucccaaagugcugggauuacaagcgugaaccacagcucccugccuuggugucacuucucaaugccugaaguguaaccccaucuguuaggaaaaucaggaugggagagggcaggguguggaaacaauugugauaaucagaacauggaagucuuucugcuggugacuuugcagagaaacuuaaaggguucuuuuuucuuuucuuuucuuuuuuuuuuuuuuuuuuuuuuuugagucuuucuuugucacccaggcuggagugcaguggcaggaucucggcccacugcugccuccaccacccagguucaagcgauuucuccugccucagccucaguuguugaguagcugggacuacaggcauguaccaccaugcccugcuaauuuuuguauuuuugguagagaugggguuuuaccauguuggccaggcuggucucaaacuccugaccucagcugauccacccaccuuggccucccaaagugcugggauuacaggcguuagacaccgcauccggcccaaaggauucuugauaacauuuuugugguuuauacuuuuugcagaaaagaacucagucguuuaugggaaugcuuaauguuggaaguauuuacuguuuuuuguuuugguuugagucuuauuuuccuaaaucugucaaauaucaugaggcuauugauuucacugaaaugaauaugauguggcauauuguuaaaauuaucaccuacuuuuuaacaggauuauuuuaaaacagcaaaaucuucguuggcuuauuuuuauaccacuugugccuuucuuagguucugaaacuucauuagaauucagcuagggcuuuuuuaguauaugcuauuucuuuaauauguuuuuauuuaaacaauuaaggggccuuuauguggcaaggaaaauacuuuuuuauuccuuauaaauaaucucaaacuugucuuaaauuuccuuccauaguuuccaucuuugcuuugcuuuuugccagcagcuaacuuucaaaaguuaguauugcuuaugagaaagagcugguguuguaaauaaucaccaaugcuauuuuauuuauuuauauuuuuugagacaggaucucacucuguggcccaggcuggagugcaguggcaugaucucggcucaaugcagcaucugucucccgggcucaagugauccucccaucuuagccucccgaguagcugggacuacaggcgcacgccaccauguccagcuauauuuuguauuuuugguagagacucaauuucaccauguugcccaggcuagucucuaacuccugagcucaagugauccucccaccucggccucccaaagugcugggauuauaggcccaagccaccacaucuggcugcuauucuuuuauaauucaaauuuuuaccaguuuguuuucaauaaaaauguguggaaguuuuuauuauugcucgugucagugauuugccagaaaaauagaucagauacauuucuacagagcaaccuucgcuuuuaacaguaauaauacguuuuccugaaucucccuuucuagccagauaaagaaauauuaauacuucuacugaaaagucacauccuuaggucuaaguugguguugcuuuuuuguuguuguuuguuuguuuguuuugagacggaguuuguuuguuuguuuguuuguuuugagacaaagucuuauucuuguuccccaggcuggagugugaugaugcgaucugggcucacugcaaccugccccguggguuccagcgauucuccugccucagccucccgaguagcugggauuacaggugccugccaccacgccuggcuaauuuuuguauuuuuaguagagacgggguuucaccauguuggccaggcuggucucgaacuccuuaccucaggugauccgcccgcuucggacuccuaaagugcugggauuacuggcaugagccaccgugccuggccgagacggaguuucuuucuuguugcccaggauggagugcaguggcacaaucucggcucacugcaacuuccaccucccagguucaagugauucucgugccucagccuccuguguagcugggguuacaggcgugcaccaccaugcccagcaaauuuuuguauuuuuaguagagaugggguuucaccauguuggccaggcuggucucgaacuccuaaccucaggucauccacccaucucggccucccaaaguguugggauuacaggcaugagccaccgugcccaaccuucuccuuugguuuugaaguucaauguagaacagauucuuaauugggaauuaagaaugcaccacuagauguagcaucgcggccucguguccuuaagcucugugaccuuggacuaagucacuguaaaaugggagaugacagugccugacuuccuaggaucguugacaggauugaauggcaauauaaagcccuuaguacagugccuaguggauaagugcucaguaaauguuaacuacaacgaguaaauaauucuguuugauggacauugaaaauagugaagugggccaggcacgguggcgcacgccuauaaucccagcuacuugggaggcugaggcaggagaaucacuugaacccaggagguggagguugcagugagccacgaucgcaucacugcacuccagccuggcaacagagugagacuccaucucaaaaaaagaaagaaaaaaauagugaagugaauuuguaugcuuuuggcugauauggcaacuuuuuuuuuuuuuuuuuuuuucuugagauggagucucacucugucgcccaggcuggagugcaguugcacgaucucagcucacugcaaccuccaccucccggguucaagcgauucuucugccucagccuccgcaguaaccagccaccacgcccagccugauaugacaacuuuuaagaacucuccaguguucacuuggacugccaagccccauuugaaaucucuguuagacaauucaacgugaaauuuaagaguaauucuagauuuucauacuuugaaaaauacuccaguaaagccugguaagcaaguggcccuauuguuuuauaauuuuauagugcagaaacaggcuuuuugcucaucaaaaguauauagucugggcugggcacgguggcucacaccuguaauccuggcacuuugggcgccgaggcaguggaucaccugaggucgggaguucgagaccagccugaccaauauggagaaaccccaucuguacuaaaaguauaaaauuagcuggaugugguggcgcaugccuguaaucccagguacucgggaggcugaggcaggauaauugcuugaacccgggagacggagguugcagugagccgagaucgugccauugcacuccagccugggcaacaagagugaaacuccgucucuaaauaaauaaauauauagucuggaauauauguuuaauucuaaugccaccagucaacacuacuuaaagacuuauccagauuucagucaugcaacaaauuuugagcaccugcugugugcuggcuauggcugguguacacuacagagcaggacugcugcuguggguuuacauucuaccaguggguccagaugagccggcagaagcaaacuggcaaguauaaaacaaauacaagcaugguugagggggugugguggguagugaccugauguugagagagccuuucaaaaagcaugcagcaagcuugugaggggagaggagauggaugagagaagcuuuucuccagggugaagugugguaucugagcagaggccugaagucugagcaguuguaugauaacugauggaagaugguuuuggcaguuucuaucuuuauauaacuuuuuucuuucugcuaauuuuagggaauuuaagaagcuuucagaccauguuuguugauguuuuucauaagcaccauucuuuaaauacaaaucuuuauuuucucuggaaaagcugcaucuaaucuuaauauuaagaguaauuuuuaaggccaggugcaguggcucaugccuguaaucccggcacuuggggggccagagcaagaggaucacuugagccuggaagguugaggcugcaguaagccaugaucaugccacugcacuccagccugggcaccaggcuucuucaaaaaagaagaauuuuuaaauuguuguuaguauugcuuuugcuuuuuacugaucucugaauguccccacccagaggacaaacagaaacagaauaaaggaguuaaaacaaauauaaacuauguucaaaggugacaguggagagcguccaaagccaaaaaaaaaaauuguuagcaacauugauuucaucugauggcauugacuaacugcaauagcauucauaaaacaaagcuugccauuauaugguaugagcuauuuaucgcagaaauacucuccuagaagacuuagagucagcuauucauucauaagugugggacucugcugaaaaaaauucacguugaaaccagaagcuucuaggauuuccuuccuagccaaaaauaaagcuuccugcugggcagucugcccaaguuuuugguuaacuuauggugaaaucacuaaugauuggcauuuucuggccaaugaaguggggaucccaucuuucaccgggaguauuuccugaguucuaacucuguaugugugucuagagagaaaaaaaauuacuuacgaaaaaaacauuuuuguugcucaguugcuguuuuauuaaauaugcaucuguuucauaucuuuccucgaagacuauuauuacuaugcuuuuauugcuucuuguuguauaauauuuuuaucagaacgagacuuaguuacauauuuugggguccaaaagugaacuuuauaacuguaaaauuaagguacauuuagcaguuccgugcuacuuuaucuguaucuaaugacuauccagucuguuacaacuggaaccaaaacaaaauuucuuucccacaacuaccuacgugcugacaagugaguucuguugcaaaguuuguacuuugauagaagaacccuaagugcucuggugguguggaugccccaugcugugcaaugauuucuuucucccauuauuaucuuaucuguucaaauuauuagggaacgugcuuucuuacaguauagcacaugacugacauccuuugcccuauauagacaugagcauaaacacaaaugcaggcccagaaaaugcauggcaaaauaaguacaaugaaccaacauuuucuuaaugaaaugaaaacaacacuaacauuuuuucauagguaaauuaaaucagagauccucaggaggagauacccaugguccucuggaaaacacugaugggggaggguucugaguauuuccaauccuguuucuuuucuuuucuuuucuuuccuuuucuuuuuuuuuuuugagacggagucucgcuguguugccaggcuggagugcaguggcgcgaucuuggcucacugcaaccuccgccucccgggugcaggcgauucuccugaguagcugggauuacaggugcacgccauguuggcgaggauggucuggaucucuugaccucaucaugaucugcccgccucacccucccaaagugcugggauuacaagcgugagccauugcaucuggccugcaguccuguuucuaacagcauucgcacagacaggauggcuccuuuuuuggaauacuauaaaagaagucuuacuugguaucgaagaugcaauuaagucuugucuaagauuuuaagauucuaauuagacauuaaaaccauguuuauuauaaguguccugaaaaugaagccacucagaaagcuaguuaaaccauguuuuugccccuuuaucuaaaucucguauuguauuuuguauuuuggcuucauuggacuaauugcgauuuuucucuugcagugagaggguccaagccugguaagaauguccagcuucaggagaaugaaaucagaggacugugcuuaaagucucgugaaaucuuucucagucagccuauccuacuagaacuugaagcaccacucaaaauaugugguaaguuuggggcacacagguuaucuuuuguuacaugauugauuaacugagucaaggauauguugaugaccuuguauuagcuagcagaaugauuauccuguuugcgaauagcuuggaacuacuuaaaaguaaguuaaauaguagcuuuagaauaaauaccucuaauggacuuaguuuacuuagauguacuucagauuuuuaaaaaaaauauuuugcugaaggaauaaacauugcaaaagaaaaaaaugaaacuaagaauggagagcugaggaaaggucugaacuacauggauguauaggaauauguuuaaguuuaaagcaacacugguuauagcuaaaaauagaacuuccuugauacugauuuugugguucuguuuucugcauaauagaagcaaauaaucuguguuuuaacucaauguaaaaccaaacuuuauucguuugaguaauauauucuuauagcauauuugcauugauaaaacuuuguguucauguuuuuaaaaguaaaauguucuuuggcauuaucuagcagggagaaauugaaagcuaaaugcauugauggguggggggugggggugguguguauguguguaugugcuuuuguucagauggggccaagacucacuagaagugcagcaguucugcugacacaguacccagagacugagcugucagagaucugauauugaucagucagccugaaagggauaccauguuacuuggcaagaaugcaugcuuggacauaauaacccuuuccacagaauaaauucuuaauaguugaauuuuaugugagguucuggacauacacauauacuuaaaauuuuuguuaagcucaguugaacuaaauaugauauaagauuggaaauuacuuaguguuggcugcccaguuaaacucucauuacuagaggucaaugccauuguacaaugaauauuuaaagaaugucuuuccaaagcuuuguuaguggauugagcuuuaaguaugggaacacuguguaacaaaauucuugcuuccaggugacauccauggacaauacuaugauuugcugcgacuuuuugaguacggugguuucccaccagaaagcaacuaccuguuucuuggggacuauguggacaggggaaagcagucauuggagacgaucugccucuuacuggccuacaaaauaaaauauccugagaauuuuuuucuucucagagggaaccaugaaugugccagcaucaacagaauuuauggauuuuaugaugaauguaaguacuuuucuauaucuaaggaagaguuauugaaauuaagauauuuaucauaaacaauuaucacauacuucuguuaggaauugugagaguuuagaugcagugguaucaucucucauguuuucuauuucaucaacuuguuuuuagcuuagcuuuuuuaggggggugggggaacggagucucacucuguugcccaggcuggagugcaguagcaccaucuuaccucauugcaaccucugccucccaggcucaagcaauccuccugccucagccucccagguagcuaggacugcagacaugcaucaccacgcuuggcuaauuuguguauuuuuuugaagagaugggguuucaccuuguugcccaagcugaucugaaacuccuggcucaaggaaucugcccgccuaggccacucaaaguacugggauuacuggcgugagccaugaugcccagccaguuuuuucucucuuggguagaaaaauaacacugccgcuguaauaaaauaaggucuuggauucuuuuaugaugugaugaucagauuaggaaguaaugaucaugguaaugguugcuuuaagauuuaaauuguuguauucacagauaacuuaauucuuaguagaaaucugagaaccauuccaaauaguuuuuuuaagcaacuuuauuauguaauuucauuccauaaaauuauucuguuaaaaguguacaauucagcgauuuguaguaaauuuauagaguuaugcgaccaucaccauaguccccaggcaaccacuaaucuacuuuuugucuuuucuagagaauauugcaugcaaauggaaucuugcaauacguaaauaauuaguuuuugaaauuauuauaguuuuucuccuucuggcauauccacacccaggaagaauggcaauaacuuuccuaaaacuaaaaugugcugaacaaagauuauuuuuacaguauuuuacacauuuugugacccauuuuggauuguuuaauuaaagguauacuucgauuugacuauugacaaaacacaguucuuaaagcuuugaaaauaggcugggcacaguggcucacgccuguaaucccagcacuuugggaggccacagcggguggaucacaaggucaagagaucaagaccguccuggccaacaugaggaaaccucaucucuacuaaaaauacaaaaauuagccaggcgugguggcagaugccuguagucccagcuacucaggaggcucaggcaggagaaucacuugaacccaggagucggagguugcagugagccaaaaucacaccacaguaguccagccuggguggcagagugagacuccgucucaaaaaaaaaaaaaaaaaaaagcuuugaaaauaucaguucaguaaaggguuucaagucagaaaagguuuugaaucuuuaccuucaccuuccuuuugugcucaucauugcugccaggacggguuucagguuuggagugaagaggugguuaaggaacuucagguacuuggcauuugcuaauaugauuauagggauaucagcaaaggguugucccuguggcccuccccuagaccacaucguaaccuagagucuccagaugcaguguuuuuccaucucaauucacauagauauguugagcuagcacauuuguuagaagugcauccuagaaagauuauauucacaaacugagcccuucuacuaccacccuuucccacaacuggauguuugcuuggucugugaccuugagauccagcugauaagaugggguggcaggaaucaucagggacaaaaauucuauggguucuggacugacugauagcauugaacuuguacaugaaagguauucaauauuaacagugauucugugucagagaaguaccaguaagccaguuacuacuccuuagguagugaaaugcaaggcaggugugauggguuuuuuuuguuuguuuuugagacagagccuuaggcuggagugcagaggugggaucauagcuuacuaccaccuguaauuucuggguuuaagcaauccuuucaccucagccucccuaagugcugggauuacagucaugagccaccacacccagccaacacuguguuuuggauacuuauuccaaguguuacucuugaguuuuuuguuuuuuguuuuuuuuuuuuuuuuugagacggagucucgcucugucgcccaggcuggagugcagggcgcgaucucgccucacugcaagcuccgccuccuggguucacgccauucuccugccucagccucccgaguagcugggacuacaggcgcccgccacuacgcccggcuaauuuuuuguauuuuuaguagaggcgggguuucacuguguuagccaggauggucucgaucuccugaccucaugauccgcccgccucugcuucccaaagugcugggauuacaggcgugagccaccgugccuggccugcucuugaguuaaaggauuccuuuuacauagcuguuagcccagcaaauacuuuucauguuugcacugaugaauucaaauccaguugaccucauuuuugugacguguauccuaauguaaugauacuggcugcaucaguuucgguuucuacuuaaugcagaggccuuuaaaaaaugacuuagaagaucaguguugguugguaucaguuucgacuccuguuuggucaucaacacaauuuguagaucuuaugcucaagcuuccucucucucaucaggcagauauaauuugccauccagucuacuugugggcaugaaagugcccuugacauagguggcuuuugguugaaggcuugcagacauuuaauauauauauaaaauacuuaacuaauuuuauuaaaaugaaaaguuguauucaaauguugauuuucaugggacaauuuaaaaaccacugccuguuuuccagguacauaaguacuuuauacuaccauuucuuuuuuuuuuuuuuuuaacuuuguaaaugugauggaaaggcugagguauauguuguuggguaaaacaugaguguuuguugaucuguuucugcugccguagcugucugauguacaguaaugcgaaaccgcauuacagguuauggcucagaaucuuaggauuuggaagcuaggcgauuacccuggcuaaaccuuucaggagccagauguuccuaguggucugagguagccuuagggaggaaaugaagagagaauagaaagaggcaggcccacgcuuaaagugcugagagggaaaaggaggaaacaaacugauuuuugauggagaagccagcaggaaucagcaggagaagcuggaguauguggcauaacuaaagaaucaaagccggggcgugguagcucacgccuguaaucccagcacuuugggaggccaagguggguggaucacuugaggucaggaguucaaccugaucacaagaggucaggaggucugaccaacauggggaaaacccaucucuauuaaaaauacaaaaauuagcugugguggugcacaccuguagucgcggacacucaggagauugaggcaggaaaaucacuggaaccugggagaccaugguugcagugagccaagauugcgucgcuucauucccccuaggugaugcagugagaccccaccucaaaaaaaguauccagaagugaagcugaccuuggggaaagaggaagucacugucacuggggagcuaagacagcagcucuguuuuuauaauacagguuaaguauuccuuaccgggaaugcuuggcacuagaaguguugcagguuuuuuguuuuuguuuuuaauuuuggaauauuuguguuauaauuacugguuaaacaucccuaauccaaaaaucugaaauccagaaugcuccagugagcauuuccuuugagcaucaugugagugcucaaaaaguuccaaauuuuggagcaucuuggauuaaggauacucauccuguggugguaguaguaguaguauugcuguuggaaaugggaguuggugguuuuuggagauugcccuucagccuuucguaagaaggaguuugcuuuuuuuugagacggaguuucacucuuguugcccaugcuggagugcaauggugcgaucuuggcuuacugcaaccucugccucccagguucaagcaauuuuccuuccucagccuggcgggagaaguuuguuaaacuuuccgaacccccuagugaaggaccucuaaagaaauaugcaacagggugaaccauagucaguguuagacccagucauugagaaaccagaaauuauuaggagaaaagauaacacuccucugcagagagaaggcaaacauuuguugaauuuacauuucauuucaagcccugugguaaacucccuaagcugcuugauuugcauuacagggugggaggugugguucaggucaguugcuugggcuggcucuaacucucaaaggagagguauagguuuaaaccuuuagaugucccuguauuccccaggaaaagagacuaaggacaaacucuugguuuguuuuguuuguuuuguuuuguuuuuugagacggaguuucgcucuuguugcccaagccggagugcaauggcacaaucaaggcucaccgcaaccuccgccucccagguucaagugacucuucugccuuagccucccaaguagcugggauuacaggcaugcgccaccacgcccagcuaauuuuuauauuuuuaguagagacgggauuucuucauguuggucaggcuggucucaaacucccaaccucagauggucugcccgccucggccucccaaagugcugggauuacaggugugagccaccgcgccuggccaaacuccugguuuuuaaagauugugcuuaguauaguaaguacaggaaacaaaggcaucuggacaauuggacaauccucaaccaauccagagaaauuuguucuugcaagguaugugacuagguuuuaaacucagaacaucaguuuccuguagaaacagugcauagaggcauauuucugucagaacugcacucugacuccagaauguguggaugccugugcuguugagggaacaugaccauccugugacaucaggccugugggagcauguggagucugugcaguguuggaaacaaaugcccuguagugccugugagaggcagccacugccgugugaucauugugccuccugcuagaguacugagggcuggggauccucuggugucaguagguuauugaggggcauauaugggggaugggugcuaacucucagguuuccucagaaggaaggucauaacgccacauguguaaguucguaauugaauucagaaguaggggacuagcugcggugagauuggacagagcagacaauuucaaacagaauugaugcucccagauaauuccugggauuugauggcaguccuuaaucauuaucaaaucuggaauucugguuucaugcuucuguggaauuuaaaaagauuucaugugaaaauguaagucauugcuuuuagaucagauaugugucucuccuaaaccccuucccucuaggagagucuuucuuuaaagagauggggucucacuauguugcccaagauggucuugaacuccugggcucaagccauccuccuaccucagccucccgaagugcugggauuacaggucugacccaccacgcccagcucuuauuuuaaaagagccuuaaaauaagaugguuuuauuaagauucuuaauaaaaacauaguuucauuugcuuaaaaggcacccagaaucuugcuuugggggaaguuaauccugagagaaugagccuacggaacaguaauacucucuuuuuaauguaauacucucuuuuuaaucacagguaaaagaagauacaacauuaaacuauggaaaacuuucacagacuguuuuaacuguuuaccgauagcagccaucguggaugagaagauauucugcugucauggagguaggugggcugauuuuuguuccaaauagguuuugaucccuuccaaagggugaacacuuuaacauuugugaguuaucauugggaugacuuucucugacagaacacucuccuuuguugauguguugcauugcacuuucacucugauacagccaggaucauuuggauaaaaaucuuaaggaauugauuuauuacagggaauucuagacucuguaagcuagguuugaaaauagagcagaaaauuuuuauuuuuauuuuauuuuuuguaaggaugaguucucaccacguugcccagucuggucacaaauuccugggcucaagcaguccuccugccucggacuuccaaagugcuggguuacagguguaagccacugugcccggcuuagaaaaguuuuugguuuuuuuuguuuuuguuuuuguuuuuugagacagagucucgcucucucacccaggcuggagcgcaguggcaccaucucggcucacugcaagcucugccucccagguucacgccauucuccugccucagccuccugaguagcugggacugcagccacccgccaccacgcuuggcuaauuuuuuguauuuuuaguagagacggggcuucaccguguuagccaggauggucucaaucuccugaccucgugaucugcccgccucggccucccaaagugcugggauuacagacuugagccaccacgcccggcagaagaguguuuuuaacuauaaaaugaacaauguguaauuuguugugccagagauccucuagaacacucaagaugugaguagauuuucccuugauuguuuuuuauccucucagaacuuucucugacuuggauuuuaaaaguuauuuuggccaggcauaguggcucgcaucuguaauuccagcacuuuggagaggccaagccaggaggauugcuugaugccaugaauaugagaacagccuauaacauaucgagaccccugucauuagaaaaaguuguaaaaguuagccagguguaauggugcacaccuguagccguagcuauuugggaggcugaggcgggaggaucgcuugaacccagggguuuaaggcugcagugagcuaugaucgcaccacugcacuccagccuaggcaacagagcaagacccuaucucugaaaauauauacauauauauguuauaagcuguuuugcuuugcucagugguugugcuuucuauaauguaauuaaaauaguaauugcaaagagaauuucuuuuccuguauggucugaaauuaaucagccaucaaaaagccugcauaaugucuuuuaucucugugcuucuguacuuagguuuugguagaguuggauacaugguuuuuaacucuuacaauaugcaucccauauuguaacucgauacaauaagcucuuguagauuuuagccaucaaaaagccugcauaaugucuuuuaucucugugcuucuguacuuagguuuugguagaguuggauacaugguuuuuaacucuuacaauaugcaucccauauuguaacucgauacaauaagcucuuguagauuuuaauggucugugaacagugcagguuuccuagagaacuaccucacacugagcauccuuaucuucucagcucagucauuauaagccaucaaucauaacaucgcucauuauugucaucaacugggggaagcccauagaagaguuuuuuaaaucacuggauuuuauuuuacaguguucuguauaauauaauuguuuccauguacuguuuaaaccuacugcaccccaugcauuacugcauguaauucuaguguguauccaguuguccuuuuucuguguuuuuuucuuuuaaccaaaaguaaauaaaauauaaucauagauuucaguuuuuaugucaggauuauugaauuucucuguagacaaauggaacuuuugaagggguaguauccuuuuaaaaguucugcuuucuucauuuuuuuuuuuuccucauugaauagguuuaucaccagaucuucaaucuauggagcagauucggcgaauuaugcgaccaacugauguaccagaucaaggucuucuuugugaucuuuuguggucugaccccgauaaagaugucuuaggcuggggugaaaaugacagaggaguguccuucacauuuggugcagaagugguugcaaaauuucuccauaagcaugauuuggaucuuauauguagagcccaucagguauugauuuugaauuuuacauguacacuuaagagcaugugugugagcacagauucuccuuguugauuuugguggguagguauugcuuauuuauacaaaguguuucuggaacacaagauaucaggcucaaugggaaacugaaacaugguuuuacucaccuaauauuugcaccuauuuauauugaaaaaauuuucucuucaaggugguugaagauggauaugaauuuuuugcaaagaggcaguuggucacucuguuuucugcgcccaauuauugcggagaguuugacaaugcaggugccaugaugaguguggaugaaacacuaauguguucuuuucagguagagcaugcuuucaacaugauuuccuuuuaauauguuuacacuuugcugauugaaaaauauaauugcuacuuuuugccuaguguucacuuaugcugaguaggcuaaguuuuuauuuucccuuaaccaguguguauuauaguugaauaauguguggaucccuuguaaaagaaaaaauuaauuauggcaccuuuucccaguguugaauuauaaauuuuugcauugcauauuggcuccuuaaugcuuauggcucuuuuacuguaaaucuaaaaccuuaaugacaauguaauguucagcuaaaauuaaaucaccacuugaaugugaaaaguacugagugccuugugcuauguguuuacuuaguucugcccucuagucuaacuuccacaaaacuucuguuaauguaccaugacaucauuuggccuucaguuggcacaaaagcauuauuuagaaucugccucagccuuuuucucauuugcuuauuaugauacuuguacaacuucaagccagccuagucauaaacauaaauacagccaccaaaucauguggcacucaucaguuaaaugaauuaaaauaguuuuuuaccaauuaucagagagaacuugcagcuuucaaaauuccaaagauugugcaaggauccccuacagguuggagaaacacuuuuguaaagaacuuuuuccccuguaucagaaggaguagcuaaagauacuaccagguguagacuucagaagauugucauuauacucagaggcaaaauaauuuguccagauaauagauuuuaucuguucgucauagcguuaauuaccaaauguuuacauucaacauagcuuguguuaauaugcuaggggggcuuuuacaguuguuggggcaguugugaacaccaucugaacagaagaucugaaugaaauuuaaggacucuuaagauuugggguugaguauauuuccuaaauuaacugucuuuugaaucuccagauuuuaaagccugcagagaaaaagaagccaaaugccacgagaccuguaacgccuccaagggguaugaucacaaagcaagcaaagaaauagaugucguuuugacacugccuagucgggacuuguaacauagaguauauaaccuucauuuuuaagacuguaauguguacuggucagcuugcucagauagaucuguguuugugggggcccuuccuuccauuuuugauuuagugaauggcauuugcugguuauaacagcaaaugaaagacucuucacuccaaaaagaaaaguguuuuguuuuuuaauucucuguuccuuuugcaaacaauuuuaaugaugguguuaaagcuguacaccccaggacaguuuauccugucugaggaguaaguguacaauugaucuuuuuuaauucaguacaacccauaaucauguaaaugcucauuuucuuuaggacauaaagagagcccuagggugcucugaaucuguacauguucuugucauaaaaugcauacuguugauacaaaccacugugaacauuuuuuauuugagaauuuuguuucaaagggauugcuuuuuccucucauugucuuguuauguacaaacuaguuuuuauagcuaucaacauuaggaguaacuuucaaccuugccagcaucacugguaugauguauauuuaauuaaagcacacuuuuccccgaccguauacuuaaaaugacaaagccauucuuuuaaauauuugugacucuuuccuaaagccaaaguuucuguugaauuauguuuugacacaccccuaaguacaaggugguaugguuguauacacaugcugccuucuuggggauucaaaaacagguuuuugauuuugaauagcaauuagugauauagugcuguuuaagcuacuaacgauaaaagguaauaacauuuuauacaauuuccauauagucuauucauuaaguaaucuuuuuacaguugcaucaggccugaacccguccauucagaaagcuucaaauuauagaaacaauacuguucuauacgagugaccgauuaugcuuucuuuggccuacauucuuuauucugcggugaaguugaggcuuauaaguuaaaacaaaggaacuaacuuacuguccaccaguuuauacagaacucacaguaccuaugacuuuuuuaaacuaagaucuguuaaaaaagaaaucuguuucaacagaugaccguguacaauaccguguggugaaaaugaauucagacuuauuaaaugaugaacuuguuaaaucuucucagugucuauuuaucagcacaauacacacaggagaacuguugauggcauauugaauagauuuuccugaauaaauugcucuggaaaccacac

SEQ ID NO: 191519 - RNA, 16236 nt, Homo sapiens
ggaggggcaggagcgcugcggucgcugagcguuugcacguuugcaccucucuguggaagcagugcgucacaggagggaaauauacaugcuccccaaaacaagaggugccuuccacuucaguauuccagauccucagcacauuugcaaaucgcgagggucaccauacaggucaaacgucugcacgcaaaccacggaccgaagcacguggcgcaaggaugcggagcuuuaucuguuguccguuauuacucagguauccaagcuuagacagcaucccaacggccgauuuccaucaacuacuuuugcgcacgcgcaaauccucucccucgccccuccccuuuuuucucaggacgcguuucucacgggauuuggcccgcgggcugccccguaguaggaggugugguagaacuggaggcguagaaagaauguggauugcgauugguucgcacuucacuuucccggagcucagugggcgucgcgcgaaggcuaagggaguguggcgggcggcuccgggagccaacaugccucgguaugcgcagcuggucaugggccccgcgggcagcgggaaggugaggaucugcggggacaaggagagaaaaguaggaguucguggaaggcgggagauuggguccugagggagugagccggcggguguguguacugggaacccugagaccccacgcaacucauuucugcugucuggcuucacguucuuuuuuguuguuguuuugaaagggaaauaaugguaguuguuaauauuuauuguauacuuaagccccaggcagcagaugaaacgccucgcuuauuucuacaacaacccugugagagagaucucauuuuucucauuuuacagaaaacgagauacagaaagguuaauuaaguucuuugccccgcaaaaaaauauaaauccaguuuugucucaacuccagaauccggcccugucucgcucccaggaggguaaaguggggucucauuaauuacuguuucucagaacuugggacauggacuuuugguauuuaaggugcuuuuaggugguaggugguacauggaccccacauuaaggagcaucagauaauguguuagggaaauuguucccuuuucauuucucuuucaguucucaacuucgcauuuaggagaaguugugcucggugcuaguguguaucuucagcacuucuuuaauccccaggucuuuucagagagcaguucuuagucucagagcuuuuaauaggcaccuguauuuagcuaaaaauagaacauuuaaagauuuuauauaauuuuaugucuaauuucacguuaugucaaauauaagugguuuucaguuuacaguagggauaaaauuuuuucuuguaaacaaauauuaagggaauguuaggaacauucaaauacagugagaauggugaagauauggaucaaauaacauaugugugggaaacauagccaggcgugguggcucacgucuguaauccuaucacuuugggagauggagguggacggaucgccugagcccaggaguuugggaccagccuuggcaacacggcgaaacucugucucuacaaaaaaaugcaaaaauuagccaggccugguggcagguaccucuagucccagcuucucgggaagcugaagugggaggauuaccugaacccaggagguugaggcuguggugaguggugaucgugccacugcacuccagccugggugacagagguacugucgcaaaaaaaaaaaagaagaaguguggaaacacuagagucuguggagguguuguguggccucagucuuuaacaaacacauuguucuaagcuguugacuuauucuggguaaaaacauguacauguaacuaagauaccuauggccuuuaacuuacccagagucuguagucuuuuggggaagacaaauagaugaccugucaauuaagauacagugugauguggccaggugugguggcuuaagccuguaauccucgcacuuugggaggcugaggccagcagaucacuugagcccaggaguucagggucagccugggcaccauggugaagcccugucucuaccaaaaauacaaaaauuagcugggcaugguggcgagagccuauagucccaccuacucggggggcuaaggcuggagaaucgcuugagccugggucaaagcugcagugagcuaugauggugccacugcacuccagccugggugacagugagacccuuugcaaaaaaaaaaaagauacagugugugauguauggagagggcauuccagacagagacaacaguauguguaaaggcacugagaggacagcaugauggauguuuuuucuauagucuauuuuaauuuuugggcugauuguauuaaacaaguaucuuuauaagcuuuugaugcuuacuaucagaaacauuccuugaguacguucuuuaucccaggcacuguuuugggcccuggggguuguauggggaaaaaaacaugcacacacaaaauccgugcccuuguggagcuuaucuuuaaacauaauaagucaauuagaaacaauuaucaaguauuuauuauguacuagguauugcgcuagucccugugcuugggaaacugaauaagacacaucucugccuuuaaacagaguaugacacagacaaguagccuagagacuuuuuuuuuuuuuugagccaggagucuuguucugucauccaggcuagagugcaguggugugaucucagcucacugcgaccucugccucccggguucaagcgauucuccugccucagccuccugaguaucugagauuacaggcauacgccaccacgcccagcuaauuuuuguauuuuuaguagagacgagguuucaccaugucggccaggcuggucuccaacuccugaccucaggugauccgucgaccucagccucccaaaguacugggauuacaggugugagccacugcacccagcccgagauguuaacauaguacgguaacaacuacauaauggauaaagaauuaucuaaaccaaaaguuacaaacugauagccaccuccagacuauuuauugaucuuggcguucuuucaucuuggaaugcucuuccccuuagguuggcaaacuccuucucauauacucauaucuccccuacucagagacaucaucccugaccauccuaccuaaagcuuuguuugcacuguacaaguccugguagagacacuguguuagguguuacacuauguaaccagaacucuucccuuuaaauaccgcuugucacauuuagaacaguaaggagccuuagugauuauggaggacaucccaguuagagacacgaaaauugaagggcagaguggagaaguaaauuccccagagguacccaugagucuaagucagguuugaaucugcagcccagucagguaucuuuuucccuuguugucagucagccucuugguugaugaaggcauaguuuugaccuuaguggauaguauuccagaguauggaagguagcacuacacuaccuguugcuuuaaccucucaugccuugugacauuacagagcaccuacugugccaccaugguccagcacugugaagcccucaaccggucuguccaaguuguaaaccuggauccagcagcagaacacuucaacuacuccgugauggcugguaaguccugagcaaaggcuccccccaccuucaggaacaguaagggcuggggaggcagugaguacuagcugcuuagcacugauacuuauuauagucuggaucccugguguuaugguaaauagcaugagcuugucauuuggucacaucuguucauggugauaugugugacaguauccuuucuuggucuuugauguaagauuuaaaaguaaauggggccgggcgcggaggcucaugccuguaauuccagcacuuugggaggccgaggcggguggaucacgaggucaggaauuugagaccagccugaccaacauggugaaacccugucucuacuaaaaacacaaaaaaaucagcugggugugguggcaugugacuguaaucccagcuacucaggaggcugagaaaggagaaucgcuugaacccaggagacagagguugcagugagccgagauugcgccacugcacuccagccugggcaacagagcgagacuccaucucaaaaaaaaaaaaaaaaaaaguaaauggacacuucccucagcacccuuucauucugucccuuuuguccuuaguccugcuguagugaaucaugugguauauugcugaucacuauaagucaggagccuggguuuguuuuuuuuaauucuuucaauuuguucauucaagugucuguugaacaccuguuuuacgccagacaccggaguuauagcagagaauaauacagacauuaucccugcccacaccaacccuuuaggaaauaggcaauaaacaacaugaugaacauguuacagaaugugaugacugcagacaggcucaugagaaguacucauugagguugcuuuagcuagaauugucagggagaauggugacucugaggaggggaucuuugagccuagaccugaaggaugguaauaugcuccucaggcugaggaaaguccuuccaaaaugagggaacauuuagaucaauaaauaugccaagcugggugcagggacaugugccuguagucccagcuacuugggaggcugaugugggaggaucacuugagcccaggaguucaaguccagccugggcaacauugcaagauccaucucugaaaaauaaaauaaauaaauaaauagccuggaggugagaaaggauuugguauucuccaggaaagcuaagaugucagugagcuaaagcguaaugucugaaagaaagaaguggguaggggcuaacaggacaugauaagaugggauuuuauccuguugucaguggggugccacuagaggguuuuaagaagaggaaaggauugacauuugauacacguuuugggguuuuuuuuuuuuuuugagacaggguccagcucugucgcccaggcuggagugcagugacacaaccucugccuccugagcucaagccauccucccaucucagccucccaaguagcugggacuacagaugcgugccaccaugccuggcuaauuuuuauacuuuuuuuuuuuuuuuuuuuuuuuuuuuuuuuuuuguagagacaggguuucaccaugcugcccaggcuggucucaaacuccugagcucaagcaaucugcuggccucagucucccaaaguguugggauuagaggcgugagccacugcauccggccuuuuuuuguuuuuguuguuguugucguuuuguuuuugagacaaggucucacucugucacccaggcuauauaguauaguagccugaucacagcucauugcagucucaaccuccuggacucaagcaauccuccuaccucccaaguagcugggacuacaggcacacacuaucaugccuggguaauuuuuguauuuuuuguagaggcgggguuucuccauguugcccaggcuggucucauugcccaggcuggucucgauuuccaggcuggucucaaacuccugggcucaagugacucacccagcuugacuuccgaaagugcugggauaauaggcaugagccaccgcacuuggccugauuuauguuuuaaaaaauaacucaggugcucagaugaaaaauggacucuaguggguugagaguagaaguacaaccugcauggcugggcaugguggcucacgccuguaaucccagcacuuugggaggccgaggcaggcggaucacaaggucaggagaucaagaccaucuuggcuaacacagugaaaccccgucucuacuaaaaauacaaaaaacuagccgggcaugguggcgggcgccuguggucccagcuacuggggaggcugaggcaggagaauggcgugcacccgggaggcggagcuugcggugagccgagaucgcgccacugaacuccagccugggcaacagagcgagacuccgucucaaaaaaaaaaaaauacaaaauuagcuggguguggugacacaugccuguaaucccagcuacucuggaggcugagacaggggaaucgcuugaacccgggaggcagagguucuggugagccgagaucguaccauugcacuccagccugggcaacaagagcaaaacuccauuuuaaaauuaaaaaaagaaguacaaccugcacugccgcuguuguaguuagccagguguacaccaggacuaggguggucacgguggagauguaaggaagcagacagauucaauauauuuugcaaguugaauuaacagcauuuugugggggauugaaccaagaaggcauagcaaaguaaggaaucaagggugaggucuuacagcuuuguucaguguaugauauaauuuccuguggagggagacaggucguuuuagguuuggggacguucucuuugcacucacuaagugcaaagggaaacuucugauuucuguuaaugagugagcagguugcggggaggcagauugaagggagaggaggagaugugaaaugcuuuucuuugagaaaaaaggcauuguauuacuuuggaaccauuuggcugcagcaaacagaaaccacucuaagcuagcuuaguuaaaaagaggacuuaggaugggcgcuaugacugacaccuguaaucccaguacuuugggaggccaaagcagauggauggccugaacccaggaguucaagaccagccugggaagcauggugaaaccccaucucuacaagucaauacaaagauuagccuggcaugcuggcgggugccuuuauucccagccacucaggaggcugaggugggaggaucacuugagccuacgaggucaagguugcagugagccaugauuaugccacugcacuccagccugggcagcagagugagacccugucuaaaaagaaagaaagccagauugauugucccaauuuggaucaguuaucuguuauugauugcugagggaggggguaggaagguguugucaguauaaaugugacugugaaugaagcucaguccuuugugaauggagaauguagguuugagcacaaaaauaaguaaaaaccuaagguagaagauucuauauacugauuccccaaaauuaguaagauaaccauaccagaauuuuuuaagccucuccuguuggugauuuuuuuuuuccugagacagucucucucugccacccaggcuggagugcagugguaccaugucaucucacuacauccucugccuccuggguucaagugauucuccugccucagccucccgagcagcugggauuacaggcacaugccagcacaccugacuaauuuuucuauuuuuguuuguuuuuguuugagauggagucuuuuuuuuuuucaauuuuauaacuuuauuugauguauuugacgaucagugauuaguucucaucgacauugucuguagauuuuugaaaguggugacagguacauagguaaccaaaguauauggcuuauuuggugaaucuucauccucauuacguuuucuggacagcugcacacggauucaguaugggacauuccuuauuccuuuggcccagacagcuuuguugagccugguaucaaugcgcacaucuggaguucccaucuccuucauggcaaauuucugaaucucuuugagugccugaggggcacgcuucuugaagcccacuccauagaugugcuugugaauguugaugguguauucucggguuaccacuucguugauggcagaauggcccuuuuucuucucgccacccuucuuugcaggagccauucugcuggguccaaguuggaaagugagauggagucuugcucugucgccugggcuugagagcaguggcgugaucuuggcucacugcaaccucugccugcuggguucaagugauucuccugccucagccuccggaguggcuagaacuacaggcgugcgccgccaugccugcuaauuuuuguauuuuuaguagagauggggcuucaccauguucgccaggcuggucucgaacuccugaucucaugauccccccaccucggccucccaaagugcugggauuacaggcaugagccaccaugcccagccuaauuucuauauuuuuaguagagacagguuucagcauguuggccaggcuagucuugaacuccugaccucaagugauccgccugccucauccaaagugcugggauuacaggcaggagucaccgcacccagccccugauggugauuuugauauauuaucucauaguucucauccuucuaacccaggauaaggaaagugaggcucaaggaggugaaauaguuuccuuagugucauuguguuaagaaaugguaaucuguuuucuuuuuuugguuuuguacuuuuuuggaauagguaauacauauucacaugguucauaauguaaaaguacuaaagaguaaguauacaggaaaacaucuuccucucagcucugcaucccagcaaucagcuccccucccuggcagcagccaguguuaccaguuucugguguguucuuucauagccugugcacauaaaauucaagauguauauguauuaugucuauguagugaauuuuugucuuuuauuaacaccaaugauagcauucuuacacaguucugcaccuugcauuuuucacugaacaauauaccuaggagauuguauuauuauuaauacuuaaagagauuuuccccauuuauggcuguguaguauuccauugucgggcuguacaauaauuuauuugcucaguucucuauugauggacacugcuacagggaaaagccauguacauaaauaauuuccugcauauggguuuuuuauguaauuauuaacuuuuauguucuauuucuaguaaggauaacaauuuuugaagggacacauauauucugggcccuaucuguccuuuucagacauccgggaacugaucgagguggaugauguaauggaggaugauucucugcgauucggucccaacggaggauugguauuuugcauggaguacuuugccaauaauuuugacuggcuggagaacugucuuggccauguagaggacgacuauauccuuuuugauuguccaggugaaucaacaauuugaaugcauugucuuccuuaaagucuugauaguuccauccuuaguaggagaaaggagagugaguauuuguagcucuaaacuauacugcaguaaaguaccaagcuuauucaauggcugucacuuacuaaguauaucuguugaggccgggcgcaguggcucacgccuguaaucccaucacuuugggaggccgaggcagguggaucacgaggucaggagaucgagaccauccuggcuaacauggugaaacccugucucuacuaaaaauacaaaaaauuagccaggcaugguggcgggcgccuguagucccagcugcucgggaggcugaggcaagagaauggcaugaaccugggagguggagcuugcagugagccaagauuguaccacuacacuccagccugggcaacagaaugagacucugucucaaaaacaaaaaaaaaaaacaaaaaaaaguauaucuauuaagugcuugcuuuguacacugggaauaccauagagcacagauggccauggucucuggccucauggagcucacauuuggcagaacucgagacaguacaaacaaaaagcauccaaaugauuauuuaauauucaguugucauugaguauuccacaggaguagcacagaucaucacacagauaauggcgguuagagaggcaucugaggcggccuuucagcugggcuggaggcugagggugaggaaggcagagggcacagccugcugaacaccucccaggaggaaggaacaaagcuguuuuaaggcacugaaaaggccaguguggcuggagcauaauaaacaaagaggcaauugucaugaggugugacugguaggagacagauaauagcacaucauggcuucugaagccaaaucgugaauuuucuuuuuuuuuuuucuuuuuuuugagacugaguuucauuccugucacccaggcuggaguaugauggcgccaucucggcucacuccagucuccacuuccuggguucaagugauucuccugucucagucucccaaguagcugggauuacaggcacccaccaccacacccggcuauuuuuguauuuuuaguagagacaggguuucacuguguuggccaggcuggucucaaacucuggaccuuaggugauucaccugccucggccucccaaaugcugggauuacuggugugagccaccaccuccagcccaaauugugaauuuucaacuugagccuaaccuggcuuugaccauuuauggcccucacuuuuuuccccuugcuuuuaauugaccauacauauacccacagaaaaguauauaugucauaaguauacagcuugaugaauauucccaaacuauagauaucuuuguagcacuuauuuauuuauuuuuguagagauaggaucucacuauauugcucaggcugcucucaaaguccugggcucaagcuauccucccaccuuagccucccaaagugcugggauuacaggugugugaaccauggcaucuggccaauaacacucauauugauuggcagaaaacuaaagugugaagaaccucauuuucuuucuuucuuucuuuuuuuuuauuuuuaaagacagagucuuacucugucgcccaggcuggagugcaguggcgugaucuuggcucacugcagccuccuccucccggguuuaagcaauucuugugccucagcaucccacaggcgcgcaccaccacgccuggcuaauuuuuguguauuuuuaguagagaugggguuucacuauguuggucaggcuggucuugaacuccuggccucaagugauccaccugccacagccucccaaagugcugggauuacaggcaugagccacccugcccaaccagagaaccucauuuucuacauaaaacuuaauaguuagggauuccuaugguggcaguaccuuagguuuuaugauugcuuugagaggcugugggccccuuaaaaauguguuggcuuuuauuuuuguccaucuuauggggaaaauuuguuuccucuaacuugaugauuuaacauacuugcuauuucuaaaauucuugcaauacucuucauguaggucagauugaguuguacacucaccugccugugaugaaacagcugguccagcagcucgagcagugggaguuccgagucuguggaguuuuucuuguugauucucaguucaugguggagucauucaaggucugaagcuaaaucucuuacagauuuuuuuuuuuuuuuuuuuuuuuuuuuugugugugugacagagucuuacucuguugccuaggcuggagcgcaguggcgugaucucagcucacugcaaccuccgccucccaguucaagugauucuugugccucagccuccugaguagcuggaauuacaggugugugccaucaugccuggcuaauuuuuguauuuuuaguagagacgggguuuuaccauguuggccaggcuggucucaaacuccugaccucaaacaucaagugauccaccugccuuggccucccaaaguucucuuaaagauuuuuaaacuaugaguucaagcagaugacaguuccuuuaauuauugugugauucugaacauuucacaaaugauuccagaguuacuuuaucccuuuuauuauuaaauuauaacauguuguuaaucaaaaauaguaaauuauuauaucauagagauuuaggaggaacugcuuaccaagaaaaaaacugagguugcugggugaagugguucacagcuauaaucuuagcacuuugggaggccaaggcaggaggauugcuugagcccaagaguuucggaccugcuugggcaacagagugagacccugucucuacaaaaaauauaaaaauuagcuagacguuguggcacaugccuguagucccagcuacuugggaagcugaagugggaggaucgcuugaguacaggaagcagagguugcagugagccaagaucgccaagaucgcaccauugcacaccagccugagugacagagugagacucugucucaaaaaaaaaaaaaaagaggaaguagugggggagaaaaaacugaagcagauggcuauuuuauaaaauagucuauuuuuaauuuucugaggaccuuuuguccaguuuaugaacuaccaagaucaaauuuuuuauuaauagcucuuaaggaauauuagaugggaaaggaaauuaaaaugcugucuaaauugaaauuugugaucacuguauguuaucuauaucuucccucaccuuugggaaccaagaaucaagcauuugauucccaaugauuugggaacauuuuuuucuauauggcuagcauuacuuuuaauaaaauauaaauaauuuugccuuuuccacauguucugaacuggcauuucuuuuuuuuuuuuuuuuuuuuugagaccaaguuuugccguuguugcccaggcuggaaugugguggcgcaaucuuggcucacgggaaccuccgccuccuggguucaagugauucuccugccucagacucuugaguagcugggauuacaggcacaugccaccaugccuggcuaauuuuguauuuuuaguagagacaagguuucaccacguuggccaggcuggucuugaacuccugaccugaggugaucugcccgccucagccuccccaaguguugggauuacaggcaugagccaccacguccagcuugcauuucuuuuauuuaggccaguucuguuccagugaggaauagaagacucuuuaugcagaccagguaacuguuggcaacagucaguucaucuucccuuuucuguuuccuccuucaguuuauuucuggcaucuuggcagcccugagugccaugaucucucuagaaauuccgcaagucaacaucaugacaaaaauggaucugcugaguaaaaaagcaaaaaaggaaauugagaagugaguucacuguucuuccauuauuaucagaucucaguugcagagaugaaccuucuguuuuauuuagaugggaaguuuggcugguuuauaaaccuagucuccugaauucaucagucuuucugucuuuuaaagauuuuuagauccagacauguauucuuuauuagaagauucuacaagugacuuaagaagcaaaaaauucaagaaacugacuaaagcuauauguggacugguaagcuuuuaaaguuuggauuuuuuggccaggugcaguggcuaaugccuguaacccuagcacuuuggcaggccaaggcagcaagauugaguccaggaguucaagaccagccugggcaacauagugacacccuaucucuaaaaaaauuuuuuaaauuaggccaggugcaguggcucacaccuguaauccuagcacuuugggaggccaaggcaggcugaucauuugagaucaggaguucaagaccaagccuggccaacauggugaaacccugucucuacuaaaaauacaaaaaaaaauuagcugggcaugguggugugcgccuguaauccuaguacucgggagccugagacaggagaaucacuugaacucgggaggcggagguugcagugaguugagaucaugccacugcaguccagccugggcgacagaguaagacuuugucucaaaaacaaaaaaaaauuaggccaggcgcggugacuuacgccuguaaucccagcucuuugggaggccgagguggguggaucaccugaggucaggaguuugagaccagccuggccaacauggugaaaccccaucucuacuaaaaaauacaaaaauuagccaggcgugguggugcaugccuauaaucccagcuauucgggaggcugaggcaggagaguugcuggaacccaggagguggagguugcagugagccgagaucuugucauugcacuccagcccgguccaacaacagcaagacucugucucaaaaaaaaaaaagccaggcauggugcugcacgccuguagucucagcuacuguggaggcugaggugggaggaucccuugagccugggaggucaaggcuguagugagccaugaucagaucaugucacugugcucuagccuaggcagcagagaaacccuaucucaaaaaaaaacaaaaacaaaaagggcgccaggugugcaguggcucacgccuauaaucccagcacuuugggaggccaaggcagguggaucacuugaggucaggaguucaagaccaggcugaccaacauggugaaaccccgucuguacuaaaaauacaaaauuagccgggcaugguagggcacaccuguaaucccagcuacucaggaggcugaggcaggagaauugcuugaaccuggagguggagguugagcaacaagagcgaaacucugucuccccaaaaaaaaaaaaaaagaaaaaaaaagaugaaguuuuuuggguuuuuuuccuaaacaccuggucaaguguuugccuguguccagucauuugccauauaaaaagcacaguucaacccuauuuucugcaaaguggagggaaaagggcugugggcuggucagucagcaguuuaauuuagaaguaguuauugguaguggccaauaaauaaacuaacaucuuauuauuucaagccauuuggagaguucaggacuguuuguucucuugugaaauuuccagugguuguugaauucagauaaauagccgugaaacagugucuaguuaaaguaauaagcuaacaaguguucuagcagaucagaagucagaaaaaucaaugauuuacucucugugucuagcuaucccuucuccuccucuuccuguaaacacaucaguguuuuuauucagaaguacaaaugguuauaaaacucaaauauaaguugaaaauuauguauuuugcacaacuucagaaugaacuuuucuugaaauccacaacuuguagauugaugacuacagcaugguucgauuuuuaccuuacgaucagucagaugaagaaagcaugaacauuguauugcagcauauugauuuugccauucaauauggagaagaccuagaauuuaaagaaccaaagguaauuucugguuugggguguuuguuagcuuuugauaaaaauauuugccagcacucacuggacucuugcauaauccaggcgacuccuuaaauuaguuuuuugucuuauugauggcaguuaacugggcuuuucugggugaucucugaaauuaacacuguacuccacaagcaguaucacuuuuacucuacuuuuguugaggcaguaugaugaagccuguguguacuuagagcuuggguguauguguaaagaggaggugaaauugggcugcccucacguaugucauugagaagacuaaugauaguaucagcuaagcauuuuuuuauuuuuuuauuuuuuauuuuccugaccacuagacuaccagcgaaguaaagcacuaucacaggaaauuagccaagaaucgucuugaauguaaauucaaaugagaaaugcuucugggauagaagcacauuaauuuacuacauaacuggaaaaaaaucugucaaucaugccuuuucuuacuauuaacaguuaccuauaagcagcaccuggagcuggugcuggguaauuaguuccacauaggguauuaccugaaaaauauauaaacacauacuaguucugacugaggggaaaugaauauauuuucuauuuuguguuuccauugugucaggaacgugaagaugagucuuccucuauguuugacgaauauuuucaagaaugccaggaugaaugaagaguuuacuaaaaguaaccaucuaaagagcuuguggccaaaccagcagaacauucuucucuucaaaggaugcaauaguagaaagcuacuuauuuuaaugaaaaaaaguaaaacuucguucuuuaucagccucaugccugaaucaaauuuuuaauuauucugaaacugcugcuguuuaaaguggaaucuuuuaguauuauaacagcaucacuuuagauuuuguaagucaaaauugaaaugaaugcacauagauuuauauauaaauuagcaccugagcuaagguuaaggcuggucuaaacuuauuuucacuuuuuguauuauuuuugagaugcaggaauuacuguaacaaaauauguauguccgaagggaaaaagcugcaaggauauauauaagaccacugcuuaucuguaucuucccauuuuccuauauugaaaauguauauuauuuauauaacuuaaaaaguaaaaauaacuauguuuugagauauguauguguauauauaaaagaaacaaagguuuuuaaugauucuuggaccuagauaacaagua

SEQ ID NO: 191520 - RNA, 28264 nt, Homo sapiens
gauggaccccggcgacgccgccauuuuggagucuucccuaaggauccucuaccggcuuuucgagucagugcugccgccgcugcccgcggcuuugcagagcaggaugaaugugauagaccacgugcgggacauggcggccgcggggcugcacuccaacgugcggcuccucagcagcuuguuacuuacaaugaguaauaacaacccgugaguugaggcggguagcugccuggggcugaggagaaagcggcggcggucugggagcgggggcucagggcacgugggaacaggcgggaaggagcggccgccggcgccagcggaggcuccggggucugcgagggcguccuggagcggagcagacuucggagcgcaaguuggguucacugggugccggcgucaagucccgcggggauguggcgagcggcggcuuggagacauagaaggcagaggcucugaggacgacccaggcgaggguuuccugaggcaccugucgcggggcagcgcgacugucacaucgcuaggcugaauccuucccucucggcuccuuccagaagaacguuuuuuucucucgcugcagcucagggacccagccuccugguuuuuaugcgcuagcccccgcaucugagauugguccccccguuaaguguaucaggaggguccacuuucuggccuugggaaaccccugaaaacggggccgggcgcgguggcucacgccucuaauacgagcccuuugggaggccgaggcgggaggaucgcuugagcccaggaguucaagaccaaccugggcaacauagggagacccugccucuacgaaaaguaaaaauuaaacaauuagccgggcgugauggugcgugccugcggucccagcuacucgggaggcugaggcaggaggaucgcuugaacccaggaggucgaggcugcagugagccgugaucgcaucauuguccuuuaccgugggcgacagaacgacugccugucucaaaaaaaggaaacgggagacuccauuaaugggugggcguggcgccuuucauguuuccuugaagcacugagcugauuccauccuugagugcaugucccucuccugcuuaauauccuuuauuggccgggcguaguggcucaugccuguaaucccagcacuuugggaggccgaggcgggcggaucacgaggucaggagaucgagaucauccuggcuaacacaguguaaccccgucucugcuuaaaaaauaccaaaaaaauuuagccaggcgugguggcgggcgccuguagucccagcuacucgggaggcugaggcagaagaauaacgugaacccgggaggcggagcuugcagugagccgaaguagcaccacugcacuccagccuggacgacagagcgagacuccgucucaaaaaaaaaaaaaaauccuuuauugcacuuaugaaaauucuuucccauggccucugaaggcaaauaucugcccuccacucucugcgacuucaucucauuacucuguucacugcucucuagccucccuggcuauucuguuauuuguuuuuauuuguuuauuuauuuuuauuuuuuugagacagccucgcucugucgcccaugcuggaguugaguggcgcagucuuggcucacugcagccuccgcuuccuggguucaagcgauccuccugccucagccaaccaaguagcugggauuacaggcgagcgccacacgcccagcuaauuuuuguuauuuuaguagaaacagaguuucacuauauugaccagucuggucuuuuuuuuuuuuuuuuuuuuuuuuugagacggagucucgcucugcacgaucuuggcucacugcaagcuucgccuucuggguucacgccauuauccugccucagccucccgaguagcugggacuacaggcgcccgccaccgcacccagcuaauuuuuuuguauuuuuaguagagacaggguuucacgauggucucgaucuccugaccucgugauccgcccgccucggccucccaaagugcugggauuacaggugugagccaccgcgcccagccgaccagucuggucuucaacuccugaccucuggugaucccgccgccucggccucccaaaguuuaaggauuacaggcgugaaccaucgcuucuggccucuuuguguuauuugaaugcaccaagcguguucucuacucugggcccuuguacuugcuguuccuccugcgacgguccucaucucagcguugccuccuccuucagguuuuagccuggauaucucuccuaaagagccuucucugacucccaggacucucggguacucccacuuuucuacccuucgcaucacccaccaauugaaagcgcaguggcugugcgcaauaagcacucacaugcuuauugaguguguugaggaagugaguacaaccucagggaggugaaauacccuuguccaaguucacacauccaauaaauggaggaguacgaugccuggaccuggucuucucugacuggagagucuccauucugagccaccagucugcuaccuccaaauggcguuauaauggaaacuuuuacucuguagauguauuaguguuuggccugcuguagaagcuggucuaggucagaagggaaaaguccuuuaagugcuuacaaugcagcugcugcugcccauuggauuuucauuagugcacuuugguguuuuguuuuguuuugcuuuucagacggagucuugcuuuguugcccaggcuggagugcaguggugcgaucucggcugacuacagccuccaccucccaggcucaaucgauccucccaccucagccuccugaguagcagggauuacagauucgcaccaccacgcccagcuaauuuuuuuuuuuuuuuuaauagagaugggguuucaucauguuggccaggcuugucuggaacuccugaccucaagugauccccaugacuuaggccucccaaagugcuuggauugcaggcgugagccaccgagcccagccucauuaaugugcuuuggaccuuacuagugagacccacauuuugccaccauccacuucauguugacaggagcccuggucucugucagccuuauguguuuaugcuggagccuuucacuugguucugagugauuugccaaagcauacaguuuccacguuuggagauuuaggcccuaguuacucuuaguucuuaaagauguuacaggauaguuugaaacaguuuaauucucuggcuagacgaaguuuagcccaugcuuuuucauauuggguuagauuggcaguuuccuagcuucaggacauguuuaaguucugaccuucaugauuuauacuuuaaaauuucuuguggaauaggaauagacacuguuaaauucaaacaguggagaaggggcaugcagaucaguaucuuuaccugagucuugaaccucaccccaacauuuccuuucuccagaggcaauaacuauuuuuucgugugucauuacagagauaacuuaaugcauguguaaguagacauguaucuuauaugcauaucugaaugcuuucuguggauguaauaauacuuuuguaucuaagcaucaaaugguuauuucucacuacauacauagaaucacagaguuugaagagaacuuaagucaucuagacuauacucuuuuuguuguuuuuuuucuguuuuucuggggagacugagucucacucugucgccagggcuggagugcaguggcgugaucucggcucacugcaaccuccgccugcuggguucaagcaguucucccucagccuuccaaguagcugggauuacaggcgcccaccaccaugccuggcuaauuuucguauuuuuaguagagacgagguuucaacauguuggccaggcuggucgaacuccugaccucaggugauccucccuccuuggccucccaaagugcugugauuacaggcgugagccaccgcgccuggccccuuuuuuuuuuuuuuuuugucugagacagagucucucucucgucacccaggcuggagugcaguggugggaucuuggcucacugcaaccuccaccucccagguucaagcgauucuccugccucagccucuaaguagcuaggauuauaggcauaagccaccgcacauggccacaauaaugcaauucuguggguuuuaguguauuuacaaaauuguaugaucaucaccaugaucuaacuccagaagguuuucauuaucccaacaaaaagaaaccgugucuauuaguaaucacucuccaauugucccuuccucccgcaaacacuaauguaugaugccuauuuuuuuuuuuuuuuaagagacaagaucucacuauguugaucagacucuaggcucaagcagucuucccaccucaaccucccaaaguguugggauuacaggugugagccacugugccuagcuuguugagaaauuaacuaucuacagaauuauucgacucggcugggcgcaguggcucacgccuguaaucccagcacuuugggaggcugaggcggguggaucaugaggucaggaguuugagaccagcgauggccaacauggcgaaaccccgucucuaccaaaaauacaaaaauuagcugggcgagguggcaggugccuauaauccuagcuacucgggaggcugaggcaggagaauugcuugaacccgggaggcaggggucguagugagccgagauugugccacugcauucuagccugggcgacagaguaagacuccuucucaaaaaaaaaaaaaaaagaauuauucagcucacucuguucuuucauauaagcaacuauaacuuuguuuuucuuguuuuuguuuuuguuuuuggagauggaguuuggcucuuguugcccaggcuggagugcaauggcacacuaucuuggcucaccgcaaccucugccucccagauucaagugauucuccugccucagccucccgaauagcugggauuacaggcaugugccaccacgccaggcuaauuuuguauuuuuaguagagacaggguuucuccauguuggucagguccugaacuuaggugauccacccaccuuggccucacaaagugcugggauuacaacaggcaugagccaccaugccccggccugcuguagcuuuuacuugucaaagaaaaacaguaaacuucuuccucuuauuugggaaggaguggaauuggagguugaaaauaugaguuccucauuaggaaugguggucaacuucuaggcaguuauaauucuugacuguaauacucaagguuaaacaguuuuaaaacauugguuccuuuacacuguccugaaaucccugagacuccaggagguaagaauucuagugcuagugaaguuuacuuuuuuuuuuuucugagacaggguuucauucccuguugcccaggcugguguacaaauggcaugaucuuggcccacugcaacuucugucuccugggcucaagcgauuguccugucuuagccuccuaaguagcugggauuacgggcaugcaccaccaugccuggcuaauuuuuguguuuucuuuuuuuuugagacagaguuucacuugucacccaggcuggagugcaguggcacgaucuuggcucaccccaaccucugccuccuggguucaagucauucuccugccucagccucccagguagcugggauuacaggcacucgccaccgcaccuggcuaauuuuuguauuuuuacuagagacgggguuucaccuuauuggccaggcuagucucaaacucccaaccuucagugaucugccugccucggccucccaaagugcucggauuacaggugcaagcuacugagcucagccuaaauaaacuuuuaucaaggccaauccucuugcuaucccauuggcuuucccgaucuuuuuuuuuuuaaaagacagaguuucacucuugucgcccaggcuggaguguaguggcgcaaucucggcucacagcaaccucugccucccggguucaagcgauucuccugucucaaccucccgaguaggugggauuacaggcaugcgccaccacacccgucuaauuuuguauuuuuaguagagacgguuucaccauguugguuaggcuagucuuaaacuccugaccucaggugauccgccugccuuggugucccaaagugcugggauuacaggcaugagccaccacgcccagccccccauucuccuuuuauaguggcauuuucuuuaguuuuuaguguuuuuuuuuuuuuuugagacgagaucucgcucugucgccaggcuggagugcgagugcaguggcgcgaucucggcuuacuauaaccuccaccuccuagguuaaagcaauucuccugccucagcuucccgaguagcugggacuacaggcgccugccaccacucccagcuaauuuuuguauuuuuaguagagcugggguuccaccguguuggccaggaugaucucgaucuugugaucuugugaucugcccgccucagccucccaaaguggugggguuacaggcgugagccaccgcgccuggccuuucuuuaguauuugaagagcuuucagguuuuuucaaacuucuuuuugugcauugguuuuuuuuuguuguuguugagacggagucuggcucugucgcccaggcuggagugcaguggcaugaucucggcucacuacaggccuccuggguucaugccagucuccugcuucagccucccaaguagcugggacuacaggcgccugccaccacgccuggcuaauuuuuuguauuuuuuaguagagaugggguuucaccgcguuagccaggauggucucgaucuccugaccucgagauccgccccccucagccucccaaagugcugggauuacaggcguaagccaccgcacccagccugugcagccuguuuuuaaaaaggauucaaaguggugagguuucucuguacuucaucuuaauaugagaauauggauagauauaucucagacuguuaaaagggccugguggccaggcaugauggcucacgccuguaaucccagcacuuugggaggccgacgcagguagaucacuugaggucgggaguuugagaccagccuggcuaacauggcgaaaccccaugucuacuaaaaaaaaaaacaaaaauuagcuggguguggugccaugugccuguaaucucagcuacucgggaggcugaggaaggagaaucacuugaacccgggagguggagguugcagugagccgagaucgugccacugcacuccagccugggugacagagugagaaucuauuucaaaaaaaaaaaagaagcugggggagcuuggauugaaagggaggaaaagauguauuacauuuucucuuguuuucuagugaguuauucuccccaccucagaaguaccagcuuuugguguaucaugcagauucucucuuucaugauaaggaauaucggaaugcugugaguaaguauaccauggcuuuacagcagaagaaagcgcuaaguaaaacuucaaaagugagaccuucaacuggaaauucugcaucuacuccacaaagucagguaauuggagauagaauugugauuuuuuuuuuuuuuuuuugagaaagacuccaagaauuuagaacaggguccccaggccccagugccuggucuguuaggaaccaggcugcacagcaggagguggguggagggcuagugaauauuacugccugagcuccgccuccugucagaucagcugcggcauuagauucuuauaggaacacaaacccuauugugaacuacacaugcuaggaucuagguuguguguuccuuauuauaaucugacuaaugccugaagaucugagguggaacaguuucauccugaaaccacccccucaccccccaucuguggaaaaauugucuuucaugaaacugguccccuggugccaaaaagguuggggaccgcugauuuagaugauagcugauuagauguagaagaugaggccagaagcugggcgcaguggcucacgccuguaaucccagcacuuugggaggccuaggcgggcggaucacgaggucaggagauugaaaccauccuggcuaacacggugaaacgccgucucuacuaaaaauacaaaaaauuagccaggcauggugguggaugccuguagucccagcuacuugggaggcugaggcaggagacaccagccugggugacagaacgagacucugucucaaaaaaaaaaaaagaagaugaggccaggcacaguggcucacaccuguaauccaagcacuuccagaggcggagguaggaggacuugaggucaggaguuugagacuagccuuggcaacauagugagaccccugucuuuacaaaacggcaugguggcacauaccuguaguacucagaaggccaaggugggaggaucgcuugagacuaggagucuaagacugcaguaaaucauguuugcaccacugcauugcagccugggcaacagagcgagacccugucucaaaaaaaaaaaaaagaauugcugggucauaugauaacucuauguuuaacguuuugaagaacugucauauuguuggaauaacguuucaaagaaauauuuccauugucuuuuagugucuuccaucugaaauugaagugaaauacaaaauggcugaauguuauacaaugcuaaaacaagauaaagaugccauugcuauacuugaugggaucccuucaagacaaagaacucccaaaguaaguugaauguuuauguguuuuucuccucagcucuccuaacccugcucccucucuccauguuuucucaugcauuaaggaguccgugugaacauuuuacccaugauucuaauucucauuuucuuccucuucauggagugggggugggggacccugaaaauccagcugaugaaaaugauagcuggagaauacuacacaugcuuauucuuuguuuuuucuuuuuuauuuuuuauguuuaacuuaauuuaauauuuuuugagacagagucucacugucacccaggcuacaguacaguguugugauccuggcucacugcagcuucaaccucccaggcuuaagcaauccucccaccucagccucccaaauagcugggauuacaguugcaugcugccacacccagcuaauuuuuuuuuuuuuuuuuuuuuuuuuuugagguggaauuucacucuuguugcccaggcuggagugcaauagcaugggggcucacugcaaaguugcccaggcuggagugcaauagcaugggggcucacugcaaccuccaucucccaaguacaagugauucuccugccucagccucccgaguagcugggauuauaggcgccugccaccacgccaggcuaauuuuuuuguauuuuuaguagagaugggguuuugccauguuggccaggcuggucuugaacuccugaccucaggugauccgcccaccucggccucccaaaguguugggauuacaggcgggagccaccgcaccuggccaauuuuuuuuauuuuugguagagauaagguuccacuguguugcccagguuggucucaaacuccugggcucaaacuguccucccacuuuggccucccaaagugcugggauuacaggugugagaugccacuccaagccuauuuuuuauuuuuguuuuguuuuuuuuguuuugagacagagucuugcucuguugcccaggcuggagugcaguggugcgaucucggcucauugcaaccaccaccucccggguucaagugauucuccugccucagccuccuggguagcugggauuacaggcacccgccaccacgcccagcuaauuuuuuuuuuguauuuuuaguagagaugguguuucaccauguuggccaggcuggucucgaacuccugacuuugugauucgccugccacggccucccaaagugcuaggauuacaggcgugagccaccauguccggcuauuuuuuuuuuuuuuuuuuuuuugagagggaguuucgcucuuggugcccaggcuggagugcaauggugcaaucucagcucacugcaaccucugccucccggguucaagcaguucuccugccucagucucccaaauagcugggauuacaggcaugcgccaccaugcccaacuaauuuuguaauuuuaguagagacuggguuucuccauguuggucaggcuggucuugaacucccgacuucaggugauccacccaccucggccucacagagugcugggguuacaggugggagccaccaugcccggccaauuuuuuuuuucuuuuuuuuaaauagagauggucuccaccauuugcccagguuggucccaaacuucugggcucaaguuguccuccccccuuagccucccaaauugcugggauuacaggcaggagccacugcaccuggccuccuuguguuuguuuuuguuuuuaagugaaagugaguuuauuaauaaaauaaaggaauaaagaauggcuacuccauaggcagagaagacuuugauauuucuuauuauaggaaauaaugauuuauuugcaaaacacuuccagguggcaaaaauacuuuuuuagaacuucauuuuuugccuuccauagguguacacauuugguaaugggggugguuuuauuccuuuguuuugaaaauuaauacuguaagauucuuuuauccuuauuuauguguagaauaugucuuuguguuugauuuggcagcauauuauagugaagaaaacaccuuuaacuaaaaucaaaagaucuggugucggcugggcaugguggcucaugccuguaaucccagcacuuugggaggccgaggugggugaaucaucugagguugggaguucgagaccagcuugaccaacauggagaaaccccgucucuacuaaaaauauaaaauuagccgggugugguggcgcaugccuguaaucucagcuacucuggaggcugaggcaggagaaucgcuugaacccaggaggcagagguugcggugagccgacguggugccauugcacuccagccugggcaacaagagugaaacuccaucucaaaaaaaacaaaaaaacaaacaaaaaaagaucuggugucuaguuugaguuuaggugcauacaagcugugugcagugugaacuugggcaaguuaccaauuugugagcuuuacuacuuuuuuauuuauaaaaugagaagaauaguauuuuuucuguuacuuuuauaaauaccaaauaaauucaugaaugugagaauauaucaguauuuaauauucuaauaauacugucaugucuccugccuugcucauuuuauugaaaaacuguuuugugcaacuugugcuuaacaauaaggaauuuuauagguaaaaugacaggugcauccuccugccuuuaaaagauacgaaaucuaagcaguaggggccugguguauuuuaguuagugcugcuucauccaagucuugcugaacuuuaaaaguaaccaaacuugaugagaacauguuuaagcaccuccucauauuaagguauuauuuacuauuuucugaguuuuugaagcuauuucuucaguaugaugguggcugcuauuaaaaacacuugaaaguuuauuaugaauuaaccucucucaucauaagccuggaugcuguauacuaaauccuguucugguaaccuaugaaagucuucucuuacuccaagaauaaucuuguugcacagaugaagaaugucugcugcaaugcucaagguaucuuccuuuuguaagaagccuuuuuuuuuuuuuuuuuuuuuuuugugagguggagucuugcuguguugccaggcuggagugcaguggcacaaucuuggcucacugcaaccuccaccucccggguucaagcgauuccccuaccucagccucccgaguagcugggacuacaggcgugugccaccacgcccagcuacuuuuuugcauuuuaguggagacgggguuucaccauguuggccaggauggucucgaucugaccuuaggugauccgccugccuuggccucccaaagugcugggauuacaggcaugagccaccacgcccggccaagaagccauuuuaauuauaaacuuugaaggauacuauuccuuacuuuauuagaaauauaccauaaucuccuucauaaugaccuguggauauuuguaggacuuuuuuuugaaaauaguaauguuaaagcaucucagcuuuauagcauccacugcuugauuuucauugccaucauucuuagagcaccuguaugagucugcauuugucagcaguacauauccuucauucuguagugcucuuacagcuaggagcaaagaugugugccucaaacauaaaccuauaacauuuacaguuuuucuuucuugucuguuagggaguuaacuggcuucucagucuauguaaaggacaaggaagugagucaaaaugugucuaaaugaaugucuguuaauauaugguaaacaucgccacauauucccucacauuuuaaaggaaaauuccaguguuagauuauuaaaucuugguaaaucuucaccuuuuaagaguaaacauaccaacauagaauuucuuacucaguuuuuagaaaaugaugacugcuuguguuuauaacugguggaauguggcuuuaugauguuuuuaagugaguaucuauuuuuaaaauaguugacuuuuuuuguuuguuuguuugagauggagucucucucuguugcccaggcuggagugcaauggcaugaucucagcucacugcaaccuccaccuccuggguucaagcgauucuccugucucagccuccugaguagcugguacuacaggcgcguaccgcugcaccugccuaauuuuuuguauucuaguagagacgggguuucaccauguuggccaggcuggucucgaucuccugaccucgugauccacccaccucggccucccaaagugcuaggauuagaggugugaaccacugcgcccggccaauaauugacuuuuucauuagguauuacucaaaacucauucuuuuaaagugacagucaaguagcuuaaaggaaauuuugauauuuguugagaaagauaguccaucagucauaguuuguuaauauaaccagcagucaagaaaggaucuuaaauuuaacuuuuuauucuuuacaaguauugacaucaauccuggaguuuuccuuuuaaguauuuuucuuugcauuuucaaaauaguagccuaauauggaaaaucugaggccaaguaaaaaauaguuuuauuuuuaguauuucauuauuccauuguuugaauuagugugaaucaaugcuauauuagauuguuuuauauaauguaggucuauaauuggaacagauguucuuuaucuuuagagccacucuuucuauaaauaucuggcauaccaagccacaguuaaaucgaagagauuggggguugaccuuuuuucuuuugugcccucacauugacugcuuccuuagguuaaugaucuagcaaauacuguuguguuuaaaaucuacuaauuuugccagacacgguggcucacgccuguaaucccagcacuuugggaggccgaggugguuggaucaccugaggucaggaguucaagaccagccuggccaacauggugaaacaccaucucuacuuaaaauacaaaaaaaaaauuagcugggcgugguggcgggugccuguaaucccagcuacucaggaggcugaggcaggagaaucacuugaacccaggaggcagagguugcagugagcugagaucgugccaucgcacucuagccugggugacaagcgugaaacuccgucucaaaaaaaaaaaucuaauuuuaaauuggaauauuguguuuaucuguguacuauuaggaaggucuuuuaucacuugccuauaacuucuacauucuuaggaacuuuuagauuuucuggcuuuuuuuuuguuuuuguggguuuuuuuuguuguuuuuugagacggagucucgcucugucucccagucuggagugcaguggcacgaucucggcucacugcaagcucugccuuccggguucacgucauucuccuuccucagccuccugaguagcugggacuacaggcgcccgccaccacgcccagcuaauuuuuuguauuuuuuaguagagacgggguuucacuguguuagccgggauggucucaaucuccugaccucguaauccacccaccucggccucccaaagugcugggauuacaggcaugagccacugcgcccggccagaacuuuuagauuuucucauuucccaguugcauguuagguaggauuauuuuaauuuagcuuuacaaaguuacauauuuaaauuacgcuaaaaugcagcugucugcacucacuggauuuaaauaguguagcugauuuuuguagcauuacuuuagugaguuaguaccuacgggccaaagccuuaaguguuagaaaggcuagagucuagccacaagucgaauugucaaagaaaagccaaguauuauacuucuuuaucugucuuucuguaucauuuccuuauuaggaaaaacugagcugauccuucuuaacuagcuaugucaagaguuucucacuuucuuaugugagauaguucaucuucuguuuuaagaucaagaaagaaucaaguuaacuagcguucucuaccauuucuuaaaugaauguuauuccaguuuccagagggcagcgucuuuuguucagauauuacugggccuugugggaagguaaugugacuuuccucuuagggaaggcaggagcuagggaaaggaaggguaguaauuucuuuucuuuucuuuuuuuuuuuuuuuuuuuuuaagauggagucucacucuguagcccaggcuggagugcaguggcgugaugucgguucacugcaagcuccgccucccgguuucacaccauucuccugccucagccucccgaguagcugggacuacaggcucccgccaccacgcccagcuaauuuuuuuguauuuuuuaguagagacgggguuucacuguguuagccgggauggucucaaucuccugaccucgugauccacccaccucggccucccaaagugcugggauuacaggcgugagccacugcaccuggccaauuucuucuuucuuuugaagaauggggucagucugccuuuauuugcacaggguuguggguagauuuuccaguaaaaaguaaauaacugguaaugaaaauuaggacuuuuucauggugagagauuuucuuugcaauauacgcuuauuuugcuaucuguuauuuguguuuguacagauaaacaugaugcuggcaaaccuguacaagaaggcuggucaggagcgcccuucagucaccagcuauaaggaggugcugaggcagugcccauuagcccuugaugccauucuagguagagauauuuccugccuguuuucauggcauguuuacugucaaagauaguaguucucaaucuugccuguacauuagaauaacuuuauuuuuuuuaaaaguuccccugaagagagugauuuaguaggauuccuguugucacauauucaaucaagaaauacuuaauuaugguuuuuggccgggcaugguggcuuacaccuguaauucuagcaccuugggaggcugagguggguggauugccugagcucagcaggucgagaccagccugggcaacauggcacaaccccgucucuacuaaaaauacaaaaauuagccaggcaugguggcgcgugccuguagucccagcuucucggaaggcuggggcaugaguaucgcuugaacccaggaggcagagguugcagugagcugagauugugccacugcauuccagcccagggggacagaacaagacacugucucaaaaagaaaagaaauacuaaauuaugguuuuucucucaugcaucgcucagaauagggaagcaguugccuuuuagccaagggaagauguagcccguugcuccuugcauguggaagagagauaucgugccuuacuuucuuucuucugcuuucuguugguuuaggcuuguugucccuuucuguaaaaggggcagagguggcauccaugacaaugaaugugauccaaaccgugccuaacuuggacuggcucucuguguggaucaaagcguaugcuuuugugcacacuggugacaacucaagagcaaucaguaccaucuggugagagccacaaaguuaauucaguguucuugaggcccuuugcuugucuggaagucugauguaucugaaguagcaaaaagaaaaaugagaugcuuugcuguuggugcugcagccagucucugggauguguuagucuuuuauacugaauggucccaaauguaaucauguaaucaucucuguuggagaccuguaaaaauagaaaucugacugaguuuagcucugugccugcacagguaguaacccuugcaaagcaaagcaggcuaccuuggugugucauuuuuuuuuuuuuuuuugagacaaggucggucucucucucucucucucucucucucucucucucucucucucucucucugucucucucucucucugucucucucucucugucucucucucucucugccucucucucucucucugucucucugucucucucucucucucucucucugucucucucucucucucucucucucucucucugucucucugucucucugucucucucucucucucucucucucccaggcuagagugcaguggcgcagucacagcucaguguagccuugaccugucaaucucccgggcucaaaccauccuccugcucagccuccugaguaucugggacuacaggcgcaugccaccacacccagcuaauuuuuguauguuuuuguagagaugggauuucaccauguugcccaagcuggucuugaauuccugggcucaagugauucucccacgugggccucccaaagugcugggauuauagacgugagccaccaugccuggccuugguguaucauucuucagccuggaagaaaaucauuuugcacucaccagaagcuugguuuauugcagugucuaaccuagcuugccugcuuaggacuagggauuuucuuuauauucagauaaaguucaaggacaagaagagacuugggcuuguguuaugcaaagucguuuacuugaguaauaaauaggugucacuugugaaugacauuaccuuuaacaccauguagcguauguuguguucugaagaacugcaaccacagaguuauuuguugguacugagagacuucugcuuuauucuuuguuuuugcuauccuguccuauauaacuuuuuuuaaagucauaagcuuaaaguuuuuuauuacgaagaauuuuauauuuaugcaaaagaaaauaguaucuguaugaccaaucauccagauucagcaacuaagaggauuuauaauagauuuaaagguucaauguuuaauaaauaucuuaaaguucacuagagaaaaaauccuuauugcgagauaacguggaccuauugggaagcuuggcagaucuguacuucagagcuggagacaauaaaaacucuguccucaaguuugaacaggcacagauguuggauccuuaucugauaaaagguaaguaauucuuggggcaggaagacaguggcuguuguugggggggaucagagauaauagggagaauaugcagcauuaauacucgauaccaaguuucauagaaaugguguauaaaacuuauacuagucuuuuacuuuuuuuaggucaugacacaugucucuaacgcuuagguaauaccauuugagcagcuguuuuugcuugaauucaagugucuucuccccacagaucauuauuuggcuuuuuuucuuuugagggggucauagcuccuccuuaugacuuauaaauuuauggugugccugacugagaauuuggauggcaucccuaaaaccauaauauccuuuuagggaauuuuguuuugccauguccuuaguauaauuaaaaaggaauaagaaagggauaaggugauuaaaggcaguaauuaggcgugaacaacagaaaaaucacugaucuugaaaaagauugcaggugaaggguaaucuucacagggaccuccaacagauggcaguuaggacacuggcagugaguucucaggaauagugggaaauaaggucagauagauaugcugucuauuuguaaagguccaaaaaaggccaucagaaaaacagggccuugugacaauaaacagucuuaugagcucuuaagccaggggaaugauggagcugggaaggggccaucccaagcguuuagaugaggaagcagaucuagaaggauggauuuguuugcacaagaucuccccucaccucaagugcuuauuccucuucuccaagcugccugcacccaugaugaaaaugauguuuuagaaauacuagucuggcaacagcuggcagcuuggaauggcaauggcagcuuggaaucucagacccaggcccaggggcuagcaggagcauugcaguaaucuuggcuugagaggaauuuucaugggaaucugaagggauagcaagggauggaagagaaugguggcaagagauggguaacagugagcauaggucccuuuuuauagaaugugggugagaauaaagcgggggcugcggagaggcagugauuuuuuauuuguuuguuugagacggaguuucacucuugucgcccaggcaggagugcaguggcacaaucucugcucacugcaaccuccgccuccugguuaaagugacucucccaccucagccucccgaguagcugggauuauaggcgcccgccaccacacccaacuaauuuuuguauuuuuuuagaagagacggggguuucaccauguuagccaggcuggucugcaacuccugaccuuagguaauccacccgccucagucucccuaaguguugggauuacaggccugagccacugcacccagcccgaggcagugaucuuuaaugaacugcauucuggauagaacuacaagcuuuuuucuggaauaggccaacuuuuucugagacugauuggcuuuucagcaguguauuucugauggucuagaacucugggaagagagaccuuaguugaugccuuuuuugggccuuuucugguuggguuaggguagcuguguaucacaccacaggauagaaggacaagcacuuccugaaaauagcaggcuuucaaauugugagguagguuguucugcuccuuugguuuuuuguuuuuuuuguuuuuuuuuguuuuuuuuuugugagacagagucucacaggcuggagugcaguggugcaaucucggcucacugcaaccuccaccuccugguuuaagcaauuuucugccucagccucuugaguagcugggauuacaggugugugccaccacgccuggcuaguuuuuguauuuuuaguagagaugggguuucacuaucuuggccaggcuggucuugaauuuccaccucggccucccaaagugcugggauuauaggcaugagucaccgugcccggccuccuuugguuuugguuuugguuuuguuguuagagacagggucucacucugucacucaggcgggaguggcacaaacauagcucacugcagccuugaccuccugggcucaagcaauccuccugccuuagcccccugaguagcugggaccacaggcaugugccacugugcuuggcuaauuuuuuuuucuuucuauuuuauuuuacuuuauuuuauuuuauguuuuagacauagucuuacucuguugcccaggcuggagugcaguggugcaaucucggcucacugcaacauccgcccucugaguucaagcaauucuccugccucagccucccgaguagcugguauuacaggcgccugccacugugccuggcuaauuuuuuguauuuuuaguagagacgggguuucaccaucuuggccaggcuggucuugaacuccugaccucgugauccaccugccucagccucccaaagugcugggauuacaggcaugagccaccgcgccuggcccuucuuuuuucuuuuuuuuuucuuuuuuuuuuuuuuuuuuuuuuugagacggagucucgcucuguagccaaggcuagagugcaguggcacgaucuuggcucacugcaaccuccgccucccugauucaagcgauucuccugccucagccuccugaguagcugggauuacaggcacacgccaccaugcccagcuaauuuuuguauuuuuaguagagaugggguuucaccuguuagccuagucucgaacuccugaccucgugaucugcccuccuuggccucccaaagugcuggguuuacaggcaugaaccacugcaccuggccacuuggcugauauuuuaaaauuucuuuagagacagggucucaccauauugcccaggcuggucuugaacuccugggcccaggugauccuccugccucugccacccagagugccaggauuacaggugugagccaccacgcccagcuggguuuugcauuuucuuuuuuugagacagagucucagucugucacccaggcagugcaguggcgugaucucggcucacugcaaccucugucucccugguucaagugauccuccugccucagccucccaaguagcugggauuacaggcgcgugccacuaugcccggcuaauuuuuuguauuuucaguagagaugagguuucaccguguuagccaggauggucucgaucuccugaccucgugauccaccugccucggcuucuuaaagugcuggaauuacaggugugagccacugugcccaaccuggguuuugcauuuuaauagucacuuuguaggaaacuggaaauaguaguuggaggagccugugaugguggaaagggcuuagccccugcaggagcuggggccucagcauggggucugauguugggugcuacuccuguaugugggaccccugcuucucuucuuaaaacaccucuucucacuauguccuucucuucuaggaauggauguauauggcuaccuacuggcacgagaagggcggcuagaggauguugagaaccuuggaugccgccuuuucaauaucucugaucagcaugcagaaccgugggugguuucuggguaugauuaugcauucucuuuucuccccaguugucaguagauuaagagauaaugguugcucuugaagagaauauaaauugaaagcacagguuuaagagguaaucaccuggacaggcaugguggcucaugccuguaaucucaacacuuugggagacugagacagguggauugcuugaacccaggaggcagagguugcagugagccaagaucgugccacugcacuccaggugggcggcagagugagauuuugucucaaaaauaaauaaauaaaaauaaaaagagguaauuacuugaggccagaaauuugagaccagcaugggcaauguagcaagacccugucucuauaaauauauauauauauauauauauauauauauauauuuuuuuuuuuuuuuuuuuuuaaaaggauaaucagcccuggauucaaauaauaguuuaugacucuggaugcauuauuuaccuaucuaggucuguauucucauuuggaaaaugggcuaauaaccucuccuucuaggguuaagcauuaacugaguuggugaaugcauugugcuuaguacugagccaucagugauggggccagaagaugcuccuuuguuuauuaaccuggcuuuacaaauucucugaaugccucucugcuaauaacuaauauccagaucauagguucuuuuucauaauuuuucucuuccauaucaagauuuccccuuaaaaauaaauaguggauuuuuugguuuguuuugcuuuucuacuaauaucuuagguuaaaacuauaagugugguuuggaauaaggauuauguucagggccuucaauaugauuuuuggaucaacuuucuuuguagucuucucuuggauaacuucugggguuuuuguguuuuuuuuuuuuuuuuuuucuccagcugucacagcuucuauagcaaacgcuacucccgggcccucuauuuaggagccaaggccauucagcugaacaguaauaguguucaagcucugcuacuuaagggagcagcacuuaggaacaugggcagaguccaagaagcaauaauccacuuucgggaggccauacggcucgcaccuugucgcuuagauuguuaugaagguaagaaagaaaacauaggugaauggugugaauccguggguguggcagcagcccucagauggaagguuucauuaggccagcacuucccaaacucuguuagaauaaucuggggaagcuggccggacgugguggcucacaccuguaaucucagcacuuugggaggccgagacgggcagaucaugaggucaagagauugagaccauccuggccaacguggugaaaccccgucucuacuaaaaauacaaaaauuagcugggcaugguggcucacaccuguagucccagcuacuugggaggcugaagcaggauaaucacuugaaccugggaggcggagguugcagugagccaagauugcgccacugcacuccagccuggcgacagagcaagacuccaucuauuaaaacaacaacaacaacaacaaaaaaacaucauccggggaagcuuuucaauauccugacguugggucucuccaguguagauggaaauacauggaauugggaauagacaucgauauuuuuggagguccccagggguuaccaaugugcagacagguuugggaaccacugcauuaggcauuuuacauuuauuuagggcuuucacuggauuugucaccccauacuuucauaauccauuuuuucugauuuuuuuucugguuuuuggugaggguauaguugggaugggguuuuuuuuuuuuguccucccaccgcucgcccccauccaguguggcguacucauuaauaugaaucucucugugucagacaccaugcaagaucacuuaguuugccuauuuuuuuucucuuacuccucuuuuuuuugagacagagucucgcuuuguugcccaggcuggagugcaguggcaugaucucggcucacugcaggcuccaccucccggguuaaugccauucuccugccucagccuccccaguagcuaggauuacaccuggcuaauuuuuuguauuuuuaguagagacaguguuucaccgugcuagccaggauggucucaaucuucugaccucgugauccgcccgccucggccucccaaagugcuaggauuacaggcgugagccaccgugcccggguccuguuuuuuuuuuuuuuuuuugagacagagucucgcccugucacccaggcuggagugcaguggcaugaucuuggcucauugcaaccuccaccuuccggguucaaaccauucuccugccucagccucccaaguagcugggauuauaggcgcccaccaccacacccagcuaauuuuuguauuuuuuagugagauggaguuucaccauguuggccaggcuggucucgaacuccugaccucgugagcugccugccuuggccucccaaaguucugggauuacaggcaugagccaccacaaccggccuauuuuuuuuauuuuuauuugagauagagucucacucugucacccaggcuggagugcaguggugcaaucucagcucacugcaaccuccacuugccggguuuaagugauucuccugcuucagccuccugaguagcugggauuacaggcauacaccaccacacccagcucauuuuuguauuuuuaguagagaugggguuucgccauguuagccaggcuggucccgaacuccugggcuuaagugaucugcccaauucagccuccuaaagugcugggauuacagacgugaaccacuguacauggccuguuaggccuauucuuuuucguggccaucuuaccuugggccagaguuaguacucgugggauaacuccacauccauaugauaguguuggcugugggaaugggucuguucauugugaccuccagagugggcacaaucaggguccaacuuuguuuuguuauguaauauuuuaaguucaugugaauugacccugggaguucaaaggagcugugccaguuucagcaacguuuggugacucagucacagacauuaaaauagaucuuacaagaugcaguuccuccaaaacauauuuuuauaagcauuuaaaaauaaaccuaggagucuaggagugauuugcucuuaacaggaagaugaguucaaauuugagaaauaaaauuuggauguugggaaagagaacaaaucugcuuauauagccagagagcuaugccucuggauuuguugagggggaaagaguauugucuuuguucugaaagaagcucuagcaaaccaaccauugauuucagauuaacuucuugauccugaaacuguaacuucccugucuucccagcugcuguuaaucauguuaauuccauuauacugcaugccuauuucaccagagcucagggaugcgguugaauaguccguccuauaauauuuggacagcggauguuucccaguuggccagugaggcuucuuaagcugccauuuggagauuuaggucagggcaacucugacuacacccuuugauauuucuuacaguuuccaguuggagcuuccuucuuuugcugguagagauuuagguuaggcaagugcauucuguuuuuuucugaaguuccaguagggcuuuagcagggaaguaaaacuauucaguaaguaauugcaaacaacuguauguggaauccaacauguugcccuuaagaguuagguaauuggcuggguaugguggcucaugccuguaguccuagcacuuugggaggcugaggcggguggaacaccugacgucaggaguucgagaccagccuagccaacauggugaacuaccaucucuacuaaaaauagaaacaaauuuagccaggcaugguggugcacgccuguagucccagcuacuugggaggcugaggcaggagaauugcuugaacccaggagacauggguugcagugagccgagaugucaccacugcccuccagccugggugacagagcaagacuccauuucaaaaaaaaaaaaaaaaauaguuagaguuagguaauuucugguuaaguaaccauaguguguggaagggugugcaugaauguuauaaaugcugcuaggguggaggaguaugcagagaaaaucugccaaggauuguguggguuugggguuuuaagcuguuuuuuuguuuugaugagcacuuugugccaaaaaguuauuccucuguucuccucaacuuacuggcaugaagaguugagaguugacucuucucaagguggccuccucauagggcgucucgcuguggguguggaaagaggcaagggcugccaguugcagucuguuuggugcaugugguaaguacuguucaucucguuuagggaagcccucagcaagugccuuuugagacagcuguuacguuucaaauaaaagagucuuucucccuaaguugcuugacaauaaguccuuuauuugucaaacuguaaauucacuuuaagacucuaggagccaggccaggcacgguggcuuacgccuguaauccuaauacuuugggaggcugagcugggcggaucaccugaggucaggaguucgagagcagccugaccaacauggagaaaccccgucucuacuaaaaauacaaaacuagccgggugugguggugcaugcuuguaaucccagcuacucgggaggcugagggaggagaaucgcuugaacccgggaggcggagauugcagugagccgagauggcgccauugcgcuccagccugggcaacgagagugaaacucugucgcaaaaaaaauaaauaauaaaauaaagacccuaggagucuuccaucuuaaaccuagcccuacaggugaccgaaugcagcuggagaauaacugcuuguuaagaggcagcaaaaccuuggguuuuguugggaacaucaucucucacuacuuugaucucuuggccauaugacagacuaaucauuagugucgcauuuauucuuccaguggucagauggggugcucacaugcugcagguuccuuacaugugcuuguuuccuucccuaaacugaaggugccuuugaaggcagucuuuuucuacauccaucaaguucucuggggaagagcacuucuuagcuauuccaucaacacucuugccagucuaaucucaccaucaguuucccguggccugcccuuugucugaaacuuugaagguuagcaauuuggagagcugucagaguggaagcauggguuggaaugguaauggcauugaaugucuucacguguuuuacuuuuuucaggucuuaucgaauguuacuuagccuccaacaguauucgagaagcaaugguaauggcuaacaacguuuacaaaacucugggagcaaaugcacagacccuuacccuuuuagccaccguuugucuugaagacccagugacacaggagaaagccaaaacauuauuagauaaagcccugacccaaaggccagauuacauuaaggcuguggugaaaaaagcagaacuacuuaguaagugugucuuauuuucuguccuguucaucauuaauuuuuauaaaaccugaccucaguuggagccccuugucccagcuaguuacagaugacuagacaggugugugccuuuugcagcaggucugagccugcuuggauugguuuauauuuagcccaaccaaacguagcuggcuuagaucugcuuggcuugguuccaaccaccuauaauugguugguaucuauucggcucacuaauuuuuuuuuuuuuuuuuuuuuugagacggcaucuugcucugucacccaggcuggagugcaguggugcgaucucagcucacugcaaccuccgccucccggguucaagcaauucuucugccucagccuccugaguagcugggacuacaggcgugcaccaccaugcccagcuaauuuuuuuauuuuuuauuauuuuuuuuuauaguagagaugggguuucaccauauuggccaggccgguuucgaaauccugaccuugugauccacccgccucggccucccaaaguggugggauuauaggugugagccaccgugcccagccucggcucacuguuaucugguuugaguuguccugaauuaguuggagcugaauauaacuaacugauuuuagccauuuugaguggagcuaucuggaugauuuuaugacuucccguuuggcccuuuuuuuuuuuuuucaguccugauuuaugauaaacucauaauuugguucauugaauuugggcuaguuggcaaagcaguuuggcuuuuuaaaguuaagagcccauuuaaaacauuauaauucaaacugcaaauuucuuuuuuuuuuuuuuuuuugagauggagucucgcucuguugcccagacuggaguguaguggcacaaucacggcucacugcaagcuccgccuccuggguucaggccauucaccugccucagccucccgaguagcugggacuacaggcaccugccaccaagcccggcuaauuuuuuguauuuuuaguagagacgggguuucacuguguuagccaggauggaaaauuucuuaacugaauagggcuucaggugugcuugcccucgcuuuguguugcaccaguguucucuugaggaugucugcaaagagauggucagaaugguaguugugguuuuuuuguacaugacuuaagugagggucuuuuuuauucccccaggcagagaacagaaauaugaagauggaauugcuuugcugaggaacgcacuggcuaaucagagugacuguguccugcaucggauccuaggagauuuccuuguagcugucaaugaguaucaggaggcaauggaccaguauaguauagcacuaagguaggcacuagccucccuugggggaaggccacugaggaggguagaggaggcagugagcugugucacaggaguuauggaaacacacacacacuuuguguccaugguugaaagcagaauaauaauaguaaugguagaagaguuauuugugaauucaugacuucuaaaaauuuuuucuuaaaauauauuaacaacauuagagaacuguuucacucauaaccaucccacaccacuauaacaucuguguucauuuguauagcucaucuucuguccuugcccacacacacauauuuuuauagggcuguaccuaguauauauuuuauauucuucuuuuucaaaucaaaguauuguaaguacuuucccauguuucuaucuacuguagucauuaagaacuugaggucugaaguuuugaauacuaccuucaccaccugugaucuugggcaaguuacuaacacauuuccuugucuauaucuagcuaccuuauuagauauuaaaugaucgaaugaggguuaaaugauuauuucauguaaagcucuuagcccugugccugguacauaguaaaugcuaaauaaauagugguauucuuacuguuuaauacagaa

SEQ ID NO: 191521 - RNA, 18268 nt, Homo sapiens
aguccagcacuaaaggauccccacuaagggcuguucaccugccccagggacucagaacacacaugacucuccccacuugagcucaggaucccggcauuacacggggcgcgcugagccccagaugucccuaaccccuuuccagcacccuccagccuugcagaagcagccaccaugccagucucuaagugcccaaaaaagucggagucccuguggaaggggugggaccggaaggcccagaggaacggccugcggagccagguauacgcugugaauggcgacuacuaugugggcgaguggaaggacaacgugaaacacggugagugggacuccgggacgggcggccggaguggggucagagccacagugggcaacagggccaggaaggcagagugcagagcucacuggggacaugagauguguccccaaggcucccccagggugagcgcuggcccaggccagcugggggccuucacaugcuggggcuucugaacaaacucagcccugacuucaacugagugagggucucaggaccagcaguggacagagggucuugagaaacuggccugcccccggggcucugggaccuagggggcucaguuccugccuucugagaccuggguuaagcacugggcuggcuggcaacaagaaaagccacgccccugaagccagcuugcagugggguucugggcuucgcauucagcugugaugcucugcagagggcugagcgccaggcacaagggaggacccccuacuccaucccacaaggaggagcuggggcuccaagucugaccagcagggggcaaagggguccuguugauacaaacuaaauccugacuggggaaaaaaauaaagaaaaaagagcuuuuauuuuaaaauguggcacugcugcucacuccagucuugcaauuccagacucuguacucuuuuuuuuugaggggacaaggucuugcucugucucaaaaaaacaggcuggagugcaguggugccuucauagcucacugcagccucgagauccugggcucaagcaauccuccuguccaagccuccugaauugcugggauuacaagugggagucacugugccuggcuagauucugugcucuuuuuauuuuuuuagacggaguuucacucuuguugcccacgcuggagugcaauggcacgaucuuggcucaccgcaaccucuaccucccgaguucaggcgauucuccugccucagccuccagaguagcugggauuacaggcaugugccaccacgccuggcuacuuuuguauuuuuaguaagacgggguuucuccguguuggucaggcuggucuugaacucccgaccucgagugauccgcccgccucggccucccaaagugcugggauuacaggcguuuagccacugcgcccagcccaauucugugcucuuaaccauccugcucuccugccuugcuggguuaagugcuuugcagucaaauaaaccuggguuaggaucccaguuccaggcugggugugguggcucacaucuguaaucccagcacuuugggaggccgaggcaggcagaucaccugaggucaggaguucaagaccaccuuggccaauauggugaaaucccaucucuacuaaaaaaauacaaaaaugggccagguggggcugggcgugguggaucacgccuguaaucccagcacuuugggaagccgaggcgggcggaucaugaggucaggagauugagaccauccuggcuaacacagugaaacccugucucuacuaaaaauacaaaaaauuagcuggcugugguagugggcgccuguagucccagcuacucgggaggcugaggcaggagaauggcgugaacccaggaggcggagcuugcagugaaccgagaucucgccacugcacuccagccugggcgacagagcaagacuccgucuccaaaaaaaaaagaaaaaaaaaaagacuuggaggagagggaguaacugaguggauguuugcaggaacuagcauagaagguggcaggaccagcuggagcagagaauauaccugggguguucaaggaacagccaggaggacggugugggugaaacagagugaggaagaggaggaggucagagagguugcaggccggggacaguggcucacaccuguaaucccagcacuuugagaggccgaggcaggcagaucacuugaggucaggaguucaacaccaggcuggccaacauggcaaaaccccaucucuacuaaaaauacaaaaaauuagcuggaucgaguggugaacgccuguaaucccagccacuagggaggcugaggcaggagaauugcuugaacccaggagguggagguuacagugagccaauaucaugccacugcacuccagccugggugccagagcaagacucugccucaagauaaacaguccuggcgcggucgcuuaugccugaaaucccagcacuuugggaggccgagacaggcauaucgccugaggucaggaguucgagaccagccuagccaacauggugaaacuccgucucuacuaaaaauacaaaaauuagaccagacaugauggcaggcaccuguaaucccagcuacuugggaggcugagauaagagaauugcuugaaccugggaggaggagguuacagugagcugagauugcgccauugcacuccagccagggaguuuccaagaacgaaucuccaucucaaaaaaaaaaaaaaaaaaaaaagagguuguggguuaaagaagaaggguagucagaucauauaggacccugucagccaugguaagaacuuuggauuugacucugugacacagggaggguuuagagcauaggaaugacaugaucugauucaugucccauaacacccaugcuggcuauuuaguugugaaugaggugggggcaggaagaccccucagaggcccuugcagacauccaggugagagacauccagcaggagaacgaagcaccccauaaaagcaaauuauuagaaaggcaggaauggagccauccucagggaaggcuuaggacaacuucuccaucuaucugcuucucccuggcuggccuuuuuucucuccuccugcaaguauaccucugcaugauacacauggcugccagcaucuuagugacaggauggaggaauccucuucacuuccugauauaguuuugucuuguuugagacagaguugugcucugucgcccaggauggagugcagugcugcgaucucggcucacugaaaccuccacuucccagguucaagugauucuuguaccucagccucccaaguagcugggacuaaaggcacacaccaccacgcccagccaauuuuuguauuuucugguagagauggggauucacuugccaggugcgguagcucacgccuguaaucccagcucucagggaggcagaggugggagauagcuugagcccaggaguucaaggccugcuugggcaauauagcgagaccccguucuccacaaaaaggaagaaaaaaaaagacaaauaaauaaauaagugagacacggauucaccauguuggccaggcugguuucgaauuccugaccucaagugaucugcccaccuuggccucccaaaguucugggauuacaagugugagccaucaugcccagccuuuuccccuuauuuuccuacuugauaaguuuugguuugccucacuguguccugugcagacucucagcucuuccauccccuguauuaaauuuucucuauuugaaauaacuagcauuucaaacuguccuagggucuucaguguuccgacaaccagcaucacugcacugcagaagacagugcaguaugguuucuguugggucgucuggaccccgaacccucaacugauucagucacccaaacaguagcagaaaaugccaggucuuuuuuuuuuuuuuuuuuuuuuugagacagagucucauucugucgcccaggcuggagugcaauggugugaucucggcucacugcaacuucugccucccagguucaagcgauuauccugccucagccuccugaguagcugggauuacagaugcacgccaccaagcccagcuaauuuuuguauuuucaguagagacgagguuucaccauguugguuagcuggccucgaacuccugaccucgugauccgcccgccucagccugccaaagugccgggauuacaggcgugagccaccgcgcccggccaagaccucgcguuuucuaauccaaaaaauuagccgggcgugguggcgggcgccuguagucccagcuacugaggaggcugaggcaggagaauggcgugaaccugggaggcggagcuugcagugagccgagaucgcgccagugcacuccagccugggcgacagagcgagacaccgucucaaaaaaaaaaaaaaaaaaaaaaaaaaaaaaggaaagaaaaagaaaacgcgagaucuuaaaaccaggucucaggacuccuauacgagguacuccaguacuguuaggcuagggacuuuccccagcacaggccauauacugugcguaucaaccccuaacucgacuguuggaugccuccugcucucacucuucaccuucuucuaauaacaggccccugcuaccuuggucacagaaaugagcacguaauccaacugggcaaaucaaaaaauugagaugagauuuuucaaaauggacuagcagagaaaaagcaccuuuccccucuaauucccagccuauugauucccaugugucuccugcauuugccugcgguaggagagacugaagccacccacggaaggcauagucaugagcauccaucagugucuuuuuuuuuuuuuuuuugguaggggcuacaaaaaaaaaaaaaaaaacagguuguuuucgccuguccugccccucacuuccucccgguuuuauuuccuuuagggacaccccucucccacucuaaauccccaagguucgggugggcugacuccgccccccuagcaggccuagccaaucaauguauuggcuagccaaucacucuguugcuccuggguucaagcgauucuccugccucccaaguagcugugauuacaggcaccugcuaccaugcccgguuaauuuuuguaucuucaguagagacgagauuucgccauguuggccaggcuggucucgaacucccgaccucaagugauccgcccgccuuggccucccaaagugcugcgauuacaggcgugagccaccucgcccggcugcaaccaucauuuucaaaccucuuugccuuuacucaugcaguucccugugccuggacugcccuuccuggccccaacgucacccccuccaggaagucucugaguccccagauuugaccaagugcccuucuucugauauugaaaucucagugccuaccuucguauauugaaauugaacuauguggguauucaucaggccucuuucauuugcaagaggcagaaauucaacucaggagggcuucaguaaugcaaguucagccauggugggauucaggggcuuaaugucacuggaacuuggcgucucccuccaugucuccauuuugcuuuccucugcguugaguuccuucuuaagucagcuuccuccccuugcaggcccgggugggugugguggcccaaauggacuuacacggagucucauuggaccaacuugggucagguggccugcacugacccaaucacagcagccugguggguagaauacacugauuggguaggccugccagggggcggagucagccacccaaaccuuggggguuuagagugggagagugguguccccaaaggaaauaaaaccaggaggaagugaggggcaggacaaacgcaaacaacccaacagccccuacaaugugguugggcccuaccagaccaugggcuccccaagggcaaaaauaauaacaaaggcucccaugauuugagagaggaaaaaaaaaauaaaaaaauaaaaaaaaccaauaaaggcuaacauugacaucguauuuccuacuuguaggcucuaagugcuguacacauauccuggaaucuagugauaagaaacaaccccaugagauacuguuuuucuuuucagaaaauuagaauggucccguaauugcucacaaauugaaucuuuucucccucggcuuuauugcgguaugauugacaaagaaaaauuguauauacuuaagauguguaguaagauauuuucuuaaaagucuacauuucgaaggccggacgcaguggcuuacgccuguaaucccagcacuuugggaggcugagauggguggaucuccugaggucgugaguuggagaccagccuggccaacauggggaaacaccgucucuacuaaaaauacaaaauuagccaaacgugguggcgcaugccuguaaucccagcuacucaggaggcugagacaggagaaucgcuugaacccaggaggcggagguugcagugagccgagauugcaccguugcacuccagccugagcaacaagaaugaaacucugucucaaaaaaaaaaaaaaaagucuacauuucgaaauuauuaguacaaucaaaguaauuagcauauccaucuccucacauuauuaccauuuuguuuguguguggggagaacaauuaagaucuauucucuuagcaaauuucaaguacaguauccaauacaccaauacaguauuaauauagaacgaugcuguacaccaggucuccagaucuuuguuuuuguuuuguuuugucuuuuugagacggagucccgcucuguugccaggcuggagggcgguggugcgaucuuggaucacugcaaccucugccacccggguucaaaugauucucuugccuccaaccucccaaguagcugggacuuucacuauguuggccaggcuguucuugaacuccugaccucaggugaucugcccgcuucagccuucuaaaguacugagauuacaggugugagccaucaugcccggcguuuuuuuuuuuuuucagucucacucuugcccagccugaagugcaguguugcgaucucggcucacuacaaccuccgccuccugguucaagagauucuccagccuuagccuccccaguagcuagaauuacaggugcucaccaccaugcccagcuaauuuuuguauuuuuaguagagacgggguuucaccauguuggccaggauggucucgaucuccugaccucaucauccgccugccucggccucccaaagugcugggauuacagacacgagccaccgcacccgaccuguuuguuuugagacagucucgcucugucguccaggcuggagugcaguggcgcaaucucacucacugcaaccucugccucugacguucaagcaauucuccuaccucaaccuacugaguagcugggauuauaggcaugcgccaccacaccaggcuaauuuguguauauuuaguagagacagggcuuaaccauguugcccaggcuagucuugaacuucuagccucaagugauuuaccugccucagccucccaaauugcugggauuauaggagugagccacugugcccagccuuaggucuccaaaucuuguacaucuuguaacaaaaaguaugcacccuuugacagaacaucuccacauuuuccccaccccaccagccccugcuaauugcuauuuuacuguuucuaugaguuugacuuuuuagauuccacauauaaguaaaaucaugcaguauuugucuuucucugcuuggcuuauuucacuuggcauaauguccuccagauucauccauguugucacaaauggcacguuuucuuucuuucuucccuuccuuccuuccucccuuccucccuuccucccucccucucuccuucucuuucuuucuuucacagucucacucugucgcccaagcuggagugcaguggcgccaucucagcucacugcaaccuccaccucccagauucaagugauucuccuaccucagccuccagaguagcugggauuacaggcaagcaccaccacgcccagcuaauuuuuguauuuuuaguagagaccagguuucacuauguuggccaggcuggucucaaacuccugaccucaagugaucagcgcgccucggccucccaaacugcuggguuacaggcgugagccacugcgcccagcccccccauaagauauucuuauacccauuuuacagcugagauaucugaggcucagagagacccaaagaauuaacuuacuuggucaaggucacaaagcucagagggauaauguugaauuuguuccuggguuaccaaggacccagacaugaauugaccaauauugguacuccacaaauauuuuauucaucguuuuguuaaauauguauuaagcucgguguacuggugugugcuuguauucccagcucgucgagaggcugagaagggagaaucucuuuagcucaagaguucaagaccagccuggguaacauagcaagaccccaucucuaaaaagaaagaaaugccugguguggugccucaugccuguaaucccaauacuuugggaagccuaggcaggaggacugcuugagcccaguaguuugagaccagccugggcaacauagagagacucugccucuauaaaauuuuuuuaaaaaauuagccagguguaguggcaugcaccuguggucucagcuacucaggaggcugaggcagaaggaucauuugagccugggugguugaggcugcagcgagcuguguacgucagcauagccaacacagccagauccugucuaaaaaaaagaaagaaaaaggccaggcgcgguggcucacgccuguaauccuagcacuuugggaagccgaggcggacagaucaccuaaggucgggaguucgagaccagccugaccaacauggagagacccccgucucuacugaaaauacaaaauuagccaggcgugcuggugcauuccuguaaucccagcuacuuggggggaugagguggaagaauugcuuguaccugagagguggaaguugcagugagccgagaucgugccauugcacuccagcccaggcaacgauagcaaaacuccgucuuaaaaaaaaaaaaaaagaaagaaagaaagaaaaaaaaaggccgggugcgguggcucaugccugcaaucccaguauuauggguggccaaggcagacggaucacgaugucaggaguuagagaccagccuggccaauaugguaaaaccccgucucuacuaaaaauacaaaaauuagcugggcaugguggcgggcaccuguaauucuagcuacugggguggcuaaggcaggagaaucucuugaaccaggaggcggagguugcagugagccgagaucgcaacacugcacuucagccugggcaacacagcaagacucugucucaaaaaaaaaaaaaagaaagaaagaaagaaaaaaaaagagaaaacaguaaauuagcagguauuagucaccuacaacaugccaggaacaguuuguuuguuuguuuguuugauuuugagauggaguuucgcucgucucccaggcuggagugcaaugacgucaucucggcucacugcaacgacgucaucucggcucacugcaacccacgccucccagguucaagagauucucaugccucagcuuccugaguagcugggauuacaggcgccugccaccacgccuggcuaauuuuuguauuuuuaguagacacaggguuucgccauuuuggucaggcuggucucgaacuccugaccucaggugauccacccgccucagccucccaaagugcugggauuacaggcucgagccacugcacccagccuccaggcacaguuuuucagugcagggaacaaaacagaccaaagucugugcccuccugcagcucacauucuccuggaaaagacaggcaugcgacacuaaucaacaaauaagagaauuaccucuggccggacgcaguggcucacgccuguaaucccagcacuuugggagaccgaggugggcauaucacuugaggucaggaguuucagaccugccuggccaacauggaaccccaucuuuacuaaaacacaaaauuagcuaaguguguuggcgcacaccuguaguccuagcuacucuggaggcugaggcaggaguaucuccugaacccgggaggcagagguugcagugagcugagaucgcgccacugcacuccagccugggcgacagagugagacacugccucaaaaaaaaaaaagaaagaaagaaagaaagaaagaaauggaacuuuccuggccuucuccuggguacuuggugucuaggaugaugcgcagagccugucccagcucucuagauucgucuaguugggggccccugaggcucaggcaggcacaccacccccaccccccggcggccaugucugcagcauugcccaucugugugucaccagggaaaggaacacaggucuggaagaagaaaggagccaucuaugagggggacuggaaguuugggaagcgagacggcuacggcacccucagccuuccugaccaacagacaggaaagugcaggagagucuacucaggcugguggaaaggugauaagaaaucggugagcaggccugccagccggggugugugugugugugugugugugugugugugcgcgcguguguguuuaggggaagccgagagaggccugggagaaaagagaggggaggucuacagggaggaggacaggguugugcugcucgugggagaaggaaggggugggggaauugcaaaguuucucagaacaaaacccaggaaacaggaagcaacagaaggccagggaggagcccacgaaacccugcgguugcgaggagccagccaggcuuguggggacgaagucgccuccacccuuuucccccucguuuccuggcuuucuuuuccccagguaucacuuucugagaauccccuuucugcugggccugaauaaaagggagguaggaaaagugggagcaagagagcaggggacaggagaggagggucccggggggccgaagccagccagaggcgcgugcucagcccggaaacacccaagcugggcacagguucccuccaucuacucccacaaguguggaggaauccucaccaucagucccagagacacuaauaauaaacaguauugcaacugagcaacugcuacugugagccugaaacacauauuuaaaacuuuuuuuuuuuuuuuuuuuuuugagagggagucucauccugccgcccaggcuggagugcaguggcgccaucuuggcucacugcgagcuccgccucccggguucacgccauucuccugccucagcuucccagguugcugggacuacaggcgcccgccaccacgcccggcuaauuuuuuguauuuucaguaaagacgggguuucaccguguuagccaggauggucuccauccccugaccucgugauccgcccgccucggccuuccaaagugcugggauuacaggcgugagccaccgcgcccggccugaaacacauuuaauauucaguuaacucucacagcaacagcucaucaucaucaucaucuucaugcccauuuuauugauaagcaaacaagcucgaagagaugaggugucuuguaacugcccaagggguucaccuugccggugccuggccuugaguuguauuauuacucaaaucagucuccccgaacauuccagcagcagaguuuuuaaggauaacuuggugggugggggaaagacagugaaccaggagugcugauuggucagagauaaaaucauagggagucaaagcugucuucuugcuccccagacagagccgauucaucaagacgggaauugcaauagagaaagaguaauuaacacagaacuggcugugugggagaccugaguuuuauuauuauuauuauuaauuuauuuauuuuuugagauggaguuucgcucuugucgccacgcuggagugcaauggugugaucucggcucaccgcaaccuccgccuccuggguucaagcgauucuccugccucagucucccgaguagcugggauuacaggcaugugguaccacacacugcuaauuuuguauuuuuaguagagacagaguuucuccauauuggccaggcuggucucgaacucccgaccucaggugauccgccagccugggccucccaaagugcuaagauuacgggcaugagccaccgcgccuggcccuggguuguauuauuacucaaaucagucucccggaacauucuggcugcagaguuuuuaaggauaacuuggugggugggggaaagaguaagccaggcgugcugauuggucagagauaaaaucacagggagucaaagcugucuucuugcccugagucaguuccuagguggggagccacaagaucacauaaaucaguuuauugauuuggguagugccagcugauccaucaagugcaaggucugcaaaauaucuuaagcauugaucuuaggagcaguuuagugaggaucagaaucuuguagcuuccagcugcaugacuccuaaaccauaauuuauaaucuuguagcuaauguuaauccuacaaaggcaaucuaguccccaggcaagaaggaggucuucgggaaagggcuguuacugucuuuguuuaaacuauaaacuauaaguuucucccaaaguuaguucagcuuaagcccaggaauggacauggacagcuuagagguuagaagcaagauggagucaguuaaauuaaaucucuuucacugucucagucauaauuuugcaaaggcaguuucagucuugccuggagucacacagcuagcaagugguagagcccaggguuucauguucucugcucccaaauuguuuauuggcaaguaggaagagaaagcccugaauaaccaauuuacguagaauaugguauuaggagggauguuuucacagggugcccagaggaaggucaucaagcccagccuagagaauucaggacagaaggcuaagcacaauggcucacgccuguaaucccagcaauuugggaggcagacagggguguaucacuugaggucaggaguucgagacuagccuggccaacauggugaaacccccgucucuacuaaauaaaaaacacaaaaaaaauuagccgggcauagugguguguaccuguagucccagcuagggagacggagacauuagaaucgcuugaagccaggaggcagagguggcagugaaccgagaucacgccacugcacuucagccugggcaacagagugagacuccaucucaaaauaaauaaauaaauaaauaaaacuauauaauaauaauaauuagcuagauguuguggugcacaucuguagucccaacuuuucaaaaggcugaggcaggaggauugcuugaucucaggaggcugagguuauagugagcuaugguggugccacuacacuccagccuggacaacagagcaagacuugucucaaaaagagggaauucagggcaggcuuccuguaggaggugacacuaaaagaugcuaggaguuagccaggaagaaaaaaaagggagaaagaugggaggcaaaaaaauagcaaagggaacgagauguaaaacagcagagugugucugcccugggacaggagugaggagaagaguugcgggggcccucagggauaugugggaaaucaggauuuugaggaguagacuuggcuucucaacccaaccuccucgggugugaucugcaaacagaccuuguuucccugugguuggacacuaagugugguguuuuuuguuuuuugagacggagucuuucucuguugcccaggcuggaguacaguggcgcgaucuuggcucacugcaagcuccgccuccugguucacggccuucuccugccucagccucccgaguagcugggacuacgggcacccaccaccacacccagcuaauuuuuuuguauuuuuaguagagacggguuuucaccauguuagccaggauggucucgaucuccugaccuugugauccgccugccuuggccucccaaagugcugggauuacaagcgugagccacagcgcccagccuaagugugguguuuuuuguuuguuuguuuguuuguuuuuugagacagucuugcucuguugcccaggugggagugcaauggcacgaucugggcucacugcaaccuccgacuccuggguucaagcaauucuucugccucagccucccaaguagcuaguauuacaggugcccaccaccacacucagcuaauuuuuuauauuuuuaauagagacaggguuuugccacguuggucaggcuggucuaaaacuccugaccucaggugauccaucugccucggccucccaaagugcugggauuauaggcguaagccaccacgccaggcuaaguaugguguuuauguucauuuuucugggucaaaauaagagugggaggggggcgagcaugaucagaugggcgauuuuuuuuuuuuuugagauagcgucucacccugucaccuaggcuaccgugcauucucagcucacugcaaccuccaucucccagguucaagugauucuccugccucagccuccccaguaacugggaucacaggcgccgccaucacgcccagcuaauuuuuuguauuuuugguagagaugggguuucaccauguuggccaggcuggucucaaacuccugaccucaagugauccacccaccucagccuccuaaagugagccggugagccacagcgcccagccuagaugggcgauuuaaagaguccuccggcgcuguaggggcugcauggcgcauggugugguggggaugagagaggagagggugggucaguaaggagggaguuuaaugacuggcugcauggaggcgccagcagagggacagagagaaacagagcauggggagauccuucaagacauuaucggugggcacuauggcucacaccuguaaucccagcacuuugggaggcugaggcgggcggaucacuugaagucaggaguucaagaccagccuggccaacauggugaaacccugucucuccuaaaaauacaaaaauuagcagggcguggugaugcguguuuguaaucccagcuucucgggaggcugaggcaggagaaucacuugaacccgggggacggagguuacagugagccgagaucacaucacugcacuccagccugggugacagaguggaucucugucuaaaaacaaacaaacaaacaaaaaagacaggauacuccgcuaagacacgacccuccgcuuggacguagggcugaggaagaaggaagaagcugggguguguggcucuaggggugccugggaagacggugggcuuuccuggugguguuggggggcgcccugaguaguagcaucuucguacuuucaggguuaugggauccaguuuuucggacccaaggaguauuaugagggugacugguguggcagccagcgcagcggguggggccgcauguauuacagcaacggcgacaucuacgagggacagugggagaacgacaagcccaacggggagggcaugcugcgccugagugagugccccacccccgccggccccgcccacccgaccacgcccccggcagcgagcuggccacgcccauuuggucccacagagacaggccacaccccacacucuugucccacacugacccuugugucaaugugggacaagagaggaagagcacccuaucucuccccucagucacaaaaggucacauauauaugaugcuauuuauaugaaauuuuuaggacacgcaccuccacagagacagaaaguagacuaaugguugccuaggacuauggggguggugacauuaguggguguggggaauggcugcuuaaugggcacaggguuuccuuuucgggugauuaaaacguuuugaaacuagauagagguaaugguugcacagcauugugaauguacuaaaugccacugaacuauacacuucaaaauggccaacuuauguuauaugaacuuauaucucaauuuuuaaaaaaaaagccaggcgcaguggcucaugccuguaaucccagcacuuugggaggcagaggcgggcggaucaugaggucaggaguuugagaucagccuggccaacguggagaaacccugucucuacuaaaaauacaaaaaguagcugcauguggugguauacaccuguaaucccagcuacucaggaggcugaggcaggagaaucacuugaacucgggaggcggagguugucacucaggcuggagugcuguggggcaaucucagcucacugcagccucaacuucuugagcucaagccauccucccaccucagccuccagaguagcugggacuauaggugcacaccacuaugcccagcuaauuaaaaaaauuuuuuuuuuugcagagauguggucucacuauguugcucaggcuggucuugaucuccugggcuuaugagccucccaucuuggccucccaauguguuaggauuugcacugagcucuggaagagcgaccccugggggucuagcuuaguuugguguacccugcaccacaccucccuguccuuucccccagagaacgggaaccgcuacgagggcugcugggagagaggcaugaagaacggggcggggcguuucuuccaucuggaccacggccagcuguuugaaggcuucuggguggacaauauggccaaaugcgggacgaugaucgacuuuggccgugacgaggccccugagcccacucaguuccccauuccugaggugggcagcccucaccagggcccuguggccacacccagacagagacagaagccagcauccccagccaugcccaggccagaucugccaggcccagccaagcccagacagggaacagacaagguuuuguuuucagucagggcaucccuagcaagggagguggcuccugaugaggcuggcagcaccccacacggcaggcagcgccagucaaggcuggcagccuggguccuccaugcucuccaaaccaacuucuugguauuucccuccaggucaaaauccuagacccugauggugugcuggcggaggccuuggccauguucaggaagacagaggaaggagauugaugccaggugaggggugggcacaccugccaaguucugauguggcugaggcugcuccagggcccagaacaaugcacagaucuccuggggucuccaaagggcuuggggucggggagugggggagcaagaccaucgagggcaggcuucuugccuccuacagucccagguguccuuuuugacgcuuccucuucaaaaccccuuuugaccggcugugguggcucuugccuuuaaucccagcacuuugggaggccaaggcaggcggauaaguugaggucaggaauuugagaccagccuggccaacauggugaaaccccaucucuacuaaaaauauaaaaguuagccaggugugguggcaggcaccuguagucccagcuacucgagaggcugaggcaggggaaucacuugaacccgggaggugaagguugcagugagcugagauugcaccacugcacuccagccugggcgacagaaugggacucugucucaaaaaaaacaaaacucgccaggcacaguaauccuauaauccuguaaucccagcacuuugggaggccgagguggguggaucacgaggucaggaguucaagacuagcuuggccaagauggugaaaccccaucuguacuaaaaacacaaaaauuagcugggcgugggggagggcaccuguaauuccagcuacucaggaggcugaggcagagaauugcuugaaccugggaggcagagguugcagugagcugagacugugccacugcacuccagucugggugagacugugucucaaaaaacaaacaaacaaacaaauaaacaaacaaacaaaccauuucacugaagaccagugcauuccaguccugccugaaaccuucuauuugcacccugggccacacaacugagcugggcacgggguugaaaggagguggucuccuggcuucugaacacccuugaguaaggcaguuggccuucagccuccauuuacacaucuguccaguggggucuuguccaguccaaguccuccugggcaugaugugaggguuugaggagaggacauugguaacagcgucuuucaaaugccagcuccaccaucccucucuccccugcagagaacacaaacgcuucaggagaaauucaagccugugucacccgaucgcucagaccagugcggcucuggcuggaggagucagcagcagcuccaggcaugaccccggcacccucauagggccccucacuacccccagcacugggucauuucuugccaauaggaaggcuggugcuucucucccaggcuguccucgggacccucuucauucucugaucucauccuggaaugcaugagaauaaagaauaaccaagugguauaa

SEQ ID NO: 191522 - RNA, 29398 nt, Homo sapiens
gccccgugugcagcuuucgcggccugcgucuggagaaaacccuagcggguggcuccgugcggccagagcucuagagaguggugccgccuuccaaccuucuuccccaagcccugguggccggcuccgccucuucucgaaucuuuuccacagcccaaaauggccgcagagguguauuuuggcgaucuagagcucuucgagccguucgaccacccagaggagucgauuccgaagcccguucacacucgcuucaaggacgacgacggcgacgaggaggacgaaaauggggucggcgacgcggagcuacgggagcggcuucggcagugcgaggagaccaucgagcagcuccgcgccgagaauauccuuuccucucgcugggcccugucacccggguguggggccggggcagcgccaggcguggggccggggcagcgccgggcgagggcgagggcgcgggcggaaguuccaggagggccagaauuccaagugcuuucugucacccgccggcggaccgagagucuaggguucggggcgcgcaggcugccucggcgcagaccucuuccccucagggaggccgucuccugaccagacccacuccugccucccacccgggugccguguuuaggguuauuuuaggcugcucaccugacagauuguacacaagcccuuaauugccccccucuguuugaggucguggugagguuucauauuucgcagccacgcucaaauugugccgucauguuacaguuguaggugaugaaauaccggcugcuuagacgcgggaucgguuuuuauaccggggcaaacgcuaguggucccagaaugcagaguugggggccucaaggaauccgggugugcugagauaauugguuaauugcuugauuaaaauuggggauuaauuuuagaguucuuccacucggagcucgcuucugugcugaagaugcuuugcaacgccuugaggaaaacgcgccaaagaaguuucuguuagacuugaguuacaagauugcagauuuuucuugauuugcuaguauguuuuuuuuuacguucguagaguuuuauagguagauagauaacuuugguucggguaguuuuccuuuuaaaauuuguagagaacugaaaguggcugauauguuagcuuuuuuagggggacggggucggggaauggagucucagucuguugcccaggcuggagugcaguggcgcgaucucggcucacugcaaccuccgccucccggguucaagcgauucuccugccucagccucccgaauagcugggauuacaggcgcccgccacggcgcccagucaguauaucaguuuuuaagguuugugaagcgcgauuuauuuuuucagaaugucgucuuccuccacauugugaggaaaauuuucagaauacaaaaaguugaggccgggcgcuguggcucaagccuguaaucccagcacuuugggaggccgaggcggguggaucaugaggucaggaggaucaugaggaucagguggaucaugaggaucaggaggucagccuggccaacauggugaaaccccgucucuacuaaaaauacaaaauuagccgggcgugguggcgcgugcuuguaaucccagcuacucaggaggcugaggcaggagaaucccuugaaccugggaggcggagguugcagugagccaagaucacaccauugcacuccagccugggcgacagggugagacugugucucaaaaaaaaaaaaaaaaaguugaaaggauucuacaguggacauccauagauuuauuccaaauucuaaaguuguuaacagcucguuauacugcauucucuuuaucacauagugguuguugaaagguuugacaggaacacugaugcuucaauaaugguuuugguucaguuuguuagucuguugaacuucaggaucgugucuuagaauauauguucgaaaggauaaaaaccguacuuuaauuuuggguuucaaaagccuaccccugcaacaaaauagaagcucaauaagugugucauccucaaaauauccgugggucuuuugucuuuauaauauucugacaccaaaagugagagaaguaguaguugaauuuuaugauuugcauuguuaaaugagggcuuaucuuccuuaacaaauaauaacaucaagaacuuaaacgaaaauugaacauucugacucgaccgagguaugagauuuuugaaauuacuccauaguugucccuuauuauuuauccugauauuaauauuuaaucagaauuucguuguaaaaaguguaugggauuuuuguaucauuuuuauuuguuuagcauacucugaagaaaucaaaguaauaguuauuuaauuguggggauaaggucugaauucucauaaguggauuaaaauuguaagcucauuuauuggaugaaaggaugaaacaaaauccagaaaauguuuacuuaauguucagaauaggcaaguuguuaaccuagcuauuccuauuuaacaaacauuucuagaaaguuagaauuaagauuacaauauuggcugggucugguggcucaugccuguaauuccagcaccuaaaaaaaaaaauuauaguauaaugggccaggggcaguggcucacgccuguaaucccagcacuuugggaggccgaggugggcggaucaacugaggucaguucgagagcagccugggcaacguggugaaacgcugucucuacuaaaauuacaaaaauaagcuggacguggugggcgccuguaaucccagcuacuugggaggcuaaggcaggaaaaucccuugaacccgggagguagagguugcagugagcugagagugacaagagcgaaacuccgucugaaaaaaaaaaaaaaaaagauuacaguauuacucuagcugaagauuuauuuacauaguuaaaauguguucauaaauagaacaaugaaagaaucagcauuuuagaagaaaaaguaaugugcuuuugaaaaagauaaaguguguagauuugcauuuaggcaucugauuuuauguuuuuguuuuuguuugagacaagaucucacucugucacucaggcugguguacaguguugcaauuauagcucacugaaaccuugauccucccgccucagccucccaaauagcugggacuacaggcagacaccaccacacccagcuacuuuuuuuuuuucugauagagucagggucuugcuguguuacucaagcuggucucaaacuccuggccugaagugauccuucugccuaggccucccaaagugcuggaauuacagggaugagccaccaugcccagccuaggcaccuaacuuuaacagagauauuacugguaucucaaaauauauauuuauuuaacaggucacuaaucuaaaguauuuguuaaaguacagauuaugagaaauuauauuuucaagcuuucagaauuuggaggugccaugauguaauuucacaugcacuuuuuuauuauauuuuuuaauuuuuuugagacagaguguuacucuguuucccaggcuagacugcagugguacuaucucagcucacugcaaccuucaccucccggguucaagcaauucuccugccucagccucccgaauagcugggauuacaggugcccacuaccacacucggcuaauuuuuauauauuuaguagagauggggcuucaccauguuggccaggcuggucucgaacuccuggccucgagugaucuguccaccucaaccucccaaagugcuggaauuaacaggcaugagccacugcaccuggccucacaugaacuuuuuagucccuggcaccaguuggaauaacuggcugcaguggugacuacagguuuaaauuuuagaauuuagaaauauuucagauuuuuuuuuuuugagauggagucucgcucugucgcccaggcuggagugcaguggcaugaccucggcucacugcagccuccaccuccuggguucaagcgauucugcuuucuccugccucagccuccugaguagcugggacuacaggugccugccaccaggcccggcuaauuuauuuguauuuuuaguagagaugggguuucaccguguuggccaggauggucuugaucuccugacaucaugaucugcccgccucggcuucccaaagugcugggauuacaggcaggagccaccgcacccggccaauauuucaaauuaacuuccucauaucucacccuuuuuucucuaugugagcuaacuuuguguaucuaaacucauuuuuggcugggcacaauggcucacaccuguaaucucagcacuuugggaggacugcuugagaccagaagugggagaccagucuggacaacauggugagacucugucucuacaaaaaauuuuuaaaaauuagcuggaugugguggcauguuccucuggucucagcuacaugggaggcuuaauaaaauaaacuaaauuuugauuagguauucaauauauuaaauauaacuaggauuccucauaaaagucauaauuuuuauauguuaaagauguuuuauuuagauaaguuuacacuuucuaauggagucauucauuuaaacauuuaauauuuaucuuaaauugggugauuuuuauccgaguucaaacgauuaccgcaucauauaggcuuugccaguuuauaagcacaaaggauuaguaucaugaaaaagaaauaaaucaguguuuucuuagaauuggugcccuccauauugucaggcugauaaaguguuguacagaaaaccaaggaaaaaggacaaauuaaauuauuuagauaaaauuugugcucucaagccuuuugauuuaguccuuauuuuugaaacuguuauaaucagaaguuucuccugguuuuuguuuuuuuuuaaauuuuuugagacaauuucucacucugucgucuaggcuggacugcagucgugcaguuacugcucacugcagccucaaccucccaggcucaagugauccucccaucucagccuccugaguagcuggaaccacaggaacaugccaccacaccuggcuaacuuuuguauuuagcuuagagaugggguuuugccaaauugccaggcugguuucaaacuccuaggcucaagugauccuccugccucagccucccaaaguccugggauuacacugggcuuagucuguuucuccuuuuuuuuuuuuuuuuuuuuuuuuuuuuuuuuuuuuuuuugagacagagugucacucuaucgcccaggcuguagugcaguggugcgaucuuggcucacugcaaccucugccucccagguucaagugauucuccugccucagccucccgagcagcugggauuacaggugcacaccacuaugcccagcuaauuucuguauuuuuaguagagacgggguuucaccauguuggucaggcuggucuugaacuccugaccucaugauccacccgccucggcuucccaaagugcuggcauuacgggcaugagccaucgugcccaggccucuccucuuuauuuaaucaauaaacauuuuguuggguuuuguuuguuuguuuuacuuucuguuuguuuuugagacagagccagagucucacucuguugcccaggcuggaguacagcggcaugaucuugacucagugcagccuuugacuucuggguucaagcuauuccuucaccuaggucucccgaguagcuggggcuacuggugugugccaccacgccuggauaauuuuuguauuuuuuggcagagaugggguuucaccauguuggccaagcuggucuccagcuccugaccucaggugaucugccauccucagccucccaaggugcuaggauuacaggcaugagcuacuuucccuggccuucuucuacuuuuauugugaaaauauacaaaaaaugaaaagaacaguaugguuagcacccauauuuuccucacuuaauuuaacauuuaauauuuuugccauauugccuccuucuaaucccaugcacauuucagcccaaguauuucaauguguauuuuuaaaaauagagacuuuuucaugcauaaccaccacucaauuaucacaccuaauaacugcaaugacuuccuuaaucauaucuccuaccaacuccauauucaaauuucuccaacugaguauauuuauagcugguucaucaaacuggacucacuuuaggaaccaugcagcugcaugugacuuuuaaaaacaucccugguuggccgagcguguugcucugucaccccggcuggagugcaguggugcaaucucagcucacugcaaccuccgccuccccuguucaagcaauucuccugccucagccuccugaguagcugggacuacaggcgcgugccgccacgccuggcuaauuuuuuguauuuuugguagagucgggguuucaccguguuagccaggauggucuccaucgccugaccuugugauccacccgccucggccucccaaaguacugggauuacaggcgugagccaccgugccuggcccuuuuuuuuuuuuugaaacagagucucgcuguguugcccaggcuggagugcaguggcacaaucuuggcucacugcaaccuccaccuccuggguuuaagcaauucuccaccucagccucccgaguagcugaguuuacaggcaugugccaccacgcauggcuaauuuuuguauuuuuuuuuuuuuuaguagaaacgggguugcaccauguuggccaggcuggucucgaacuccugaccucgugauccacccgccucugccucccaaagugcugggauuacaggcaugagccacugcgcccagccucuuauuuuauuucuuuacuugauauggacaauuccaaauagagacauuuauuucacaugcuguacaggaaaagaaauaugaggcaggugagaagaggaagaaucagacauucagcuggccccgggcuacccaugggauauauuacagguuucuaggcugcauucuaguucuguuuuuugcgguauuugaaagucaaauccaggaauaguauacuuuuuuauaucucuucuuuagaaucuuggauuugagauauuuaguacaauaugcuuugcccuccaagagucuauuuauaaaguguucuuuccuauauacuuccaagccaaauucauuuagauuccuuuagaaaaauacaggcacaggcugggcgcgguggcucacgccuguaaucccagcacuuugggaggccgaggcgggcagaucacgaggucaggagaucgagaccauccuagcuaacguggugaaaccccgucccuauuaaaaauacaaaaaacuuagcugggcauggucgcaggcgccuguagucccagcuacuugggaagcugaggcaggagaauggugugaaccugggaagcagagcuugcagugagcugagaucacaccacugcacuccagccugggcaacagagugagacuccgucucacaaauaaauaaauaauuaaaauaaaaauaaaaauacaaaaauuagcugggcgugguggcgcucgccuauaaucccagcuacucaggaggcugaggcaggagaauugcuugaaccugggaggcagaggcugcagugagccgagauugcccccacugcaauccagccugggcaacagagcgagacuccaucccaaaaaaagaggaaguauauucuuguaaccugcuuguuuaccuaguccuucccucccccuaauuuguaaggaaaucggccauuagacaaacuguuugguugaaaacugaaagauuaacugcaguucuuaauuuuuuguuaaacauuaaaaaaaaagugauaccucuguauaaaauuauuaaaguagauagaauuggugaaaauguauaauuuucuugagaaaacugcaauauguggaaaaugcuauaugauuuuugguacuuaagaauuuuaaggcuggugagaugguucacagcuauaaucccagcacuuggggaggcugaggcagguggaucccuugagcucaggaguucgagaccagccuggccaacauggcaaaacccugucuccacaaaacauacaaaaauuugcuggauguggugguaugcaccuguggucccagcuacuugggaaggugaggugggauugcuugaucucgggaggcggagguugcagugauccaagaucucaccacagcacuccagcacgagcgacagagugagaaccugugucaaaaaaggaaaaaaaaaguauaaaaguuaugcguuuauauauacguaugcaaguuuuacuuaaauaucuucuaagaauauguucuaacuucuguuuuaguggaauauuggugaacgauacuaaguuagauggaccuauauuacagauucuauucaugaacaaugcuauuucaaaguaaguaauuuuuucccuuuccuaaauauaauaauguguuuauggaacaauuuucucuauaaauaugcuguuuucauuuguacucauaucauuuuuauuauuuuacuuaaaaugccccuggaguuaaaguacaaggaaucaugauuaagagcaaggacauuggggucacagugaccugaauaucuggacucuuacuuucuaugucugugaaccugggaaggucacagaucuuugcugcaucauccguuacuucacuggaaaacaggauagucauaguaacuaccuaugggguagcuacaugagcaccucuaagagcucaauaaauagcuucuaauaaaaaucaucacuaucacuguaacaauaacaaugauguucaccauuucucuuucugaaucagguaacugaguuuuccauguuggccaucuucaaagccuacucacuugauuauuuguuuuaacagcaaaacuagacuuuugcaaaccaucagcaucaggguuuagggugacccugcgcauuccugcaguguuugcucagaguguaaggucuaaaaugguuugcucugucccuccuucagagcauggucauagacauuucacauaguugcuugcucccucgaaagucacuuagucauauuguugucuucuuaaugcugaccaaggucagguccauaaccuacucuaucccagcagaaguggaacccaaggcucugaggguugggaagcuggaugcuaaauacagcagcaaggugcugggcacaacugggcuguagcacuagugucccucucaugcccagguuagaaucaguaacccucuagcucaugacggucucauuucugcaccauucaccuaguguuucaccugcagaaaucuuuuuuuuuuuuuuuuugagauggaguuccggucuuguugcucaggcuggagugcaauggcacaaucuuggcccaacacaaccuccaccugccagguucaagugauucuccugccgcagccucccacguagcugggauuacaggcaugcaccaccaugcccagcuaauuuuguauuuuuaguagagacgggguuucuccauguuggucaggcuggucucaaacucccgaccucaggugauccacccaucucggccucccaaagugcugggauuacagguaugaggcaccgcaccuggcuuuuuuuuuuuuuuuuuugagauggaguuucacucuuuuugcccaggcuggaguccaauggcaagaucuuggcucacuacaaccuccacccacuggguucaagcgauucucuugccucagucucccaaguagcugggauuacaggugccugccaccaggccuggcuaauuuuuguauuuuuaguagagacaggguuucgccauguuggccaggcuggucucgaacuccugaccucaagugaucugcccaucuacagaaaucuuaaaaugucagagcuacaagauaccuaaaaaaucaucaagucugugaaaaggaaacugagucugagacauuauggcuccccgauuacaugguaauaaggcuugggcuccuuugacaccuccugaacugagcacuaccgaauauaugaugagcuugguucuugaccuggagggcuggggaaagcagaucucaguauuuuuucuugcuuugcauuuugauuuuaucuuuuccaguuucauauuuauauugguguuuccuuauguacguauuaagaaucucugggaggaggauguggaagaccugaauauauggacuaucuuuguguugcagaaauagauggccaagagacaggguaggaagggagcuuuucauuauguaacccuuuuacuucucuuggauuuugaaccauuuacauguaguaucuauuuaaaaauuaaguacacagaauuuuuaaauaaaauccguguauucuuugcacaacugguuggcaguuguuaugccaaucacuguguuacuuuaucauaauuauugcauuaacuuggcaauaauauguaauuuaucuuaaggaauauguuccugaguauuacagagucagugauuuauuaaacuucugaaaaacaacaacauucacacuugaaaucuuacaguaaugcauaagacuucagucuauugaauguuuuacucugucuggguucugaccauuuuguccucuuacacaggcaauaucaucaagaaauagaggaauuuguaucaaauuuaguaaaaagauuugaggaacagcagaaaaaugauguggaaaagacuuccuuuaaucuuuugccccagguauuucaaauuuaagagacuuuaagauuaguaaguuaugcguuucacugccaauuauugggccacaaggauccucuugaaucaaaaccaaaaugauuaacaccguuuaccacuucuccuucuacuggcuugcuuuuccgaagccugacugguuuagccacacagcguucuuuuaccuuguggcucagacuuuuuacauugccugacuuggacaugugguuuuggguagaaaauuaauuuuaggccagaaaaaaaucuaaguuucugggguuuauaaaagauggauuccuuuuaucuaaaaccaacaggcuuguggacuauccuuuuuucccucuacuuguuuuuagaaaauuaauugugugcccaaagaaaucugagaaguuuuacuaugugaauauuagaucacgcauuuauguuuuaaaaaaaagagagagagagagaggagaaucagaguuaugauuucugggucuuuuuuuuuuuuauuaaaaauuaagguaaguaguauuucucaaauaaggaacuuuagcuguuuauccucaggcuuuggagaacaguguucugauugauuacguuuuuuauugccuuugguuuuuauguauucuguacaauuuuuaaagauucagcaaacaaaauacauuuaacaauaaaauucauacugaauauuauuuuugauucaaggaaacuuuuguaguggcuugaggucugugaggguuauauuaucaauauugaccaguaauguaaaacuauauauuuuugaucuuucugguuaucugccuugccaguuuaaaguguugaaagcggcauaauuaauacugguuaaaaaagaaguuguagugcaugcuagugcuucagaagaagcucuccuuuuacaucuuccauucucccacaugaaaugucguucauaaacauucuuagcuuaauuucuaaacuuacuaacuuccauuuaaacugguuaaaaauugguuaccgguuguaauauguguuuuucuuuguauuagccauccaguauugugcuagaggaggaccacaaaguggaagaguccugugccauuaaaaacaacaaggaagcuuucaguguaaguuuggacauuucaguuuugaauucagccaauagguguuuccuauccuaugucaacuggguggcguuuaaaagauaaaguaguauagucauaugucuucacuugauaacagcaucuuuuugugguaaauagcaguuuggacuuuagccucaguuugcuguuuaauaaugauugcguugugaccuggggcacaguaaacauacuuuggagaacuuuguuuuuguauugaccaaccacuguguuuauucaagaaguuggaugaagauauagaaagcaugcuuguugaacuuauacauggcuaaagcugagagggauagauagcuaauguaacagauggcaaauuuggaauuuaaaguguugacagucucaaauggugggugaaaaacagaagaaguuaacagggaugaccuacauuuaggcuacagccuuucaauaccugugcaaaauucguuaguguuaauacaauguaguaguaugauuuugcagcuuauaauuuuuuuuuuuuuuuuuuugaaacggagucuugcccugucguccaggcuggagugcaauggugcaaucucggcucacugcaaccuccgccucccggguucaagcaauucuccugccucagcuucccgaguagcugggauuacaggcacccgccaccacgcccagcuaauuuuuguauuuuuaguagggacaggguuucaccauguuggccaggcuggucucgaacuccugacuuugugauccacccuccuuggccucccagaguguugggauuacagaugugagccacugugcccagcgcagcauauaauauuuuaaaagguaauguaauaguggauucuauaauauugaaggaaaacugguuuucauguuuauguaguauuaucccauauuaguauaccacaauuuuaggcugggugcaguggcucacaucuguaauccccaguguucugggaggccaagguggaaggauuaccugaguccaggaguuccagacuagccugggcaacauagccagaacucaucucuaugaaaaauucuuaagaaauuagccaaguguggcugggcgaaguggcucacaccuguaaucccaggacuuugggaggcugaggccgauggaucacuugaggucaggaguucgagaccagccuggcugucauggcgaaaccuugucucuacugaaaauacaaaaauuagccaagugugguggugcacaccuguagucccagcuacucgggagacugagucacggaaauugcuuugaacccaagagacugaggcugcagugagccgagauuugccacugcacuccagccuggacaacagagugagacucugucucaaaaaaaaaaaaaauuagccaagugugguggcauggaccuguagucccagcuacucaggaggcugaagugggaggacugcuugaggucaaggcugcagugagccaugauugugccacugcacuccagucuaggugacagagcaagacccugucucagaaaacaaacaaacaaacaaaauauauauauauauguauguauagauacauauguguauauaaaaaagaaagagauaugggccuacugggaugaugaagagcccacagacuuuauugaaagaaaaauuuacaaaggaugucgcaucucuacaaauaggauaaagguuguuauuuguaaaagacuaaaacuuauuuuaaaucacccuuuaaagugccaaguggcagaauuaagaccagugauugaauugaguacaagaagguacauuucaacucaaccuuuagaaaguucaaguuucuauaagagaugugaaaaaugauaugaccuggcauucaaaagaaaaaagaaaaaaaacaagugaaauggcacuucucauucauaaaagugaauucaguauuacuggagucaaauagggacugagauguuauccggacacuuuaaagaaaaauuucugaauuugaaugagguaguuuuucauuuuccuucugacccuaagguucugggauugaaaguggcacuugccuagaaacugggaauuuuguuuauuaauuuagaccuuuaaaaaauacgaaaauauuuagugaaugcuguuuugucccagggauccuucuagguuccagggagacagcagugaaaagaagggcaaagucccagcucucaucgaauuacauuguagucagggaagguagugcccugaagaaaaauaaagcagagaaagcagaguagcugugggguaggugguuuguauagugacugacagccucucugaaccgaaccuuggaugcauugaggaaguaagugaaggcugugcuuugaauggggcacuccaggcaguaggaagguaaguagaaagccccaaggcaggagcacuaccuggcauguaaguucuaagcucauuaaagguauuacucaugaaggugcucuuaggcuucaguuguacagaugaggaaacagguggaaagcuaaguaacucgccaguggguuagugaguggcaaagccagggcagggcuuaaaaccaggcccguggccuggcacggcggcucacaucuguaaucccagcacuuugggaggccaaggcagguggaucaccugaggucaggaguuggagaccagccuggccaacguggcaaaaccucaucucuacuaaaaauacaaaaauuagcuggguauggugacugaagcccauaaucccagcuacucagggggcugaggcaggagaaucgcuagaacccgggagacagagguugcagugagccgagaucaugccacuucacuccagccugggcaacagagcgagacucucucucucaaaaaaaaagccaggcccuuggagucuggagcacguggucugaaucuguagguugugcaacagacuguaaugaggacuuuagauuuuacuguaagaugagaagugauagaggguuuuaaguagaaauguaacaugauaugaauugacuuuuuuuuuuuuuuuuuuuuuuuuuugagacagccucucgcucugucacccaggcuagagugccauggcacaaucucagcuuacugcaaccucccccucccagauucaagcaauucuccugccucagccuccugaguagcugggaucacaggugugcaccaccacaccuggcuaauuuuuguauuuuuaguagagaugggguuucaccauguuggucaggcuggucucaaacuccugacuuugugauccacccaccgcggccucccaaagugcuaggauuacaggcaugagccaccacgccuggccaugaauugacuuuuuaaaagagcuggguucuguguggaaaauagucuguagcugguuaucuguggaagcugaaaaccaguuaggaaguuauuguauucaacucaggugagagaaacugguacugagacuggagugagaguggugcugcugagaagugcuuagaacguggauguacuggggaaguagagcugaucaaauguguugaugaauuggacgcagaauaugagagcaaaagagucaucggagugacucagguuuuuggcccgagugccaguaagaaugucgucguaaaaaauuagccaggcgugguggugggcgccuguagucccagcuacucaugaggcugaggcgggagaauggcaugaaccuggaaggcagagcuugcagugagccgagaucgcgccacugcacuccagccugggcgacagagcgagacuccaucucagaaaaaaaaaaaaaaggaugucgucauauuuucucugauggggaagacuagaggaggagcagguuuggagggggcuagaaauccagugcaguuuuaagcaggugaguuugagaugccacucacacgccccuugagagcugucaaguugacacuuccauauauaaaauuggagguuaggacugaucagaacuugaccguaaaggagaacauauauucagggcaacuucaaucuaugcucccagugaaaaaauaauaauuaaaaagugauaacuuaggccaggcgcaguggcucaugccaguaaucccagcacuuugggaggccaaggcgggcagaucaccugaggucgagaguuugagaccagccugaccaacaugaagaaaccccgucucuacuaaaaauacaaaauuagccgggugugguggugcaugccuguaaucccagcuacuugagaggcugaggcaggagaaucgcuugaacccaggagguucaaccggagguugcagugagcugagauugcgccauggcacuccagccugggcaacaagagcgaaacuccgucucaaaaaauaauaauaauaacuugaccuuuagaagucguaagcauacauauuauacuacauaccaugggucaggaugaaccaccugaguagugaaaguggagaggaggacugagaccuagggcacucuaauacauggaagauagagggaugagaagagucuagcacagaagagcgaggcucagucagcaaggaaagaagagaacggagaagcauguccuagaagacaagggaggaagauguuuuuaggaggaaggaagaauugugucaauugucacagcuagguuaagaaagaugaagagugagaacuguucauugaauuuggcugcauggaggucauugggaagcuccauuguuaggagcucagcccagugauauguauagaagcauuacuggaaauguucaagagagagggcagugucauuaaaaaaauggaggccaggcacaguggcucaacaccuguagucccagcacuuugggaggcugaggcgggaggauugcuugaggccaggaguuuaagaccagccuggacaacauagcaagaccccaucucaaaaaaaaaaauuagcuguguguagugacacaacuacucaggagacugaggcaggaggaucauuuuagcccaggacuuugaaguuacagugagccaagaucaugccacugcauuccagccuggacaacagagcaagacccugccucaaaaaaaaaaaaaaaauuaaagaguauaugugaggccaggugcagugguucacggcuguaauccuaacauuuugggaggcugagucggguggaucgcuuaagcucaggaguuugagaccagccugggcaacauggcaagacugccucuacuaaaaauacaaaaaaauagcugggcaaaaaaauagcugaccgugcuuguggucccagcuucucaggaggcugaggugggaggaucguuugagccuggcagguggagguugcaguaagccaagauugcaccacuguacuccagccugggcaacagagacccuaucucaaaacaaacaaaaaaguguauguguguguguucgguguauguguaaagagagagagaggcagacaaaaauguuaaacuauuaacaguuguuuaggugaaggauacauuggguauucauuguaccacuuuuccaacuugucuguauggaauuuuuucaaaaagaacuggagggauaagaaaagaguaaaugggaagaaaggaaauggaaacaauaacuaaagggucugcaugucuugcaaagagaagcaaugaaauggggcauuggagggaaauaugagagucaagguuuucauuuuuuguuugaauucuguagagaaugcagcugauagucaugauccaauacagaggaaaaacugaucuagcagagagagggaacugacgauguaguuucuacuuacacaucaaagucuggcuccuuaauaacaaggaaguuauuauuucuaauaauuccauccaaaaauaaauuguuaaaacaguuaaucauaaucuuacauuauuuaaugucuuuuuuucugcuuaaauagcaauauuuuuugacuuguuuucugcagguuguaggaaguguccuguauuuuacuaauuuuugccuugauaaauuggggcaaccgcuucuaaaugaaaacccucagcuuuccgaaggaugggaaauacccaaguauccuacauagugaaugaagaucuuuuaugcaucuugccacuaaguucaccuuuaaaacaauuuccaaauuuugcagaccaugauaacuauuccuuaauaaaauucacuaaagguaccaucaagucuucagccacauuguuucucuagaagggcaagaaauacaaguaaaggcaaaaagguuuguguggggaguuguuuuguuuuacuuauuuacuuuuuuaaccaaaaucauaaacuuuuggcuugaaaaguucauguucuuuacugcugguuuacucuaagguuaauuacagauugagcuagaauuuuaauccauacauauauguuaaauguuuaaaugaaucaucugcuuccuggaauucauugguucucaccuaaugugccuggguggguggaaagguauaauuguugcugucaauuugauugcagucuuauaaccaucugccuucuuuccauguuaccuaacggaaauaugaucaauguguucaccuugauucuucguuguuaaccacugaaaaaacucaaaagagguaacagaucagucaggaacagaaggguucuugguuaaaagacucugcauaguacuauuuaaaucacuaaauaaaggagauuaaaguguacuucuuguugcagauauuagugaucugugaucaacuugcuuucuugucucucugauacacuuugcugucauauagaauuuuauugauuugcuuuucuauuuuuauugacauuauaaaaaucuuugucuuuugaccaaauaggccaaagccucacuguuucaauugugguucugaagaacaccaaaugaaagauugcccaaugguaaauuuuucucauguuaagaaaagucuuugaacaagagcuuucuaauguuuucaacacauuuauguuauuguaugacaugaaggaacuuucuuuguuccuuuaauuugaaaucuuguguccuuuaauuugaaaucuuuucaaauuuguguucauauuuuaagacauuaaauuuuuucaguaaauaauuuaaaacaguguccuuuaauuugaaaucuuuucaaauuuguguucauauuuuaagacauuaaauuuuuucaguaaauaauuuaaaacaguacucuuuguauuugagaugaauaaacaugagaauuaaauuguagaguuuauccuaaaaacuugauuuaauuuaugauaauagguaauaaauagacugcuccuuuccuuacguauuuuucuaaaauauucacccucuuuuacacuuguucguuauacauuaaaacuaaaauaaucuguuuacuugaucuaaaaaaaaguauuuuuauuuaauuucugaaauauuucugaguugcaugaaaccauucuuuucaaaugugucaugauguagccucggaaugcugcucgaauaagugaaaagagaaaagaguauauggaugccuguggagaagcaaacaaucagaauuuccagcagcgauaccacgcagaagaaguagaagaaagauuuggaagauucaagccaggaguuauuagguacuaauggcauuuuaccauagaaggucauuuuuauuucccuagcauuuggaauguucugugucucuuugggcuaauuaucaggauauaaguguacucuggcaaagcccuagguaauauacauuaauucauuuagaaacacuucuuuaaauuuuaauuuauauuuguuagacgucaugguauguaauauaagcaagaaauguuuuaaaauaccagaauacuauguguuuucaugcaaauaagaauucaguauuuuucuuccuccuuuauuuuuacuuagugaggaacuucaagaugcacuaggugugacagacaagagucuuccaccuuuuaucuaucggaugcgccagcuaggguacccaccaggguggcucaaagaggcugaauuggagaauucggggcuugcacucuaugauggaaaagguauaguaucuuaaguuagagaagucaccuuaaguguuuccuuuuuuuuuuuaauuaaagaaucacaacaaaaugugauaggaauggccggcuucuuuaaugugugcuaacuaaaaaauaucaugaugauguuuccuugguaaauuuuacaaggaaggaauaaaauuucagugaguuuguagauuaucugaugguuuucugggcuugcucagguacugucuaggccagaguaucaccucuccagccaguccucauaagcucuuaucuuugucaguaauaauaacagacauaaauccuaaaugccaggagaccuguaaaauguaaaauacagaaaaccucuaauagucuagaacuucucuccuagauaccuacccuagaaagauauucacacauaugaaaaggaaauuguauguauacaagaaucuuuuuguaucauugaauaugauagugaaaaaucuacgacaacauuaaggcccuaaaaaagaaugguuaaauaaauugguaguucugagcuguggacucccugcaacauacaugaagaguggaauaaaucuguaugagcugacauggcaaaaucuuugugcaguauugaguuuuuaaaaagcagguuucagccgggcacaguggcucauggcuguaaucccaggauuuuuggaggccgagauggguggaucaguugcggucaggaguucaagaccagccuagccaagacggugaaacccggccucuacuaaaaauacaaaaauuagccaagcgugguggcaggcgccuguaaucccagcuacucgggaggcugaggcaguggguggaucucuugagcucaggaguuugagaccagccugggcaccaucgugaaaccccgucucuacuaaaaauacacagccuacccuggugugguugugcguucauguaguaccagcuauuuaggaggcugaggugggaggaucacuugagccugagaggcagaagcuguagugagccaagauggugccacugcacuccagccuggugacaaagcaagacccuuucucaaaaaaaaaaaaaaaaaguucuguccuaaugauuuagaaaaauuauaaugaaaauugaaagccauuucaaaacuaauucuguugccaugauuauaagcacuuuccagguguacuuuuggucuggggagggauauauauugacauuuagcaauauuaacacuuuuuauggucuguaauagauggcacugauggggaaacagaaguuggagaaauacaacagaauaaaagugucacuuacgaucucucaaaauuggucaacuauccugguuuuaauauaucuacucccagaggaauuccagacguaaguauauugauuuuuuuaaauuaucaugugaugugauauuauuauguuaaagauuggucaaaauauuaacuuguuggcuaggcauaguggcucacaccuguaaucccaacacuuugggaguccgaggcaagaugaucacuugagucccagaguucgagaccagccugggcaacauagcaagaccuugucucuaugaaaaaauuuaaaaacuagccaagggugguggcacaugccuguaguccuggcuacuagggaggcuggggugggaggauugcagagguuacagugaggugagaucacacuagacccugucucaaaaaauaauuaguuaauucauauacaccuacaaacuuauauagcaguuacuauuuaaaggaauaaauuuguuacuuguuuacauuuuuaauuucuuuuauagaaucuuucuagaaucuuaauugaagucuuauauucaucaacagcaguuuucucugauuuugugcccucagaaagggagccaaaauagauugguuagaguaucuaaaucuaaaaguacucuaacauuuuaaaaguuuuuaacaauauggauuuuucugagacaguauuauuaauuuuacagaauuaacuugggaaauaaguuucuaucuauaauaaaucuaaauauauuaucacucuuuuuccugauuauucuugccuuuuuuccccucaaaguaaaauuucucauuuuuuauaugaaugguuuuuccauacuuaacucuuuuccagcuuccaucuuaggucucaggauucaacaaugaacuauuguacuguuuuauuuaaaaagcauauucuuggccggcgcaguggcccgugccuguaaucccagcacuuugggaagccaaggcggguggaucaccuggagcucaggaguuugagaccagccuggccaacauggcaaaauccuaucucuacuaaaaauauaaaaauuagcugagcgugguggcaggcgccuauaaucccagcuacucaggaggcugaagcagaagaaucacuugaaccaaggagguggagguugcagugagccgagaucgugccauugcacuuuagccugggugaugaaagcaaaacuccaucucaaaaaauauaaaaauaaaaaguguauccuugguguucuuaggaacuggacaguagggaaacagccaaagacuugaaguuagagucuagugagcagauagaaaguucucaaucacgcaagacuguguaauucauuacgggcggaagugcaugauacaaaccaucagugcuucuggaagccaguccagcuuccagucuacuucagaguccccugggaauacucguuagaaauguacauucuugagucccacccuuagacuuaacugauucaaaaccuagaaccuguauguuucacaagaguuccaugggauucuuaccgagaaccacuguugaaugugcgauuggagaugagagagaaacaagcuguguggaaucuuuaaagaugaugcuguauuuggaaagagaaagagcagaagauagaaaacucaugaguaaguguguuaggagaauugggcgaugaauggcccuguuagcagugccagugcuugaugggagagagacuggagccugggaggccccauagcagucacuccugccuacaucuucugcuugcaguauguagaaccuuuuuuggccaagugauugugucagguagucuuuuaguauucagucuuaauuauuuugcaggcaaguuuaguuuuccuucaacacauuauuuuccuuaauuuccaauaaaggaaaaguaacauaagaaggaaaaauguaauuugagaucuccacuguaccuccuuugagcaaaaucucaaaacaugacauuuuccaaauacauguguuuuuuuuuuccuucucuuuucaucauuaggaauggaggaucuuugguuccauaccaaugcaggcaugucagcagaaggauguguuugccaauuaccuuacuucuaacuuccaagcgguaaauagauuuuaagggugugcucuauaaaauguuguugugucugcgagauuguguaauuuauuagcgucuuacagccuuuucuugcuuuguuaucuugacaaaccaaaaggaaaacaguggcaaaauucaccaauuaccuagacuuaacuccagauuguuuuucuacaucauuuuaagugaagggauggaguuuaauucauuaucuaccccgcuuaacuuguguuuggucugguugcucuuuuagccaggugugaagucuggcaacaagaggucuucaucucacucuagcccagguaguccaaagaagcagaagaaugaaagcaacucagcgggaucucccgccgacauggagcucgauucagguagguuucauccuauggcucugauuucucucuuuuuuuuuuuuuuuuuugagauggagucucacucuugucacccaggcuggaguacaauggcgugaucucggcucaccgcaaccucugccucccggguucaaguauucucccgccucagccucccgaguaguugggauuacaggcaugcaucaccacgcccagcuaauuuuuguacuuuuuuuuuuuuaguagagacaggguuucaccaucuugaccaggcuggucucgaacuccugaccuugugauccacccaccucagccucccaaagugcugggauuacaggcgugagccaccgugcccggccccugucuucauuuucaaauucacagagagaauuuaaagaccaugaauuaagccgggcgcgguggcucacgccuguaaucccagcacuuugggaggcugaggcaggcgggucacaagguaaggagaucaagacaauccuggcaaacauggugaaacccugucucuauuaaaaauacaaaaaauuagcugggcaugguggugggcgccuguagucccagcuacucgggaggcugaggcaggagaauggcaugaaccagggagguggagguugcagugagccgagaucacgccacugcacuccagccuuggcgaaagugugagccuccaucucaaaaaaaaaaaagaucaugaauuaaauucccuuaaaguucaaagggauuaaagccccacaucaaauuauuuugcacaagugacuucaaaguucagaaucaaagcccucaaauuauuuccccuaaguuuuucuuuguuuuuucgguuguuuuucgagacagaguuucacugucucccaggcuggagugcaguggcgugaucuuggcucacugcaaccuccgccucucagguucaagcgauucuccugccucagccucccaaguagcugggauuacaggugcccgccaccacgccuggcuaauuuuguauuuuuaguagagauggaguuucuccguguuagccaggcuggucuugagcuccugaccucaggugaucugcccgccuccaccucccaaagugcugggauuauaggugugagccaccgugccuggcccaugguugucauuuuuugaaguuuggggauuuguggugguggcaccccugucaccagggucacacacuucuguguaggcauuuucaguuuuguacuaggggcucuuuccucuauuucuguuuuguuuuguuuuuuguuuuuuuuuuugagacaggaucuggcucgguugcccaggcuggagugcaguggugcgaucauggcucagugcagccucagacuccugggaucaagcaguccucccaccucagccucccauguagcugggaguauaggcauaugccaccaaacccagcugauuuuuguauauuuuguagacaccgaggucuuauuuuguugcccaggcugauauugaacuccugaguuuaagcaaucugccugccucagccucccaauguuacuggcaugagccaccgugcugggccaugaguugacuucuaagugagaguuuguuauucucacaaaucuuauugucuauagaauaaaguucagacccccuacuagacccugaggcagaaagcuuaauaagacaguauugcugcccuaguuaccacucucugucaccucgggauugcagauguguaaacaucauuuucauauaaaugugguggcccacagugauauauacagaaugauaguauuacauauugcugccacagagcaguuccagacuguaaugguggcacagaggaaaaacagcaucugugcugaaugaagucauaggguaacuuugaacugcaucuugagggaugaaugcagggauuuaccaaggaaaugaggaggagggcauuugagacagagggaagugcagaugcaggauagugaaacuucacagcacaucaggccagcagcagggugacagcuggaguuugagccaggcaauaggaggugacaugauggaaguaaggaaacuauauccuagagggccauggaggaagauuggacuucauccuguggggucugggcaggcacugaaugguuuccaauggagaugggaaagguuauagggccagacuugugaugaaucuggcagcgguuuggaggacagacacaaggaagaugaauccagaggucagggugauucugauguuccuggcaaaugucaugggccugaagcaagguagcggcuguggcagccagcaggagagcaugcaccccagagagccaaagaccuggggauggauggaaggaaagagaguacucucagaggacaagcagauccacugguggugccauuugugagaacagcagaugggaaaacaguccucauuuuaggaagagaucauuuguuuuggacagguuguaucuguggaacguguaggugaugauggucagugggcaguuagauaugugaaccugcaguucaggcgagcaguguagauuagagaaaacaauugggggccaggcacaguggcucaggccuguaaucucagcacuuugggaggccgaggugggcggaucacuugagaucaggaguucgaaaccagccuggccaacauggagaaaccccaucucuacuaaaaauacaaaacagccgggcauguuggcgugcgcuguaaucccagcuacuugggaggcagaggcagaagaacugcuugaacccgggaggcagagguugcagccagcugaaaucaugccacugcacuccagccugggcaacagagcaagacuccaucucaaaaauaaaaaauugggaaauugggcaauuaggcuaggugcaguugcucaugccuauaaucccagcauuuugggaggccaaggcagguggaucaccugaggucaggaguucgagaccagccuggccaacauggugaaacccugucucuacuaaaaauacaaaaauuugccaggcgugguggugcacaacuguaauugcagcuacucgggaggcugaggcaggagaauugcuugaacccaggagacggaggauacagugagcuaagauugugccacugcacuccagccuggguggcagaguaagacugucucaaaaaaaaaaaaaaaaaaaagagcuaggaaauaacccaagguguacuccugccuugccccucacuuccuccccauuagccuuccacccacucaguaaccagccugcaccuccagucaaauuuccuacugcauucugccacaaauuuuuggguagagugcacugccuugaaauucugaagucuccaugcaauugcucgcauuuccucaaucuaaaaugaugcacacagcacagaaacagaucucccgagggauagccuuuagcaccagaagauccugacagcuaucccugcagaucuuuucagguggacugaggauaccagguggugguaauggcaccugagaauccagaauuucccucauguuaagccaguuauuuuuggccauugaauuacuggauacaccugaguucaaauaacaaauuuuaguaaaaccaaaugcuauuauaaguucuaaaguaucucuuaacuuucuuacuucagauauggagguaccacaugguucucagagcagcgaaaguuuucaguuucaaccaccauuaccuccugacacuccuccacucccccggggaacuccuccacccgucuucaccccuccacucccaaagggcaccccgccgcugacucccagugacucaccccagaccagaacagcaucuggagcuguggaugaggacgcacugacucuagaagaacuugaagaacagcagaggcggaucugggcagcucuugagcaggccgagagcguaaacagcgacuccgacguuccuguggacacaccuuuaacuggcaauuccguugccucaucaccuuguccaaaugagcuagaccucccugucccggagggaaaaacaucugaaaagcagacgcuggaugagccugagguaccagagauuuuuacaaagaaaucagaagcuggacaugccuccaguccagacucugaggugacaucacuuugucagaaggaaaaagcagaguuggcuccgguaaacacugaaggugcccuucuugauaauggcagugucguaccaaacugugacaucagcaaugggggcagccagaagcucuuuccugcagacaccaguccuucaacggccacuaaaauucauagcccuauaccugacaugagcaaauuugcaacuggaaucacgccauuugaauuugagaauauggcagaaucuacuggaauguaccucaggauaagaagcuuguuaaagaacucaccccgaaaccagcagaaaaacaaaaaggccucugaauaauggcuugacuuagcacugagagcuauuuaauaacuuuguuccguuaauuaguacuaauuaaguggauagauagaaugguuuuccuguuugucccucccauguuuaaaaaucuauccaagguucauguuccaaagucaagccuauuuuaaagaaagacugagcucacuaguucaguauauuuuauucucacugacaaaacuuggggggagaugugaauaugaccugguuuagagaggguuuguuaagguuuauacuauuuuuggauugugacuauccgucgagagugaugguuuuuaucugucuuuuguacauuguuuucccuuucuacauuuugcuaauuauccuguauauaaguuuaauauaucacuuuuuaaaagaaaaaauucuaccauuuuaaauucauguuucaacuccuacaaccaaaugagaaaaaucagggaugagcagcuuuaucccauuugggguauuuuuguaagugauuuacaugugucaauuuuaguaauacuuuuacuuuuuuguaacuucauccuucauauaugcuugcuauacagguauguucaucuuuguguacagagguuuaauaaauuaguuuucauauacauaaucuaagacuuugaauacaaaaaagugauucacagguaaaaucaguguauauaaccuuuuuuuuuuuugagacaaggguuucacucuuguugcccaggcuggagugcaauggcacaaucucggcucaccgcaaccuccgccucccgaguuuaagcgauucuccugccucagccuccggaguagcugggauuacaggcaugugccaccacgcccagcuaacuucguauuuuuaguagagaugggguuucuccacgucgggucaggcuggucuugaccuccugacuucaggugaucugcccgcccagccucccaaagugcugggauuacaggcguaagccaccucaccuggccggugcauauaacuuuuaaguuuaaaaguaaauuguuggccaggcgugguggcucaugcuuauaauccuagcacuuugggaggccaaggaggaaggaucaccugaggucaggaguucgagaccagccuggccaacauggcaaaaccccaucucuacauaaauacaaaaauuagccagguguggugguacaugccuguaaucccagcuacucgggaggcugaggcaggagaaucacuugaaccugggagugggagguugcagugagccgaggucgcgccauugcacuccagccugggcaacaagagcaaaacuccaucucaaaaaaaaaaaaaaaaaaagguaaauuguaaaaaucagugguagcaaaacaaaaauaaugauaggaauugcaaguuuggguguuuucaguggauuucagccuuaaauauagaaacagcagaauuuuugaaaaguaauuauuuugaaaaaugaauggcaugcagcuagccuuuguauaaaaauaauuuucuagauuugaacccuaauaguuaaaaauuaaaaauuaaacauaaacauacugcuuuuaauugucagguauauauauaagauagagcugaaacugugguuuaggucuuucuguggaaugccauuacaucuuuauauuagucaaguccaugaaaauaaauguuuagaucgucuugaauuguuagucucaggcaguguuauccugcucucaggccaacagggggagcaaaauagaaacauuccagauauagcuuucauuuuugagaacuugaguaaucagaauuuacuguucuguaaagaauaaaggaaaggaaaauuauaaagagagaaauuucuuuuuaaagcccucacagaaugugcuagaaauagaauaaaauuuaaaauacuuuuggcuucuuuuccucagcuuaaguucaaaauaaaagcaauccuuuacaguug

SEQ ID NO: 191523 - RNA, 99139 nt, Homo sapiens
ggcauggaaccuaaagacuagaggcgguugugugagucaggaagaggggccagauaucugaguguuccucuuuaguuucuucaauugcaggugaggacggggagcugcgcuguguagggaacuggggguggguucaggacgaaguagcugcagccucugcucaguuccuguuguuuuccccuugacgcuggcaggagagagguuggagucgguuuuugcuggcggcgauguccagcggagagcguuuaaguauggaggccuaacugacaaguguuucaucuugcucauucucucguauucgcgaaucuguucugcauuccgccgccagagugaucucaaaauuauaaaaucagaccacucguuugcugaguuccccuucuaccccuuguacugagaauaaaauucaaucuugaggucgagguuuuauuggacuccacugcucucucccucacugucuucugcuuuugcuuugacccggcagcagcaucaaacgcuuccuacccagccuccgagucuuugcacucuguucccucugccuacgucgcguuccgccuaaguuuugcguacuucuuguuauucaggucucagcucagaugucaccuccuucccuucccaaacaaauccuucuucagcgacgccucaccuuauccauuuaaucacuguuuccuucaaaucauuuagcacuuuuuguaauuauuugugcaguugcuuuuuuguggagguagcauaacaagauacguauuaacaauuuuauuuuuguccguuuuucccgcaaaaacauaaacuucauaauggcaaagacauuuuguguucuguucaagcuauauucccaguuccuagaaaggugucuggcacauaguaaauagguauucaauaaacauuuguugaauaaguaaauauggcaguuacgggcgguuucucuauuucacagaugugggaaauugagacccauaaagguauucauuccaaccugucccuccuucuucaucuccucacucccacccaaacaccagccacugaaacuucucuauucuccaaacauguuuuguuucuguucccuugcuuaugcucuuaggaagaacucuuuaaacauuuauaaaacuaugaucuucaauucucagcccaauaacaaauuagcuaacaccuaaaauugaauguuugccaucaaccaagcauuguucugugaacauuuaaaacucaaaacauuuggaggcugaagcagaaggauugcuugagcccaggagaucaaggccagccagggcaaaauagugagacccucgucucucaaaaaaccagaagugaaaaauagaaaacuccuucagguggguacaacuaaauuagucccuugguauugguauccaugggagauugguuccaggaccucccacagauaccaaaacccuaggaugcuuaagucccugucauuaaauggcauaguauuugcauguagccuaggaacaucugccuguauacuuuaaaucaucucuugauuucuuaucuugcguaacaguguaaaugugcuaugccuguaggugcaaucuagggauguggaacacauggauauugacggcaaacuguauauauauauuuuuuuuccaagacggaguuucacucuuguugcccaagcuggagugcaaguggcacgaucucgacuuacugcaaccuccgccucccggguucaagcaauucuacagccucagccuccugaguagcugggauuacaggcgcacaccaccacgcccggcuaauuuuuuguguuuuuaguagagaggggguuucgucauguuggccaggcuggucucaaacuccugaccucagauaauccaccugccuaagccucccaaaguucugggauuacaggugugagccaccgcgccggccuggucuguauauuccuauuuuauaaauuagagaauugaggaacagaaagauuaagugaucacccaaggacagcugccuagucauugugaaagagcaccaagucagaaauuguuucuaccuugugcuauaccuuuuauagauauugaaacauacuucuaguagcacuuaugaaaccaauuguaauuauuugauuaucauucccuaccagucuugauccaaggauuguuuuuauccuuaguguucuuuucccacccagacuccagguaauaugguuuauguaaaccuuugcuuuuugagauggguaaaccucauaagguuucaagcuuagucuuugauccagaaaccuaauucauuuuuuucuccuccccuuaucauuuuuauuuguuguauaauaauacuaugauagcaucaauggacuuuuucugaacuucaucuggaaucuuaucauccuaugauaucccugacaaucuggcaucuaaaccuacacuguuugcugcuauuaaagguuuauuucuaaugaaagguuuauuucuaaugaaaacuugguauaauuaaagguuuauuucuaaugaaaacuugguauaauuccaaacuagacacacaaaguaauggaagcucuaagauacauugguaagaucagaauuguugguuugugugcauaaaccaauauguuguucucugguaaccaucauagcucuaguuccauuuauguuauuggcccgaaguguuuaguggccacagcaauaacaagaagacuaagaugucuguauauguuaauguuagacuuuuguuuuuguuuugugaguaagcuuuaucauuucccaaggaaccagguucuaugcaacaagauaauauggugucuaauuuuauguuguucaggaaagacagugguuccugacucaggaagacagucucagaaacauguggaaugauauugagcugcuaacaaaugaugauaccggaaguggguaccugagugucgguucaagaaaagaacauggaacugcuuuauaucaaguagauuugcuagugaagaucucuucugaaaagguagugauuauuacacugacuguuucauucacagaauuuuuacugagugcuuaguagggcuaguggcccacaguaaauauuuugugaaugaacauagcacuuccucagggaaucaagauucaaucucagauugcuagaaauucacgucugaauacccucugcaucaugucaggaucaguauuuucacaacugaaggauucuuaguuccucuugauauuucaugcauacaaaaauauguguaaguugauacaaaggauaucuuuuuuuuuuuuuuuugagacagauucuuacucugucacccaggcuggagugcaguggugugaucacggcucacugcaaucucugacucccagauucaagugauucucgugccucagccucccaaguagcugagauuacaguugugugccaccaugcucagcuaauuuuuuguauuuuuguaaagaugggguuucuccauguuggccaggcuggucuugaacuccuggccucaagaaauccacccaccucagccucccaaagugcugggauuacaggugugagccaucacucccggcauacaaagaauaucuacgacugacuuaggaaauaaaauguuacaaauagaguugaaggcucugaggguccaucccugaaucuguguuccuccuguuuccuaccagagucaagcacccugcugaguaugagguuuauccgugcauuucuuucuacauuuuaacuuucuucugucaguaauugcaccauucuugcuucaugccugaaaccuuauucuuugcauucuauagaagguacuauuagcugggugugguggcaugcacauguagucccagcuacuugggaggcugguauuuaauucuuuuuuuuuuuuaauaaaagaaauuuuuuuucacucaaauggaaucugacagauaaggcagggcauccacuguggacguuauuccuaaagggaauuaaauguaugcuuuugacuuuuuuuuuuaaacuggcugaugggauuuuaaaaagaaaucauucuuuaugcagcuuuaagcuggugucuguggaacugugcugcuuuuucuugcuguggugcuaucucggcucggcucacugcaaccucugccuccuggguucaaaaaauucuccugucucaauuucccaaguagcugggauuacaggugugugccaccaugcuacuaaaaauuuucguauuuuuaguagagaugggguugcccaggcuggucuugaacuccuggccucaagugauccgccugccuuggccucccaaagugcugggauuaaaggcaugagucacugugccugauuuguaccgcuuuaaauguaccaugaaucauguuaaaggcaguauaauccaacaauaagauaauuaguauaagauaaacauuaauuaugaguaguacaaaucucauuguauuuuuugucauuauuuauuagaggcaaaaauuucaagugcagcauuucuuuuuuuuaaauuuuuugaauccuucgagacaucugaaagcacaguuucuauaaugaggaaaugacgucuauuuuuuaguauuuuuguucguuuguuugagauggagucuugcucugucgcccaggcuggaguacaguggcaugaucucagcucacugcaagcucugccucccagguucacgccauucuccugccucagccucucaaguagcugggacuacaggcgcccgccacuaugcccagcuaauuuuuuguauuuuuaguagagacgggguuucaccauguuagccaggauggucucgaucuccugaccucgugauccgcccggcucggccucccaaagugcugggauuacaggcuugagccaccgcacccggccauuuguuuuuuuuuuuuuuaagagagacucucacucuguagcccaggcuggaguacagugaugugauauugacucauuacaaccucccacuccuggauucaagugauucuccugccucagccucuggaguagcugggauuauaggcgccugccaccacgccuggcuaauuuuucuuuuuuuuuuuuuuuuuuuuugagacgaacucuugcucugucaccaggcuggagugcaguggcgugaucuuggcucauugcaaccuccgccuccuggguucaagcgauucuucugccucacccucccgaguaacugggaauacagacacgagccaccacacccagcuaauuuuuguguuuuuaguagagaugaggcuucaccauguugagcaggauggucucgaucucuugaccuugugauccacccaccucggccucccaaaguucugggauuacaggugugaaucacugugcccgggcuuuauuuuuuaauauuaucaggagccuuaaaacguggaaguggcucaggccuuucuugaccucaagguugcuguugaaaaauaauagugcauguguauagaaucuuggauucugguaggaacuaaaauucuaucuauuauuagcacguggcauacacuuaccaacauguuuugaacaucugcuauguucugagcccaauauuaggaacuuggacauaagauggcaucuuauucauuccuuuuaggaucuuaccuuaaaguuaggcacacaggacacaaacaauaaaagaugcuuagcugugcaagucaguauaugcuaaaugccaaaugaacaguacagacaguaaaugaguaggaauucaguggcuggagagcucauugucgguugggcaguuuaaggagcauuuccuuaagaaacuaugugugagcccggugugguggcauguccuguagucccagcuacucaggcugaggcaggagaauggcgugagcccaggaguuugaggccagccugggcaacauagggagacaacaucucuaaaaaaaauaaaaauuaaaauaaacuacacuugcuuugggccuuaagaaggagaacagucuagagagaagagucuagagagaacaguguggacagaucccuagaagauauagugccguuccuuuucuuuuuuuuuuuuuugaggcagagucuugcucuguugcccaggcuggagugcaguggugugaucuuggcucacugcaaccucugccucucggguucaagugauucucgugccucagccuccccaguagcugggauuacaugcguccgccaccacgcccggcuaauuuuagugccauuccuuguuggcagugccuucauguaaccuuuuacuaguugaagaagcaaguaaaaagauaagaaggaggcugggcgcagugccucacauuuguauucccggcacuuugggugguugggauggaaggaucguuugaguccaggaguucuagaccagccuggccaacacagugaaaaccccgucucuauaaaagaaaaagaaaauuagccaggugugauggugugcauguguagucccagcuacuuggguuggggaggcacgaagaucccuugagcccagguguuuaaggcugcagugaguuaugauggcaucacugcauuccaaccugagcgacagagggagacccugucucaaaauaaagaaaaaaauaagguagaagagggaucagaauguuggggaauuuucaaggauuacaccuggagaagaugacuuuugaaauagucauaaaaugaggugauuagcuguauuuugucagggaagaauaggacugguuaacauuuauugagcauauacuaugugcagggcucucucauaagcccuuuacgugaauucguuuaaucuuuauucaggugaaccuuguagguauuauuauuguuacucuuuuacauggaguuaguugaugcauuugccuaagaucacuuagcuaguaagggacugagcuuccucaaccacuaaucugucccagugcuucaagacagcuaugugugggaggcucuuggcaacagaaacugaauacuggagacucugauuuggcuugucuacuguuuuuaaaaauguuggcuuagcugccaauauuuaaaaaucagaacauuucacauaaagauccagcuucuguugaugaauugggagguauggccaugccagugcugcauccccaccaggcuucccacuggcuggugugaaguagacucuauucuuucaugucugugggggcauggacccuccaguucacaguucaccaccguuccccugccuagcguauccacgacaccaagacuuuauuccaaucuugauuaauucauuauguuaauaccuggcuccugcagcauaaagucaauccugaggaaacaaggacuugaacaugagaauccuuugcccuuccugcucauccugaacuguuuuucuacuuaggauccuggauggauucaagauauaccauacaaagaaaaacucgaugauuaauuagauagaggggcuaaagaaaaaaagccugucaaguuuuaaagugggauauuugggaauuugaugauacuauugauaaguauuauuaaacacauauaaaaauguuugaauuuucaucaugcuuuucucucccacaggccucauuaaauccaaagauacaggcaugcagcuuaagugauggguuuauuauuguagccgaccaaucagugauauugcuugacaguauuuguagaucacuucaauugcaucuugucuuugguaaguauaauguagugaaugaaguaagauaaauuggaagucaaauacaucugcugccaauuucugcuggauugccuccucuuuacuccauuauuucuaagauuucaaauuagaccaauuucaaguaauuaagcuugagugcuuagugccuuauuugcguugggcacuagagucaaaggacacugagaugaucccuucucucaauacaucugaggggaaauacacauguaaagcaacaacuuaguuuacuugcuuguauuagaauacuauggaaaacaugagcucauuuguguucaaauuccugaaucuuguacagaauuucgguaucauuaauggguauuugcauauuuuuagaauuaauagcucucuaaaaauccuuuaacauacuuaugaauuaauucuucaucgagcuacaaggcuucaaguacaugcaaauguggauuugagagugaauuaaagcugggcgugguggcucaugccugcaaucccagcacuuugggaggcugaggccaccagaucacuugcggucaggaguucaagaccagccuggccaacauggugaaaccccauuucuacuaaaaauacaaaaaucacaccuguaauccuuguacuuuggaaggcccagguggguggauugccugagcucagggguuugagaccagccugggcaacauggugaaaucccguuuucucuacuaauauacaaaaauuagcuggccgugcuggugugcgccuauaguuccagcuacucgggaggcugagguaggagaauugcuugaaccugggagguggagguugcagugagccaagaucacuccacuacacuccagccugggugacagagcaaaacucugucuccaaaaacaacaacaacaacaaaaauuagcugggcaugguggcauacaccuguaaucccagcuacucaggagucugaggcaggagaaucgcuugaucccaggaggcagagguugcagugagccaagauuaugccacuauacucuagccugagugacagagugacagucgugucucaaaaacaaaaaaaagagugaauuaagggguaagucagugauuguacugagcuuaggcaagaauauuaugaaaguuuuuuuuuuuuuuuuuugagauggagucucucucgcucugucacccaggcuguagugcaguggcacaaucucggcucacugcaagcucugccucccggguucacaccauucuccugccucagccuccugaauagcugggacuacaggcgcccaccaccaugccugggcaauuuuuuguauuuuuuuuuuuuuuuaguagagacagcauuucaccauguuagccaggauggucucgaucuccugaccuugugaucugccugccucggccucccaaagugcugggauuauaggcaugagccacgacacccgaccccgaaaguuuuuucuuucuugaguagaaauuuuuuuuuuuuuugagauguagucucgcacugucgccuaggccggagugugguggcaugaugucagcucacugcaaccuccgccuccaggguccaagcaauucuccugccucagccucccaaguaucugggacuacaggcacccaucaccacgcccugcuaaucuuuuuuuguauuuuuagaagaaacaggguuucacuauguuggccaggcuggucucaaccucaugaucugcccgccucggccuccugaaguguugggauuacagacgugagccaccgugccaggccuuuuuuuuuuuuuucccugagacagucucgcucuguggcccaggcuggagugcaguggugcucucucagcucacugcaaccuccaccucccagguucaagagauucuucugccucagccucccaaguagcugggaguacaggcgccugccaccaugccugguaauuuuuguauuuuuaguagggucagguuucaccauguuggccaggcugcucucaaauuccugaccucaaaugauccacccaccuuggccucccaaagugcugggauuacaggcgugagccacugcacccggccauuaaauagaaauuuuaagagaaagauaguuguugaaacuuuuacauaagaacuuagacaacugaaaaggaaacagaacacaugcauuuuggaacauaucuugauugcaacauggaggcaagaaacuuguguuuuauggaaccuugacguauugacccugauugguccacaagauucacaguuucuucuauuaaguggugggaugaguaacgaugauccauuugugaaaagacauuguggcggaauaacuugaguucguaagccaguuacauacuauuguuuuucugucuugucccuucccucuuugcuuuguuuucuguuaccuuggccuucuugcuuuugcaugaauacaacaggcacuucccacuccaugaucuuuccuugagcuguguccaccaucugaaugcucggaaugcucuucaucuuagucauuuggcuaacuuccucaccucuuucaugucuccugugagcuuucuaauuaacacugcaaaaugcaccauucuucugagcucucuuaccuggcucuacauuuuuuuccccagaacaucuaucaccuucuuacaugucucacaguuuguuuauuaugcuaauuguuuaucagcuauuuuuuuuuuuuuuugagacggagucuggcucuguugccuaggcuggagugcaguggcgugauuucagcucacugcagccuccaccuccuggguucaagcgauucuccugucucagccuccugaguagacuggauuacaggcacaugccaccauguccggcuaauuuuauauuuuuaguagagacggaguuucaccauguuggccaggcuggucucgaacuccugaccucaagugaucugccugcuucggccucccaaagugcugggguuacaggugugagccaccacgccuggucauuuaucagcuauuucugucuuagaauaugagcucugugacggugguaaucuuuuguuacuguucucagauauauguaaaaggccuagaacaaaguuuaccauauaguaagugcucaguaaauauuucuugaccagcugcaugcaguggcucacaucuguaaccucagcacuuugggaggcagagauggacaaucgcuugagcucaggaguucgagaccagucuggguaacauggcaaaaccucgucuguacaaaaaauaccaaaaacuagcuggccauagugguguguaccuguggucccagcuaccugggaggcugaggugggagaauugccugacugagcccaggaagucuagggugcagugaacuggggugguaccacugcacuccagccuggguagcagagcgagacgcugucucaaaaacaaaacaaaacaaaaaauauuuguugacugaauaaaagucaacaacauucuuuuuuacuuucaucacaucuguuuugcaguauuuagaaguaacuuaaguaaucguuggcuuuuuaaugagaaaaauuuguauuuuuuuuguauugaaaauaaagauuuucgaaggaagcuuguaacuuugauuugaaauuuucagauacugaaguggauguaguuggccuuugucaagaaggaaaguuucuuuugguuggcgagagaaguggcaaccuacaucuuauucauguaacaucaaaacaaacacuacucacuaauguaagaucuuguuguauuuuaauuuucauuauuuaaauucuaaauaaucucuuagacaacuaaaacucuagcaaacuauuacuuaacauguguuuuaaauuaaagcaauguuuuuuugaacaauuaagcuuugaagguguuaccacagcuuggauccugaguucuuggcucucguguaaauagaaauuaacaccaggucaaacagaaauuuucccagggaauguuuaguaggcuuguggcucaaggaaucucaaggaaacagcguaugggaaagggaucccaagugcuagcuccccgaagggcuuagcucuugucauuuugaggaagcugaggugaaaaagggagugauuuguaggcauguagaggcagggaacuuuuagcgccugugaauuuuggucgcauccuuuuucauguguuguauaucucacuagcauguuaaaucuccaucccugggugugauuuuuaguaucauaauuagguuaaaauuaggaaauacuuggugaaaggccaggguugaaguccaccuugucuucagcuggcuggaucuggucaggugcuuagcaggacugcuagaauccugauuuaguaaccuuggaagauggucagguuuuuauuaggaaugcuagagucccacuuuaacaacuuugggagaaguaacuccaggagacaaaugguuagguucuuguaugguugggaauucagcuuggucagcuaacucaggagcaggcagcuuucugcuguuugauuccagucagcuuguuaagggaggcaggaagguagaggagggaaugcccagacauaugaagccuuuggggucuugguuaccaugucucuugccugccaggauugaguuucuucccuauacugaaugguauuuuaaauuaaaaaaauguuuuuuugaaaaauuaagcuuugaagguguuaccacagcuuggaucccgaauucuuggcucucacauaaauagaaauuagcaccaggucaaacaaaaauuuucuuaggccagguuuaguaggcuuguggcucaaggaaucgcaagggagcagucuugaagguauuuaguacacuuguccaaaauaguuuuccauuuuaaaaguaagauguuuagaauauaggcagaauuauugcuaaugauaauugauaacucuagaguuuaaagaauaaaauccuugauuguauuuuucuauguuuaauuuuauuauuugaaauuaauuugcauuuaggcauuuguucagaaagcuaacgaugaaaaucggcggacuuaccagaaucuugucauugagaaggaugguucaaaugaagguaaguuuuccugaauuuuuuuuugaaugacuuuuuuuuuuuuuuuuaauggagucucccuuugucgcccaggcuggagugcaguggcgcaaucucaggucacuggaaccaccagcucccagguucaggcgucuccugccucagccuccugaguagcugggauuacaggugugugccaccacgcccggcuaauuuuuguauuuuuaauagagauggaguuucaccauguuggccaggcuggucucaagcuccugaccucaagugagugauccaccugccucggccucccaaagugcugggauuacaggcgugagccacugcgcccagccugaaugacuucugacuaauauccaaucaaaaauucaaauuugugguuaauaaauuauauaaaaucauuauuaugcuaccuacauuuuuucuguuuuuuuuuuuuuugagacgaagugucccucuugucccccaggcuggagugcaauggcacgaccucggcucacugaaaccucugccuccugaguucaaacgauucuccugccucagccucccgaguagcugggauuacaggcaccugccaccacgccuggcuaauuuuuuguuuuuaguagagaugggguuucaccauguuggcuaggcuggucuugaacuccugaccucaggugaucugcccgccucaggugaucugccugugagccacugugccuggccuuuucuguauuuuuuauacauuuuuuucuaucaaugcaauuaauauuguaagaaacaauuuuuaaauuuuugaaaaaaauuuuuaaagcucuuuuuagauguuuaaauauauacuuuuccuaaauauaauauucugaacuuguuuuuacaguuuugagauuucuauagguuaccaaggagacauuauauucuuuuaaaauguguuucugggcuucaguauauuauuauauuuuuacuucaacaaguguuaacugggccuuaguuuauuuugauauaucugagauuuuuuuuucuggcacaugaaguuuguuguuuuaauaaaaguuucaaaagaaguuaacaauguuuuugcaaauaaccuacuaguucuuuguaaauaaguuuuaucuguaacauuacuauaauauuugaucauuagaauuuaaaugagcaggcugugugugguggcucacaucuguaauucuagcacuuuaggaggcugaggugggagcauugcuucagucuaggagcucgaaaccagccuggauaauauagagagaccgccaccucuacaaaaaauaaaaaauuagccacauguguuggugugugucuguagucccacuuucucaggaggcugaguugggaggaucucuugggccugcagugagcugcgaucgcugcacugcagugucuggccugcgagugcaggccauugcacuccagccugggagauagauugagacccugucucaaaaacaaaaaacaaaaaaaaaaccuucaaauugacauauuuuuaagguaguuccagauacuguuuguuugugcuugccugccugccugccugccugccugccuuccuuccuuccuuccuuccuuccuuccuuccuuccguccuuccucugucucucccucucuuuuuuuuuuuuucugagauggagucucacucugucacccaggcuggagagcaaugacgcaauuucagcucacugcaaccuccacuacccggguucaagcaauucuccugccucagccuccugaguagcugggacuacaggcacgcaccaccacaaccagcuaauuuuuauauuuuuaguagagacgggguuucaccauguuggucaggcuggucucgagcuccugaccucgugaucuaccugccuuggccucccaaaguguuggcauuacaggcgugagccacugcgccccgccucuuucugucuuucucucuuucuucaaaagccacguucaaacagacacugguuuaaauuuuauauccaugugccuuuuaaaguaacugauucccagccgugagcaguggcucaggccuguaaucccagcacuuugggaggcugaggcaagcagaucaugaggucaagagaucaagaccauccuggccaacauggugaaacccugucucuacuaaaaauacaaaaauuagcugggcaugguggugcacgccuguagucccagcuacuugggaggcugaggcaggagaauugcacccuagaggcggagguugcagggagccgagaucgcgcugcugcacuccagccuagcgacagaaugagacuccaucucaaaaaaaagaaacugauucugauuuuauuucaauagguaccuauuauaugcuacuucuuacauacaguggauuuuuuuguauuacaaaccuucagcuuuuaaaaauucaacaagguaaguaauacauuauauuuuuauuauugauuugcagcaauauuuacuaguuuuauuaauguaauaguaaaauuuuaaguacucucuuuaagcuuauuuuaucuuacuuguauuuaguuauaauuggguauacuguuaaguauucagaauacaguuauucuccucuguuagagcuggaacaguaucugaauaaauguaauuuugauauggccuucaaggagcuuaguuuggggagauaagcuucaacaguuuaguuggggagacaagacauaugcuagcacaauaguaaauacuuuuuaaugugguggaugaaccuggaaauggaaaugacuauguaguguuaauagugcagaacagggcuggcgugguggcucaugccuguaauccuggcacuuugggaggccaaggcgggcagaucaccugagguugggagugcaagaccagccugaccaacaugaagaaacccugucucuacuaaaaauacaaaauuagccagacaggguggcaggcgccuguaaucccagcuagucgggaagcugaggcaggagaauaauuugaacccaggaggcagaggugcggugagcugagaucacgcuguugcacuccagccugggcagcaagagcgaaacucugucucaaaaaaaaaaauauauagugcagaacaauaauguaaaauauguuuuaagcuaguagucuggaccauuuaucccucuaagccaagugaaauuauuugaggaauggauuuggaacagguauuuaacauuuuguuuuauuuuauuauuuuuauuuauuuauuuauuuuugagauggagucuugcucugucgcccaggcuggaguacagugguaugauaucggcucacugcaaccuccgcuucccagguucaagugauucuugugccucagucucccaaguaacugggauuacaggugcgcaccaccacaccuggcuaauuuuuguauuuuuacuagaggcgggguuucaccauguuggccaggcuggucucgaacuccucacgucaagugauuugcccgucuuggccucccaaagugcugggauuguaggcaugagccacugcgcccggccuaagugauauuuuuaaaauacugacuugccaggccugugcuacgucuuggguauaugacaagauugaagauuuguuuuccauagcuucaugauggagcuagaaacguaagagcuauuccaaacagugagaagcacaggagaguuggaguagggagaagauccccuuaguaggaagagaggugguaaggguagguauggagagguacuggcuggugcccugaaucuaacaugucacaguuagcguauuuuggucaggggcaaaacuuaauucucaccaguguucuuugaacuagauuguauuuaauuucaccuugacacaaaacaggugacuuguauuauuuuguagauuaauacuauacauuuagccugcuuucuuuuuuaaugcagcaauugagaauguagacuucaguacagcaaaaaagguaagaaaauaaauccauauuguccucuuaaaaaaauuacauuuaauauuaauguaguagaauguuucuguauauaauuggucuacuucuugauauuuuagaaauuauuaugauauaacauuuuaauaacauuucuauuuaaaaauacauuuaugcccguaaucccagcacuuugggaggccaagggggcggaucaccugagguccggaguucgagaccagccugaccaacuggagaaaccccaucucuacuaaaaaauacaaaauuagccggggggugguggcgcaugccuguacucccagcuacucaggaggcugaggcagggaauuacuugaacucgggaggcagagguuguggugagccgagauugcgccauugcacucuagccugggcaacaagagcaaaacucugucuccaaaaaaaaaaaaaaaaauuuauaacugauugauaucaacugauuuuagugauuuuauggagcauaaauauguauuauauauaugacguuguuguuuuuaauuuugcaguuacaaggacaaaucaaguccaguuuuauuucuacugaaaauuaucauacucuugguugucucagucuuguggcuggagauuuagcaagugaaguuccugugauaauugggguaauuguuuuuauaaaguuuuguuuuuuguugccuaaagcauuuucucagaaaaauguuuuuguuuugguuaaauugcaaaauaauuuguaacauauaaccgaaacaaggaaauuauaaaauuaagguaauuaaaaauaacucaauaaauaaauuucugucuuggaaaaaauauugcaucuuuacuuucccuagucuuuaccugaaaguacagcauuuuuuucaauuaugagagcagacaaaaacgauagaaaacaaaaccaaaaaauuccauuguuacaguaccugugacuuugucacuaauggaaaaacagcacauuauugcagcugucuugaaauaaauauuuacacaccacuacuucaaaauuauggucaucauaguuuuucuaauaggaaguguaauuacuacuggugacauacucacagggacugcugauucuacugcuuuuuguuuuuugggguuuuuguggccuacauucauaagugaaagaaauucuguuucagauggagauuagugaaaauaaagauguaaauuuuuugcccauccagcuucacaaauccguugaaucuugaaauaauucagguuaagaaccuuaguguuagagaaugguccuaaagaguaaagugucuuugauguaaugccugccuccuaagugauucuacguuauucuuagucuuggcuagcuaggcuacuugcaaguuuuguuauuagugaaaugggaacguggacaaggaugcacguagaaaagcacaauucauucacaaccauuggcauguauacauugcuguauaaugucuuauaucucauguuacauguaaaaaguaacauuucauuauugguaugucacuuccaguaacccugaucauaauuucuuuaaauuuugggggaaaauaccuaauguuauauucaaagaauaggcagaaacucaguauaauuacguuuacaacauuuuuacuugccaaauuuauauauuaagaaguagucagcugcgugucauggcaugcuccuauggucccagcuacuugggaagcugaggcagaagaauugcgugagcccaggaguaucaggcugcaguagcucugaucacaccugugaucaccccacuucacugcggccuggcaacacagugagauccugucucuaaaaagagaagaaacaaaaaagagagaaaagaagcagucauauuuccacauugagcauaucuaauuuaacauuucaccaggguuucaaagaauuuaaaauuaauauuuauaaauuuuuuuuccaaauaucugugguauuuuaaugaaaauacuuaucaaagacuauauuuuaaucauaauccuggaagaggucuuaaaaguucacugcaugucuuuagugcuaguugccuaaauacgcucauuaaauauuuaugugaaggcuggcaugguggcucaugccuguaaucccaacacuuugagaggcugaggugggaggauugcuugcacccaggagguugagaccagucucagcaacauagggagacccugucucuacaacaaauaguaaauuagccggguguggugaugcucaccuguagucccagcuacuggggaggcugaggugggaggaucgcuugagcccaggagauugaggcugcagugagcugugaucacugcccuccagccugggcaauggagugagacccugucucaaauuaaaaaaaaaaaaaaaauuguaauaaccaugaauuccaauaguacacuguuuuuuucauucucuucagaaaccaagagaggaacuggaagaugaaaccuaguuaaguuagaauauguaaauauauuuuaaaauuaguaaccuauaaaacuuacauguuucuacuuugaggaaggcucaggucuaagaaugaaauuugcauuuuaaguacuguguucauuuuuccagggaaccgguaauugugcauucucaaaaugggaaccagauucuuccaagaaaggaaugacaguuaagaaccuuauugaugcagagauuauuaaagguaaaauaaguuaaugaaacuacuuuagacaauuauuagugaguuuuaauuuuuaugucaguguacuuagacugacauaugggucauuuuacccuaccacucuuugaaacaagccagaauagcuugaugguuguucacauacagaacaguucuugacauguuacaguuguuacucuucauuuugggagguuuuacauuuuaguaaucaccuaacagaaauagaggcaggaauaaaggaaaaugggaccuaguaauuauguaguucugccuuucugugaauauguuaguuuuuuauuuagauauaugaaauauugaaauaaaauccugagacaucuuauuuucucuuuuguaggugcaaagaaguuccagcugauagacaaucuacuuuuuguucuugauacugauguauguuucuuguuucuccuucaauguuuuuacuugauauguuuuacaacaaaaaugucagacuuacaaaggcaaggguuuuagcuaggguggauaacuaucuuguguacugugcuuuuuuucaguauauguaccaaaaaguugauccugaaauguaauuuuuuuuuuuuuuuuugagauagaguuucgcucuuguuucccaggcuggagugcaauggugcgaucucggcucacugcaaccuccaccucccggguucaagcgauucuccugccucagccuccugaguagcugggauuacaggcgcccaucaccacgcccggcuaauuuuuuguauuuuuaguagagacgggguuucaccauguuggccaggcuggucucgaacuccugaccccaggugguccacccaccuuggccucccaaagugcugggauuacaggugugagccacugcgccuggucugaaauguaaauuuuuaaucauuaagaagacacguaggcuaggcgugguggcuagccuacuaaaaauacaaaaaauacaaaaauacaaaaaauuagcugggcgugguggugggcgccuguaaucccagcuacucaggaaucugaggcaggagaaucgcuugaaccugggagguggagguugcagugagccgagaucgcaccauugcacuccagccugggcgacaagagcaaaacucugucucaaaaaaaaaggacauguaaaugaaaugucucuauugcagaacgugcugaguuuaugggauauuuacacucuaacuccuguauggaacuggcccucucuucacguagaagaguuucuucuuacuacagaagcagacucuccuucaucagucacgugguauguuaugacuauggcuaguagucauuucccuucuguuaguaccagguaucuugucugguuuuguucaggucauuuauuauguuuuacauucuaaacaacacugugaaacagucugacagaguaaagaccguuugcaaaauucacugggaacaguuaggcaauaugaacuuccaagucauuuuguuagaaacugucagucugggcauaaacgugcagaaauggaauacagugucuauuacauuuuauuuuuuauggaagaguguuacuuuaguuuauaucuuguaauuggcaaagccuacuuuuuuaaucaauagauaauauuguauguuuuuguuguguaaaaguuuacuugaauuauuuaaagguucuuuucucuuuuaggcaaggaauuacaaaucucaaauuaauagcucugacagcuucagcuaauaagaagguauuggaaaauuuuauuuugugcuugccuauauuauguguuagaaaaagcauuagugaauacaaaaguagauguuaaauaguacagcauauuagcucuuaguucacacagaaacuugacaaucagaaauaaaccugcagaacucuuuuuaaaguaaaaagcuguaaaucuugacuccauauuuuaaauggagcacuucaggaaccaaaaaugcccauaggaaaguguuuauuuuauuuuauuauuauuauuuuuuugagaugggaucuuacccuguccccugggcuguagugcuauggcacaaucucggcucacugcaaccccccacccccuggguucaaacgauucuccugccucagccucccaaguagcugggauuacaggugccugccgccacacccagcuaauuuuuguacuuuuaguagagaugggguuucaccauuuuggccaggccggucucuaucuccugaccuggugauuugccugccucucggccucccguagugcugggauuacaggugugagccacugcgcccggcccaggaaaguguuuauuagagugacucuuacguaguucuggcacugaggaauuacauuucaccuuaaauacaaacuguagaauggacuucagguauauguauggauuuucauucaacagaguuggaauaugggguagaacaucauuucauauguaacauuuaaaucauauaguaacaagcugggugcguuggcucacaccuguaauccuagcgcuuugggaggccaaggcagguggaucaccugaggucaagaguuugagaccagucuggacaacauggugaaacccagucucuacuaaaaauacaaaaauuagccgggcuugguggcgugcaccuguaaucccaguuacucgagaggcugagacaggagaauagcuggaaccugggaggcagagguugcgguaagcugagagugcaccaguguacuccaccugggcaacaaaagcgaaacuccaucucaaaaaaaguaaaauaaaauaagucauacgguaacagacuuacuuauaaaugcuuauuuuuugcauuuagcuuuguacuguguguuuuauuuauuuauuuauuuagagacagucucacucuuucacccagacaggaguguguguaguggugcaaucucggcucacugcaaccucuuccucccagguucaagcaauucugccucagccucccaaguagcugggauuacagaugugcaccacuauguuccagcuaauuauuuugguauuuuuaguagagacgggguuucaccauguuggcuaggcuggucuccaacuccugaccucaagugauccgccugccucggccucccaaagugcucccauguguuuuugguuuuuuguuuuuuauuuauuuuuauuuuuugagacagugucgcucuguugcccaggccggagugcaguggcacaaucucggcucacugcaaccuccgucuccuggguuccagagauucuucugccucagccuccccaguagcugugauuaucccaguagcugugauuacagaugcacaccgccacaccaggcuaauuuuuuguauuuuaguagacaggguuucacuguguugcccaggcuggucuggaacuccugagcucaggcaauccgccugccucagccucccaaagugcugggauuauaggcaugagccaccacgcccagccgcucccauguguuuuaaucugcucuuaauugugaagugcuguuuuguacuugcauguuuaaauugaucugcuaaauuaauugcucugcuauuuuucuuagaugaaaaaccucaugguuuauucauuaccuacaauggaaauacuauauucuuuggaaguaucuaguguuucuucucugguccaaacaggaauuagcacaguaaguuuauuugcauuuuaaaguauucuuuuaacuacuuuuuucuuuaucugguaucuaaucagggaugauuaaaagccuuaauaauuaagcuaagcauuaguggaaccuaguggaaaccuggauaaauuucagguuuauaacuauauuuauuaauagagauccucaaauauacuuacuugauagucuaagguuagucaucauauuaaaaaaaaagucaaaacaucagucaucugcuuauucuucuuucuugugucucuacaggaaguauagaugauaaugggagauggagacuauugcuguuacauauuuauguaacuaauuuacauauuuuaaaaauauuuuaccacauuuguuuaauuucuuuuuacacacacacuguaguuuuccacauuuuggaaauuacuuguagacaucaugcugucacgccuaaaucuucagcagguaucuccuaaaaauaagggcauucuucuacaaugcaauuaucauacucagaaaauguaacucaaauacaguauuauuuauuauaaacucuucuagauuuaaauuuuaccaauugggccaauuacuuuaaagcuauuuuuuuuucuuaugaucuaaucaagaaucacucaucaaauuuaggucucuguguuuuuguuguuguuguuguugucgagacagggucuugcucuguugcccaaguuguaguaccgucgcucaaucauagcucacuacagccuccaacuccugggcucaagugguccuccugcuucagccuccugaguagcugggacuacaggugugcaccaccaggccuggcuaauuuuuacauuuuuuguagagagguggucucacuauguuuccugggcuagacucaagcuccugagcucaagugagcuuccuggcucaccuccccaaauuguuaauauuacaugugugagccauugcaucugguccauuuuuugucuuuuaagacauugacaguuuugaagagucgccacccugugguuuuguagacuguuucucuauuuggauuugauuguuucaucaugauuagauucauguuaagcuuuuuuuggcacaaauacugcacagguaauauuguuuucuaaccacaucacguuaagaggcucaugguauccauuuguccuguuaugggugauuuuaaaugugaucauuugguuaaggcaguucugucagauuuccccauuuauaaaguguuuuucccuuaauagaaaguaaccuaugugauauuauuuugagucuaugggauuuauauuuccuagccauuuuuucccaguguuuuuuuuuuccuuaaauuuuuguggguacauaguagguauuuaugggauacccaguuguuuuaaaguccauugauggauaauucaugccugaaccaguaguuacucuaguaauuauaaaaugcauugcucuuauauuggaauuuuaaucauguuuuuuuguuauuguaggauaccauauaccuuuuagaaggaguuugcaaaaaugauccaaaguaggucauguuuuaccguguuaaguaauagcuauguuaaauuuuacguauuaauauuaaaagacaagcgcauuuauaguuaaaauuuuuucuagauugucugaagacucagucucuguguuaguacucagaugucuuacggaagcuuuaccagaaaacagguaacuucucauuuuuuuuuaagcuuuauccuuuagugaauaacuuaaauucccugaauaauaagcauuuaacaaaauuucucuuccaacuuaacagauugagucgguuacuucacaaacacagauuugcugaagcugagaguuuugccauucaguuuggacuagauguugagguaaucauucauguauucauuuguucaccaaacaagcauuucgucaugggcuagaggcugagaggacagacauguaauauauaauuggaauuuagugugauuaaggcuguaauuaagauaugacugaaguugauuagagauucagaggaaagagugacccauaguugggcagaaagauguuacugaggaggucguuuucaggucaggucuuuuuuuuuucuuuuuucuugagauggagucuuacucuguugcccaggcuagagugcagugguacaaucucagcucacugcaaccuccgccuccuggguucaagcgauucuccugccucagccuaccgaguagcugggauuauaggcaugcaucaccaugcccgguuaauuuuuguauuuuuaguaaagaugggguuucaccauuuuggccaggcuggccuugaacuccuaaccuccucgugaucugccugucuuguucucccaaagugcugggauuacaggugugagccacugcaccuggccucaggucaggucuugaagguguuccugacagaccagggaggggaagggauucuggguacaaggucagcauggauagaaugagggggacuugugaugcuucaggaacuccugcugauuaggugggacuagaauguagguuauaugggcagcagaguaaaagaagaugaugaugaugcagaaguaggggccucugucacccaggcuggaguacaguggggcgaucacagcuuaccgcagccuugaccucccaggcucaagugauccuccugcuucagcuucccaaguggcugggacuauaguugcauaccaccaugcccaacuaauuuuuaaauuuuuuguagagacaagguuuuccauguuacccaggcuggucuugaacuccugggcuuaagagaucugucuaccuuggccucccaaaguuuugagauuacaguccuaagccaccacuuguggccaggagugagauuugauuuugcaggugauaggaaccugcugacaguuuuaagcaggagaguaucuugauuagguugucauuuuagaaagacaaagaauuuggagaaggguaaauacauuggaacuaaguacuuuucucuaggagaccugaaccagggcaaugaaguacagauauaggugagagagaaggcugauaagagaggaauauaggccaggugcgguggcucacuccuuuaauuccagcacuuugggagacagagacaggcagauaaccugaggucaggaguucaagaccagccugggcaauauggugaaaccuaaaaauacuguacuaacaauacaaaaauuagccaggugugguggcacaugccuguagucccaccuacucgggaggcugaagcaggagaaucacuugaacccaggagguggagguuacagugagccaagaucacaccacugcauucuauccugggcaacacagcaagacucugucucagggaaaaaaaaaaaaaaagaggaauauaguggguggaaucagcaggacuuagugaucaaauggaaggaagggcaggggacuugagguugacuugcuuuacucuggcuaagcauacacauugggugacgauggcaugaccugaaaugaggaauauguguggaagagcaguuuagggauaaaagaugaaaaguucugcuuuaugaaaauuggaugugagcugagcacagucgugcaugcugguaguccuagcugcucgggaggcugagggaggaagauuccuugaggucagguguuugaggcuauacugcaauaagauuggccuguuaauagccacugcaccccagccugggcaucauagugagccucucaucucuaaauuaaaauuaaaaaaaaaauggaugugaggggucuggugaaauagagaugucuagugggaaguugaggaguggccuacacugcuucuaagggucggagacaccaguguaauggcucagaugacuccagcaaaugcagagagugaaaagacaucugaggaugugaugugggggcaauagcauaucagggauggaggaggaagggcuguacacauauuugggaagaaauaagggagaaaaacuguaagaauguaugauuauggaagccaaggaagcaguaaguuuuaaauguacuggggagugaucagcaguuucaacuacuacagagaagaucaaguauaaaagcugaaagacaucuggaggauacagcaauuaggucauugauaauccuugaaaagucaguuuuuggggaaguaauaagagagaaagccuuacuguaguugguuaaagaauuaauauuuacuaagugggugcuugcuacucgugcuuguuuuaaaaaauauaacgguuuuaaacauacagaauacuuccuuaaaaaaaaaaaaauauauauauauauauauauauauuuguauuuuuuguagaggcgggguuucaccauguuggccaggcuggucucgaacucgugaccgcaaguaauccaccugccuuagccucccaaggugcugggauuacaggcaugagccaccaugccuggccgaaaaauauauauuuauuuuuauauauauuuuguaaacacagggucuugcuauguugcccaggcuggucuuaaacuccugaccucaagugauccucccuucucagccucccaaagugaugggauuacaggugugagccaccauacccagcaagaauaauucuguguauuguuuagaaauguauacaaguuaagagacaaaguaauuaauggaauuaguacuaaauacaagaauaauguauacuucugguugggaggaagaggaugauguauuuggaaagacaacagugggaucugaaacuauugguaacaucugcuuuauuuuuaaagcuaaaggugaugaguacauuauuauuauaguauuuauaauuuacauuauuacuuuuuugaacaucugaaagauuuuagaaguaauguuuaaaaagagacaguggagcaaaaaaaucaaaccaaaacagaaaaucugugaaagaaaugaggggaauauucaugaauuaaacuacucuuuguuaucauuuauaguuuucagaaccagagagucccugucaaaguugguauuguguccauaggaaacagaaccugaaauuugaguauuuguaacucuaaccuuuaaagaacuuuuaguagacuuagaaaauugguugucuuuaaaaaccuguuucaugagcugggugggcgugguggugugcgccuguagucccagcuacuugagaugcugaggcaagagaauugcuugagcccgggaguuccaggcugcagugagcuaugauuacaccgcugcauuuuagccugagugacagagcgagaucuugucucuaaacagacaaacaaaaucgacucuguaacuuuuggacugcauaauuucagacacguuacuuaaccuuucuugggucucaguuuucuuguuuguaaaauggggauauuaguacuuaccccauagugucaugaugacauguaaaaguuuacuucuuagguuaugauaauuuaaaaagacaauucauauaaauaucuuucuucgguugauaaauaaucauauauacuuggccgggugcaguggcucaccuuuguaaucccacacuuugggaggccaagguggguggauuacuugaggccaggaguuuaagaccagccuggcccacauagcaaaacgcugucuguacuaaaaauacaaauauuagcugggcauggcaguggaugccuguugucccaguuacucgggaggcugaggcagaugaaucgcuugaaucagaaggcggagguugcagugagcugagguuacacuuacugcacuccagccugggugacagagcaagacucugucucaaaaauaaaaaagaagggccgggcgcgguggcucacgccuguaaucccagcaccuuggaaggccagggcgggcagaucacaaggucaggagaucgagaccauccuggcuaacacgaugaaacuccgucucuacuaaaaauacaaaaaauuauccuggugugguggcaggcaccuguaguccuagcuacuugggauguggaggcaggagaaucgcuugaacccgggaggcagagguugcagugagccgagauccugcuacugcacuccagccugggcgacagagcgagacucugucucauaaaaauaaauaaaaagaaaaacaagaaugauuguauauacuuucgaugugcaauguggugauuuuauacauuuacauugugcaaugauuaaaucaagcuaauuaacauaacuaucaccucacuuaucuuuuuuuguggugagaacauuuaaaaccuacucuuuuagcaauuuuuuuuuuugagauagaguguuguuuugucucccaaacuggggugcaguggcgcgauuuuggcucacuacaaccuccaccuaccucccagguucgugugauucucaugccucagccucucgaguagcuaggauuacagacgcgcaccaccacgccuggcuaauuuuuuguauuuuuaguagagacgggguuuugccauguugcucaagcuggucuugaacuucugagcucagguaauccaccugccucggccucccaaaaugcaaggauuacaggugugcgccaccacgccuggcucuuuuagcaauuuugaaauauacauuauuacuaacuacagucaucauagaccucugaaacucauuccuccuucuaacugaagcuuugcagccuugaaacaucucugacaccucuguauccucccgccccuuccccugggcucuaguugucaccauucuacucucuacuuuuuuuuuuuuuuuuuuugagauggagucuuucucuguugugcaguggcacgaucucugcucacugcaagcuccgccucccggguucaaggauucuccugccucagccucccagguagcugggauuacaggcgcccacuaacaugcacugcuaaguuuuguauuuuuaguagaaaccauauuggccaggcugguaucgaacuccugaccucaaauaauccuccugccucagccucccaaagugcugggauuacaggcgugagccaccgugcccgaccucuacucucuacuuuuaugaguuugacuauuuuaagauuucacauguaagugagaucauauaguguuuuuuuuuuauugugucugacuuaucucacuuaccauaauguccuucagguuuaucuguguuguuguuggaaaugacaaauuuucccucuuuuuuuuuuuuuuuuuuuuuuuaaauagggucuuaccauguugcccaggcugggcucgaacuccugggcucaaaugguuguccugccucggccuccugagcaggcuggcacuacaucuagcuucuagacugaacaauauuuuacugugcaaauauaccacauuuuauuuauucacuuaucuguugauggauauuuagauuccauaucuuagcucauauaaagcucuuaguaaguguacugcuugacacguuuaguaaggacucaacagaaaugguucccauaccugcuaauaaucugguucaccucucagauaucugaauguuacuuucuuuaaaucucauuccuggagcgcaugaggauucaccuuuuugaaguaguuuguuucacucagcuuacucugagaauaagccauccacagguauuauuguacuucaaauugcuugauguggcguguuuauauuacagcuuguuuacaaggucaagucaaaucauauauuggagaaacuggcauugaguucuguggaugccagugaacagaccgaauggcaacaacuuguagacgacgcuaaggaaaaucuacauaagauccagguauguuuuucuugucacauacuacaguauuuagauugacguguugaucaacauuagguugccuuacugugucuggcauuugugaaacaggaugaugaauuuguggugaauuacugccugaaagcucaguggauaaccuaugaaaccacucaagagaugcugaauuaugccaaaaccaggguagguucguuuuuuuguauuuuguuuuuuuggggcaggggagaauuugcuuuaaucucucauaauccugccucaaauauaucuuuuccuccuauccgcuauguguauuauuaauaaaaaaguuuuuauaauagcuuaauggagauaauucacauccuauacaauucaccuauuuaaaguauacaguucagugguuuuuaauauauuccuugaguugugcaagcaucauuauugucaauuuuagaacuuuuaaaucuccccaaaagaaccucuaucccagaccggacgugguggcucacgccuuaaucccagcaauuugugaggcugagguggguggaucaccugaggucaggagcuggagaccagccuggccaacauggugaaacuccgucucuacuaaaaauaaaaaaauuaguugggcgugguggcacgugccuguaguuccagcuauuagggaggcugaggcacaagaaucacuggaauccgggaggcagagguugcagugagcuaaaauuguuccacugcucuucagccugggugacagagcaagacugugucucaaaaaauaaaauuaaggcuaugugcgguggcuuacuccuguaaucccagcacuuugggaggccaagguggguggaucaccugaggucaggaguugaagaccagccuggccaauauggugagaccucauguugucucuacuaaaaauacaaaaauuagccggguguggugucacgcgccuguagucucaacugcuugggaugcugaggcaggagaauugcuugaaccugggaggcggagguugcagugagcugagaucacgccacugcacuucagccuggcgacagagcaagacuccgucucaaaagaaaaagaaaaaauauuaaauuaaaagauaaaacucuuaaauggcugggugaggugucucaugccuguagucccaguacuuagggaggcagaggugagugggucaccugaggucaggaguucaccagccuggccaauauggugaaaccccaucucuacuaaaaauauaaaaaugagcugggugugguggugcacuccuguaguuccagcuacuuggcaggcugaggcaugagaauugcuugaaccugguaggcagagguuagggugagccaaaacugcgccacagcagccugggcaacagagugagacucuuaucaaaaaacaaaagaaaacaaaaccucuaugccauuaauagucauuccccauuugccccagucccccagcuucaggaaaccacuaauuuaccuccugucucucuagauuugccuauucugaacgguucaaauaaauggaaucauauaugucuccuucaugucuggcuucuuucacuuagcauaauauuuucaggguuugggcugggcacguuguuucacgccuguaauuccagcacuuugggaggccgaggugggcagaucacgaggucaggagaucgagaccauugugacgaacauggugaaaccccgucucuacuaaaauacaaaaaauacaaaaaauuauccaggcaugguggcacgcaccuguagucccaggaggcugagggaagguaaucgcuucaaccugggagguggagguugcuuugagcugagaucgcgcuuccagccuggcaacggagcaagacucugucccaaaaaaaauaaaaauaaaaaaaaaucuucaggguucauccaugcuguagcacaugucagugcuguauuucuuuuuauuggcacauaauauucuauuuuauggauauaccacguuuuguuucuccauuuaucaguugauggacauuuggguuguuuauacuuuuuucccccaauuuuguuuauauuuuguuaaaaaauacauaacaugaaauuuaccauuuucaccuuuuuaaaaaaaaauauuuuauuuuugagagggagucucgcacugucacccaggcuggagugcaguggugugaucucggcucacugcaaccuccaccuccuggguucaagugauucuccugccucagccucucaaguagcugagauuacaggcucccgcugccaccacaccuggcuaauuuuuguauuuuaguagagacggaguuucaccauguuggucaggcuggucuugaacuccugaccucaaaugaucugccuguuuuggccucccaaagugccgcaauuauaggcaugagccacugcgcccggccuaucuuaagcauuuuuaaauuuaaugguauuaaauacauucauaaucacauucggccaucguccaucuccccaacucuuuucaucguugugaaacugaaacucugcccauuaaacacagacuucccauuucuccgucuccccagccccuggcaaaccauaugcugucuauguauauaauuuugacuacucuaaguaccuuauauuaaauggaaucauuuaaucauuuaagacaguacuugucuuuugugacuggcuuauuucacuuagcauaauauccuccagguucauucauguuguugcaaaugacagaauuucuuucuuuuuuguuuauccauggucccugacucugacccuaacccugacuucuuuaguuauuuccacauuuuugcugcugugaauaauucugcuaugaacauggguguacagaugucuauuugagucccucuuucaguucuuuugagcauauacccagaaguggaaauguugggucauaugcuaauucuguuuuuuugagacagagucucacuuugucucccaggcuagagugcaauggcgugaucuuggcucacugcaaccucugcccaccccccaggcucaagugauucucucgccucagccucccaaguagcugggauuacagacaugugccuccacgcccagcuaauuuuuguauuuuuaguagagaugggguuucaccauguuggccagacuagucuugaacccugacuucaagugaucugccugccuuggccucccaaaaugcugggauuacaggcgugagccaccacacugggcccuaauucucuuuuaaauuuuuuaaggaacuaccauguuuuccauggugacugugccauuucacauuuccagcaacagugcauaaguguucagauuucuccaccuuugcuaacacuuuuuguuuuugagacaaggucuugcuuucacccaggcuggagugcaguuguaaugcauugcagccucaaacuccuggguucaagcaauccuccugccucagacucucaaaguguugggauugggccaagcacaguggcuguaaucccuccacuaauguauguaaggugggaagguauguuuugauaccguuuguauauauuagucuuaugccaaagaaauaauuuuuuaaaaaauggauucuuggcugggugcaguggcucaugccuauaauccuagcacuuugggaggcccaggagagcagagcacuugaggucaggaguucaagagcagccuggccaguaagaugaaaccccaucucuacuaaaaauacaaaaauaauuagccaggccugguggcgcaugcuuguaaucccagcuacuuggaaggcugaggcaggagaauuacuugaacccagaagguggagguugcagugagcagagauugggccacugcacuccaaccugggugacagagcaagacccuaucucaaaaaaaaaaauaauaauaauaauaaauaaaaaauggauucuuuuucugucauagaccuuuuuuggcaugcaauuuuugcaauugcaaauaaugucauuuuugcaaugaccuaugaguauuuuugcuauuuauuuauuuauuuguaauuuuuuuuuugaaacggagucucauucuguaccccaagcuggagugcaguggugggaucucggcucauggcaaccucagccucucgggcucaagggauucucgugccucaggcuccuuaguagcugggacuacaggugugcgcaacagugccugguuaauuuuuuauauuuuaguagagacaggguuucaccauguugcccagggucauccugaacuccugagcucaagcaguccgcccgccucagccuuccaaagugcuaggauuacaggcgugagccacugcccccaggcaaaugcauuauuuuaaaaaacaugucaguucuuuauaguuuacuauucauuucacacuuaaaugcaauuuauuuaaaaaaauuuuuuguuauuucacagaaaauccaucauuuaggaaauaaacaguagauauucuucuaacuguauuucuuauuauucuuacuuagcuuuugaagaaagaagauaaaacugcucucauuuauucugauggcuugaaagagguaauuacacuagauuucuagguuaauaugugggugaauauaccuuuauaauauguuuuccauucaaaauagacccguauuuuaucaagagcaaguuauuucaauaccuuacuuuucuuaucugcaaaaugguaauauuaauagguacuuacuuuauaaggucauuuugagaucaaaggaaauaauucauauaaacuguuguacauaguaccugguaccugcuaaacauucaaaugaagauaaacugcgauguugauuaugauggugcuaaaauacaugugugugugcaugugagcauauaaauauucaaauucuuaguucaaauuaaguauuguaauccagcuggauuuuaccauaagaauuuagaaaucagugaaaaaacugauuuuaaagaguuccuacaauuaauguguaugugccuuuauaauuggauguaauuggaaauguuuuucuuaucccauguuuuguguguguguguguguguguguguguguguguguguguguaugugugugaaauaaaggcaguccuaugggaauugaguugugaugugagauaaaugugaauguguauagacaugugaaauguaaugauucauuuuuaauguuuuaauuucaauauuguugcauauaaauucagauuauuaaauuauuuuuucuucaggugcuaagagcucaugcaaaauugacuacuuuuuauggagcauuuggaccagaaaaauucagguguguacauuuuuguuaaaacuuuuuaggccaggcauggugucucacgccuguaaucccagcacuuugggaggcugaggugggcagaucacccgagaucaggaguucgagaccagccuggccaacauggcaaaaccccaucucuacuaaaauacaaaaauuagccaggcgugguggcgugcaucuguaaucucagcuacuagggaggcugagacaggagagucacuugaacccgggaggcagagguugcagugagccgagaucgugccacugcaccccagccugggcgacagagcaagacucggucucaaaaaaaaaaaaauuuuuuuuuuuagauuauaaguuacauagaaauuuggaaugucauaacagguauagcaguccucuugcugaauuuguguuucuaugagggguguugagugauagaaaauacuaguuuuucagcaacaaaaacgggcugaacauccuuguugucauuucuucuuuuuugagacagggucucacucugucacccagguucgagugcaguggugcgaucauagcucacugcagccucaacuuuuuaggcuugguaaaaaucuaacuauucuggauaaaucaaguauuugguuccuuaucugcaaagaaguaaacucucuuaaaaccauuucuaaguuucaauguuauaagauuauauagauuuauauugguucuguagcugacauuacuauuuaacaguaauaauuauguccuguauaauacaaaacauuguuuauauugcaaggcauuauagaaaccuuucauguacaacagcugcuccaagacacccgcuaacccacagcucccaggucauucucugugggcucaagcagccgcuccaaggcagccacaauuauuuuuuuuuccuaguaguaaauuuacccaggaauuuuuucacugcgccacccuagcagcgagaagggcagaucuccauauguguaaguccaucuuuucuauccuauugaguaauagccauaaaaauuggauuuacuuauauuuuacuuagugaaaaugucaccucuuuagaaugaucuggcucuucuuguaacgccagucgugcccauaugaugacucuuccacaguuuuuucagcuucagcaggaggcaaagacuucaacagaaggagacagucuucacucuauaaacaggguuugaaaggaagaaaaaacagcugguauuugcaaagggcaguguggccuuaccucuuucuuuucuauuuaaagauaaaaauacaucauuuggaaaaacauuaugguucaauguuuuuuauauauuuuuugaaacggagucucgcucuauugccaaggcuggaguccagcgaugcuaucuuggcucacugcaaccuuugccucucaguuucaagcaauucuugugccucagccucccaaguaacugggauuacaggcacccgccaccacgccuggcuaauuuuuguauuuuuaguagagacgguguuucaccauguuggccaggcuggucucgaacucugaccucaggcaauccacccaccucggcuucccaaagugcugggauuacaggugugagcuacugcaccuggccuuaugguuuaauguuuuaauaaucugaaaauccauuucugaugauagcaacaauaaaauaaauuuaaaauauaauucuaaguaaugaagauuuguuuaauucuuagucauugcuauaauuauagaaucguauaaaaauaaugacauuuaaaaacacaauaaaagagaacccacgcuccauucuagaauuaaaggguccuaaaacauauaaaacugagucuggcccaggugcaguggcucacgccuguaaucccaacacuuugggaugccaaggauaccugguauccucccuggugauccuccuaccucagccucccaaguagcuugggacuacagaugugcaccaccacaucuggcuaauuuuuuuaauuauuuuuuuagaaaugcagucucucuguguuguccacgccggucuugaacuccugagcucaagcgaucugccugccucggccucccaaagugcugggauuacaggcgugagguaccacgcccagugcucauuucuuuaacacaaauauuuuuaccuuugaucauagucagauucuuaccauaucuucuaauugcucauuucccuucauuguuaauuuauucugauaaauagauuuaaaguaaguauaccucuaauuuuaaguaaugauauuuuggugccacauggaaguauaucuguggauucaauuucuggaggugcaguugcuaaggcaaaagguuauucauccaaacuuggcuuccaaagcaccuuuuccaauagaaugaguaggggagggcccauuuucucacucauucaccaacaguauguuauagaacuuguuuuuuugcuaaucugauguaugcaaaaaaauuuuuuuuaaauauuaccacauggauuugauuuccauucuuaauuuugguugaaauauuuacuuucucaaggugaaaagccuuuuguuuuucuccuuacauccuuggucccucuuucucuugaguuguuuuuuuuuuuuaaaaaaaaaaaaacagagcuauuucugugguuuuauuauuguuguguuuuuagagacagggucucccauguugcccaggcuagucucaaauuccugggcucaagugauccuccugccucggccucccaaagugcugggauuacuggcaugagccaccacgccuggaccgaguuguucuuuucaaaauugacuuuaaaguucuuuguggguauuucaaauuuuccucuaauuuggcauuuuuuuaauugauuuuguuauuauuauuuuuuuuuuuuacaaaaaauucagaaguuuguauuuuuaugucuguuuggaaaaauauuacccaccgcaagauuaaaaauaaauucuuggccgggcacagugguuuauaccuguaauccaagcacuuugggaggcugagguaggcggaucgcuucccaggaguucaagaccagcuugggcaacauagugaaacccugucucuacauaaaauacuaaaauuugccaggcaacuuggccaggugcuuguaguccuggcuacuaaggaagcugaggugggaggaucaccugagccugggaggucgaggcugcaguaagcugugauugugccacugcacuccagccugggugacacagugaaacucgccucaaaaaauaaauaaauaaauacuuucucuuguauuuuuucauuuuuagaguuucuuucuacguuucaaucuuuuuuuuuuuuuuuuuugagacagagucuaggaguguggagugcaguggcaugaucucggcucacugccaccuccgccucccagauucaagugauucuccugccucaaccuccugaggagcugggauuacaggcgucugccaccacacccagcuaauuuuuguacuuuuaguagagaugggguuucacuguguuggccaggcuggccucgaacuccugaccucguaaucugcccgcgucagccucccaaagugcugggauuacaagcgugagccacugcgcccggccuaaaucuuuuuuuuuuuuuucaaugagacagagucuugcucuugucgcccaggcucgagugcgguggcucgaucuugacucuggcucacugcagccucugccucccagguucaagugauucuccugcccaguagcugggauuacaggcacgugccacugcaccuggauaauuuuuuuuuuuucuuuuaauacggacucucacuuuguugcccaggcuggagugcaguggcaugaucucagcucacugcaacuuccgccuccuauauucaagugauucuccugccucagccucccgacuagcugggauuacaggcaugcaacacuacgucuggcuaauuuuuguaguuuuaguagagaugggguuucgucauuuggagcagacugguuucaaacuccugaccucaagugaucugcccgccuuggccucccaaagugcuggguuacaggagugagccacugcacccagccaacuuuuauauuuuuaguugagacggauuuugccauguuguccaggcugguuuuuuuuuuuuuuuuuuuuugagguggggucucacucugucacccaggcuggagugcaguggcaugaucucagcucacugcagcuucagccucccaagcucugccacccaaguagcugggauuacaggugagcaccaccacacucagcuaauuuuuuguagagccuggguuucaccauguuucucaggcugguuucgaacuccugggcucaagugauccuccugcuuggccaccgaaagugcugggaauauagacaugagccacuguggcuggcugccaucuuuucuaaaggauguggcgagcuagugauuaaaaaaaacuuuuuuuuuuauuugagacaguuuuguucuguugcccaggcuggagugcaaugacaugaucucggcucacugcaaccucugccuccuggguucaaucaauucugccucagccucccgaguagcugggauuacaggcaccugccaccacaccggcuauuuuuuguauuuuuaauagagacaggguuucaccauguugacuggguuggucuugaauuucugaccucaagugguccacccaccucggccucccaaagugcugggauuacaggcgugagccaccacgaucagcugauuuuuaaaaauguuuaaccagcuaccuuaaugaauuucuuuauuaugcauaguaauauuucauuugaucuuguuuuuuccagguauauaauuuuauauucaaauaaugaaauuuuaucuuaucaauucugauuuucuuuuuuccucgucaaauucauuauagaacacuuacuuauuuaaaaaauaggcugggcacgguggcucaugccuguaaucgcaacacuuugggaggcugaaguggguggaucaguugaggucagggguuugagaccaucuagccaacauggugaaaccccaucucuacuaaaaauacaaaaauuagccaggcaugguggugcaugccuguaaucccagcugcuugggaggcugaggcaugagaaucucuugaacucaggagacaaagguugcagugagccgagauugugccacuucacugcagccugggugacagugagacuccagcucaaaaaaauaaaguaaaauaauauaaacaugccuguaaucccaucuauucaggaugcugagguggcaggauugcuugagcccaggaauucaaguccagccugagcacauagugagaucccaucucaaaaaaacaaauaaaacaaacaagagugaaaaauaguuauuucuacguguagugauuaucugaggaggguccuauaggaagcuacauggcucugaggaagaugucgggaguucuagggucugagauaagaaggaaauguacuuugcauugugugaucuuuggaacuggguuuuuuuuaguuuuuuguuuuuaccuuuaugaagaagaaaacuaauuaaaaugcauuuaaagauaauccacuuaaaagguauaaccuuaauuuuuuuuaaaacugacuuuuuucccuucuuugucuauucaguggcaguucuuggauugaauuucuaaauaaugaagaugaucuuaaagauauuuuuuuacagcuaaaagaaggaaaccuuguuugugcacaguaucuuuggcuucgacaucggguaacauguuuuacauuuuuuccuuaacagcuuuauagcuccugaguuaggugauugaaucaauguuggagacuaacaaggugcaagucugacugggugaugggauguuuuuugauugguucuuaaaauaugacuugcuuuuguuuguaaagggcaaggggauaaaaaagacuuuccccaugggcugggcgcgauggcucacgccuauaaucccagcacuuugggaggccgaggcgggcugaucacuggagguugggaguucgagaccagccuggucaacauggugaauccgugucucuaccaaaaauaaaaaaguagccgggcaugguggcacguuccuguagacccagcuacucaggaggcugaggcaggggaauuucuuuaacccagaagguggagguugcagugagccgagaucacgccacugcacuccagccugggugacagagugagacuccgucccaaaaaaaagaaaaaaaaaaauuacuuuucccggagaaaauugucuucugauaauauuaaaucagaagaaguacagugaauguacaguagaaccuuauuuuauccaaucauuaagaaucuagcuucuugggagcuaaaugaugagaacacguggaugcauggagggaaacacacaccggggccuuucagaagguggagggugaaaguaucaggaaaaauaacuaaugauuaauaggcuuaauagcugggugaugaaauaaucuguacaacaaacccccuugacaaaaguuuaccuacacuuauaccacugaacuuaaaaguuaaccaaaaaaagagucuaacuccuaaucuuagcucuaaaggcaacauguuaucugguuuauuagugggcuuuguaauguagcauuggugaagaagauguugcuacugcagcucaaauugugguaaaagauugccccuuaaaauugcuugucucgaucccuuuaagguuggccaaaguugguauagaacauuagauccauaaagucauaacuugccgugaugcccuuaauggcugcauugcuuguuugaauuccuaguaucacccccaguuaaguuuuccuuagaauacucucucugcugguucuucugcuacaugauaaacuauuuggcacucagcgccgugacauugcauacaguaugcagcucccaacuagaaucauuugcauagugugaaucuccuuuagcacucauuauuaaaucaguaggcuacuccuuaaaaugacuuccuaaaauaucuuugucaaacauuuggaagccuuugguuuaaauuugucagaucuuaauuucucgcuccuuauaauuuaggcaaacuuugaaagcagauuugaugugaaaaugcuggagagcuugcucaacucaaugucugcaucagucucuuugcaaaagcuguguccaugguuuaaaaaugaugugauuccauuuguaagaaggacugugccugaaggacaggugaguugucuucaguauuuccacucuugaugacuuuauuucauuuuuuacauuagaucauugagaauuaagucacguuaacaccaguuaacaccaguuaguuaagcuaacaccuguguuaauuaaagugucucuuaaaagacaacugugauucagaaggagauguuaucauuugcaacaauauagauggaacuggagauuauuauguuaagugaaauaagccaggcauggaaagacuaacaucacauguucucacuuauuugugggaucuaaaaaucaaaacaauuuaacucacggccauagagaguaggaggaugguuaccagaggcuuggaaggguuguggggugaugggugaugggugagagguggggaugguuaaugcauacaaaaaaauauauuuagaaagaaugagccugggugcagugacucacgccuguaaucccaucacuuugggaggcugaggugggugaaucaccugaggucagaaguuugagaccagccugaccaacauggugaaacccugugucuacuaaaaauacaaaaauuagccgggcaugguggcaugccuguaaucacagccacucgggagucugaggcaguagaauugcuugacccaggagguugcagugaaccgagaucgugccauugcaugagauccagcaugggugaugagcgaaacccugucucaaaaaaaaaaaaaagaaagaauaagacauacuauuugauuauacaagagagucaauaauaacuuaauucuauauuuaaaaauaacuaaaagaguguaauuggauuguuuguaacacaaaggggauggauaccccacucuccauguugugauuauuucacauugcuugccuguaucaaugcaucucauguacuccacaaguauguacaccuacuacgugcccacacacaagcaaaaaagacaaucguggauaagagguuuauggacaaaauaaauauuuaaaggaaaaaaaagaaaucguggagguuuuuaguuaugucagugauuauccauuaagaauuucauuuuuaaauaaucuauuucagauaauucuugcaaaaugguuggaacaagcagccaggaaccuugaauuaacugauaagguaauacugauuuaauuaacaguaaaaagacauuuugcacacucccaacagcauaaaacauuguuuugaacugucuguaaucuuuuuuaaaggcaaauuggccagaaaauggacuucaauuggcagagauauuuuuuacagcagaaaaaacagacgaguugggauuggcaucuuccuggcauuggauuuccuugguaugaugugagaauggauuuuuaguaaugaaacagucaguuuaccugaaaggguuugucugcauguaugugaaguaucuggaaauauaucuacuucuuaaauuuucuguuuuuuugugccuuuuuuuuguuuugugccuuucaaauccauauguaggaaaauuugcuuuuucuuucuuucugauuuguguuaaaacuucaaccuauguuuuuaauuuauuuauauauuuauuuauuuauuauucauuuuugagacaaggucucacucuguugccccagcuggaaugcaguggugcaaccauggcucacugcacccucaacuuuugggcucaagugauccucccaccucagccuccugaguagcugggacuacaggugcgcaucaccaggcccgacugauuuuuguauuuuuuguaaagaagggguuuugccauguugcccagguuggucuugaacucccagacccaagugaucuacccaccugggcuucccaaagugcugggauuauaggugugagcuacugugcccagcccucucaaccuauuauuauuauuuuuuuuugagauggagucucacccuguugcccaggcuggagugcaguggugcgaucucagcucacugcaaccacccccucccagguucaagcaauucuccugccucagccucccguguagcugggacuacaggcaccccccaccacgccuggcuaauuuuuuuuauacuuuuaguagagacgggauuucaccauguuggucagacugaucucaaauuccugaccucagaugaucugcacugcucggccucccaaagugcuggauuacaggcaugagccacugcuccuggccccccuccaccuguuuuaaugaacaguuuuucucuauucaaccaaccaaaaggggaacuauauaaacauucugcuaagugguauaauugggauuuucugcauuagcagcauuucacaauccuuugaaaaauuaaaucuuggcugggcacgauggcuuacgccuguaaucccagcacuuugggaggccgagaugggcagaucauuugaggucaagagauugaaaucagccugauuaacauggugaaaccccaucccuaguaaaaauacaaaaaaaauuagccaggcaugguggugggugccuguaguccuagcuauuugagagccugcggcaggagaaucgcuugaaacggggaggcagagguugcagugagccgagauugugccacugcacuccugccugggugacagagcaugacucugucccccccaaaaaaaaagaaaaaaggaaaaauuaagucuugacaguacauuaauauuaguuuucaaagguugugucugucaagucaccuuuucuauauaagagcuuuuuccucuugcuguaaaacauuauuuuuaucuuuucccuguuaacuuuuaucaauauugaagguucuguucuuuuuauauaauuuuaggaaauguuaugccuuuauaucugguuaugauauauaaucucuauagauagaugggacacugagcacuaccuaaaugaugcuguguacuaaguauacuuggguucugaaaaaguauuauacuaauauucuuaauuuuucuauuuuuuuaagagaaaauaucuuucagauucugaucuauacuaauuugguuaaaauacuacaaaauuuagagcauaaguugguuuaaaguugcagguuuccucuuacgugcauaaccaggguuaauucuuauuuuaucugaaauaauucugauucuauuuuucucucauacuuuuauuuuauaucguuaacaacuuuaacacuuuuguuuuagaaagauuaucagaacacagaggaaguaugucagcuaaggacuuugguaaauaacuugcgagaguugaucacguugcauaggaaguacaacugcaaauuagcccucucugauuuugagaagguaaaguccagggucauaagaauuauuuuguauaucaaguuauggguagagucuguauuuauuccaucuuucuuuuggcauccaggaaaauacaaccaccauaguguuccgaauguuugauaaagugcuggccccagagcuuauucccuccaucuuagagaaguuuauaagaguuuacaugagagaacaugacuugcaagaggaggaacuucucuugcuguacauagagguaacuuuuccuuuacaucuagucuuauuucuuggaucuaugcaguguagcacuguaguaaauauuuaacucuuuaaggaaugucauaugcuuucucaguaggacucaugcagcauauugaauugguuaaaaauguggguuaauucugcuacuaaccaucuugagcaaaggggggauacaugaggacugugaacccggaaaaucugagacaguucucaguuaauuuagggaguuuauuuugccaaaguugaggauacacccaugacacagccucaggaaguccugacgacauguacccaaggugguccgggcacagcuugguuuuauauauuuuagggagagacacgaggcaucagucagcauauguaagaaguacauugguucgaucuggaaaggugggacaacuugaagcaaaggcaggaagacuccaagcgagagggagcuuccaggucacagauaggugauacaaaacauuaaaauucuuuugaguuucugauuagccuuuccaaaggaggcaaucagauaaugcagcugucucagugagcagagggguaacuuugauagaaugggaggcaaguuugcccuaagcaauuuccagccugaguuuuccuuagugaucuugggggcccaagauauuucccuuucacaguacuuucuucaaagggcuauugugagaccacaggagcaugaacucaauaaauauuagcaguuauuucuuguggauguuauuaaugugcuacaguaaucuuauuuguagauucuucaagaauguuucauucuuaaauuuucuauaccauauaaaacuaaaggcuaauguuuuggcaguuuuguauuuuuagaccauuguucaacauuuaugacuaauuagaauuuuuagguuuuuuuucuuuuaacacaucuaucaaggccauauaauaucuguaucuagcuguauguggcauuuuuuuaaugagaauuuuuaauuuuuaaaaaacauacauguuuaucccuuuuuaggauuuacugaauagaugcagcucaaaguccacaucacucuuugaaacagcaugggaagcaaaggccauggcaguaauagcguguuuaucugacacggacguaaguaaauagugaccauuugcguuucccuuuugagcauuaaaucuuuucugaaagcuuuuuucuguucauaaaagcgacauauauuuguuuuuguuugagaugggucuggcugugucgcccaggcuggaaugcagugacaugaucaugguucacugcagccucaaucucccuggcucaagcaauccccaccucagccuccugaguaguuaggaccauaggcgugugccacuacgcccagcuaauuuuuguauuuuuuguagagacaggguuucccaggcuggucuugaacaccugggcucaagugaucugccugcuucauucuccuaaagugucuguuuucuuuaauuacagaaaauaaaaagugaauguuuacucauuuccacccccaggggaaccuccauggacaguuguaugcauaucuuugcaggcuuuucugugguuaugcaaacauggagacuuuucuuuuucaguuauucgcugcaaugugagacauuuguuaauauauuguaauaugccuuuauuuuaacuucacacuguuauugccacuauaaaauagaaauaaaauaaugaaaacuguuuuuaaaccagagacugaggcuggacacaguggcucaugccuguaaucccagcacuuuuggaagccaaggcagacagaucaccugagcucaggaauuugagaccugccugggcaacaugguggaaccgcaucucuacagaaaauacaaaaauuagccaggugugguggugcuugccuguaguccaagcuacuugggagccugaggugggagaaucgcuugaacccaggagguggagguugcagugagcugagaucgcgccacugcacuccagccugggcaaugggaacaugacccugccucaaaaaaacaaaaaaaacccagggauuguagagaccguagaaagcaauaacgcuguaugucuuagcuuacagcagaaaaaauacucuucugaauuuuucugaauagucaaauuguucucuauaugugaaaacugaagaaauaaaugguuuuccagugaguggaugaaauauucucaaacuaccaugugguugauguaagaccugcugauuagacugugcuguucacuugcaugcaucguaaaccugagggcuguuccuuguccaugcgugcaucuuuuguagcucauauuugaugccgugcucaagaucauguaugcggcagugguuccuuggagugcagcuguggagcaacuggugaaacagcaccuggaaauggaccaucccaaguaagaugacugucuacgaaacaauguuguuaugcucuggagaaacauuguguuuugaguugacguucauuuauguuucuauauuguuugcugugucccauaguacuucauaaaaaagacaauccauguuaauauggguaaauuugcuuucagagucaaguuauuacaggaaaguuacaaacuaauggagaugaaaaaacuuuuacgaggcuauggaauaagagagguaaaucucuuaaacaaggaaauaaugguaaguacacucuucgaagagucuuuuuucucuuucauuucuggggcaauauggaaagcuuaaugaggaauuuauauucuaggaggcuaauagagcuagguuuuuccacuacauuucuuuuguuagauaugauguuaauaagguguucaguuauuuaugagaguauuuauucuuuuugacauggaguuucgcucuugccgcccaggcuggagugcaauggcgcgaucucggcucaccacaaccuccgccuucuggguucaagugauuuuccugccucagccuccugaguagcugggauuacaggcaugcacuaccacgcuuggcuaauuuuuuuuuuguauuuuuaguagagaugggguuucuccauguuggucaggcugguuggucuugagcucccgaccucaggugaucugccugccucggccucccauaguguugggauuacaggcgugagcuaccgcuccugggcuuuuuaugagaguauuaaagacaccaaauaggccaggugcgguggcucacacccguaaucccagcacuuugggaggccaagguggguggaucaugaggucaagagaucaagaccauucuggccaacaugguaaaacuccgucucugcuaaaaaugcaaaaaaauuagcagggugugguggcaugugccuguagucccagcuacuugggaggcugagggaggagaaucacuugaaccugggaggcagagguugcagugagccgagauugcgccacugcacuguagccuggcgacagagggagacucugucucaaaaaaaagacaccaaauaguaaauuaagaagcuguagaagaaagaagacaggacuguggaaugaucagaauauaaaucauguuuuaaucuuucauacaauuuaguuuuuugcugcauuauuuaaauuuuuuugccacuuugcucuuauaagcaagugauuucuugguuuucugugaguucuauaacaaagaaauguucauauugucuuuugcagagagugguuagauacauucucaaacaagaugucccaucuucuuuagaagaugcuuuaaagguagcccaagcguuuauguuaucugaugaugagaucuacagucuaagaauuauugaccugauugauagagaacagguuuguaaguuuuauguugucauuucauauggcuucuuuguuucuguguuguuguuguuguuuuuugagacagggucucgcuccauugcccaggcuggagugcaguggcuguguuucaccauguuggucacgcuggucucaaacucucaaccugaaguaauccaccugccuuagccucccaaagugcugagauuacuggugugagcuaccaugcuuggccuguuguguuuuuaaaugucauuauuuuuauaugauucuauaaucauagcaaugccuaggaauuaacucuucaguaucuaggaucguauuuuaaauuuauuuuauuguuugcugucaucaaaaauggauuuucagcaucaggauggauagcugaugcaugcagggcuuaaaaugugcaugacagguugauggguacagcaaaccaccauggcacauguaacaagccugcacuuccugcacauguacccugaaacuuaaaguaaaauaaaauaaaaauggauuuucggauuauuaaaacauugaaccauaaucuguuuuuccaaaugauguauuuucaucuuuaaauagaaaagaaagagguaaggccacaccguccuuugcaaauaccagcuguuuuuucuuccuuucaaacccuguuuauagggugaagacugucuccuucuguugaagucuuugccuccugcugaagcugagaaaacugcagaaagagucaucauaugggcacgacuggcauuacaagaagagccagaucauucuaaagaggugacauuuucacuaaguaaaauauaaguaaauccaauuuuuauggcuauuaaucaauaggauagaaaagauggacuuacacauaugaagaucugcucuucucacugcuaggguggccuagugaaaaaauuccuggguaaauuuacuacuaggagaaaaaaaacaauuguggcugccuuggagcggcugcuugagcccacagagaaugaccugggagcuguggguuagcaggugucuuggagcagcuguuguacacgaaagguuucuauaaagcguugcaauauaaacaauguuuuguguuauauaggacauaauuauugucaaauaguaaugucagcuacaaaaccaauauaaaucuauauaaucuuauaacauugaaacuuagaaaugguuuuaagagaguuuacuuuuuugcagaugaggaauacuugguuuuuccagaauagcuggauucuuacugauuuuuaauuuuuucucuuuuuuuaaauauuauauauaggagaugaggucuugguauguugcccaggcuggucuugaacuccugaguuuaaguucucuucuagccuuagccucccaaguagcugggauuacaggcaugcaccaccaugcucaauaguuggguuuuuuuuuucuuuucuuuucuuuuuugagacaagagucuugcucuguugcucaggcuggagcacaguggcgcgaucuuaacucacugcaaccucugccucucagguugaagcgauucuccugccucagcugggaguagcugggauuacaggcguccgccaccacaccuggcuaauuuauguauuuuuacuagagacggguuucaccauguuggccaggcuggucucaaacuccugacgccaacugaucugccugccucggccuuccaaagugcuaggauuacaggugugagccaccacacuuggccaauaguuggauuuuuaaaccccuaaggauagauaccucccaacuucucucaguccauuucaguaauguuuuuugcuguuggaaaaugaaguuauuguuguuuuuaacaccuaauauuugcuaugcaauaggcauuagguuaaauagcuacuucuuguucauaacaaagguguaaaguaguuccuauuguugucuccuuauguauuaaguucaaaaaccaaaauaugaaaguaaaugacuuuuuuccaagguuguuagaaaggggcagaaccucagcucaaacugucuaauaccauagucuguauucuuuuuuuuuuuuuuuuuuuuuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgccugccucggccucccaaagugcugggauuacaggcgugagccaccgcgcccggcccguagucuguauucuuaaguaccaguuugaauugcucccguuaugaaaauauuugaauuuuuuuauuggcgaggcacuuacuaaacauuuuacauacaucaugucuuuuaauuaaagcaucuccuuuuuuuccuucucuuaaaauuuuuuuaaauaaucacuggaagguagugauuauuuauuagacuucuguucucuaggccauuuuuuagacuucuauucuuuuuaacuuuuccaaauguuuuuucaaauaguaaauaacucuaaaagcgaauaaggaucuauuaaucauaauguaguugaaagguuauuugggagaguugcauauucuuugauauuucuaaaucauauauccaggaguucauacuggaguuuuucaggucuacccuguauaacgcucauuaaccauccauuucucagcugcccaacuccuccacgauuguuuuuucugcuucugugguuuuuguguauuuguauauguacuacugaaguggucagaaaaggaaguagauuuuauuucgcuuuauuuauuuauuuuuagggcaaggccuggagaaugucuguagcgaagacauccguggacauucuuaagauacuaugugacauucagaaagguagcuuuuacuucuguuuucucaucucaguuuuguuccaaagcucacccucuucagaaagaggcaucgaagacaacucucaccguacccgcaguuuuucugguucugauugucuuuauugaucuuacccauuuugcuucaugaaaagucuuccuuuauuccuuuaucagcaauucaagaacagaugcaugcaaaaucaaccuaucauuuguuuauaugcucacuuacuauuuagugcuagacuagauuuccuuagcgucucgcacucauugcucauuuuucucauuuaucaguugcuuaugaugguggggagaagccauuugacuggaaguuaaauaaaacagugaagaaaguaacuuuccagggaaaaaaaagaagcuacaauuuacuucagaaaaauaacuuuuuuguaacacauaaacuucuguuuucuaccuccugaaagaauaauuagauuuuuuucaaauuagaucuuuuguacuuaguuacuguauauuaucauuugagaagaacuacugaagacuugagaugagagaaccaaagcuaauuaaaauuucuucuuuuuaaaauucugauaauaugagaauuugcaugucugcuauaacuuuuaaaaauuuaauuacagacaaucugcagaagaaggacgaaugugaagaaauguugaaacuauuuaaagagguugcuagcuuacagguaaacauauugagccauguuaaacauuauuacuugaccaaucagugcauuuuucccuccuuaaaguuuucuguauggcugggcgcaguggcuuaccccuguaaucccagcacuuugggaggccaaggugaguggaucacaaggucaggagaucgagaucauccuggcuaacacggugaaaccccgucucuacuaaaaauacaaaaaauuagccaggcgugguggcacucaccuguagucccagcuacucgggaggccgaggcaggagaauugcuugaacccgggaggcggagguugcagugagcugagauagcaccacuggacuccagccugggugacagaucgagacuccaucucaaaaaaaaaaaaaaaaaguuuuuugcacuagccuuuagggacuggagauacugguuuuccuucucucucucucucucucaacagcuguauugagauguaauuuacauaccauauaauucauccacuuaaaauauacaauucaaugauuuuuuuguuauguuguguuauuaauuuuuuuuuuuuuuuuugagauggaguuuugcucuuguugcccaggcuggagugcaauggcgugaucucggcucacugcaaccuccaccucccagguucaagugauucucuugccucagccuucccaaguagcugggauuauaggcaugugccaccaagcccggcuaauuuuguauuuuaaguagaguugggguuucucugugugggucaggcuggucucaaacuccugaccucaggugauccgcccaccucggccucccaaagugcugggauuacaggugugagccaccgcgccuggccuuuuuucuuuuuuugagacaaagucucacucuguugcccaggcuggagggcuguggcaugaucucagcuuacugcagauucugccucccagguucaagagauucuccugucucagccucuugaguagcugagacuccaggcaugugccaccacaccuagcuaguuuuuguguuuuuaauagagacgggguuuugccauguuugccaggcuggucucaaacuccuggccucaagcgaucugcccgccucagccucccaaaauacugggauuauaggugugagccaccgugcguggaugcauuauuaauuuuguuaaaauacuuauaacaaaauguuccauguuaacaguuauuuaguuuguaauucagugguguuaauuacauucacaguguugugcagccaucaccucuaucuacuuuuucaugacccugagcagaaacuccguagccaugaaaaaauaacuccccuuuccucucuucucgcagccccugguuaucucuacuuucugucgcugugaauuugcuuauucuagcuauuucauauaaguggaaucauacaauuaagcauguaaaggaguccuaugacccaaaaauuugagaccagcuguaaauagcuuucucugugaaaaccaucuggaggccggguacagugguucaugccuguaaucccaacgcuuugggagaaugaggcuagaggaucacuugagcucaugaguuugagacuacccuaggcaacauagugagaccucgucucuacuaaaaauaacaaaaauuagcugggcguggugaugcgugccugcagucccagcuacuuuggaggcuguagcaagaagauggugugagacuagaagguggaggcugcaggagcuguguuuauaccacugcacuccagccugggcaacagagugaaacccugccuuaaaaugaaugaauggauggauguaaacaacugggaacuaccuugcugagguggggaggggaggagggcaaaggucgaaaaacuacgcaucagguacuaugcugggugaugggaucaguuguaccucaagccucagcaucacacaauauacccaggugagaagcccagacauguaccccugaaucuaaaauaaaaguugaaauuaugaaaaaaaaaacuaaugaaaaugauuauuuuaaacaauagauuaaacagacuugggacuuugucuugcuuaccuuugcuacaggagaacuuugaggucuuucuuucauuugaagauuauagcaauaguucccugguagcagaucuccgugagcagcacauuaaagcucacgaaguugcacaggcgaaacacaaaccugggagcaccccagagcccauagcugcugaggugaggagcccaagcauggaaucaaagcugcacagacaggcacuggcccugcagauguccaaacaagagcuggaggcagagcugaccuugagagccuuaaaagaugggaacaucaaaacagcacugaaaaaaugcaggugacauuccagaucccugaauugcauagcuucucugaaauugcggcugggcacgguaacucauaccuguaaucccagcaauuuaggaggccgaggcaggcggaucacaaggucaggagaucaagaccauccuggcuaacauggugaaacccugucucuacuaaaaauacaaaaaauuagccaggcaugguggcaugugccuauagucccagcuacuggggaggcugaggcaggaucguggcggguugcagugagccgagaucacaccacugcacuccagccugagcuacagagcaagacuccgucucacaaaaagaaagaaaguaacaacugccugauuucuucagucauaaggguagggccagugacacucuuuuuucacagaagcaauucuugauuucucaccuucagagcauauuuugggccucagugucagaaaguaguagcauaaaaggcaaguaagcaauacugcagaguuagguaacauaaccauuaaauuuagguuacugugcacuucagcauuuaaugguauccuuagucauuugaaaaacaggcuggggccagguguggugacucacgccuguaaucccaguacuuugggaggcugaggugggcagaucacuugaggucaggaguucaagaccagccuggccaacacagugaaacccugucucuacuaaaaauacaacuguuagucgggugugguggugggcaccucuaaucccaccuacucgggaggcugaggcaggagaaucgcuugaaccugggagguggagguugcagugagcccagaucgugccauugcacuccagccugggcgacagagugagacucagucucagaaaaagaaaaacaggcugggcacggugacucacaccuguaaucccagcaguuuuggaggccaaggcaggaggauuacuucagcccaggaguuugagaccagccugggcaacauagugagagcucaucucuacaaaaaaaauuuaaaaauuagccaagugugguggcacacaccuguagucucagcuacuugggaggcugaagugagaagauugcuugacccuggagguugaggcugcagugagccaugauugugccacugcacuccugccuaggcgauagggcuagagccugucucaaaaaaacaaaagaaaaacuacacuauauaccaugagaacauuuaaaagacauuuaauguguugauggugguggugauauauuaauccaagaaaggccaugcguucacuuucaaugugaguauucuaacuaccaauacuuucuuucuuccaaagcgacuuguuuaaguaucacugcaaugcugacacugggaaauugcuauuucugacaugucagaagcuuugucagauguuggcugauaaugucccagugacagugccugugggacugaaucuuccuuccaugauacaugaucuagcaagccaagcugccaccauuugcaguccaggugacaauauuuauaauauacguaguuuuauauucucugguucaugucauacuugucucccaaaugcugucucuuuacaauuggacaucacgguaaucagacuagagauaguaucugcauuucacaaagggaugcuuauaauugauucucuuugaggauuauuguuugaaaguauuucaaaauacuaacaaugucauuucugacuguugacauuacucacuuuuguaggauuaugaaauuccuugccucccauaucugaucuuauuuucaagucaagcuugagaaaaaauuuaacuuuuuaggguagucaaagcuauauggaaccuuucuaucuacauuguggccuuccuuagaauuuuaaaugguaauuauuaaaagguuguuuucauuauccuaaagacaugaaauaugaguuuaaugauuuuucuccauuuuguuucagauuuuuuacuagaugcuuuagaacuauguaaacauacuuuaauggcuguagagcuuuccagacaaugccaaauggaugacuguggaauccucaugaaaguaaguuacuuuugaguuuuuucccuuaaauccugggcaacgcauuaugcaccuuuuuuuuuuuucggacaggguuuuguucugucacccaggcuggagugcaguggcaugaucaaggcuuacugcagucuugaacugggcuuaagcaguccucccaccucagccuucugaguagcugggacuauaagugugugccaccacaucugacuaauuaaaaaaaaauuuuuuuuuugcagagacagggucucaccaucuugucuaggcuggucuucaauuccugggcucaagugauucccccaccucagccucucaaagugcucggauuacaggcaugagccacugcaccugggccguuuuuuaaucauuugcaaaguuuaugaaaauacugaauccaccucuuauguuuucuuacccuagaccggaaaacaacguaagggcaugaggccacuucucuguuccagucacuugauuggcuuuaauuugcacuaucuuucaaaacauugggccuccagcaaggccucccucgacauuguccuucuguuagaguuuaacuuaaaaugaaauuucuauaagccauagaccagaagaaacaauguguugugcagcguacugaguucucucuuuuuuguaugauuuggcaccuaggcuucuuuugggacacauaaagauccauaugaagaguggucuuacagugacuucuucagugaagauggaauuguucuugagucacagauggugcuuccagugauuuaugaacugauuucaucucuugugccucuagcugguaagucuuauuuguaucauuauuuucuauguguuucugucuuauguaaauuuaaacuguagagguuuggagcuagaacuacacacaguaaugugggcgaaccuuauaagcguaauguggagcuaaagaagcagauacaaaagaauaaauacugugugauuucauuuauguaaaguacaaacacaggcuaggacuaagcuggugcuguuugaagucagggcagugguuacccuugagggugggaaagggaaaggagggagcuggggagcuggcaauguuuuguuucuuuuuuguguguuuguuuuguuuuguuuuguuuuguuuuugagacggaguccugcucugucacucaggcuggagugcaguggcaugaucucagcucacugcaaccucugccuccuggguucaagcaauuaucgugccucagccucccagguagcuggaauuacaggcucaugccaccacgccuggcuaauuuuguauuuuuaguagagaugggguuucaccauguuggccaggcuggucucaaucuccugaccucaagugaucugcccgccucagccuuccaaagugcagggauuacaggcgugagccaccgcgcccggccgauguucuauuucuugaucuggaugcugcuucuucaguuuguggacguuuaucagguuauacacuuaccugugcauuuuccuguguauauuuauuuuuaaagcaucaguucgcuuuagaacuuuuuuuauaauagugaaauauuuacacaucugugagaguaugugcugugugaggguuauuuauuuauuuauuaguuguaugaauuuaagggguccaagugcuauuuuguuacauggauauauugcauagugaugaagucugggcuuuuaguguggccaucuauuuaguguuguuuaauguuuuauuaucuuuuguagaaagcaagagauaucccuuggagucuaccaguuugccauacugcucccuuaaugaagguauuuggcacaagaaauauauagcauucuauuaauauuuauuuauuuauuuauuuauuuauuuuauuuuuuugagacagagucuugcucuguugcccaggcuggagugaaauggcaugauuggagcucacugcaaccucuccaccucccgggcucaagcaguucuccugccuuagccucccaaguagcugggauuacaggcgugugccaccacgccgagcuaguucuuuuguauuuuuaguagagacaggauuucaccauguuggccagccuggucuugaacuccugacgucaggugauccacccgccucagccucccaaagugcugggauuacaggcgugagccaccacgucuggccuuaagauuucuuaauagaaagaaaugguggugugcuccuguaguccugguuacuugggaggcugaggugggaggaucucuugagcccaggaggucagggcugcaaugagcuaugauggcacuacuguacuccagccugggcaacagaagacccuaucucuaaaaaaacaaaaaaucguaguucuagaaauuucuugaaauucuaaauaugaaugugauuuaauauccuuaauguaauuguuuaguuauuauuuuuacauuguuauuuguuuaaaaguucaguagauuaugugauuuggcuuauaguguuaacuucuaugaauuuguuuauaaauuuuuaucuuucaaauggagaaaugguuuuucuucagcuaaaauaggcaaguuacaaucaaaggaucucauuaacuaguagacuuaguuauuuucugguuuaagucaagccucauguuaacuucucauuaacuaacugagaacaaacuccaugacuauuaucuguauugaagaagcaggcugucccugaaaacaguuuucaauaauaugaucuuucuuuguuuaaaaaaucuaaauauuaaaauccuuuaucacucugcaggagauggccuuguuuuaccuguuauaaauuccaucucugcccugcuucagaaucuucaggaaucuagccagugggagcuagcccuaagauuugugguugguucauuugguaccugucuucagcacucugugucaaacuucaugaaugccacuuugagugaaaagguauagugucaagaacaaauacuuugacuuggggugaauauagauguaaaagcgcuaacagaggaauuuggaguccacguuuuccuauugucuuuguagcaaggaaauugguaauucgucagauuuaagaacauuuguugagcaucucuaagaaucuggugugggaauaaggugccugcacacauuuucauacucauucuuugcaacagcccugagaguuuccaguuuacaaauguggaagcucagcucagauucagggagguggaauaaguuaaccaagguuuuauauuguagugguaagucuucacacucuaagcuuagugcaguguccacuauaccacauuuggucaaaauaucugcuguuuguuuuguuaucaccuaaauggccaaauuauuauaauuauuucugagaguaucauugagcaucauugaagagauucuagaagacaaacuaacuguugauaacucgcuuaugaaacugggccucagagggaguugucuucauuucuacuacucuguugauauguauuaaaugcugacucuuuuuuaaugaacuguauugagguauaacuuucaaaauuaaaaugcacauuuuaaguauaucaaccaauguacucaccuugucaccaacaccacagugaagacuuaggguauuuuuaaugcuuccucuuugcucccucccagucagucccccaccccuuucuagcacuauagguuaaauucugauacuuuuuggauauaaugaugaauuuucaccaaaguuccuuaauauuugaaaaaauuuucagaauguuauauagaacuagaccuaaauauuuuuuucuucuuuucuaaaaguuauuuggagagacuacauuaguuaaaucaaggcauguuguuauggaauugaaagaaaaagcuguuauauuuaucagggaaaaugcuacaacacuacugcacaaaguaaguauuuguucuggguaaaaauuuuguuuguuuuuuuuuugccuuuuaccucaguuaauugcauaugacucaauaguuuaugauucaguacaguaguauuuuacuauucaaaaacuucaagaaacugucuuauagcuaaucaauuauauuuuuauuaugguaauugacaugcuauagagcuuuuaugaaauaguagucaaucuuguccacugucguauccugauuuugguuacuuauauuuauauuuauuuauuuuuuagagaugagguuuuucucugucacccaggcuggagugcaguaguaugaucauaguuugcuacagccuugaacuucuggguucuaguuauccuccugccucagccucccaagucacugagauuauaggcaugagcaacugugccccacucuguaguuauuuauuuuacagauuaaagcauuccaaugauccuuucacuuauuucuauugcagaaauccuaauuuuccauuacccuuuauuuuuuaaaagauucuaauauuuuaaauauuagauuuuuuauuagauguuuuuaaauauuagaaauauuuaauguuucaucaacuguauuuggugaaaauauaguugcauuaagcauuuaauuucauuugucagauuacuucuuuaaaaaaauuguguuuuuuuuuuuuuuuuggagacagggucucacucugucaccuaggcuauagugcagaggcaccaucauagcuuacugcagccuugaacucaugggcucaagcaacccuccugcugcucagccuccugaguaucuggggcugcugguguuuuaccaugccuggccaauuuguaaaaauuuuuuguagagacaggucucacuguguugcccaggcuggucuuggacucuuggccucgagcaauccuuccaccuuggucuccugaaaugcugaaaguacaggcaugauauugugcccgggccccccaauuuuuuuuuuuuuuuuuuuuuuuuugagacggagucucgcacucucauccaggcuggagugcaguggcgcgauuucggcucacugcaagcuccgccucccagguucacgccauucuccugccucagccuccugaguaggugggacuacaggugcccaccaccacgccuggcuaauuuuugguauuuuuaguagagaccggguuucacuguguuagccaggauggucuugauauccugacccuugugauccacccuccucggccucccaaagugcugggauuauaggcaugaaccacugcaccuggccuaaaauuuuuuauuuggagauaauuucaaaguuucaggaaaauuuuaagaauagcacaaagaucuuugguauaccguuuacuguuucaucauuuucuggcaugcucuuucucuauuuuucuauuuauauauaaaaucauuucauauuuuguauauauuuuuuguauuuaggauuuaguuacauacauuauagcucuuuaccccuaaauauuucagugcccuauagaacuuguaguugcuuuccuuacucuucagauagucauaaaggacauuaaaccuaagcaaacacauuagaacuauguuacuauaacuuuucaugaaacacuucuucuguagugucuauaauucaauuuagugguaaauaaaccuugagacacugaauucuguuuuuuuuucuuuaaaaaguuuuuuuuaaguauaaauuaaaauuauuccucuuuauuuguauuucugcccuuugugaacaaaguuaauucuguuuugauugugaagaauuugcuucuuuugcugguuucuuccuguagguauuuaauugucgcuugguagaucuugaccuggcguuggguuacugcacucucuuaccucaaaaagauguguuugaaaaucucuggaagcucauagauaaagcauggcagaauuacgacaaaaucuugguauguccuaaggaagcacaccuucaauucuugaaguauucaagauugggggggagaaaugaaguugguuuugccaccuguucuuaaagauuuaguagaagaaauguugagcuaacucgugauuucuaccagcuucugcuugacuggugacauacuguugccuguauaugcaaguuaugagcauuguucaacccaaagaauuacaguuuuuuaauuucuuaaaaucuguguacacccuuagaaccucaaaucuuauuuugguguaguugaaacccuagacccaugaaucaguuuguuuuuguaggauaaguuuaacagauagaaaauuucucuuggauauuguguuaagggauuuucuugcaagauaacuaaaauuuggccuuuuauuauaaaggaaagccaggcuaaauguauagcauuauacgaaaaccugaauuaccuaaauauuacguaagaaguaacgacuguguacaaaauaauauguaacauucuacacgguugaucacaaaguuaugauuuuuauuguugcguuucgucuaaaagguguuauaagaauacauucuacuuacgauugaacuuuaauucucuuuuaauuuuuuaggcaauaucucuggugggcucugagcuggcaagucucuaucaggaaauagaaauggggcuuaaguuccgugaacucaguacugaugcccaguggggcauucgucuugguaaacuuggugugaguauucuuuguacugcugucaucgauucuguuaauuacccgguuggaaaauuuaaaacaaagauucuguuguucuuuacuuuugggaggagaguguauguguacugccucauacauuuuauuaacuacacacauaggugcuuucaaagaaauaaggaacuuuuugccucauuuccuuuuuucuguauuuuuaaggaaauuaaaaggggccugacauuuucagcugcuuaacuuucucauuuauagguauauaucuaguaucaauugacauuuaugcuauuucaggccuagccuuuagccucauacuuuuguuuucugcugcuguuauuuaaagauaauauuaaaauguauauacagcuauauaccaugcuucaagaacuccuagugagaggugacagugugcgggcaguccucacagcccucgcucgcucucggcgccuccucugccugggcucccacuuuggcggcacuugaggagcccuucggccugccgcugcacugugggagccccuuuuugggcuggccaaggccagagccggcucccucagcuugcagggagguguggagggagaggcgcgagcaggaacccgggcugcgcauggcgcuugcgggccagcuggaguuccggguggaugugggcuuggcgggcccugcacucggagcggccggccggcccugccggccccgggcagugaggggcuuagcacccgggccagcggcugcggaggguguacugggucccccagcaguaccagcccacgggcgcugugcucgcuuucucgccgggccuuagcugccuucccacggggcaggccuugggacugcagcccgccaugccugagccuucccccgccuccguggguuccugugcagcccgagccuccccgacaaaugccgccccaugcuccacggcgcccagucccauggaccgcccaagggcugaggagugugagcgcacggcacgggacuggcaggcagcuccaccugcagcccuuggugcgggauccacuaggugaagccagcugggcucaugagucugguggggacguggagauucuuuauaucuagcucagggauuguaaauacaccaaucagcacccuguguuuagcucaagguuugugaaugcaccaaucuacacucuguaucuagcugcucugguggggccuuggagaaccugugugucaaaacucuguaucuaacuaaucugauggggacguggagaaccuuuguaucuagcucagggauuguaaacgcaccaaucagcguccugucaaaacaggccacucggcucuaccaaucagcaggauguggguggggccagauaagagaauaaaagcaggcugcccgagucagcacuggcaacccgcucggguccccuuccacacugugcuuuguucuuuagcuguuugcaauaaucuugcuacugcucacucuuuggguccacgcuguuuuuaugagcugugagacucacaugaagaucugcagcuucuuuccugaguggagaccacgagcccaccgagaggaaggaacaacuccagacgcucugccuuaagagcuguaacacucacugcgaaggucugcagcuucacuccugagccagcgagaccacgaacccaccagaaggaagaaacucccaacacaucugaacaucagaaggaacaaacuccagacgcgccaccuuaagagcuguaacacucaccucggggguccgcggcuucauucuugaagucagugagaccaagaacccaccaauuccggacacacuagcagaggggacguaaauggccuuuauuuuucuuucuuuuuuucuuuuuuuuuuuuuuuugagacagagucuugcucuuuugccaggcuggagugcagugggacgaucucggcucacugcaacauccgccucccaggcucaggcaauuccccugccucagccucccaaguagcugggacuacaggcaugcaccaccacgcccggcuaauuuuuuguauuuuaguagagacaggguuucacuguauuggccaggauggucucccaucucuugaccucgugauccgcccacgucggccucccaaagugcugggauuacagacaugagcuaccgcgcccagccuugagcuuuauuuuugacauuguaaaagaacagacaagcaggcagggcgcaaucuugucuuugacaggaucucauucugucacccaggcuggagugcaguggcauuaucauggcucacugcagccuugaccucuagggccuaagugauccucccagcuuagccuccugaguagcugggacuacaggcaugcaccaccaugcccagcuaauuguuuuguauuuuuuuguagagacaagguuuccauguuggccaagcuggucucaaacuccugaccucaagugauccacccgccucagccucccacagugcugggauuauaggcaugagccaaaacccuguuuucuuuaccaaaaauauaagacauuuuauuugccaacaguugacuuaucagaaagguaaucaguacagaaaugcuauauguuuugaagcuuaauucuucugcaguaauggaacugguguucuguugacauuaacaaucaaacuuuucagaugaagaggcaaugguuaggaugacuaagaggaguuucggacccauguacaccucaaaucucagaaugauggcuggguuggguagugugagguuggaggagcuauagacaaauguuucuuuuugaaaaaggauacuaagaaggcaagucaugauguugcccuuacucugauacauuucaguguagaggguuuuuuugcuuuguuuuuuucuuuuuauuucuagauuucuuuucaaccaguuuucaggcaacauuuucucaccaagaaagaccucauuaaagcucuuguggagaauauagauauggacacaagccucauuuuggaauauugcagguaauucuuuaaacauuaacgguauuuuugcuguuaacaaacugguaauucuuuugcaagaacacaguaauaacgaugauuauuuuaugagguccauagaccacuauuuucuuuugcucauucccaaacugaguaaauaugaaaucagauuagagucucuuaugauaccaccauuuaaauucaccauuuaguguuucccaaacuugucuccugauaagcacugcuuagggcacuugauuucaaaugcagguuucugggccucucuggcaguucugacucagugggucuggaccaaggccuagaaaucgcuggucucuaauaggagcucaggugauuccuaugaucagaaaaguuggagaauauucuucugaguaauaaacuucuaaaucagguuaacuagggagcaaaguaaucuuaaaaauuaaugaaaaguaugauuuagggagaauuucuaauuuccuauuaaaaauguuuauaaaagaauuuuuauuuuuauuuaacuucuuucuuuauuugagacggagucucccucugucacccaggcuggagugcaguggcguaaucucagcucaccgcagccuccaccuucaagccauucucuggccucaaccucccaaguagcuggaauuacaggcaugcaccaccacgccuggcuaauuuuuauauuuuuaauagagaugggguuucaccauguuggccaggcuggucccgaacuccugaccucaagugauucacccgccucggccucccaaaguacugggauuauaggcgugagccacugcgccugaacaagaauuuuuagaacuaagauaaaauguguuauuuauagauuccgcugacuuugauaaguagggauaaaugauuuguaauuuauaucucagauguuucugucuaguaaauacaaggacucguuuucugguuucagaaugcuuucagaucugucaccucauuuaauuuuuauaguucuuauugcauauguugccaguugauauaugagaaaacaacauaguaugugaccugcucaaggucaaauuauuaaugacugcuucuaaaauauuaugggugcuauaaccuccaucugauuuguaacagauuaauggaaucugaguuauugagaaugaaacugcuuggugcauuuccugcacugggcaggcaucuaguucuuugucucuguggauaguggggaaagaccguggcugucaccaucuaguaccuguaagucaaggacuauaggcugcgcauagcucgaaggagcacugacuuaaaagaguaguuugaaauaacaaaacuaugucauucuucaguuuagaguguuauaaauccagaauaggguaugcacacucuuaucuuuuuuauuaauuugaacuacugcuagauucuucugugauguuuuauggugcaggacacuuuuuugaaauuuaaauagcuauaaugucaaguucauuucauaauuauucuacuuacguggcauugaugauuuguauucauaugauagugacacuucugccucaggcaguguaucugaauaaauuuagauaaacuuuagaauaucagagagugacuugaaaauggugguacuuaagccuuuuauugauauuuuaguuaugcuguauagcaaauuaaacuaucacuguguuauuaauagggucuaaaaaggcauuucaguugucauuuugucuauaguaaccagauucuuuuuuuuuuuuuuuuuuuuugagacggagucucgcucugucacccagccugaagugcaguggugcaaucuugucucacugcaaccuccaccuccugggcucaagcgauucuccugccucagccucuugaguaguugggauuacaggcgcaugccaccaugccggguuaauuauuuguauuuuaguagagaccggguuucaccauguuaccuaggcuggucuugaacuccugagcucaggcaauccacccgucucgaccucccaaagugcuaggauuacaggcgugagccaccaugccuggccuaauuuuuguauuuuugguagagaugggguuucaccauauuggucaggcuggucuccaacuccugaccucgugauccaccugccucggccucccaaagugcugggauuacaggcgugaaucacgugcccagccugauuuuuuuuaucuuuaaaaaaaaaaaacaaaacagcuuuuuggccagguaugguggcuaacgccuauaaucccaacacuuugaggggccaaggcaggaggaucgcuugaggccaggaguuggagaccagccuuggugacauagugagagccccaucucuacaaagguaaaaaaauucacugaaguguuguggcgcaugcuuguaguuccagcuacuugagagguugaggugggaggauuacuugagcccaggagguugagacugcagugagccuugaucaugccgcugcacuuuagccuggggaacagaaugagacccugucucaaagaaacaaaaaaaaauccaauuuuuguuuuguugauccuugguauuguuuuuguuucaauuucauuuauuucugcucugaucuuuauucuuuucuuuuacuaauuuuguuugguuugcucuuccuuuucuacuucuuuaagauguauuguuagguuguuuaugaauuuuuucuacuuuuuugauguguaggcacuuauagauauaaacuguuuucagcuuuuaaucauuacaaagaguugcugcagaagacauccuuacuaacauguauauuuuucuucuuaggugaaauuuguaaauguugcauuuuuauacuaaagagcauaaauauuuucaauuuuauuacagauuucucuccaauauucuaacaguuuacacacccaccaggaauaauaccugauuuuuuuuuuuuuuuuuuuuuuuuugagauggagccuugcucuguugcccaaacuggagugcaguggugcgaucuuggcucaccgcaaccuccaccucccggguucaagcaauucuccugccucagcuucccgaguagcugggacuacagccaugcgccaccaugccuggcuaauuuuuguauuuuuaguagagaugggguuucacuauguuggccaggcuggucucaaacuccugaccucgugaucuguucaccuuggccucccaaagugcugggauuacaggugugagccacugcacccggccuaauaucugauuuuuaaaaggcaauaauuagcuuugaugacagguaguuugucugauuuugagacuggacaaugacaagguuaaauuucaacaauggaagcauguacccaaguguuuugucagauacuuugcauggaaaugccugcaguuugggagacugguguguauugaaugcuucuuuuagcacauuucaguuggacugcgaugcaguucuucagcucuucauugaaacgcugcuccacaacacaaaugccggccaaggccagggagaugcaagcauggacucugcaaagcggcggcaucccaaacuccuggccaaagcccuugagaugguuccuuuacugacgagcacaaaagauuuggucaucagucuuaguggaauacuacauaagguagacacacagugaaaugaaucgggucaucucagccaucccucccacccuuaauaauuagauacauuaguaacaaauuggauguauaagucuauauuuuuaucaacuuuuaauuugaaauauucucuugauuucuauauuuuuaacacaguuaaauacaauuuucccauuuuucaaaauagaaauagcuuuucuuccccagauuuuugaaaaccuuacacauucuuugaauuuauaugagcuagagagaaauguauaaaucaaaacaagcaauuucccuauaacuccacucccuagagaugaagauguuaauagugugguguaguaacuaucuuaaacuaaauauacucuucugugacccucuuuuuucacuuaacauauggucauuauaugucauuacauacacaucuaucucaaaagaaacaauuucuuuuucaucuuuuucaugguccugccggaaaugucuuuuuucuuuuucuuuucuuuuuuuuuuuuuuuuugagacaaggucuugcucuguugcccaggcuggagugcagugguaugaaugugacucacuacagccucuauguccugggcucaagugauacuccagccucagccucccgaauagcuggaauuacaggugugcaccaucaugccuggcucauuuuuguauuuuuaguagagauggaauuucaccguguuguccaggcugguuucaaacuccuggccucaagugauccucccaccuuggccucccaaagugcuaggaauacagaggugagccacgaggcccagugaaccgucauuuuugacagaugcauaacuauuauuccauuauauggauaaaacaugccguauuuaaccaggcuuuuaugguuagacauuuaaacuuuuuuuuuuuuauuugagauagggucucacugucacccaggcuggagugcaguggugugaacauggcucauggcagccuugaccuccugggcucaagugauccuucuaccucagccucccagauagcuggaacuguaggugcaugcugccauaccccaguaauuuuuuuaauuuuuaaaauuuuuuaaauuaaaaaaaaaauuuuuuugugcagaugaaucucacuguguugucuggguauggcuggguaaauuuuauuaucauaaauuguuauaauuaauaucuucauacauauuuuuauacuuuugucugauuuguuuuuuaguuuuuuuuaagagaagggggucucacuauauugcccagguuggccucuaacuccugggcucaagugaucguccuguucagccuccugaguagcuggaacuacagggacuacaccuggcuucugcucaguauuuguuuaggagaucuucugaucuucugagaauuggaauguuuggucaggggguaguuuaauggagaaaugaaggugaauggcagggaaaaaaauuuuuuuuuuuucugagauggaguuuugcucuuguuguccaggcuggagucuaauggcgcagucucggcucgcuguagccucugccuccuggguucuccugccucaaccuuccaacuagcugggauuacaggcaugcgccaccacguccagcuaauuuuuuauauuuagcagcaauaggguuucaucauguuggucaggcuggucaugaacuccugaccucaggugaucuaccugccucagccucccaaagugcuggaauuacaggcaugagccacugugcccagccuggaaauaaaauuuuaagccugaaauaaauauuucaguuuuauauuuugcuugcaauucagccaaaaauuacauagauugcucaaaauuucuagguaacaauauuucaucuucccacuuuguucaauguuguuuuucacgcgacuuuuguuggcauuuaaaaaauaggccagccuggggaacauaguaagaauuugucacuacaaaaaauuuuuuuaauuaguuaggccuaguaguacgugccugcagucccagcuauuugggaagcugaagaggggaggauugcuugagcccaggaggucaaggcugcagugaguugugauugcaccacugcacuccagccugggugacagagcgagacucugugucaaaaauaaaaaggaaaaaaguaaugguguguggguagaaagaaagaacaaagagaagacuuccuuuuuuuguuuuuguuuuuguuguuguuguuguuuugagaugaaaucucacccuguuguccaggcuggaguguaauggcacgaucuuggcucacugcaaccuccgccuccuggguucaagcgauucuccugccucugccuccugaguaguugggacuacaggcacgcacuaccaugccggcuaauuuuuguauuuuuaauagagacaagauuucgccauguuggccaggcuggucucaaaugccugaccucaggugauccaccugccuuagccucccaaaguguugggauuacaggcaugagccacuguacccagccugacuuccuuucuuuuuguguuaauauguauauaugccacacaauuaauucuugcacuauaguauauaguuagagcuaaaacagaauccuuugagaaacuugcuuggaggcccacaguuuuacucaugucauuucuaagaaaaggaucaguuucuuucuguuccaauuuucccaucguaaaugaaagaaagggaacuuuaauuucaaaaucuuauaaaauuuugaccauaccccuacccuuucuaugcuuuuaguaucuuaagagcuuccuucuuuuuuuuuuuugagacauagucugguucuuuuguucagccuggagagcaguggcgugaucucagcucacugcaaccuccaccucccagguucaagcaauucuccugccuccgccucccaaguagcugggacuacaggugaaugccaccacacccagcuaauuuuuguauuuuugguagagaugggguuucacccuguuggccaggcuggucuugaacucuugaccccaggugauccacccgccuuggccucccaaagugcugggauuacaggcaagagcauccuucuuuauuaaaacaagacugccuugugcagcuuuuaaaaacagccuuugauaccuuuuuuuagcauguauguuuauccucacagguaauuuuagaggugagaaaauuguagcucuuuauuuuuuuauuuuuauuauuuauuuuugagauggagucucgcucugucacccaggcuggagugcaguggcgcaaucucagcucacugcaagcuccgccucccggguucacaccauucuccugccucagccucccgaguagcugggacuacaggcgcccaccaccacgcccagcuaauuuuuuuuuguauuuuuaguagagacgggguuucaccguguuugccaggauggucucgaucuccugaccucgugauccacccgccucggccucccaaagugcuaggauuacaggcgugagccaccgugcccggccgauuguagcucauuuuuaagggaguaauuaauuuaacaauguagugcagugacauuuuuauauuuguaaucugugcugauuauuguaauugaauaaaauuucaacauggcaaagucuuaucaaguuuugauauauuuuuguuuuuauacaguuggauccuuaugacuaugaaaugauugaaguugucuugaaaguuauagaacgagcugaugaaaagauaaccaauauuaauauuaaucagguauaacaaauauaucaaagauguaaaaaucaucuuucugcuuuuauuuggaucauaaaucauaucauuauccagggccuuuccaaauuauccauugaauucccuuuaaacucugugguuuauuuuagguuuuuaaaaaucuuuacaaaucuuuaaaaaaagaaaaagauuuucaugacauuccuauuuuaucacuuaucuucauccuuuuuuugcuguuuugaggugauuuaaauaaccucuccugcugucgaagaguaugaagucacuacagaacuaauugugaagaauuaaggaaacauuugccauguaggaagugaaaaaggccaugggacugagaguuaggucagcucuguguauuaauggguagguccaagaccuacucaauuaugucucaguacuuucauuaacuucuucaucguuucugaauuuuggucauaguggcuuuuauacuuuuuaauuugauuuuagaaauuaauauuuuagaaauauuuuaauauuauguuaauaagacuuauuauauaagaaaauauaucaauucaaaagauuauacaaaguguccuaauauaaaauauaaacauaggaaagauaagagcguagagaauuuagaucuguagccucuauauuuaaaaugaaaucaaguauuuugaauuauaucucaaauuauuugaagagcagauaacugucaagcucuuauuuacaaaacaucuaccaacaacagggcaccagugguuucuccucauaggauuccuuuaaucauuguauauaaauuauaguuuagaugaauaauguuaaagagaauacuagaaaagguuuugauccucuuucugaaaacaagauggucucaggaauggaaacuuuugaugguauacuauuagaugauuuuaugacaguuuaggauuggguuacucuuacuggacaaaaguuuuuuauuuuaauauaggcauugaguauucugaaacauuugaagucauacagaagaauuucuccucccguggaucuagaauaucaguauauguuggaacaugucauaacuuugccaucagcugcccaaacuagacugccuuuucaccugauauucuuuggcacagcacagaacuucuggaaaauucucuguauguguucauuaacuuuuuaugaauuuuacuggauagccaaauuuuuuuucuuaagcaaaucguacuuuccuuguuuccuuucuagcuacagaacucagugaagaaucuuucccaacauugcucuuaauuucgaaauuaaugaagguaauggauuaaaacauuguaagacauuucuguauccugcaauuaauucugaccccguauagaagauuuuucugcugcuuucauguaaaaccuuauaugugaauaugugcuucagccauaaccuuccuuuucuuugaaguucucucuggacacucuguacgugucuacagcaaaacacguuuucgaaaaaaaacugaagccaaagcuccugaaguuaacacaagcuaaauccucaacacugauuaacaaggaaauaacuaagaucacgcagaccaucgaauccugcuuacucucuauagucaacccagagugggcuguagcuauugccaucagccuugcccaggauaucccugaagguaugagcucuucuuuuaaaauuguaguuaaaaaaaaaaaaaaaguacucuuuuugcaucuuuaaggagaagcaggaugguaguuuucaaauguauuugcuugcucucuuaacuguggugaaugcugaaacgcucaagggcagugggcaugggcagggaggcaggcaauuuccaacuuguccuugugccgccuuuggggugugaccuuugcuaggaauaggcagugauggguacuuuuaauauccaaucacacuuucuuuuuuuuuuugagauggagucuugcucugucgccaggcuggaguguaguggcaugaucuuggcucaccgcaaccuccaccucccggguucaagugauucuccugccucagucccccgaguagcugggacuacaggugcgcgccaucaugcccggcuaauuuuuguauuuuuaguagagaugggguuucaccauguuggccaggaugaucucgaucucuugaccuugugauccgcccgccucggccucccaaagugcugggauuacaggcgugagccacugcaccuggcccaaucgcacuuucaaugaggaaucuuuagauagucucacauaaccaaacaggugcacaagcauaggcacucacugcuacauuuuugguuguaacaaaaguugaaagugacuuuuuaaaaaaugcucaggucaggaacugguuagaaaauaggguguauucauagaacgaaauauuauggggcugauuuggagagauauccaagauaugaagugagaacagcaaauuauacuagaauauguaugguauuacccauuaggguuaagaugcacaugcaugcaugugugaacacagacugacacacacacacagaaaacuccuaaaggcauauaagaauuuagagaauaggaauggaaucugaugagagggccccggugggcuuuuuuuuuuuuuuuuuuuuuuuuaacagagucuugcucugucgcccaguuuggagugcaguggcgugaucuuggcucacugcaaccucugccucagccucucgaguagcugggacuacaggcaugugccaccaugcccagcuaauuuuuguauuuucaguagagacaggguucuuccguguuggccaggguggucucaaacuccugaccucaggugauccacuugccuuggccucccaaagugcugggauuacaaauaugagccacugugcccagccaugaguaugcauuuuuguaauuuuuaaaaaguugcuaauuugaccaaaauacauuuucuugaaaagauuaagauuugccuguaaaucuuuauuuauuuauuuauuuauuuauuuuagguuccuucaagauaucugcuuugaaauucugccuuuauuuagcugagagauggcuacagaauaucccaucgcaggugugucugaacuaucagauuggcggcuucucuucuuccuaauuaaauuguacuagcuuaauuuaccuucucaugcugcccuggugccuaaaauggagaaggaagaccaaggcuuuauguagaugcuuaggaacauaacugaggaaggggggagggauugugauugauaaagauggaugcuuggcuucaacugaggcuuacaaaguaagauuuucuuuuugcuuggaauuguuuaaaaggacgaaaaacgugaaaaagccgaggcuuuguugaagaagcuucauauccaguaccggcgaucgggcacagaagcugugcucauagcccacaagcugaacacugaggaauauuuaagagugaucggaaagccagcacaucuuauugucagucucuacgaacauccuagcaucaaucaaagaauucagaauucaucuggcacagauuauccuggugaggacaaaacaauuuuuuuguuguccaagaaaagcuauuauuuugauucucaguuuuauguauauauguacguguacauauauauuacuuacauaugcuuauauauguauauacuuauauguguauguaugugcauauauacacauacacauauaaguauucaauauaaauauuuaaaacuugaguuuuucuuuucuuuauuuugaauaucuuagauauucaugcagcagcuaaagaaauagccgaagucaaugaaauuaauuuggaaaaagucugggacauguuguuggaaaaauggcuaugcccuucaacaaaaccuggugaaguaaguacuugcugcccaagaguaucuguaguugaguaugcacugauggcuucuucucaaaggcuaaauauuuaucccacaugauacagccuucuaauuaggagcgcagacucuucaaagaaggaaguuucuuuguuuguuuuguuuuugagauggagucuugcuuguugcccaggcuggaguguaauggcgcggucucggcucacugcaaccucugccuccugggugcaagugauucuccugccucagccucccgaguagcugggauuacaggcgccugcuaccacacccggcugauuuuuguauuuuugguagagacgggguuucaccauguuggucagacuagccucgaacuccugaccuugugauccuccugccucagccucucaaagugcugggauuacaggcgugagccacugcaccuggccucuuuuguuuguuuuuuaaagacagaguuucgcucugucacccuggcaagugcaauggcacaaucauggcuuacugcagacucgaauuccuaggcucaagcaguccuccccaccucagccucccgaguagcugggacuacacgugugcaucaccauguguggcuaauguuuuguuuuuuuuguuuguuuguuuguuuuguagagacagggucucucacuuuguuggcuaggcgggucucaaacuccuggccucaagugauccucccgccucgauuucccaaaaugcugggauuacaggcauaagccacugugccugucuggaacuuuuguucauuauaguacccucuguuaucugauaaguuuuaaagagauuguuuacuuuuuuuuuuuuuuuuuuuuuuggauacagagucuuacucugucauccagucuggagugcaguggcgugaucucagcaaccucugccgagguucaagagauucucccuccucagcuucccgaguagcugggguuacaggugugcgccacuauggccagcuaauuuuuguauuuuuaguagaguugggguuucaccauguuggccaagcuggucuugaacucccgaccucaggugauccgcccgccuuggccucccaaaguguugggauuacagacaugagccaccacgccuggccugugguugcuuacuuuuuguuuaaauauuguuuuguagcuguuuuaccuuucaguugaugauuucagaugcugucuuguaugaaagaaauggccuguucuuuuacucagauucaugugauuaacuuuuuguuuugaaauaauuuaaaauguacacaaaaaugcaaaaauaguaaaaaaagaauuccuauauacaccuuucaccgagauccaugaauuuuuaacauuuugccauauuugcuucaucucuccucuauaauugauacucuuacgauauuuuucugaaccauuggagaguaaauugcacguggcaugcccccuuacccccugaauauuuuaaagguguauuucccaagaacaggauuuucucuaauccaaccauaauauaauuaucaaaaucagaaauuuaauggugauauaauugaauuuaugguccauuuugcaguuacaccaauuguccuaauaacguuuuuuauauaagcaguuuucucccccagguccaggaucuugucuaggacuaugccuugcauuuguuggucaugucucuagucuguuuuuguuuuuuugacacagagucuggcuccauugcucaggcuggagggcagugguacaauauuagcucacugcaacccccaccuccuggguucaagcgagucucaugucucagccucccaaguagcugggauuacaggcgcccgccaccaugcccagcuaauuuuuguacuuuuaguagagaugggguuucaccauguuggccgggcuggucucgaacuccuggccucauauguuccuuccaccuuggccucccaaagugcugguauaacaggcaugagccaccgugcuuggccucuagucuguuuuaaucuguaacaguucugugacuuuuucuugucuuuuaugauauugacauuuuugaagagugaaauccagcuguuucauaagcugcccuccaauuugcgcuugucuaauacugccucaugguaauauucaaauuacuuauuuuuagcaucauacugcauaaguuguguugugcccuccucaggguaugacauuuggaggcacaugaggucccuuugcccucacaggugauguuaauuuagguaacuugguuacgguguugucuguuucucuacuccauaauuacuauuuuuccuuuuguaauuauuagaggaaauauuuuaggaugauacaauauuccauuccucuuccaacuccuuuccucuaccccugcacaccugauuuauugauguuuuugaagagcacaggccaguugguuuauaaaauauuucauuuugggucugcuaauguuucuugugauuugauucagguuaugugcuuuuggcaacaauacuguauaggugauguauuacuuucaaaggaucacaccaggaagcacauaaugucaguuuuuaagaaauagcaucauuaacaacuaaaauuuaagauaggauucagcaaauccagaucuucuguaucauuucuucugaauuuucaggcagaacuugagguagauucuauaauuccuauauccaccuaggcagauauucuugggggaacaaaaucuauuuguaaacaaauaguguaauaugacauuaggguuuuguuuguuuguuugagauagggucucauucagccacccaggcuagagcaguggcaugaucucaguucacuacagccuccgccuccccggcucaagugauugucaugccucagucuccagaguagcugggacugcaggugucccagcuacuuuuaaaaaauuaccugugcccggcuaauuuuuuuaguauuuuuacuagagauggguuuucgccauguugcccaggcugaucucgaacuccugagcuuaggugauucacccaccucggccucccaaagugcugggauuacaggugugaaccacugcaccuggccaccauuagguuuuuaauuagcaauuuuuauaucauuuggcauuugauucaacaaggauuuuuaaaguauuuaccaagagcauggacugugcuucaguggaaacaggaguuagaaacaucuuggccacguagaauaugugguugacuuuuagaaaccagccuuuacagauguuuuaacuuacauguaaguucaagguacacacuaaaaguuccuugaggccagaaacugcauguauacauagcaccuaguacaguacuuuguaaaucccaacagauauauacugaauuaacaaauggcucauuuaaaauucauggagucuuuuccuuuuacaaauuaucuaauacggggcugggcaagguagcucaugacuguaaucucagcacuuugggaggcugaggugggaggauuguuugaggcgagggguuugagaccagccugagcagcauagugagacccccaucucuacaaaaauuuaaaaaauuagccaggugccauggugugcaccuguggucccagcuacuuaggaggcugaggcaagaggauugcuugagcacaggagguugaggcugcacugagccgugguugugccacuguacuccagccugagugacagagcaagauccugucuccaaaaauaaaaauaaauaaaaauaaaaauccaaugcaugucagcuccaggaggacaggaacauuugcuuuauuuacucaggcaaucuauauacuuagaauugugucuaucauauaguaagugcucagugaauauuuguugaguaaacaaauaugaguagacccaucaguuaagcaaaaaucuuuucauaauuuauguuauaauuuuucaauguaaacauaauaucguauauuagguuuuuuaucuaauagauuuucagagagaugaauguuuguuuagucauaaacuuuuucaguuuuugaccuuuuuuuccuaccuuuucaaagaaaccaucagaauuauuugaacuucaagaagaugaagcccuacgaagguacucuuuuccuuuacuuauauucaccuauaucgugaugcaaaauagaaaucuuaccaguacauuuuucagcaguugauuuuuuuaaagggcuuucuugauaaaacucaggucagagucuaugagaugaaucaguucacuaauacguggcuaggagucugcaguggaaaacaucagagccagccaagaucuagaauuucugaacuccugcgagggcgaggguuccuagcacaccuuuagcugaaaggugccucucaagcagaagaaaacucuuucuuagcuaggacuuuggccccagacccuuuuauguucucuuaccaugcuaaacuggguugguucagauaugggccaccagauucuuuuugcucuucuaaccuacgacugaggccuagaaaggcacauugauuuuaucuaaugugcuagaucugauugguuauggcuuguauucuugagaagacucuaucugggcucaagucagaacgaauguggcaauccauuaaugaugccuggcacaggcauggauaagggagcauggugguucacaugccagccagcuuuuugucuuucuagccuaaaccaaaaguaagccaaguggccuggggaggcccuauguccagccucagccuuggagagcugauagaaaagauguggaaagacaaccccaagaaacggauuccuucugguuuggaacaagcaaagcuguccuaaucacccauaccaugcccucuuucccucuggacccgcaccuuggccucauuuagucuuuuaagggaaaggccaccuuuguucaaacaagaaguagcuccugguaugucuaccugaacuaggcacguggaaggucuuggagggaagcgauuuaaagaggagagaaaaaggaaaucccaaaaggcuacuuaaugcaaaauucauaacgugcugcuuuuuccacuaaaagcucugccccaccccuccuccagcuggccugauucauccucccuucccggagaggggccagccugcccugggucuagagguugaaaugggcugcuaacaagguccugcauaccaaacacagaauuucccauguguagcauucaagggacuuuacagcuacaguuuguauuaauuucuuaaauaaaauuuaagggaucagagauugacuagcuauucuauagaugaggaggcugaagccuggcguuuauuguguguauuaucaucuuuagcaaugaaagaacucaagaaaaagauuaagcauucuuuaaagggggaagcgcaaaugucauugacccauuauccuucugaucugccuuugaguugucuaaugaccguuccauggauagaaagauaagucuguuguuuugguaauccaucacuaaauuaaaaaaugacuguaauuaaaauuuuuuuuccagagugcaguaucuccuccugucucguccaauugauuauaguucaagaaugcuguuuguauuugcaacaucaacuacaaccguaagcucuagaaacuuaauccaaacucuucugugcaucucagcuuaacauuuuuuuccuguuuauuuaccaugcuugauugcauuaacagaugauucagauaaugcucacguacauauguauucaaagucugucucaucuccuaagcaagcauugucuugcaccaugcuccauuuaguucuggucucuguaacaucugcuuagcgugcugaauggugcaccuauugacaguuuccacuggcugucugcauucacagugguuaacucccuggucaguccacauuccugaagccaggagccaaacaaacuguccacaaacaagucuccaccaaggccuaaucuggcugcaugcucuggucagaccaccccuucugcccacuaaauucuagcuagauugaacuugcaauuuccccuaacggcaauaugaccuuuagcuucagguucuugccuauagaaauguccucugaggcaguuggagcagagagaggagaaggggauggagccaguaggcaaaugauucucagagaaaaggaagaaaaggaagucugaggugcugauuuuaaaguccgugacaaaaaggaaaaagccuccccuuauauucucuacauauaaagacuuacgaccuaaaaaugguauuccaugaaagguggcuagugcagcucacagcucagcuguguacaugcuuuucuuugcagucugccuuauguguacuucccauuaauuaguauuagcauguauucaaaugggaauucacauuaguaugauauacaguaaucuuuccguaucugugggaggacugguuccaggacccccaaggauaccaaaaucugaggacgcucaagucuuucauauaaaacggugucauauuugcaugucaccuacauacauccuccuauauaccuuaaaucaucucuaggcuacuuauaacacaaugccugcaaaucacuucguccccauggauucaguguaguacuuggcaugcagcaaauucauguuugguuuuuagaacuuuguggauuuuuuuuuuuucuugaguauuuuugauccacuguugguugauuccacgaauacagaacccauggaaaugggggcugacuguggauucaaaaguugagguuuaguaaaauuaauuuuuacuacuucaucaagaacauucugguuuuuuuuuguguuuuuuuuuuuugagauggagucuugcucugucacccaggucggagagcaguggcacaaucuuggcucacugcaaccuccgccucccggguucaagcaauucuccugccucagccucccgaguagcugggauuacaggcgcacgccaccacgccuggcuaauuuuuguauuuuuaguagagacgggguuucaccauguuggccaggcuggucucgaacuccugaccucaggugauccacccaccucgggcucccaaagugcugggauuacaggcgugagccacugcacccagcccaucaagaacauuaagugaaauuugucuuugguuuucuuuuucuuuuucuuuuucuuuuuuuuuuuuuugagagagagucucacucuguugcccagguuggaguagugcaguggcgcgaucucagcucacugcaaccuccgccuccggguucaaaugauucuccugccucagccuccugaguagcugggauuacaggcacgugcuaccacacccggcuaauuuuuguauuuuuaguagagacguggguuucaccauguuggucaggcuggucuugaacuccugaccucaugauccacccgccucggccucccaaagugcugggauuacaggcgugagccacugugcccggccaccucuuugguuuucaguacugccagggcaugccuguaaauacaagggcugcaacaacaguugggggcccucccuccauucugccugcaauuucacccaccauugcuuuugcacagucagugcaaauaucaacacaguguaaaggcaaauaacaucuuaguaucaugaaaacagcuuugacccuuucccucuugaaggagucucaggaaugccccuucagggguccauggaccacauguuaagaaccacuguuacacacagugcguuccguaacuguagagauugacuuuacauuuuaaaauaaugacguuguuuauguugccuauguugaaacucauuuacccaacuacaaugugcagguguucaacucuccaaaccucuuuugguuuuucagacauuagguaugcaucaguuaacuuuugcccauagaacucgagcucuucagugucucuucuauuuggcugacaaggaaacuauagaaucucucuuuaaaaaacccauugaagaagugaaguaaguagaaauguuuaaauuguauuaagaaauaggaaacagaucauuuuuuggagcuguaccuuuuaagcccugaauucagaagagcauaguagaguagcugugugaauacaguucuguugcccugaauauccuugacauuuuggcaaagggaaaauagggcuuugagaacaucuuguuuccaucguuucuuggagacauuuagaaacugaauguuuuauuuaucuuguucaaauugauuucuaucuaauguuauuauauauucagugaauauauuuggaaguccaaaauggacauuuaaaacaaacuggccuaauauuuccauaugguaguuuuuauuuuaaauguaaauguggccuaugagaaugauucuuagaaacguuucuguuuuccagaucuuauuugagauguauaacuuuucuggcaucauuugagacuuugaauauccccaucacauaugaauuauuuugcagcaguccuaaagaaggaaugauuaagggucuguggaaaaaccacagccacgaguccaugguagguacaccucacugccccauucccaauucccugccccuacucagaauccugaaagagaaaaccaggaacagucuuuuuguuguuguuguuguuggggacagaguuuugcucuguugcccaggcuggaguacaguggugugaucucagcucacugcaaccuccaucucccggguucaagccucagccucccaaguagcugggauuauaggcgcccgcccaccacaccuggcuaauuuuuguauuuuuaguagagaugagguuucaccauauuggccaggcuggucucgaacuccugaccucaggugauccacccaccugggccucccaaaguacugggauuacaggcaugagccacugcacccgacccaggaacagucuguaucccugagcaacucuacugcucugagaccuuucuacucuccugucacagcguguggauggauaaggcaguguggaagguccuuuuaccucuuuugccuuaaaguccaccagcuaaagucaucccugccaaccagagagagcacuuuuauaaucucuuccacggcuuaucuguccuuaucuggacagggagaggagacuguccgguagacagaggaugucauuucucuuccucuuaguugccuaugggauuuagccucugagucaguuggaggcuggggcaggaagguuuuuugguccaacaggcaaacuuuuucaauagaagaaagaaagggggagacauccgagguggugucugaguccaugacagcaagaaaaauaaucuuuuuugucaugucuuucauuagaaagaugggggucuucgauagacauucacagauuagaagcauauuuuguggccgggcgcaguggcucaugccuguaaucucaguacuuugggaggccgaggcagguagagcacuucaggucaggaguucgagaccagccugcccgacauggugaaaccccgucucuacuaaaaauacaaaaauuauccaggcaugauggcggccgccuguaaucccagcuacucgggaagcugaggcaggagaaucgcuugaacccaggagguggagguuguggcgagcugagaucaugccacugcacuccagccugggcaacagagugagacuccaucucaaaaaaaaaaaaagcagcauauuuuguauuaagcugcccuacuuuuccaaagauggcuugauuuacuggugucuuggaauagcaugauuuuuuucuuuuuuuggcuucaggcaguaagauuggugacugagcuguguuuagaauacaaaaucuaugaccugcagcuuuggaauggacucuugcaaaagcuucugggcuucaauaugguaaguaagacucaaugcccucgacuaaguauauuugaaagcuuuugcacagcauccccuaaacauuuuggauugauacuuguuauggaacagauuuaugcugaaaacacagucacucucacugagcucaugccaaacuuaaagaacuugguguuagaccagagagugcaaaauccaaaaugacauaaauuucauuggaaacaaauggaagguucccuagccuuuuuugauauuuaugaacuuguaagugaacuucucuggcaguuaucauggaagauaacguuuuaccaguacuucuucuggaacuuuaacaucugguauuucacauugaaauuuuccauuuugguggucuuuagaacuuuuuuauuuuuaauuuuuuacagauuccuuaucuaaggaaaguuuuaaaagccaucuccaguauccauucuuuauggcagguauguaguuuuuuaaaauaaauuuuauugaauuuagucuuuauacuuucuggccuugugacugcuggggacacuggauuaagcagucagcuccuucuuaaauaacagaacugagccaaguacaguggcucacuccuguaaccccaacgcuuugggaggccaagguggaaggaucacuugagcccaggaguuugaggcugcagugagccgugauugcaccauugcacuccagcuccggccuggggaacagagcuagauccuuucccuaaaauaaagaaagaagaaacagaacuaaucagcuguaggaugauuaaaguugugcccggacccguuaauacucagcucacaucaccuccugaagauacuguuuuccugaguuuuccaggccucacgagucacaucuuuauuuaugcucucaagacauuuuggcuccacucugacuuuugucaccauauaauuaguuuuaauuauauguuggacugccccucacagacuuugaagaucuuucaugucagauacccuggcuuguucaucuuuucuacauuucacauaaguuguguacccauauaaucauaauauauauuacgcagaaauauauaauuuauucuuuguuugauaaauuagaacaauauagaaguaugcugaguaaaacaugaaaauucccccuuacucuuucccuucauaauuaucucccuaagggaacgacugcuuacaauuuccuauguauucuagagauuuccuuuuuuuuuuuuuugagauggagucucgcucuguugcccaggcuggagugcaguugugugaucucggcucauugcaagcuccgccugcuggguucacgcuauucuccugccucagccuccugaguagcugggacuacaggcgcaugccgccacgcccugcuaauuuuuguauuuuuaauagagacgggguuucaccguguuagccaggauggucucgaucuccugaccuugugauccgccugccucggccucccaaagugcugggauuacaggugugagccaccgcacccggccgagauuuccuguuuuacaggcauguaugcuaugugugugcauaucuacaguguauauaugcauuuuugcacacauaaaugcaaucacauucuaaacaaaguguuguuuucacauaacaguggucucuggagauuguuccauaucagcacauguagaucuaucuaauuguuuuauugagauacaauucacauguaaaauuuauccuuuuaaaauacacaaugaaguaguuuuugguauaugcacagaguuguacagccucaccauuaucuaauuccagaacauuuuccucaccccaaaaagaaaauucauauccauuagcaaucauuccccauuccccacucccuccagcccccagugaccacuaauuuacuuucuguccauggauuugccuauucuggacauuuuguaucaacagaaucccacacuaugugggauuuuguguccggcuucuuucacucagcauccacauuguagcauggaucagaacuucauucgucuuuauugccaaauaauguuccauuauauggauauaccacuuuuauuuauccauuugccaguugauaaagauuugaguuucuauuuuuggucauuauaaauaaugcugcuaugaacauuuguguacaaguuuucacugaacauguuuucauuucuccugaguauauaccuagaagugggcuuguugggucuuacaguaacucuauguuuagccuuuugagguauuuuauuauuuuuaaugcuugauuauucuccagaauaugugguaaaauauaccugaaguuacuuaaccacuccucuauugauggaaguuuacauuuucuuuccucuuuuuuuucuuuaaauguauagagauggaggucuugcuauguugccuaggcuggucuuagaacuccugagcugaaacaauccuccugccuuggccucccaaaguacugggauuacaggugugagccaccgcgccuggccaguguucuuuccuuauucaccuucuugaaauucuuucucuuguccccuuccuucuuuccuguggcccuggcacauaaccggcuaaggauuaauuuucuuuucugaguuggguucugacuuuuugccaaauggaauaaugaaucagcaaggauuguauaaugagauccugaaagauacaguuaugaagaacauuaugcuagaaccuuaaucaucucaaacagggagauaucagcuuaugauuuuagucaucuggaauauaaacuauaaauguacaguuuugugaccauuuaacagcggccucuagagaguguuccguaucagcgcauagcgauuuaucuaauuuuuuuguugagauacaauucacuuguaaaauucauccuuuugaaaguauacaaucaaguaguuucugcuauauucauaaaauuguacaaccaucaccauuaucuaauuucagaacauuuaggcugcaauuuaaagagaguucauaauaccuuuuucgagauggaguuucgcucugucacccaggcaaccuccgccucccggguucaagcgauucuugugucucagccucccgaguagcugggauuacaagcaugcaccaccaugccuggcuaauuuuuguauuuuuaguagagacgggguuuugccauauuggccaggcugguuucgaacuccugaccucaagugauucaccugcuucagccuuucaaagugcugggauuauaggugugagccaccgcgccuggccuagacugcaaauuaaagagaguuuguaauauccuuaacaugaauaucccaaacguggacuuguuuucacagguucccuacuucagcaaagcguggcagcgugugauacagauaccacugcuuucagguauuucgcucucugaaacauuggcuacagcauuuuauaguugaguguguguauaucaugguuguuuuuuuguuuuguuuucagccucuuguccuuuaaguccugaucagcugucagauuguucugagagucucaucgcuguccucgaguaagcaaaauauuuguucuaccaaaaaaaaaaaaaguuuguugcuuauaagauucccuucuaauagauaucucuaaugaguaauuccuuuuuguuaggaaguuaagcauaacacguguuuguuguuguuguuguuguuuugagauggagucuugcucugucauccaggcuggagugcaguggcacaaccucggcucacugcacccuccaccucccagauucaagcgauucuccugccucagccuccugaguagcugggauuacaggcacgugccaccaugcccagcuaauuuuuguauuuuuaguagagauggaauuuccaaaguguugggauuacaggcaugagccaucccgugaguagcugggauuacaggcauacgccacgcaccaccacgcccggcuauuauuuguaauuuuauuagagacagccucccaaauugcugggauuacaggugugaggcacugcgcccagcaacacuuguuuuguuuuuuguuuuuuguuuuuuguuuuuguuuuguuuuuuguuuuugagacggagucuugcucugucacccaggcuggagugcaguggugcgaccucagcucacugcaagcuccgccucccagguucacgccauucucccaccucagccuccugaguugcugggauuacaggcacgugccaccaugccaggcuaauuuuuguauuuuuaguagagauggaauuuccagaguuuugggauuacaggcaugagccaucccgugaguagcugggauuacaggcaugcgucaugcaccaccacgccuggcuaauauuuguaguuuuaguagagacagccucccaaauugcugggauuacagaugugaggcacugcgcccagcaacacuuguuuuguuuuguuuuugagacggagucuugcucugucacccaggcuggagugcaguggcgccaucucggcucacuguaagcccugcuucccggguucacgccguucucccgccucagccuccugaguagcugggacuacaggcgcccaccaccaugcccggcuaauuguuuguauuuuuaauagagacgggguuucuccguguuagccaggauggucucgaucuccugaccucaugauccaccugccucggccucccaaagugcugggauuacaggcuucagccaccgcgcccggccaacacuuguuuuuauaccaaaauaucuugauuauuuuuacaaugucuacuucccauguguugugcgacuaguaaacugagcauucucuaaaaugaguaccuacuguaugagcauagaguacuuuuggugacuacccuaaaucauacagcguugucgcauauauuuugagucuucuggcugggugcggcgacucacaccuguaaucccagcacuucgggagucugaggcgaguggaucacuugaggucaggaguucgagaccagccuggccaacguggugaaaccccgucucuacuaaaaauauaaaaaugagcugggcaugguggcgcaugccuguaaucccagcuacucaggaagcugaggagggagaaucacuugaacccgggagguguugguugcagugagcuaagaucaugccaucguacuccagccugggugacagagcuagacuguuucucaaaaaaaaaaaaaaaaaagguuuugagucuucugagaauuuagaagccuaucuuuaggcaucuguaggcuuucagacauaaucaugauagcaaacaguaguccguguucccauggguaaauucuuuuauucuguguagagugcugucaaagacuuguguuacucauuccuaagcauaugucaugcaccagcacuuuaguguuuaaaauuauugaaaacuuggacaggcagaugacuauggaaagcuagaaaggccaauauaaucuagugaaucugccagauuauuaacuaauuaauguucucucucgaagauguccagucucaggugaucuugaccugaucggagucgccaggcaguauauccaguuagaacuuccggcuuuugcauuagcuugucugaugcucaugccccacucagagaaaagacaccagcaaauuaagguaucgugcacaugauuccucugggcugccaaggaaauagaagguuucaucuugcaugucccuugcaaaaggucgcauuuucauuucagcaaaccuguaaagcaugaauacaucagauaugugugaagcuuguaugggggcuuagugggagguaagacugaaagauagauuaagguccagcugagggcugucuuacaagggguuugggccuuauugucuaucaguggggaaacaagugauuauuuuagaacagcaaacugaaaugaugaaggaauuauuuuaaaaggaauaacccauuaacccauguaggcuuggacagaggagaggacaagaagugaaacaguugggaagauguugcauuugaguagaauuuuaucccacuugaucucuucauagcaaccuugugcauaggcagggaaggcuugaggguuaaguacccaugauagggucugguaaugaacuugaacaagacaagaaggcuacaaggaaggcagcagacuuagcaauugaaugugggagauagaagagggggagagucagauuuuaugugugggugcccaucagaaggagccacaagcauuuuggggauagaacuuuuaaaaauaacucucauuuccuuuauaauagagaacaaguagaacaaagcauuuuggaauguuuuacaguuaucuucccugcagguagauauaccaguagauagagaucuacauaaaugaacauacaugcauucaggcuuuuucguuuguuuguuuuuuguguuuuguuuuuugagagucucugucacccaggcuggaguccaguggugcaaucucagcucacugcagccucccucccggguucaagugacucccaaguagcugacguuacgggcuccugccaccacgcccggcuaacuuuuguauuuuuaguagagacaggguuuugcuauguuggccaggcaggucucgaacuccugaccugaggcaauccgcuggccuuggccucccaaaguguugggauuauaggcaugagccacugcgcccagcugaacaugcauauuuuuuauuugucauuuggcuuauuaauuacauuuuuaaaagccaucuguucuugucuuugacuuuuuccccucuuuucaucauucauacacucauuccuugaugucguucaguguuucaguauuuaaauagauuucuuuuggcacuuagaagagcaaaauaccugaucaacggcucuugcuguuggaauaaauaauaacaauuuucuauuaauucugcuuugauuuuucucuagaauuuucuggguuccugugacccucagguuauuuuaaagcaauuggaagagcauaugaacacgggccagcuagcaggauuuucacaucaaguaagaggcgauuucaucuccuuuuugcuaugaaaauguugauacuagaagguagucauuuucccaaaccaagaguaagcugaaaacugcuaugucuagcuguuuguuuauguauagaauuauuuugcuuuuacuaaaaccucaguaaauuuuuuaagaggcagggacccugagcgucuuguugacugcuguacuccauggaaaauuuguagccuuaagugcuuuuaauugaaaacagaucuucuuccucauaaaaagucucaaagugcacaacaacaauuacuuuauuuauugacugaugcugacaggccuccuuucccuuuuuacccccucaaaaaggaggcgcagucacaaugcagugcuaauugggcuuccgauugucagaaauguuuugauauugaauaaaggcuugauaccugucauucuauagauuagaagucugauucuaauagauuagaagucugaucuuaaugauaccugucauucuauagauuagaagucugauuuugaauaauaucaucaauaagaaggaguuugggauuuuggcaaagaccaaauacuuucaaauguugaagaugcaugcgaugaauaccaacaauaucacugagcuagugaacuauuuggcaaaugacuuaagguaaguuaauuaaaaaaaaaaaaacuuacuguggaauuuccuuaaaaucuaucuuuauaagcugggcacgauggcucacgacuguaauccuagcacuuugggaagcugagguggguggaucaccugagguugagaguucaaaaccagccugaccaacauggagaaacccugucucuacuaaaaauacaaaauuagccgggcaugguggcacauaccuguaaucccagcuacuagggaggauaaggcaggagaaucucuucaacccgggaggcagagguugcagugagccgagaucgcaccauugcacuccagccugggcaacaggagcgaaacucugucucaaaaaaaaaaaaaucuaucuuuauguuggagcagaaugucaacuguagagcuauuugguuguaauuaaaagcucaaaauauuacaucucucauuacugcacauauccaaaaguuaaucauuuaauaacccaauuucuuggaauaugaccuuagaaucugacaauuaaacaggucaucugaacccccaaaucaagugucucacagcccuguucuaaauccuacauuacaauuuuaugucuagacacuugcucagaacauuaaugacuuuauguagcaucacuuuuguuaaaccugguuaucuaauuuuccagcacccacaaguuuagaaacaauaagcuucuugggauagagcuggggguggauauggaaacugaacgggagaaggaagaagugggcugacacuaaagaaagggaaguucaagaccgcaguacacaccagauccaucccugcauguggucuagccauguuggcgcuugagaggucuuucuuucucauuaccacuccauggauuuccaucugcuuguuuaucucuugugauccagccauaauuagauauugucauuuuugagcaaguauuuuuugaguuauaauugauacauauaauaagcuggacauacuugaagucugcaauuuaguaaauuuugacauauguauaccuauaaagccaucaccacaaucaagagagugaacauaauucucugaaaguuuccucaugcccucugugaaguugauuacaugaauuaggucauucuugugauacccaaauucaucagagucgaggggcccaggggaaaagcacucagaguacaaaacauugcuccaaaaacauaauucuggccgggcgcaguggcuuacuccuguaaucccagcacuuugggaggccgaggcggguggaucaccugagguuaggaguucaagaccagccuggccaacaugaugaaacccugucucuacuaaaaauacaaaaaguuagccgagcaugguggcgcaugccuguaaucccagcuacucgggaggcuaaggcaggagaaucgcuugaacccaggagguggagguugcagugagccgagaucgcaccauugcacuccagccugugcaacaagagugaaacucugucucacaaaaaagaaaaaaaagaacaauguguaacaugucucuuuuucauaaaaccucuaaccuucucuuuguucuuuggacaauccagagacuacccagucuauguauaugccccaaauuggaauuauuucuucccaaauaaaacauuaaauucagagauuggucuuuacauuuuaauuuugacuucaaugccucuuuuucuuuucuuuucuuuucuuuuugaaauagggucuugcuuugucacccaggcuggagugcagugguacaaacguggcucacugcugccccaaccuccuggguucaagcgauccuccuaccucagucuccagaguagcugggacuacaagugugcaacaccacaccuggcuaauuuuauauuuuuuguagagacagggcuuugccauguugcccaggcuagucucaaacuccuggacccaagccaucuguacaucuuggccucccugagugccgggauuguaggcacaaggcacugugcuuggccuaacacuucuuuuucuuuuugauuuuguaguuuagaugaagcuucagucuugauaacugaauauucaaagcacugcgggaaaccugugccuccagacacugcucccugugaaauucugaagguaaagcugauggaaaguucuuagguucuaacuugacauuguuuauauuccuagggccuuaaaauugacaagccuuuucuaguguucuggagauaaauguauuuuuauguguaacuguaauuuuuauauuuuacuuuuuguguuagagaguucuaaacuagaaaucaagagaccacaguucuaaucucagcccugccacugggcagcaaagccuaaugugggcuuagucuucagaucuggaccccauggucucucaggugcuuuccagcauuaccauuccucauaaggugguguuuuuaauauugaagcaggugaaaaacugaauucuaaaagguguugauuauugucaugcuuggguauuaauugcuuuuuaaauuaauuauuauucuuuaauuaccuaaaacguauauucacugcagaaaaaaaagaaguauggcugggcacgguggcucacaccuguaaucccagcacuuugggaggccaaggggcagauuaccugaggccaggaguucaagaccagccuggccaacauggugaaaccccgucucuacuaaaaauacaaaaauuagccaggcgugguggcacacgccuguaaucccagcuacucgggaggcugaggcaggagaauugcuugagcccgggauacggagguugcagugagcugaggucaugccacugcaccccaaccuggcugacagagcaagacucugucuccaaaaaaaaaauauauuagccuggcaugguggugggagccuguaaucccagcuacuagggaagcugaggcaggagaauugcuugaacccaggagucagagguugcagugagccaagaucacaccauuguaccccagccugggcgacaagagcaaaacucaucucaaaaaaucaaaacaaaacaaaacaaaaaaaaaaaacaaaggaaaaagagaaauaugaaagagccaaaagaaagagaaaaauacuaaacugaucuucaaaaucucacuacccagacauaggaucacuguuaacauuuugcuguacauucuuccaaauuuuuuguauguaaaaugugcacauaauuuauuuuuacucccauuuugaacuuaagugccagguaaaauuuuuacuuugaucauauuuugguagcuuuauuuuuuauuugcuguuuuucagaucggaauauuuugguagcuuuaguaaaccuaaguaucguggcuuuuuucuuccuuugguccagaucaggcauauuagaaugagcccgcauuuuguuaccgcccauuaauaacuuacagggcuuaccuccaggugguugugcucaaugccauaagauuacuuuuuuuuucagaaggggagaguauugauucgggagauaaauuuguggcguuuaaaaucuguuucucucuaaucuaaaaugccaaauaguuugauauguagauuuguaucacuucacuuaaguucuguaguuuaucugaccauuuucaauuugaaaaacuaagugacuuauaaaaaucacuucuguguuucuucccauuuagauguuucuuaguggauuaucguaaaucacugaaccuuuuuuucaagaaggacaagaauuuuggagucugcuauuaauggaccauauuuauuacaguuuuuaaauuguacaaucucuguauuauagcuauuugucuaacauuaccccacauguaauaaauaaaacaauaugagcauaauugccccauaaagaacuca

SEQ ID NO: 191524 - RNA, 65496 nt, Homo sapiens
auauacaggaggagauaaaaaauuuagucaaauuacagacuaguagugcuuccuuagcuuccugugaaggaaauucuucaaacaaacaaguaucuucggaaagucaaauggguuuuuuuucucuaagcagugagagaaaugaaucuguuauccauuauccugaauccacagaaccugaaauacagcaagaaauguccacgucacaaccagacugcaauguggauaguugcucaguaagcaguggauauggcaccuuuuguaucucagaauuaaaucuguacaaaucuaaagacccuaaggaguucauggagcacauagauguucccaaaggacaguauguagcaccugcggugccggcugagucacuuguagauggugugaaaaaugagaauuuuuauauacagacuccugaagagugucaugugucuuuaaaggaagauguauccauuucuccuggugaauuugaacauaauuuucuuggugaaaauaagguuucugaaguauacagugggaaaacaaauagguaaguagaauuucuaucauuugaagggaguuuauuacauuuagaaucuaguguuccuuuuaaugcacuauaauagaaugagauguauuugaacauuuaucaguucauugccuguagaaaauugaaauaaacaaagcacacuauauucuaaugacacugacuuucuucccaucuguaauguuauaagacuacuaaacucuuaaggucggaagcuuugccagaaaauagaaaagauauuuuuagcagacaggacuguaucaauaguggaaguuugucauacauguucauguaauuugaacaauuuuuuuucguuuuuugagacggagucucgcucugucacccaggcuggagugcaguggcgcaaucucggcucacugcaagcuccgccucccggguucacgccauucuucugccucagucuccugaguagcugggacuacaggcacccgccaccacgccaggcuaauuuuuuguauuuuuaguagagacgggguuacacuguguuagccaggauggucucgaucuccugaccuugugaucugcccgccucugccucccaaagugcugggauuacaggugugagccaccucgcccagccacaauuuuuuuuucuuaaaggugggggucuugcuuuguugcccaagcuggugugccguggugcaaucauagcucacuguagccuaaaauuccugggcucaagugauccuccugaguagcuaggacuaugagcgcgugcuauguuaccauguccagcugaaaccaaaaauuauauacaggguuacccaauuuuauguuuuguuuuuuuugauauggagucuugcucuugucucccaggcuggagugcaguggcgcaaucucagcucacugcaaccuuugccucccugguucaagugauacuccugccuuaagucuccugaguagcugggacuacaggugugggccaccacacccggcuaauuuuuguauuuucaguagagacagaguuccgcuguguuggccaggcuggucucucuccugaccucaggugacgugcccaccucagccucccaaagugcugggauuauggugugagccaccgugccuggccccaauuuuauguuuuuuauuuucuuuuuucuagucuguauguugcugaauguuuuuguuuguuucuuuuguucuguuuuuauuuauuuuuugagauggagucucgcucugucacucaggcuggagugcaguggugcgaucgcagcucacugcaaccucuaccucccagguucauaugauucuccugccucagccuccugaguagcugggacuacaggcauguaccgccacguccggcuaauuuuuguauuuuuaguagagacgggguuucgccguguuggccaggcuggucuugaacuccugagaguuuaguagucuuacaacauaugcccaccuuggccucccgaagugcugggauuacaggcgugaaccacugcacccagccugaauguuuuuuauguauaagaagaauuuuuauaaauuuagugacauuucaugacaaaggaggcuuuuuauuaaacugugacugaauguuuguaaaacaaguaauccuuaaaaauuucauaauuuaucccaaguuuuuaguuucaugucccugaauugugucaucuaaagcaacacaaaucuuauguauguucaaguauaaugauugauuuaugccaacaaauacacucucauuguagagauacauuuagcacuuggaagggcaaauguggugguuuuuguucuagucuauggcuacagacuuuuuguauuauuagucacuguuagucuuuuuuuuuuuuuuuuuuuugagacagagucucgcucuguugcccaggcuggagugcaguggcgcaaucucggcucacugcaagcucugccucccggguucacgccauucuccugccucagccuccugaguagcuuuuaguagagacgggguuucaccauguuagccaggauggucucgaucuccugaccuugugauccacccgccucagccucccaaagugcugggauuacaggcgugagccacugcgccaggccugucacuguuagucuuuuuguuuacuuugccuuugauaauaagaaauugaaaaaaguaauguaggugaauuaauaaaaauucauugucuuaccgcuaguagaaaaaacaacuggcugggcgcaguggcucacacuuguaaucccagcauuuugagaggcugagacagguggaucacuugagcccaggaguucgagaucagccugagcaacauggcaagacccuggcucuacaaaaaaaauagaaaaauuagcuggguguggugguggccaccuguggucccaucuacuagggaggcugaggugggaggaucaccugagcugaggaaggucagacugcagugagcugucauugcaccacugccgcugcauucuagccugggugacagagagggucucuaaaaaacaaacaaacaaacaaacaaaaaccacacacacaacaacugaaagcaacuggugguuagcuuuauaugugaaguacaguaucuaaagaaauaauuuuggaacccagugugguggcucaugccuguaaucccagcacuuugggaggcugaggugggcagaggucaggaguuugagaccagucuggccaacauggugaaaccccaucucuaguaaaaauacaaaaauuagcugggcgagguagugcgucuguaaucccagcuauucaggagacugaggcacgagaauugcuugaaccuaggagauggagguugcagugaacugagauugcgccaccguacuccagccugggcgacacagcaagacucugucucaaaacaaaaaaaaaaaguaauuuugguuuucucuucuuaaauaguaaugcuauaacaucaugggcacaaaaacugaagcagaaccaaccaaagagagcacauguagaagauggagguucaagaucuaaacaaggaaaugagcaaaguaagaagacaccaauugagaaaguaggugacuagucacuuucccugcgggcuccaguacugaugauuauguggguuuaguacacgcucaugaacaaaacucuugugcccuuucuuuuguauuguuaauuuguucauuuauacauuuuuuuuguuguuguuuuuuugagacggaguuucgcucuuauggcccagacuggagugcaaugacgugaucucggcucacuucaacuucugccucccagguucaagcgauucuccugucucauccucccaagcaccuguggugguacaggugguacauggugguacagucgugugccaccaugccuggccaauuuuuuuuuuuuuuuuugagauggagucucgcucugucacccaggcuggagugcaguggcacaaucuuggcucacugcaagcuccgccucccggguucacgccauucuccugccucagcuucccaaguagcugggacuacaggcacccgccaccacgcccggcuaauuuuuuguauuuuuaguagagacaggguuucaccauguuggccaggcugcucucgaacuccugaccucaggugauccacccaccuuggccucccaaagugcagggauuauaggcaugagccaccacgcucggcccauuuaugcaucuuucuuuugguguuucagaggauuagaaauaaugauuugcuguaaguguuucuucuuuaguaggcuagaaaucaaagcuaauaaaggauaaaauauuaugaaaaugaaucauuugcagagguccuauuucucuuuguacugcaaauguuuacauuuagccagagaguaauccauuuaauuguuuaaaauaaacuuucaaauaauuuauauuauuauuaaauuguaagaaguaauacuguaaucuuaaaguugaggcugggccaaguggcucaugcuuguaaucccagcacuuugggaggccggggugggcagaucacgaggucaagagaucgagaccauccuggucaacauggugaaaccccgucucuaacuaaaaauacaaaacuuagccgggugugguagcaugcgccuguagucccagcuacucgggaggcugaggcaggagaaucacuugaacuggggagacagagguugcagugagccaagaucacgccauugcacuccggccuggcaaaagagcgagauuccgucuaaaaaaaaaaaagguugaaauuugaacaguucugaauuauaauccaaauugugagagauuaaauguugaaauucuguauggcccuuuugcuaagcuagcagcuacuuuaauuaaaagauuauagauauugaguaagguuuuuuaaaaaauuauuuaaauuugaguuucagauaauuaagauuuuaaacauuucuuuuauuuauuuauuuauuuauuuauuuauuuuuuugacauggagucuugcucuguugcccaggcuggguugcagugacauaaucucagcucacugcaaucucugucuccuggguucaagcgauucuccugccucggccucucgauuagcugggacuauaggcgcgugccaccacgccuggcuuauuuuuguauuuuuaguagagauggggucucgccauguugguuaggcuggccagaccucaagugauccaaccaccucagccucccaaagugccgggauuauagacgugagccacuguuccuggcccaaagaaauuuuuuuaaaauauauuuuuguagagacagggucucauuauguugcccaggcuggucucaaacuccuggcuucaagugauccucuugccuuggccuccccaaaugcugagauuacaagcaugagccacugugccuggccagauaauuuuuaauaugccuguauagcccuuauugcucuaaauuugucacagaauagcauuguuuaguauaacacauugaaauggcaaaaucaggucccucuacacacccaauaccuuuagaaacuggccaugucuuauccugaacauggucuuuuugucauccuaugaaaaagauccauuaaagaggucauaagaagauuguccuacagccuucauaaggcauuauuuauuccucuuucaauaaauuuuauuucuucaauuuaggcuuccugauaucaccauucuuuguacuuuuucagauuuauauugaagaggagggaagugaagguaaaugaagcucuaugaaccacaaaagcgucuguggucuaggaaagcccuuuaguacuguguugcuaguuuuauucuagaaaagccguuuaguacuauauugguagcucuagaaaagccauucaauacacccccaccaccacgcccggcuaauuuuuuguauuuuuaguagagacgggguuucaccguguuagccaggauaaucccaaucuccugaccucgugaucugcccgccuuggccucccaaagugcugggauuauaggcgugagccaccgcgcccggccuucucuuggucuuaaguagugagacaaauugaaacagguggaauuucuuccuugaugagaaagaaaauaaguggugccuuauaaggcucauguguuaauuccccaucuucguagguaguguuauuucagugugcuuuuacuuuggcaauggguucauggaugguuacauacucuuuacaggaauuaaaaguuucaugagggaccugauaagaaaaauucugauagaaauauucucaucacauaucucuggaaacacauuucuugcgacagugucagagaugugaggauugauuuguucagaauuuuuacuagaauugauaaguaagcagggacuacuaaccaauuguuuguauauaggaaguagucuacuacuuaaggcucauauuauugauuuaugguuuuuagaguuaaucugauuuauuguaauuaugauaaaaaugaauuguuagagcuuuuacauuaauuuuuauacuaaaugacuuuaauucuaggcacuucaaauuuguuuuggaaguaaauggcaaauuauaaauacauuuuaggucugaacucacgaaauaauaccugcccccauuuuucuccuuccagcuccacagagaaccgaaauaaacuuuuguaaauuacacaggcaaaaaaaaaaaaucugcaacagugaauuccuaucaguuagcauucuuguaaccauggggaaaucaggcuuucuucuuuuuuuuugagacagagucuugcucuguugcccaggcuagagugcaguggcacgaucucggcuuacugcaaccucugccucccagguucaagugauucuccugcgucagccugccgaguagcugggauuauaggcacccgccacugcgcccggcuaauuuuuguauuuuuaguagagacgggguuucaucaucuugaccaggcuguuuucgaacuuuugagcucgugauccacccgccucggccucccaaagugcugggaucauaggcgugagcuaucacgccuggccaggcuuucuucuuugaacccucugaagguuucuccccaccugguuugaggccuggcucucauuucuugggucagcagauugugccuaaugacuuuuagcugucaaucaauaguuuucuuucuuguagucugauuuugcugcugcuacacauccucgugcuuuuuaccucaguaaaccagaugaaacuccaaaugcuuggaugucugauucaggaacagguaugauacuuacauuuuuauuuuuuuuaaccuaaacuacauacacucagaggaagguacuuagauuuuuagagcauuauuuuuaaaaaacaacuugccuacauuucuccauaugggaugauacuguauaguaguaugguuuuguaaauguguuauguguugugauguucucugguagcagccuuaccuuuguuuguuuuguuuuuugagacagggucucacucugucacccaggcuggggugcaguggugcgaucacagcucacugcagccucagccuccugggcucaagugauccucccaccucagcuucccaagaauagcugggacaacaggcggugucaccaugcccagcuuuuguauuuuuuuguagagacaggguuucgccauguugccucagcugguuuugaacuccugggugcaagcaauccaccagccucgguuucucaaagugcugggauuacaggcuucagccaccauguccagccaccuuucuuucuuaucuuaauuuauguuacaagaucuguaaagagaauaaagaaguacuuuugcaguuguuuugaacagcuguaaaaaucaucaaccuuuuucggguaguccaaaaugaauuaaauucaaacccucugagccauccuuuacacuccauggugagcuuauuccaaucuuaauggccuuauauacagacuuuuuuuuuuuuccauaucccacauccaauucaucaggaugaauuagcuuugccuuacaaaucuuucuagaaucgcaccacuucuuacaaccuccacagcuucuagccuaagaguguucucucaucugucaccuggguugcuacugucuuccuaaccagccuccccacuuccacucuugcacacuucagucuguucucaacauaguagacaaagugauccucugaaaaguuaagucacaucaugugacuccuccucuccaaacccuguuguucacagaguccuuacaggggcccacagugccuaacaaccuagcccuguuaccucuuugaccucacuuuauacugaauuguuccucgaauuacaaugggguuauguccugauaaacccaccauaaauugaaaauaucauaaguugaaaaugggcugggcacaguggcucaugccuauaaucccagcacuuugagaguccaagguaugaggaucgcuugaggccaugaguuugagaccaacuugagcaacaaguugagaccccaucucuacaaaagagucaaaaaauuagccagggauggugaugcgccuguagugcuagcuacuuggaaagcugaaaugggaagauugcuugagucugggaggucaaggcugcagugagccaugaucacaccacugcacuccagccugggcaauaccaagacuuugucucaagaaaaaaaaaaauugaaaaugcauuuaguacaccuagcuuauuaaacaucauagcuuagccuaguguacauuaaaugugcucagaacacuuacauuagcccacaguugggcaaaauuaucuaacacaaaguauuuuauaauaaaguauugacuauuucauauacuuuauugaacacugagagugaaaaacagaauggucagccaggcgcgguggcucaugcuuguaaucccagcacuuugggaggccaggucgggcggaucacgaggucaggcgaucgagacuauccuggcuaauacagugaaaccccgucucuacuaaaaauacaaaaaauuagcugggcuugguggcggccgccuguaaucccagcugcucaagaggcugaggcaggagaauggcgugaacccaggaggcagagcuugcagugagccgagauugugccacugcacuccagccugggcaacagagccagacucugucucaaaaaaaaaaaaaagaauaacagaauggucauauggguacucaaaguaugguuucuacugacugcauaucgcuuuugcaccaugauaaaguaaaaaaaaaaaaaaaaaaaagucgaccauuguaggcuggggauuguacucuguccuuuuuuuuuuuuuuuuuuuugagacagaguuuugcucuuguugcccaggcuggagugcgauggugugaucucggcuuacuguaaccuccgcuugccagauucaagugauuuuucugccucagccuucagcuucccaaacugggauuacaggcaugcacuaccacgcccagcuaauuuuguauuuuuaguagagauagaguuuuuccauguuggucaggcuggucuucaacuccugaccucaggugaucugcccaccucaggugaucugcccgccucagccucccaaagugcugggauuacaggcgugagucauugcgccuggcugugcucuguccguuucuuugaugagaagggagauugucugcucaaaugucccagauagguuuuaggacuuuugcauuggcuguuuuccauacuugaaauguucuuuucccuguaugagggagcucccucauacauggcuaaaauggcugaugcccucuuaauuauccucucaguagccaacccuguuuaccugauucaaaaauagugccugcccaucgcaccccccacuacauauccccuuuauccuauuuuaaaaucucaucagagugcuuaccaccuauauacugcaugauuuacuuacuuuucaugucucacuccuccugccuccccagccuggcacuauagguacucaauaaacauuugaauuauuuacauugauucuguaugucuauacuacucacaaagaaauugucagcugggcgugguggcucacaccugugaucccagcacuuugggaagccaaggugcgcagaucaccugaccccaggagguugagaccagccugggcaacauagcaaaacuucgucucuacacaaaauacaaaaauuagcugggugcggugguguugaguuuauagucccagcuacuugggaggcugaaagggaaugauggcuugagcucgggaggucagggcuguagugagcugugauugcaccacuguacuccagacugggugacagauggaggcccugucucagaaaaaaaaaaaaaaaaaaaaaaaaagaaauugucuauuuuaaaauauauuuuaaggcuggaccugguagcucacaacuguaauccuagcacuuugggaggccgaggaggguggauugcuugagcucuggaguuugagaccagccuggguaacauggccaaacccugucucuacuaaaaguaccaaaaaaauuagcagggcuugguggugugugccuguagucccagcuucuuguggggcuaagacaggaggaugucuugaaccuggaagguugagacuccagugagcugggcugggcgcaguggcccaugccuauaaucccagcacuuugggaggccggggcgggaggaucacuugagaucaggaguuugagaccagccuggccaacauggugaagccccaucucuacuaaaaauacaaaaauuagucugggcacgguggcucacaccuguuuucccagcacuuugggaggccgaggcaggcagaucacuugaggucaggaguucgagaccagucuagccaaaauggcaaaacccugucucuacuaaaaauacaaaaauuagcagggcgugauggugcauuccuguaaccucagcuacucaggaggcugaggcaggagaaucacuugaaccugggaggcggagguugcagugagccgagcucgugccauugcacuccagccugggcaacagagugagacucugucucaaaaaaaaaaaaaaaaaaaaaaaaagaaaaaacaaaccaaaaauuagcugguuaugguggcgcaugccuguaauuccagcuacucaggaggcugaggcaggagaauugcuugaacucgggaggcggagguugcaaugagccgagaucacuccacugcauuccaucuugggcaacagagcgagacucugucucaaaaaaagagaccacaguggacugagauggcaccacugcacuccugggugacaaagugagacccugucucaaaaaauaaaaaaauuuauuuuauuauuauuauuuuaauuuuuuuuugagacucugucacucacucuaucacucaggcuggagugcaguggcaccaucucagcucacuacaaccucugucuccuggguucaagcgauucucaugccucagccucccaaguagcugguauuacagugugugccaccacaccuggcugauuuuuggauuuuuaguagagauggggcuucaccacguuggccaggcuggucucaaacuccugacguuagguaauccuccugccucagcuucccaaagggcugggauuacaggcgugagcuaccaugccuggccaaaaauauguauuuuaaauuguaccaacucaucuugacuuuuuauauuucaguuuuaaacauuugcauccaguuaggacucuuacauaauaaggaauuuagauaacuuuuuuccaucaaaauucaaauuacuuuaacccaaaauuaauuucuucccauauuuaauuuccuuuagguagaaauguuauucuagaaagcauuuuuguuuuuuucucacucuuuucuauucuguguguuugugcacaucaggauugacuuacuggaaacuagaggaaaaggauaugcaccacucuuugccugaaacuuuagagaagacguucauaucauugucuuccacagaugugucaccaaaccagguaauuuaaaaacacacgguggccgggcgcgguggcuuacgccuguaaucccagcgcuuugggaggccgaggugggcggaucaugaggucaggagaucaagaccauccuggcuaacacggugaaaccccgucucuacuaaaaauacaaaaaauuagcugggcgugguggcgggcgccuguagucccagcuacucgggaggcugaggcaagagaauggugugaacucaggaggcagagcuuauagugaggggagauugcgccacugcacuccagccugggugacagagcaagacuccaucucaaaaaaaaaaaaaaaaacaacaaaacaaaacacacacaccguggacugggcgugguggccuguaauccuguaaucucggcacuuugggaagcugaagugggcagaccaucugagguaaggaguucgagaccagccuggcuaacauggugaaaccccguuucuacuaaaaauacaaaaaaauuaaccagacuugguggcgugugccuguucaucccagcuauuugggaggcugaggcaggagaaucacuugaaccugggagguggagguugcacugaaccgagauugugccauugcacuccagcuugggcaacgagagugcaacuccaucucaaagaaaaaaaaaacuguguguguuuguguuuuacaauuguugcuaaguacuccaguauaaauuuuauuuuucaacuucuaaaauacuggaaaaagcaugggcuuuagaaucauacucacuuguuuucaaauucagucugucauuuuugccuuauguaaucuuagcaaugcuucuuaaaaguggaauuaaaggcugggugcuguggcucaagccuguaaucccagcacuuugguaggccaaggugggcagaucaccugagguugggaguucaagaccagccuggccaacaugguaaaaccccaucucuacuaaaaacccaaaaauuagcugggcgugguggcaugcacuuguaaucccagcugcucagguggcugaggcaggagaaucacuugaacccaggagguggagauugcagugagccaagauggugccacugcacuccagccugggugacagagcgagacuccgccucagcaaaaacaacaacagaaaaaaguggaauuaaaaauuccacuuuuaaaaaauucuggcuggcuugagcugggcaucauaguuuacaccuguaauccuuguacuuugggaggcugaggugagaggaucacuugagcccgggaggucacaccauugcacucuagccugugugacagagugagacccugucucaaaaagggaaaaaaaaaaugcugguuaguguuuugugaaauuaaauggauugugccuacuauuucauauguaguagguccucagcuauuaauuucuuccccuuuucccagaauugguguugauuuuucauuuguuacaccuccauucauuuucauuuguuaugcgauccauuuccaccauaguuaugagcaacuuaauuugcuguauucuuuuuuuuuuuuuuuuugagacaguuucacucugucgccagguuggagugcaguggugcgaucuuggcucacugcaaccucugccucccggguucaagugauuauccugccucagccucccgaguagcugggucuacaggcacaugccaccacgcccagcuaauuuuuguauuuuuaguagagacgggguuucaccauguuggucaggauggucucgaucucuugaccucgugauuugcuugccuuggccucccaagugcuggaauuacaggcaugcaccacugcgcccggccaauuugcuggauuuucuuugaguaagaaagguacauuuaaaaaaaaaauuuuuuuuuuuuuuuuuuuuugagacggagucucagucugucacuuaggcuggagugcagugguuccagguucaagugauucuccugccucagccuccugaguagcugggauuaugggcaugcgccaccaugccuggcuaauuuuuguauuuuuaguagagagggaguuucgugauguuggccaggcuggugauccacccacaucagccucccagagugcugggaauacaggcgugagccacugcgcuggcccauuuuuuuuaaauuuaagagcaaagaaauaaaacuauucaguaaauguacaucaauguaccuauuucaccucuguauuuuuuuuuuucuuuuuuuuuuuucuuugaggcggagucucgcucuguugcccaggcuggagugcaguggcgugaucucagcucacugcaaucucugccucccagguucaaaugauucucccaccucaaccuuccaaguagcugggauuacaggcaccugccaucaugcccagcuauguuuuguauuuguguagagacaggguuucaccauguuggccaggcugcucucgaacuccugaccucaggugauccgcccgccuuggccucccaaagugcuggaauuacaggcaugagcuagugcacccggccuucauuucuguauuuugaucagguaaugaaagaguaccuggggaaaaggagagauacuauuaaaguaaccaagagacauaaaaaugaaugacauauacagacagacagauggggcaauguacuuguaagcaucagagucucagugacggaaaccaauguuccguacuucaugaaaggaacaaaaagacacaggucaacacagagaaaugaaguaugagggggguaagauuguagggggcaaggcaggcuuaguaggcuuugcaauugcagggcucacaguguuaucugaucuugaacaucaguaaguggauacugcauuuuguugacucuacgguauugucaacuuuaagguuucccauuucauguucuaccaagaaaaauuuauaaauuagacugauacaaugcuuuuuuuuuuuuuuuuuuuuaaccacuuuagaauuuauauuuuauucuuauggaaagagucuuuagacuuaaacauagguuuuauuauguaucaguaacuuuuuuuuuuuuuuauuagagagaggauuuuugcuguguugccuaggcuggucucaaacuccugggcucaagugauuccccugcuuuggucucccacagugcugggauuacagcugugagucacugugccuggccuauuauauaacuuuuuuuuugagacggagucuugcucuguugccaggcuggagugcaguggugugaucucggcucacugcaaccuccaucuccuggguucaagcgauucuccugcuucagccuccugaguagcuaggacuacaggcaugcacuaccauacccagcuaauuuuuuuguguuuuuaguagagacgagguuccaccauguuggccaagauggucucgaucuccugaccuugugacccaccugccucagccucccaaagugcugggauuacaggugugagccacugugccuggcuuauuauauaacucuuaugcauacuuuaaaaaggaaaacauaagugaaauaaaaguggcuaaaauucuuuccuucucagaguguuauacucuucucuucucaucucuucucuucucuucuccucuccucuccucucuucucuucuccucuuccucucuuucucucuuucuuucuucacggucucacucuguugccgaggcuggaguauagcagcuucaucauagauaacugcagacucaaccuccugggcucaggcgauccucuugccucagccuccugaguagcugggacuacagucaugugcaaccacaccuggcucauuuuuuuuuuguuuguuuguuuuuaguagaggcaaggucucucuauguugcccaagcuggucucucaaacuccuggacucaagcaauccuccugccucagccucccaaagugcugggauuacaaaugugaaccacuaugccuggccauuucucucucuucaccuugguguuaguuucuguguuuucccacguuaucuuccucuagcccaccaagagcaucagcgauucugcauuucuuuaaaaagaauagaaaggccuuucugcuuuuuaccugucuuaguagcauguaggacuagcccgcuuuggacucccauguggaguauguugcuaaacgugucugauucaccguucucuuaaauauugguccucaggagcuucauuguaguguguagguuugucuuccaagcugcugauaccuauuuggccaauuuugagcucaugagcagggaaugacagucugucacaaccacaacuuggcccaaagcaauagcaauuauaaaaugccauuaauuacaagaggcaucccuacuuuagagauguuaacaugacaagaacauaaaaguggugaaaagugguacuuuucuauucccaugagcuuugaguagaauaaccccaacuauucccccagaccaccaggcuguggccauagcuggaguaaugcuacucuucacaggcuucaggucuugaaaaggcuucuuuagguuauuggcauguaaagaaugaauucuacagcaggauuaugggaauugugguacuuuuuuuuuuuugaggcagagucucgcucuguuucacaggcuggaaugcaguggugcgaucucagcucacugcauccuccgccuccuggguucaagcaguucuccugcuucagccucccaaguagcugggauuacaggcacgcaccaccacacccggcuaauuuuuguguuuuuaguagagaugggguuucaccauauuggccaggccggugucgaacuucugaccucaagugauccacccgccuuggccucccaaaguguugggauuacaggcgugagccaccacaguauauuuuaaagguuuagauuuaacaaauuaaugccuuuaaugcacacacucacaagguuuuaaaaauacauauucauggugcucugcagccuacguagggucuagaaaugggacacaaauuuaaagcuacaugauuaauguguucuuucaguguuuucaguguaucuauuguugaaucuguaaucucauuugugacaguguucacaguuuaaauuugaggcccaagguuaauugguucuccucucacacccuauaauacgucccaccuugaaauaauuuaagcccaaaguuuuaguguuuagagccuagaccucucugcaacauuuuuaguguagugagguccugauuucaauuuuucgaaauuaggguccuaucuucuguuuuuugagacagaguuuugcucugucgcccaggcuagagugaaggaguacaguggcaugaucccaacucacugcaaccucugccuccuggguucaagugaucgucccacuucagucuccugcguugcugggauuacaggccugcgccaccacucccagcuaauuuuuguauuuuuaguagagacaggguuucaccauauuagccaggcuggucucgaacucccgaccucaggcgauccgccugccuuggccucccaaagcgcugggauuacagguguaagccaccguguccagccuagggucauaucuucuuauuuuacuaaugaauaaagggacuuauuuucacuugaucuuagccaaaaggcugagaagugaugggugggggggacuuauuuucauugggucacuuugugacaccuaguuuuguuuggccaacucuuuuaacaaacaugauuguaacuacauagauaaggaacuccagcucuuggugcuuuuucuucagccauaugaaauuaauuuggccgaaaguuuucucauccuucuaucauucauucugaaguaucuuguuuucuuuuuuuuuuuuuuugagacggaguuucgcucuuguugcgcaggcuaaagugcaauggcgcaaucucggcucaccacaaccuccgccuuccagguucaagcgauucuccugccucagcuucccuuguagcugggauuacaggcaugcgccaccaugccuggcuaauuuuguauuuuuaguagagacaggguuucuccauguuggcuaggcuggucucaaacucucgacuucaagugaucacucaccuuggccucccgaagugcugggauuauaggcaugagccacugcgccuagccuaugaaguauuuucuuaccucaaaacuuggcuauuggcuaggcgugguggcucaugccuguaaucccagcacuuugggaagcuaaggugggaggauugcuugagcucaggaguuugagacuagccugggcaacauggugagacccugucucuacaaaaaaaaauagaaaaauuagcugggcguggucuugcacucguguagucccagcaacuugggagguugaggcaggaagaucacuuuagccugggagauugaggcugcagugaaccaugaucacaccacugcacuccagccugggcaacagggugagaccuugucucaaagaaacccagaaaacuugguucuuauuuugagugggagaacuacuaagaauuucauuauuuggaaguauucauaggcugcuaaauaauuaauguucacauuauccccuuaguguccuaaauuguuaggagauccaaacaucuuuccauucugagguagacucaucauacuagguaaugacuuccaagcuuguauuacaaaucugacagucuacauuuucaauuugcuuaaagucuuucaaaaaucuuuuuauggugcuuauuuugauaucauuaauuuguuucauuauugauaacaccauuuaauuuuguuucguaucuuuaagucuaauacuaguaaugagaugaagcuaccgucacugaaggauauuuauuauaaaaaacaaagggaaaacaagcaguuaccugagaggaaucucacuucugcuuccaacccaaaucauccaccagagguaaaguuguccacauucugccgagugaacgugaacaaugcuuccugacucuaacuuuuaccucaagcuucauuuucccuaggagaucuaaagccuacucacuucaaaacaagcaaaacaaagccgaguucugaggguaagacuucguuguugucugguuuccagguccugacucuagauccuacguuacacaugaagccaaagcagcagauuucagggauucaaccucacggccuuccgaaugcccuugaugacagaauauccuuuuccccggacucuguucuagagccuaguaugucuagucccucugacauagacucauuuucacaagcaaguaaugucacuucucaguuaccuggauuuccaaaauaucccucacacacaaaagcuucuccgguggacucuuggaaaaaucagacauuccaaaacgaaaguaggaccaguuccacguuuccgucaguauauaccauuacuaguaaugauaucucggucaacacuguagaugaagaaaacacugucaugguugcuucggccucagucagucagucccagcuuccagguacagccaacagugucccagaaugcauuucauugacuuccuuggaagauccugugauauugucuaaguauguauuucagugaauggcuuguaauguuaauagauuuucugugauaucugauugaaaaugaucuuuauugaacuucaguauugcauaaagucuuagagauuuagcauuuuuaagauggagcauauaaaaacuuuuucacuugauuguuaacuuuuuguguauuaaucuauauauuuuguaguaugcaaaggaaauaugcuauauuuuugcccaugagaaucauuguguucuugguuucucuugugggauggagacugaagauagcuuuccuaauauauauuuuuuauucucacugaauaaggauuaggcagaaucugaaggaaaagcaugcucgacacauagcagaucuucgagcuuauuaugaaucagaaauaaauaguuugaaacagaagcuggaggcaaaagaaaucucuggaguugaagauuggaagauaaccaaucaaauucuuguagacagguaaaauuuauaauuuagcugugaaguuuucuccaccuuggauguauuauuuucacagaaguauaaugugagaaaacacuuugaaaauacuuuggaucugaaauuuuaacagucauguuugccuaaguauuuuugaagcuaaaccccccucuuauaauacacuaauaacugacguggagccauuuguuucacaugggcaaaauacugaaacaguugagcgaauuuuguauaugcagaguaaugucauugaugggaggagcaguacuauggacuuucuaauaagucuauggcuuauguccuguggcaguucuucaccuuuuuaauaggcccauuccaaaaaaacccacaaagauaugcaggggagaauggccuuauauucaggauagcuucauaccuauuuuagaaucacuuagaaaaucugaugcuuucacuacuaguauuaguaguagaguccuugcaacauacuuuaccauuaaacgggacuugaucaggcaugguggcucacgucuguaacccagcacuuugggaggcuguggcaggcagaucucuugagcucaggaguucaagaccagccugggcaacauaguggaacccugucucuacaaaaaauuaaaacguuaguugggcaugguggcguguaccuguggucccacuuacuggggaggcugaggugagaggauugcuugagcucaggaggucgaggcugcagugaacuaagguuguaccacugcacuccagccugggugacagagcgacacccugucucuaaauaaauaaauaggacuuaaauagauugaaaaucgaugcaggucuagcugauagcaaggcauucucuaaggagaaaagacaaagcucacuucaaagagcuuaggagggaacuaaaaucuuccgucugguuaacaguuuaacuuucaaaaaaacaaaacaaaacaguuuaacuuucaaaguuaugggaaaacuagccuuuauacuguaaguaguuuugguugcugugguaguuaacauggcugucuuauugaauguuucuacagcuuucauuuugcauuuaguaguguggggguacaaugguagggaaaaguaauuugaaaaagagccaaaccaaaagaaaagagacagguuuagguuuuuuacgacacaaacaguagauagcagguuaugggaaguugguuuuuuuauuauuguuuuuguuuagaaggcaaagaugaggcugagugugguggcucacaccuguaaucccagcaguuugggaggccgaggcaggcagaucacuagagguuaggaguucaagaccagccuagacaacauauugaaacucugucucuacuaaauauacaaaaagcagcuggaugugguggugcgcaccuguagucccagauacucgggaggcugaggcaggagaaucacuugaacccgagaggcagagguuacagugagccgaaauugugucacugcacuccugcacuccagccugggcgacagagugagacucaguuucaaaaaaaaaaaaaaaaaugcaaagaugacuguaguuacuuccuguaggaaaacaaguaugaaagaagcccgccagugaacuuuugaagauuaaaaacaguccuaaagaagguaccuagaauaaauuauagccagucaaaacauuuuuaugacuagaagauguuugagcguguagggcaaugagcaaauauagguggagcaaauuggaagccaggguuuuaaguaaauggcuguauuauagcaguuaauaacaguggcaggcuugguuacuggaguagauguaaucacuguguaaaaugaauagcaguacauuauuuucuccucuucccaaaaaagauuugaucuggcuuaugguuaaaaaaaaaaaaagcuguguuacagaggacaguagaaacaaaauacguggcagucauuuagaacuggagaaaugauuucccccaagauaaaaaaccauuguuaucaguguauacacugguuuuuuccaaacuuaaaauugcaaauuggagaaucccccugguguuacaaauggagccauuagccagcugugauaucagauuacuaugucacggauuuagaacuugggacagugauccucuggcacauuagaauccauaguacugaaaaaagucaaauacaauuaacacacacuugauuauuugagugauuuuuuuucaagaauagucucaucaguauuucaugucugugccgcauuaaugcacagugguuaggaucaugaacuaggagugcccagcuuauguucccagugugacugcuuacaaucugugugacuuucagugaggaacugaacugucuuuguuuucucaacuguaaaaugggaucaaugauaaucuuuuuuucuuucuuucuuuuuuuuuuuuuuugagauggagucucugucgccuaggcuggaguacaguggugcugucucggcucacugcaagcuccgccucccagguucaugccauucuccugccucagccucccgaguagcugggacuacaggcgcccgccaccaugcccggcuaauuuuuuguauuuuaguagagacgggguuucaccguauuauccaggaugguuuagccaggauggucucgaucuccugaccuugugauccaccggccucggccucucaaagugcugggauuacaggcgugagccaccaugccuggcugggaccaaugauagucuuaauggacagaauugugaggauaaacgaaacgugcuuaaagaccugguguauagucagugcuaaauaaauaaagcuuuuauuauucauacuauguuaaacaccgagucaagaugguaacugaauucuucuauguauuuuguuauuuugaggaucugugauaauuaacuuuacaaaggaaguuaauuauaagaauaguuauauucgugcuaaauucgaaauaguacagaaggucauaauaugaaaaguaaauuggaucgcaugaguccaggaguuugagaccagccugggcaacaaagugagaucccaucucuacaaaaaaucaaauuagcugugugugguggugcauacucaggagguugaggcaggaggguugcuugaucccagaagguuaagucugcagugaaccgugauugcaccacuguacuucaaccuggguuauggagugagauccugucucaaaaaaagaaagaaaaaaguaaaucucccuaccccaaccucuagucccaaaucccaaauccaaauuuaauuuuuugcauuuuuccagaaaucauaaugcauauauauagauacagauuuuuuucaagcuaagaucaagcuauuuuaugcaugucuuuuuuuuauaucuuuuaaaaaaauuauuuuaggcuuuuuuuuuuuuuuuuuuuuuuuuugagacagguucucacucugucacucaggcuggagugcaguguugugaucucagcccgcugcaaccucagccucccagguucaagccacccucccaccucagccuccugaguagcugggacuacaggcacaugccaccaugcccagcuaauuuuuguauuuuuaguagagauaggguuucaccauguuggccaggcugaucuugaacuccuggccucaagugaucugccugccucagccucccaaaguguuaguauuacaggugugagccacugugccuggccaauuuuagccuuuucucuacauacuauauuauuagauucauugggcuauauucuauuaaaauggcauccugagucuuaguuaacacuggagaauuugucuuauguuauauauuagagaauugguuagauuuauguaauacuuuuaaggguaauaauuuuaucuucuaauugaagcuaaauuuaugguuuuuagauguggccaauuagauagugcuuugcaugaagcuacuagucgcgugagaacacuugaaaauaagaauaacuuacuggaaauugaagugguaaguacucuuuuuuugguggguguucuggugagacaaaugaauuauuucgugauaacaucaguuauguuucuugucuuuuuaaggaaggcuuaugaaguuuauauuuuuagugcuguuggcuucauauaaugcuauaaacuuuacccuuuuuuuuuuuuuugagacggagucucgcucuguugcccaggcuggagugcaguggcgcggucuuggcucacugcaagcuccgccucccggguucacgccauucuccugccucagccuccugaguagcugggacuacaggcgcccuccaccacgcccagcuaauuuuuuguauuuuuuaguagagacgggguuucaccguguuagccaggauggucucgaucuccugaccuugugauccuccugccucggccucccaaagugcugggauuacaggcgugagccacugcacccuuuuuuuuuuuuuuucuuuuuuuugagauggagucucgcucugucgcccaggcuguagugcaguugcgcgaucucagcucacugcaaccuucgccucccagguucaggcgauucuccugccucagccucccuaguagcugggacuacaggugcaugccaccgugcccagcuaauuuuuguguuuuuacuagagaugggguuucaccaugggggucaggcugguuuguaaugccugaccucgugauccacccaccucggccucccagagugccgggauuacaggugugagccaccgcaccuggccuaaacuuuacccuuuuaaaacuuaccuuuuggccaggugugguggcucaugucaguaauccuagcacuuugggaggcugaggugggagaguugcuugagcccaggaguucgagaccagccuggguaacauacagagaccucugucucuacaaauuagcugggcaugguggugcacagcuguggucccagcuacucgggagacugaggcaggaggaugacuugaucccaggaaguugaggcugcagggaucaugauugcgccacagcacuguagccugggcaagagagcaugacccugucucaaaaaaaaauuuuuuuuuaauuuuuugcaauauaauuugcauaccauaaaacuuacccuuuuaaaguguacaauuccaugaauuuuaguauauuuagaguugggcaaccaccaccacaaucaauuuuaggacauuuuccucaaaaaaaaaaaaaaaaaaaaaaaaaaaacccacaccccuuaaccgucaccccccacauucuguccuuccacacccuggcaaccacuacucaguuuucuuucucugugcauuugccuuuucugaacauugauauaaaugaaauccuagacuguguggccuuucgugucuggcuucuucacuuaguauaauauuuucaagguuuauccauguuguaacauaucaguauucauuccuguuuauggcugaauauauuucauucugugaauaauaccacauuuuuguuuacauucaucagguaauguuuauauacuuucuggcuauuuaaauuauauugcuaugaauguuugucuacaagauuuuaugugccacguaaguuuuuaguuuccuuggguauauaacuaaaagugcauaaacuuuuuaugcuaaaauuacuuuuuuccccacgcauuaccaaauuuuauuuuuuuacagguaacuuuuuuucuuucugaacaaagaccuuuguuaugucauucccaaucuuuugguauaaggcaaucuuuuuaagggucaaaaguuucucaaagucuguguuuacaaguuuuauuuuuaauaucuauuagacgauaaaaugcaugauagcuaucauagaguaguguguauauguaugagauacauauggccuuaugaacaaaauuuugguggaaacugucuauuuuguuuuuuuguugagauggagucucgcccuuguugcccaggcuggagugcaauggugcgaucuuggcucacugcaaccuccaucucccugguucaagggauucuccugccucagccuccugaauagcugggauuacaggugcccaccaccaagcccggcuaauuuuuguauuuuuaguagagaugggauuucacuauguuggccaggcuggucucgaacuccugaccucaggugaucugcccgcuucggccucccaaagugcugggguuacuggcacccagcguauuuuguuuuauauguuguuuucaucuuugccuuuuuuuuuuuugagacagggucucacuccaucgcccaggcuagagugcuguggagccgucauggcuuacugcagucucaaccucuugggcugaagugcuccucccaucucagccuccugaguaguugagacuauaggcacacaccaccacacccagcugauuuuuaaaauuuuuuguugagacacgcuaugucgcccaggcuggucuuaaacuccugggcucuagcaguccucccaaagugcugggauuuccgcugugagccacagugccuggccuguuugcuuuuuuaguuccucuccuccuaagcuucaugacauucgggacuauuaucuuuuuuguuaaucuuacauuucuagcacccuagugccuagcaccuaguggguauuccagaaaugauuguugagugaauauuaacauaucagauggguuuuuaauuuccuguauuuucuuuuuuuuuuuugagacagagucucacucugucaccagggcuggagugcaguggcaugaucucggcucguugccaccuccgccuccuggguucaagugauucuccugccucagccuccugaguagcugggauuacaggcgccugccauuaagcccagcuaauuuuuuguauuuuuaguagagacgggguuucaccauguuggccaggcugcucuugaacuccugaccucgugauucaccugccucggccucccaaagugcugggauuacaggcgugagcuacugugccuggccaacugaauuuccuguauuuucauagugagaggguaugaaauguuuuucuccucccuaaauguugauguugggcaacaaaguccagcuauacuuucaaauaauuucccuaauagcagugguuauuuuuuccuuauuaaagugaacuguaggagcuauuaggugaguccuagagucauagugccacagaugauaguuuccuguauaccuuaugauaaugucaggggcugguauuccaguagaacuauucuuucuggacucuccaucccagaauacaacaaaauagauuuguucauuuccauuucuauguuuuguucauuuuuuaaugcccacaauuuauuagcuauuauuaaggcaucuuuuuuuuucauuuaaaauaaauuuugggcugggcgugguagcucaugccuguaaucccagcacuuugggaggccgaggccuguggauuacuugaggucaggaguuugagaccagccuggccaacauagugaaacccugucucuacuaaaaauacaaaaaauuagccaggggugauggugggcgccuguaaucgcagcucucgggaggcugaggcaggagaauugcuugaaccugggaggcagagguugcaguaggccaagauugcgccauuguacuccagcuugggcaacagagcgagacuccaucucaaaaaaaaaaaaaaauuauguuugucuuuguuuuauagaaugauuugagagaacgcuucagugcagccagcagugcuuccaaaauuuugcaggaacgaauugaagaaaugagaacaagcaguaaagaaaaagacaauaccaucauucgacuaaaaucuagacugcaagauuuagaagaagcauuugagaaugcuuacaaacucucagaugauaaagaagcucaacuaaaacaagagaacaaaauguuucaagauguaaguagcgaauaauaguaacuuaaugacgugauuggcuaaaaguaauuuagguauuauacucuuacaagugauuaugacuuucuaggcuuauuuuauuauuuauugauuuauuuugagacagagucucacucugacacccaggcuggagugcaguggcaggagcucaacucacugcagccuccaccucccgggcucaagagaucuucucgccucagccucccaaguagcuggaauuacaggagcccaccacugcgcccggcuaauuuuuguauuguuaguaaagacaggguuuccccauguuggccuggcuggucucgaacuccugaccucaggugauccgcccgccucagccucccaaaguccugggauuacagguaucagccacuauguccggccuuuauuuuaguuuuacauaacuuugcagcaacugugaauauguaccuuccugauggagucaauugggucuugcuuugcagcacgaagucagauacuuagaacgauggcaucacucccauaucuuuucuguuucuagcaggucaacuuaaaaaaaaaaaaaaaacugugucugcaucaggucaacuuucaagcuaucuuaacauuugugugucuggcaggauaaaaugcuaugaacagauuuagagcaaguuugauuaaauuuuuucacuuugauauaauuucacuuaaaauuuggauuuguauaacauugaaaccagauuagguuucagguugcuuauuuuuuucuaaauuuuucuuucuuuuuguucuuagaaacagggucucgccauguugcccaggcuggccucaagcucuugggcucaagcauucuccuuucagccuucugaguagcugggucuacacgugugugccacugcaccuggcuucuaaauuuuucuuaacaucguuuuucaggauauuacaauacaugaguaaucugaaaguauuuaggcuguugaaauuuucugauugcuuuagauuugcaucucaugaaaaacagcagucuucccuaccuaccuuuuaguauccuacccuagaggcuguuacuuucagcucuuuuagcuauuucuucuagcauuuuccuccauguuuacaaauaauauucuuauauugcacucucauuuuuuuuuccaucuauuucagacauacugacuuucucccaugcagggucacaguguggcuuucuuacaccauuugcugcaacacagacacuucuccugcuccuucccaugugguucguguguguguguguguguguguguguguguguguguguguguauauauauauauuuuuuuuuuuuuuuuuuuuuuuuuugaaagacaaucccucucugucgcccaggcuggagugcaguggcgugauuuuggcucacuacaaacucugccucccagguucaagcaauucuccugccucagccuccugaguagcugggaguacaggcgcgugccaccagcuaauuuuuguauuuuuaguagagaugugauuucaccaugcuggccaggcuggucucgauuucuugaccucuugauccgcccaccugagugcgggauuacaggccugaagcaguauuuuuuucuuuuaguaauuuguaaaauaauggugugauauauaaucaauggugucuuaaaauggaaauuauacaucauuuauuacagcuguauaaauauuguucacaguuaagcuauggugguauacuguaauuacauauuacauuuccuuuucucucuguuuuuuuuuuuuuuuuuuuuuuuuuuuuugagacggugucucacucuguugcccaggcuggagugcaguggugcgaucacagcuuacugaagccucaaccuccgcgggcucaggugauucuuccaccuuggcuuccaaaguugcuaggaccauaggcacaugccacuaugcccugacaauuauuuaacuuuuuuuuuuuuuuuugagauggagucuugcuugguugcccacgcuggagugcaguggcaugaucuugacucacugcaaccucugccucccggguucaagugaugcuucugccucagccuccugaguagcugggauuacaggugcacgccaccacacuuggcuaauuuuuguaucauugguagagacaggguuucgccauguugcccaggcuggucucaaacuccugggcucaagcguuccuccugccucagccucucaaagugcagggauuacagggauuacaggcaugugccacugcacccagccuuuuucucauuaagcuuuuaccuccuaguuuuagcuuccauugaggagucuugccugaaagaagcauguacugugguguguuuuucuaauucuguauuccuucugcauuugacugaaaggagcuucccucuuuccuugacuuauuuauuauuugccuuuagagacagguccuugcccuguugcccagccuggaguaagcaauccuucugccuuagccuccugaguagcuaggauacuacuacuaaagugcauguccuuucuuuguuauaucaguaaagaagauugauggauucuuauuuuacucaguggauugcgguucuuuaccaugauuauuuugauacucauggugucccaaguuuggccagugggagacaugucagacuggucccguguccuuuugacuugcuuuugucauucuuugagcauguccauauuuccuggcacagcacuauguuccaggcucaucuuguacuuuuccaagcuccaguccuagaaucagucucauuuuuucuguugaguucugguuccuuuucauggaaaaugguauucagacauuaagaucuggugcuaggcugagugugauggcucaugccugugaucccagcacuuugggcagccgaggcgggcagaucaccugaggucagcaguucgagaccagccuggccaacacgguaaaacccuugccucuauuaaaaauaaaaaacauuagcuaggcguggugaugcacgccuguaguccaagcuacucagggugcugaggcaggagaaucacuugaacugguacugaguauguucauugcuacugggaugucauuguuucuuuuucuuuuucuuuauuuuuggagacgaaguuucauucuuguugcccaggcuggagugcaauggugcaaucucagcucaccacaaccuccgccucucagguucaagugauucuccugccucagccucuugaguagcugggauuucaggcaugugccaccaugcccggcuaauuuuguauuuuugauagagaugggguuucuccauguuggucaggcuggucucgaacucccgaccucaagugauccaccugccucagccucccaaagugcugagaugacaggcaugagccaccgcgccuggccugggauguuauuguuucuaauuauucacaaacccaccacaguuauguuugagcagcaaucaagcagcaaaggauagcuagaauguguuguuuuuagcugaaauuguauuaauguagacagugauacacugacuuugcauuuaucauauacaacauuucaagcauacagaaaaguauagagaguaauauaacaaauaccguucuagccuucucuagauagagugaaacacugucuucuauuccucucuuccccacccuagagguacucacuuuguuaaaugugcucuguuauccucaugcaguucuuuuugcuuuuacuacauaugccuguguuuguaaacaauauuuaguaauguuuuauguguucuuaagcaauguaugaauuguauugcauugcauauauccugcugcaaccugguuuuucccuuucaacauuguuucugagauuugccauguugacacauucagcuuuuauugauucauuuuaauuuaaacauuuacauuugaaauaucuuagguacauaaaaagauauagagaauaauauaauguacauaugaauccaccaccuauuuuaagaaauaaaauacuccggccgggugugguggcuugcaccuguaaucccaguacuuugggaggccaaggcagguggaucagagucaggagaucaagaccauccuggcuaacacguugaaaccccgucucuacuaaaaauacaaaaaauuaguugggcgugguggugggcgccuguagucccagcuacucgggaggcugaggcaggagaaugguguaaacccaggaggcggagcuuucagugagcugagguagcgccacugcacuccagccugggcgacagagcgagacuccaucucaaaaaaaaaaaaaagagaaauaaaauacuacaaaaugcaguugacauccccugugcacccuuuucugaucacuucugucuuccugggaguaacugaucuaaauugugugaauaucauuaccuugucuuuguauggucacauguguauguauguauccuuaguguuacuucuuuggcguaucuugaaacuuuuauaaauacuaucaauacuuauuuuuguuuuuguuuuuuuuuuugagauggagucucgcuccauugcccaggcuggagugcaguggcaccaucucggcucacugcaagcuccgccucccggguuugugccauucuccugccucagccucccuaguagcugggacuacaggugcccgccaccacaccuggcugauuuuuuugguauuuuuaguagagacgggguuucaccguguuagccaggauggucucgaucuccugaccucgugauccgcccgccucggccucccaaagugcugggauuacaggggugagccaccgugcccggccuuaauacugucuuuaauguuaugcaacuuuuuucacuugugagauucaccuaacuggauacauguaguaguagcacaacuucauuucuguuuauuccugugucguccaucauguggcucuuccauaguauauuuauccacuuuccuuuugccaguuugucauugcuguuaggagcaaugcuacuaugaacauuucuucuauguggcuccuuaugccaaugugugcaagcgccucuaggguauuguucuagcugccauagcuccaaaacucauaaccucaaaucuugacauauucuguucguggacucuguuguucaggagcuugcacugggcccagcagggacagccugucugcucugcagugucuaggaccucagcucaaaacuuaaggacugggagcuggaaucuucugaagggcauguuccaucaugaaugguggcugucagcuaaggccacaguuccucucuaugugguuagguuggguuucuuugcaacaugauggcuuacuacuaaggacaagaguccugaaagagcaucccaacagcuacauuuacauugccuuuuaugaccuugccuuggaaacuguacagcaucacuuguaccacauucuauuuuuuugagacagagucuugcucugucauucaagcuggaguguaguggcaugauuauagcuuacuggagccuugaaguucugggcucaagugaucuuccugccucagcccucugaguagcuaggacuauaggcauacgccaccacaccuggcuaauuauuuauuuuuauguuuacucuuuauuuuauuuuuuugagaaggaguuuugcuuuuguugcccaggcaggagugcaguggcgcuaucucggcucacugcaaccucugccucccagguucaagcgauuccccugccuuagccuaccauguagcugggaguacaggugugcaccaccaugccuggcuaauuuuuuguauuuuaguagagauggguuuucacaguuuuugccaggguggucucgaucuccugaccucaggugauccgcccaccucagccucccaaagugcugggauuacaggcgugagccaccgugccuggccucuauucuauuuuuuaaacaauuccaaaguccugcauagguucaaggggagggaaaauggauaccaucucuuaauggaacacagcaagguucugcaagagcuuaugggucuggaaauauugcuguggcuguuacugggaaauauagccuguuauaauagucucuuucucugaaugcagugguugggacauagaauaugagcuuuguuaucuuuuuuagauauugcuaaauugcucucugaaaugguuguaccaguuuauuuuccugccaguaguguaugauaauucuuauuuuucuagauuauuuccagugcuugguauugucaagccuuuuaauuuuucaagugugauuaagaggaaaugguuauacguauugcauccaucuucuuuugguauuuuuaugggauacaaguuuuggguguuuuuuguuuguuuguuuuugagauggagucuugcucuuguuguacaggcuggagugcaauggcgcaaucuugguucacugcaaccucugccucccggcuucaagcaaucucuugccucaaccuccugaauagcugggauuacaggcacccaccaccaugccucacuaauucuuuuuguauuuuuacuagagacaguuucaccauguuggccaggcuggucuugaacuccugaacucaggugauucacccgccucagucuaccaaaguguugggauuacaggugcgagccacggcgcccagcccagaauuaccucuuacguaauauaugguaugaguaggaauugaacuugauccucccugccuccaaugauuaaccaguugucccagaaucauuuuuaaauagauuuuccuucccuuacugacuucuguuguacauuuuauuuccuucucguguaaaucuccuuugaggcucugagcuguuccauuggucugucucugaauuggaaccacaucauguaaauuauuaguauuuuauaacaaguguugauuuuuggugccauuuccuuaucucguuuuuuugcucuuguaaaaauuauuuugccuauuucuuggcuuuguuuuguuucauacaaauauuacugucagcaugccacucugcuuucgauuggaauugcacugaauuuacagauuuauuuggagacagcugagacuugaaauauugauucuucccauacaugaacgugguuuaaaucucaaguauuuuucuuuuuuaaaaauuaaggccuuuuacauccuuuguucauuuuuuucucgagguauaucauauucuaguauuuauguauuucuaaauaauguacugauauuguucguucguucuuuuuuuuugagacagaguuucgcuuuuauugcccaagcuggagugcaauggcgcaaucuuggcuacugcggccucugccuccuggguucaagugauucuccuaccucagccuaccaaguagcugggauuauaggcgagcaccacaacacccggcuaguuuuuuguauuuuugguagaaacaggguuucaccauguuagccauggcuggucucggacuccugaccucaggugaucugcccgccucagccucccaaggugcugggauuacaggcgagagccacugcgccuggccucuuucuuuccuuuuugagauggaaucuuguucugucgcccaggcuggagugcaguggcaugaucuuggcucacugcaaccuccacuuccuggguucaaacaauucucuugccucagccuccugaguagcugggguuacaggcgcgugccaccaugccuagcuaauuuuugcauuuuuaguagagaugagauuucaccauauuggccaggcugaccucgaaauccugaccucaagugauccacuugccucagccucaugaaaggcugggauuacaggaaugagccccuguggcuggcucgauauuguuauuucuuaaauuuuacauauuaucuauaauuguggugggugaagaucuagguccuagcugaagaugaagaucuagauccuaacugugauucuggguguauguuuucuucagauuugaaggcuuuguuuuauugccuaugacaugaucaauucuuuuccuuucucuccccucccauggcuuucaaaguuucaagccugcagaaaaauuguaagaaugauacaaugaaaacccuuguauauucuuuaccuagauuuaccaguugugaguaucuuacagcauugcuuugucuucauagagauauaaacuuuuuucuuuugcugaacuauauuugagaguaaauuagacacuaugauaauuuacccuuaaauaccucaauagguaucucugaagaacagagauauucuccuguguaaucucuuuuuuuuuuuuuuuuuuuuuuuugagacggaguuuugcucuuauugcccaggcuggagugcaauggcacgaucucagcucaccacaaccuccgccucccggguucaagcaaugcucccgccucagccucccaaguagcugagauuacaggcgcacaccaccccaugcccagcuaauuuuuguauuuuuaguagaaacgggguuucaccauguuggucaggcuggucucgaacuccugaccucgugauccacccgccucggccucccaaagugcuaaggauuacaggcuugagccaccaugcccggccucuccuguguaaucucaauguacuuuucauccucaggaaauuuaacauugauauaauacuaauauguaaauacauucugucuauauucaaauguugccaguugucuaaauaauauccuuuauagauguauuguuuuuugcuuuuuaauccagaauccaaucaaggaucacacauugcauuuauuguuaucauuucuuugagacaggaucucacucugucacccaggcuggaguacaguaggcauauucauagcucacugcagccucaaccuccagggcucaagugauccucuuaccucagccucuccgacugcugagacuacagacacuacaggcuaucacaccuggcuaauuuuauuuuuuuguagagaugcggucucacuauguugcucuugcuggucuccaacuccugagcucaagcgauacucccacacuggccucccaaagugcugggauuacaggcaugagccaaugugccuggcccacauugcauuuaguaaucauguuucucauuccuuucuaaugugguucuuuuuuucucuuucuggaaguuuuuuaggaucaucuuuuuauccuugguaugccgaaauuuuguaacaauauuuuuuuuuuuuuuaguuucuaacaacucuuuuucugauugaucauuuuuaauagcuuucuauuccuguuuugaaucuaauguuguuauuucuuugagaauauuauggcuuccauuggacuguuucuguaguuuucauuauucugaguuaagcuuuuguuuucauuugaaguaucuuucauauuuaaugucuuuuuccaaguguugguucuuuugcaggcucacauuuaagaggcacuaggcugggugugguggcucacgccuauaaucucagugcuuugggaggcugagacggguggaucacuugaggccaggaauuugagaccagccuggccaacauggugaaacccugucucuacuaaaacuacaaaaauuagcugggugugauggugcacaucuauaaucccagcuacucgggaggcagaagcaugagaauugcuugaacccaagaaguggagauugcagugaguugagaucacaccacugcacaccagccugggugacagagugagacucugucucaaaagauaaaaauuaaauuaaauaggccgggcacgguggcucaugccuguaaucccagcacuuugggaggccgaggcggguagaucacaaggucaggagauggagaccguccuugcuaacauggugaaaccccgucucuacuaaaaauacaaaaaaauuagcugggcgugguagcggaugccuguagucccagcuacucaggggacugaggcaggagaauggcgugaacccgggaggcggagcuugcagugaguagagaucacgcuacugcacuccagccugggcgacagagcaagacuccaucucaagaaaaaaaaaaaaaauuaaauuaaagcgaagcaguauaaaaagcuauugaaagacucuuaaguguauggaugggacuuaguuccugguagccuucauuuucaggcgauuguagagucaugcaccagccauuuuguuaggggaccuccagaugugaauguuuagaagguuuuuuuucugggguuguucaguuuucguaaagacaggucuuacagucucuugccugggaccuaucagucagauucuggcaguggaggagggggaggucaccuuuuuucaaaagaaaauuauuuguuaauauauuuauuuuagagacaggucucaccuugucaccgagacuggagugcaguggugugaucauagcucacugcaucuucaaaccccugggcucgaggaaucuuccugccucagccuccccaguagcugggacuacaggcacaugccaccagaccuggcuaauuuuuaaauuuuuuguagagauggggucuugcuauauugcgcaggcuggucuccaacuccugggcucaaguaaucuuccucggccucucaaagugcuaugauuauaggugugaccugcccuggguguuuuugaagucuuuuacuuugucauuuucucuuuauccucugccucccacuccacuauuauccuuggauuuccaaaguuccauuuuucuccccauucauuuucuccugcuguccugccaccuggcugaacagucuacugcuguaugggauguguccugggcucugauuacuuaaggaauuucaaccaguuuucuguggucagcccugugccucaacccuguccaucucuaaaccuggguuucaaggugggcaucucucacaguuaugcugacaucagccugcuuuucaucagcauuucuggauucaggcacuugggguuguauccacuuccacccugcuaaggcacuuuuuuccuuuuucuuuuuuuuuuuuuuuuuuuuuuugagacagagucuugcucugucaccuuggcuggggugcaguggcaccaucucgguucacugcaaccucugccuuccaaguucaagcaauuuuccugccucagccuccugaguagcugggacuacaggcacgugccaccacaccugacuaauuuuuguauuuuuaguagagacgggguuucgcuauguuagccaggcuggucuugaacuccugaccucagaugauccaccugccucggccucccaaagugcugagauuacaggugugagcuaccacgcccggccagcacuuuguuucuuuucaauuuucuaagacuuuauugaaaucucucaccuguuacugucaccucguuuguuuucucuuuaauuucuucauuguuaguuuaguggacucugagggugaagagaagaaaauucuguuauuaauuugucaucuuuaaccagaaaucucacauauguguucuuauauuuauuuauuuuuauuuuuuaaaauauuuuugguagagacggaguuuuaccauauuggccaggcuggucuugaacuccugaccucaagugauccaccugccucagccucccaaagugcugggauuacaggcgucagcuaccacgcccggccucuuauuuauuuauuuuugagacaagaugucacucugucacccaggcuggagugcgguggugcccucucagcucacuacaaccuacgccuccuggguucaagcaguucucccaccucagccacccaaguaggcaggauuacaggcacgcgccaccacacccagcuaauuuuuuuguauuuuuaguagagacaagguuucgcuauguuggccaggcuggucucgaacuccugaccucaagugauccacccaccuuggccucccacagugcugggauuacaggcaugagccaccaugcccagccucacauauauauauuuuuaaauaaagacuuuggcauugugcuuuuacuagguagaacuaauuuagcaaaaaguaauauacaauaggccaggcgugguggcucaagccuguaaucccagcacuuuggcaggccaaggcauguggaucacuugaggucaggaguuugagacaagccuggccaacaugaugagacgccaucuaauacaaaaauuagcugagcaugguggcauacgccuguaaucccagcuacuugggaagcugaggugggagaauugcuugaacccaggaggcaaaguuugcagugagcugagaacacgccacugcacuucaaccuaggugauggagcaagacuccaucaaaaaaaaaaaacaaaaaaaaaaacacaaaaaaaacaccgggcaugauggcucacgccuguaauccuagcacuuugggaggcugaggcgggcggaucaugaggucaagagaucaagaccauccuggccaacauggugaaaccccgucuuuacuaaaaauacaaaaauuagccgggcaugguggcgugcgccuguagucccagcuacucgggaggcugaggcaggagaauugcuugaacccgggaggcagagguugcagugagccacuguacuccagccuggcgacagagcgacuccaucuaaagaaaaaaaaaaaaaguaauaguuccaaaaagagcaaugcaaauuuuagucuuuuaaaauacuuacaugguauugauauuuuauuuugagacagggucucgcucuguggcccaggcuagagugcaguggugcaaucucacugcaagccucacuacaagcucacugcagucucaaccucccaggcucaagugagccuccugagucuguaagcauauauccccauguucagcuauuuuuuuuuaagacggggucucucuuugucccccagguuagaguacaguggcacgaucauagcacacuguagccuugaacucuugagcuuucaggcucaagcaauacuuccaccucagccucccaaagugcuaggauuacaggcgugagccaccgagcccagcuuuuguuuuuuuuuuguuuuuguuuuuguuuuugaagagacgaggucucgcucuguucccuagguuggucuccagcuccuagccucaagugauccucuguccucagccucccaaaguguugagauuaugggugugagccaccgcauccagcuuuauuuugaaauaauaucaaauguacagaaaccauuccagaaauugagaauugucccauucccuuuacauugaaucaccaguucucuauugaccuuucucuuucaugacauuggcauuuuugaaggcuauaggcaguuauuuuguagacuguaccucaguugauagaauaacguuuaauuuugugguauaauuuuuuuuuguuuuuccuuguagcuuuuaggagaguaugagucccuuggaaaagaacacaggagaguaaagguaagggguaaugguucauguucuagauuucaugcagaggcagaaacauuggauugggaaucaagggaucugacucuucuccuccuugcaccccuuccugaaccuccguagcuguugaacuggaaccuugcuuauccuguuucaguauccuuauuuucaaauaccugccccauuuaacucacaaguuuguuagauucauuaaucugacaaauauuuauugaauggcuauugcauuugaaaugaaauuguucaaaagaguauaagguaccauacagaugcaaauuauuauuuaauacuguuuguuuugugacacccagguuggagugcaguggugugaucucggcucaccacaaccucugccuccuggguucaagcgauucuucugccuuagccuccugaguagcugggauuacaggugugcgccaccaugcccagcuaauuuuuauauuuuuaguagagacaggauuucaccauguuggccaggcuggucuccaguuccugaccucaagugguccaccugugucagccucccugagugcugggauuaugggcaugagccacugcacccagccauuuaauacugauuaaauaucaagcuuugauuuucacugcauuagcuuuugguaggguugaguuuaucaauuauguuugaauucuuuuugaaagcucuguuuggagacuacauauuugcauucaguaaaacccuucgacgaugguguaaguggggcccaaguauuucuguugcauagaauggaggguugugguuauugaagcucagcaaaaaggccugcauagcuuggcugccaaagcauucugaggguucgggagcagaucccaugauaucuaaaucucauugaaaauauuuguuuuaccauccuucugagguuuuagucaaguuauuuuaacacugauuuguuucuaauuaagcaaaguauaaagggcuguaucuguuacccaggggacuuacacagagggacuuguguaggccggugcuuugcucucauuuguuuuccuugaacuguugguccuggcuguaugguugaugccauacuugcugaguaugguuuguagcuaguugguuuagccuuagauucauuuucuuuuaugcauuuuaaaauaauucaugugaauauuugucuucaguuaucugaauuucuccuuuauuuccauaggaugcauuaaauacaacugagaacaaauugcuugaugcauauacucagauuucugauuugaaaagguaaaauguauuaacuuacuaauguacacauaccucaauuguucuuuuaugugucuguauugaacaugaugagaaggaaguuuuucuugaggauuuuuaagcaguuugagaacuaguuuugucuuaauuuucccuugacauggaaauagguuucauuuuagccaaacaagauuucuucucucucucucucuuuuuuuuuuuuuuuuuuuaaagagacagggucucacuauguugccuagauuggcugugaauuccugggcucaagcagucuuccugccuuggcuuccugaauaguugggacuacaggcacucaucaucaugccuggcugauuuuuuguuguuguuguuguugauacagagucuuacucugucacgcaggcuggagugcaguggcacaaucuuggcucacugcaaccuccuccucuuggguucaagcaauucuccugccucagccucccgaguagcugggacuacaggaguguaccaccacacccagcuaauuuuuuguauuuuugauagagacaggguuucgccauguuggccagacuggucuugaacuccugaccucaagugauccgccugccucggcuugccaaggugcugggauucaggcauaagccacggagcccggcaagccuggcugauuuuuaaaaacuuuuuuuagaaguaagaucuugcuguguugcccugacuggucucagaucucucgaccucaagugauccucucgucucauccacaaaaagugcugggauuacaggcaugcgcuacugcaccuggcuucaaacaacauguuuuaaguaauuaaaauguacugaugguugugccucagagguggauauuuucccaaacauuauguauuuucucagcauagguuaaaauccaaaugauauuuaaccacuggcaagaacuuuaagaagcagccuaguucacagaauuauuuuggugcuucaaaaagaaaacagcauuaacaccaaaauuauggucaucuacuuucagaaagaccgguuggagacuguauuaaugaucugauuuguuuaauuagguagggacagaaucguaaaugguaguauccauugcaaaugauuagaaauauccaaacugggcugggugcaguggcucacgccuauaaucucagcacuuugggaggcugaggugggaagauuaccugaggucaggaguucaagaccagccuggcuaacauggcaaaacccugucucuacuaaaaauacaaaaauuagcugggcaugguggugcacaccuguaaucccugcuacucaggagggugaggcaggagaaucgcuugaacucuggagacggagguugcagugagccaagaucacgccacugcacuccagccugggugacagagcaagacucuccccuccccaccaaaaaaaugaaagauagaaaagagaaauauuuaaacuaguucaagagcaaauuuuauguuuguauuuggauauaaguaacgucccuuauuuagacauuuuacugcagucuuaaggaguucucauagagaagaacagaaaugcugucuagguuucucaucugccacucuucugugauucauucaguucuagugauagcuuucuuaucagauuguuauaaaacaucagucuuguuagggcuauuauuucucaaaucuuccuugcaucaaaguagguaagaauucgaguuugaaagauaagaugaagucauacacagagcuuaaaagaacaagccaggcauggcgguaugcaccaguacucccagcugcuugggagacugaggcaggagcaucucuuaagcacagggguuugaggcugcagcaagcaaugaucaugccagugcacuccagccugggugaccgagcgagaccucaucucuuaaaggggggaaaaaagaacagcaugaaugccaggauaucuuuaaaauagucaguuggccagaguaguuauuuccuguugguaaacuugaaaauaggcuuuuauuuugaacauggcacaaaucagaugaaauaccuauagguuguuugcaauauuuuagccuuggccucuuuuuaaaaauuagaaagguuuuuuuuuuuuuuugaaauuuuuuugguaaaaguucuguuuuuggaaguuaagccugcuuccuuguuugugaaaguguuaccuauuguaugcaugguuauauacauauuaggauuaaacacauuagaaugcaguuuauuugacaauuuuauguuuauuuauaaauguuauguuuugaucuguagucaaauuuauauaacuugcgauauuaaguccauuuguucccuuuuuauucaguuguaugggaaauguuccuuuguagaguuuuaauguauuuguuuuucuguuuuucuauuuauauucacugauuuuuguuuagcuuuuauuuuuuuuuugagacaaagucuugcucuguugcccaggcuggaguaaaguggugugauaacggcucacugcaaccuccgccucccggguucaagccgauucuccugccucagucucccaaguagcugggauuacaggcgcaugccaccacaccuggcugauuuuuguauuuuuaguagagauggggguuucaccaugcuggccaggcugggcucgaacuccugacaucagaugguccacccaccucggccucccaaagugcugggauuacaggcgugagccacugcaccuggcuuauuuagcuuuuuaaauaauggugauguuuuacuaugaaaaauguuuauggacuugcaacucuuuuuuugugugugacggagucucacucugucgccaggcuggugcgaucucggcucacugcaauauccaccucccugguucaagugauucuccugccucagccccccgaguagcugggacuacagguguacaccgccaugcccagcuaauuuuuguauuuuuaguagagacaggguuucaccauauugaccaggauguucuccaucucuugaccuugugauccaccugccuccgccucccaaagugcugggauuacaggggugagccaccauucccggccauggacuugcaacucuuuuaccacccauuuuuuaggagggucuguuaaauaaacugugguugagcuauauuuuacauuuguugaaauguacuuaauuuaucuuuauugcuuuugaauuagaaugauuucaaaacuugaagcucaggucaagcaaguagaacaugaaaauauguuaagccuucgucauaauucuagaauucacgugagacccucgcgugccaaguaaguuauuucauuuacucucuauaaagcuagaaauaggugcaugcuuuuauuaagacgagaaacucaucugucuaaaucauaagaaaguccggguuaaaugucauuacagaacuuaaauguguuagauuaauuacugaacauuguaaacccucuuaugcagaggcauuugcuaaaaugaggaaauaucuuaggaucaaauugggauccuuggaauguauuuuguucuuugcccagcugugugaccuuaggcaagucacuuaccuuuuuuggaauucauuuuucuuaucuguaaaaauaaggacaaggggcuagaacaucucaaaaggucuuuuagcccuaaaauuucagacauuuuauuccuauguuaauggaaggaacuaugaagauggaucuucauuagguuguauggguuuucuuucuaguuuuuuuaguucuuucagaauuagcuuggcuauaaucucaacauugucuuggugauacccuuacagaauacauuauuuuuauauuagaucugaauuuuauuaugauuuggguguaaauaaagaauauuaauaaguaaauaauaacuuuauaaugacauuuauuagaaaaaugauuuuaaauuguaauuugugacccaaguuguaauugucaaaugaggagcuuuuucuagggccgggcacagugguucacgucuguaauuccagaauuuuggaaagccaaggugggaggaucgcuagaguccaggaguucgagaccagucugggcaacauggcgagagcccaucucuauaaaauaaaauaaauuguaagagaagauuuuucuaggucuuuguuaauuaaucuuaguagaacauaggaaauucuuuuuuuuuuuuuuuuuuuaaagaaaagauguaaguaacaaauugaacauuugagagagauaaaagagagagcuucggguuggggaccagggaaggccuuucuuuagaggaggcucauaagcagaggagucaccugugcauagaauugcuggagcaggagguguggggugagggaugggagggugggcaggguggggugucugggaggugguccaugcagagaaauugccuugguaaguccucagguaggaaagagcuuagcauauuugaagagccuaagggagguuaguguggccugaauauuuccagcaagaggcaaaguugcccuagaugaaaucagagauugaccauuuauagcuuucuaagccgugaucaagaguuggaucuuggcugggcgccguggcucacgccuguaaucccagcaguuugggaggccgaggcgggcggaucacaaggucaggagaucgagaccauccuggcuaacacgaugaaacccugucucuacuaaaaaauacaaaaaaaauuagccgggcgcgguggcuggcgccuguagucccagcuacuccggaggcugaggcaggagaauggugugaacccgggaggcggagcuugcagugagucgagauugcgccacugcacuccagccugggagacagagcaagacuccgucucagaaaaaaaaaaaaaaguuagaucuugcccuaaguccauugggaagccuuugaagguuuuuaugugguaaaaugauguuaucuaauuuuuauuaauguaccugccaugagaagauggagaaggaaagaauggaagcaggagacuaguuagucuggugcagugcuaggagagaggugguguuagcuaggugguggucacagaaauagacaauagagacucuucgggagagauucuagagguaggaucuauaggauaugguugugaauuggauggcaagguaagaaagggagguguuggaauaauuccuugguuucucucucaaacaacuaaagguaccuaguucauguguugaacuuagggaagagaucagaauuuccaucuugaauauuuuuguuugagauucauaucgauucuaaguggaaaucaaauaggcaauuauaaaugaguuuggagcucaaaaauaagguuuuaggaugguaugauaaauuuuggagucaugccgggugcgguggcucacgccuguaaucccagcacuuugggaggccgagaugggcggaucacgaggucaggagaucgagaccauccuggcuaacauggugaaaccccaucucuacuaaaaauacaaaaaauuagccgggugugguggcgggcgccuguagucccagcuacucaggagacugaggcaggagaauggcgugaacccgggaggcggagcuugcagggagccaagaucgcgccacugcauuccagccugggcaacugagcaagacuccgucucaaaaaaaaaaaaaaauuggagucgucucuuucuagauggugcguaaaguuguagaauggauguaaacugaguguguuuagugagaaguaggccuggggcaagaacucugacacugguguuggauagagagagcuggcaaaggaacccgagaaagcgcugccaaaaagcuagaggaaaacaagcagccaccgguauugagugcaaaacccaacuuguguuucccugugcucucacaccagcacaacaaaaauagacucagaagacuuuugugacccagaaugugugacauuucuccucaccagcaagcgagcaaucaguucuucaugggaccuagcuggguggccucccauucaucucugauacuaucuacccagagauagggucagaucccauaagcugagggcucaguccccaagacuucccauuucagacaccauuugcaaguccaggccuccaaaacgucuaaccaacuggcuucaaguugagguucccacagcccucucuuuggguuugauuaauuugccagaguggcuuauagaacucagagaaucauguuuaccaacuuauuacagaugauauuuuaaaggauacaaauaaacaaccaguugaagagauacagaguaaggucuggaaggaucuccagcacaggaguuucuuucccaguagagcuggggugugaugcccccucagugcguggaugagcucuuguucagcucuccagaagcucuggagcccuguccuuuugggcauuuuauggagguuucauuggacaggccugauugaagcuuggacgacuguguugaaaugugauuggacagaaaggaugugaucuaaacccagcaaggccuuucuguucagauccuucuuggccucuuugugcagcauuccuucccccagaggaugaggcaggacccucucugauucgaacaagagucuuaugacccauaaucagauuagaguccuacccugguaagguaaaaggaagacaggagaagguuagagauucuguugacugcaacaagggauaugaaaguuaugagccaggaauugugaaugaaaacugauguauaauauaugucauaaucucacauugcugcuugagagaucaaggugaagacugcaaggucuuugcaagcuggaggcuaaugcuuagugaacagucuggauagagugauaacaguagaagcccauucagaggguacucgagugaaugcaggcugggcgugguggcucacgccuuuaaucccagcacuuugggaggccaaggcagguggaucacuugaggucaggaguuugagaccagccuggccaacauggcgaaacuccaucucuacuaaaaauacaaaaauaagccaggcauaguggugcaggccuguaaucccagcuacucgggaggcugaggaaucacuucaaccugggaggcggagguugcagugagccaagaucgcaccacugcacuccagccugggugacagagcaccgcucugucucaaaaaaaaaaaaaaaaaaaaaaaaaaaagugaaugaaaaccugaaagucuaacagcuggaauauggaaaauacugucauacacucaagcaugacacugcaucaugacaaugcagguggcagagaccgaguuggcagaccccagccuguggggccacauguggcaugaacuaccuguuuuugugaggccccugaguaaagaaugguuucuacauucuuacauguuugggaaaaaagaauauuucaugacacaugaaaauuguaugacggacugggcgugguggcccacaccuguaaucccagcacuuugggaggccaaggcagguggaucaccugaggucaggaguucgagaccagccuggccaacauggcaaaaccccaucucuauuaaaaauacaaaaauuagcuggguaugguggcaugugccuguagucccaguuacucaggaggcugaggcaggagaaucgcuugaaccuggaaggcggagguuccagugagccaagauuacaccacugcauuccagccugggugagaaagugagacucugucucaaaaaaaaaaaaagaaagaaaauuguauaacauucaaauuuuaguguccacaaauacaauuuucauggaauacaagcuuauucacuuacauagcaucuacggcagcuuuugugcaacagcaaaguggaguaguugcaacagacacuggcccauaaaaccucaaguguuuacucucuggcccuuuacagagagaauuugcugauccucagcuagacggucaacguggauuaaucuuaaggacauaauauggaacaacaaaaaacuaguugcagaagaaauaggauacuauuuauauugacuuuagcaugugaagcaauuuuguauuucuuauggguucaugcaaacauaguaaacguaugaaaacgugcaugggaaugcugaacacaaauuuaguauaaaugguugcuuuugggagggaacgaaugagauuggagaggugcacaggggcuuuaguugucuuuauaguguucuacucuuaauuuaaagaauauauaaccaagauuuauaaagcuggaugguuggcaugaauauuaccuguaugucuaugugugcuugagauauauauauaauauauguuuuuuguuuguuuguuuguuuguuuugagauggagucucgcugugucacccaggcuggagugcaguggcacaaucucggcucacuguaaccucugcuucccauguucaagcgauucuccugccucagcuucccaaguagcugggauuacaggugcccacuaccaugccugguuaauuuuuguauuuuuaguagagaugggguuuugccaugucagccaagcuggucucaaacuccugaccucaagugauccgcccaccucagccucccaaagugcugggauuauaggcgugagccacaguuccuggcugauauuuuauuuuagagacaaagucucgcucugucacccaggcuggagugcaauggcacaaucuuggcucacugcaaccuucgccucccaaguucaacgauucucccaccucagccucccgaguagcugguacuacaggcacgugccaccaugccugcuaauuuguuguauuuuuaguagagacgggguuuuaccuuguuggccaggcuggucucgaacuccugaccucaagugauccgcccgccucagcuucccaaagugcugggauuacaggcgugagccacuguaccuggccccggcugauauuuuguauuuuuaaagugaacaggaacgaauaaaggaaaaguauccagaagaugaaagaacucuuacaaaucaauaagaaaaagauaacuuucucaacaaaaaaugguaaaagaauauaacaagcagcgcacagaucccugauggcuaauaaaaaugagaacauguuaauugucaugaaaaugcacauuaaaacaauaagauacaauucacaccaucggacagguuauauuuaaaauugaaacacuuuaacguuuggcaaagauauggagagacaggaacucucaaaguaaugauugacaguugauacagcuugucuggagagugauuuggcaacagucagagagguugaagaugugcaccaaaucccacaguugcauguuaagauguuugccuuagaggaauuuucacacguguuaauuuuagcauugucgaaaggcugcauauuaaaaaccauauuuccacugccgggagaaaggacaaauauauucauacuauggguaaaugauaaaaaugaauagagcuuauauguacuaacacagauaaauuucaaacauaauauugaacagagaaagcauuaaaggccaggugugguggcucacgucuauaauuucagcauuuugggaggccaagguggggaaauugcuugagcccaggaguuugagaccagccugggcaacauggcaaaacccugucucuacaaaaaauauaaaaaguuagcggcuagacacaguggcucacgccuauaaucccagcacuuugguaggcugaggcagguggaucaugaggucaagaguuugagaccagccuuaccaacauggugaaaccccgucucuacuaaaaauacaaaaaaauuagccagaugugguggcacgcagcugucaucccagcuacucacagggcugaggcaggagaaugguuugaaccugagaggcggagguugcagugagccgacaucgagccacuguacuccagccugggugacagagcgagacucugucuuaaaaaaaaaaaagcuggguguggugguuggugguacgcgccuguagucccagcugcucgggaggcugaggugggagaaucacuugagccugaggggucgaggcuguacugagccaugaucaugccacugcacuuuagccugggggacaggguaaaacccugucucaaaaaaaaaaaaagacauuuaaaaauguguauuaauacauuaugccuucuguguaauuaaauauauaaaaauuggucuuauaauuaaaaacaaauuuugcaagaucgggcugggcacguggcucacaccuguaaucccagcacuuugggaggccaaggugggcagaucacuuaagguuaggaguuuggccaacauggugaaaccccgucacuucuaaaaauacaaaaauuagcugggcacaguggugggccccuguaaucccagcaacuguggaggcugaggcaggagaauugcuugaaccugguaggcagagguugcagugagcugagaucacgccacugcacuccagccugggugacagaggaaaacuccaucucaagaaaaaaaaaaauuggcaagaucuuagcauuuauuaaaacugagaaugggugaguagaugcuuguuauaguauucuuuguaauuuuccaagaauguuugaagauuuuuuuuuuuuuuuaagacggagucucgcucuguugcccaggcugaagugcaguggugcaaucucggcucacugcaaacuccgccuccugggcuuaugccauucuccugccuaagccuccugaguagcugggacuacaggugcccgucaccacaccuggcuaauuuuuauuuugcauuuuuaguagagacgggguuucaccauguuagccaggguggucucgagcuccugaccucguuaucugcccgccuuggccucucaaagugcuaggauuauaggcaugagccacugagccuggcccugaaauaguucuuaauuuaaaaacugggccgggcgcaguggcucacgccuguaaucccagcacuuugggaggccaagguggguggaucacgaggucagcagaucaagaccauccuggcuaauaacauggugaaaccccaucccuacuaaaaacacaaaaaauuagccgggcgugguggugggcgccuguagucccagcuacucgggagucugaagcaguagaauggugugaacccaagaggcagagcuugccgugagccgagaucgcgccacugcacuccagccugggcgacagagugagacucugucucaaaaaaaaaaaaacugagggaaagagugacuggaguugaagugaauguagauagaagaggcagccucuaaaauguuugguugugaaaggggacagagagaaaacaagaguuguuucaugguuucugguguuucuuugaauuugacucaaaaguuucaccugucaacgaaggugggaugggagguuugaggaggguggaaagggugugagauagucauguuuggagaacugaagcuugcugguuacagaaagucauguugccggccgggugcguuggcgcacaccuguaaucccagcacuuugggaggcugaggugggcggaucaugaggucaggagaucgagaccauccuggcuaacacggugaaaccccgucucuacuaaaaauacaaaaaaauuagccgggcgugguggcaggcgccuguagucccagcuacuugggaggcugaggcaggagaaucgcuugaaccugggaggcggagcuugcagugagccgagaucacgccaccguacuccagccugggugacagagcgagacuccgucucaaaaaaaaaaaaaaaaaagaaagucauguugccaggcggucaggcgguuugggguguccgcuugagguggugaugagucugcccagcugguggcuuuuuuccagcaaagcucagugguaggaguugagaccugaagcgcggccuuuguagucagccaguccucagauuuugcugccagucagguguggugaaaggugagagagaaaguaucgugaguguggacuucaggguagaucaagaggaccuagucagacuaggagggguugauaaauggaaaauggagaggccaaggaucguaggucacguugcugaagcuugagggcgggaggcagaauaggggcacagucuuuggaguauugguuucuuaaggggaguguguucucugguuuugacaaaagccagcaaguacccucugagguggcuggcugaggaguagagggucaccucacuggagagaguggucaggaaguugccuagugugagaacaggcauagguguggagaaaacaaggcaggcucuaaagucuggggaaugacuggggguuaacaugauggugggaaccucagaugagcugggggagcaaugucuagaauugcgcuguucaguacaguccugccaacagccacuauuacuauuuaaaucaaucaugucaaccuaaaaucagugacagagacugacucuccaaagaaauuuauuuggaaauguuggggguuugcaagcuggaguacgcaugcuguggugaaccauaagcauguccaaagggguugggacacaggaaacuuuaaaagacaaagggcaguccacaguccacuaagcuauuuuaaaacaaagaccacugguuacaggagcauguugcaggcauuagcauuagcucagugguggagacaucccuuguuagggauguuuccuuguacaagcagcuuauuaucuggaauacugucguucugaggaauucagaauaguucccauaaucagcaucugugugagaggcugcuccuuugugccucccagcuccauuuuuugggaguuugacauuagugacuccauuuugauacugaaaacuuucauuauuaaaauuaacguuuuauaauugguucuucagucucagcagccacauuucagguguucaguagugacaccugacuugugacugcugcauuggacagugcagauagcauuucugguuuugcagaagauucuguuggacagugcuggucugaagggaacaagaagggcagcccugcuuccuucagcacuuuacccucagcuacaguaggggcacagaguguaaagggugugaaaugccugagagacagugaggggaauguucagagccgcaaguaccugaaucuugacugagauucagaaguaacagaaaccuagaacaacaguuaaguugaaucauaaaacuguaaaauaaauuguauccaaaauauagauuguuacaugugauuuuuaaauuaguguacaaauguguaaauacuguuugagagcagauuguuuuauaugcacaugcagucugaaaugaagugcagaccuuuauaaugccugaccguuuucauucuaauagcacacuagcaacuucagacgucagcaggcggaaauggcugauuccaggugcagaguauuccaucuuuacuggccagccucuggacacccaggacaguaacguggauaaccagcuggaggaaaccuguagccuagggugagauaacuuugcuaaagauucuauuuagggauguuauguuuucuuagagauuucaauugcuuuuaaaaguuugggaagcccucucuuugguucuuuaaugucuuaauuuugagaaccugacuuuuauuuuacuuugaaaggcuacuacuuuuagaauauuuuacuuccaugagcucugccaagcuuccccaccugugcucaguggcacaguauggguuugugauuaggauaggaugucgauccucaggccaggugugguggcucacgccuguaaucccaacacuuugggaggccaacguggaggaucgcuugagccuaggaguucgagaccagcuugggcagcaugacaaaaucccaccucuacaaaaaauaaauauauuagccgggcauggugacaugcgccuguaguuuuagcuacuugggaggcugaggugggaggauuacuugagccuggggagcucaaggcuacagugagcuaugauugugccacugcacuccagccugggugacagagugagaccuugucuaaaaacaaacaaaagauguagauccucucccacuucagauggcucuggccagcccgagccccgagccugcgugagcagccucagccgcuuacuccagggugcugugcagaugcuguuccucuaaguguaggacuagaaggaugggaaagcacuguaugcagguuuaauuuauuugcauugcaaagcaugcucauuguggaguauaauugucaacucuguuauuccccuaacaaccccaguaaaguguguguuuuagcuuggacuguuauaacaaauuaccguagacuggguggcauaaacaacacacauuucuuucucuaccucuggaggcuggaagugcaagaucagggugcugaguguuuggugagggcccucuuccugguuauguccucacauggccuuuccuuggugugugugcacagagagagcgcuccugccucuuucccuuuuucauaagggcauuaaucccaucuuggaggcuucacccucaugaccucauccaacccuaauuaccucguaaagaccccaccuccacacaccaucacauugaagauuagggcuucaacauguauguuuggugugggggcggggggcaagauacagacauuuaguccauagcacuguaugucuuaaaauuauuguuuaaggcaccguucaccucuggaaaaggauucuucaccuggaaguucaucaacaagcuuguugauaaaaaagcaaagagagacuucagacacgccgaucaugagagcuuuaaaagaacuugaugagggaaaaauauuuaaaaauugggggacacagacagagaaagaggacaccucaaauagugaguauuuccuuguuugagauagauggauauagauaucuuuuccccauuuauauuaccuucguuaaaauuaaaauauuuagguaaugaaauuaaaaguuuuagcucuguaaacuugcuauuuuacugcuacuucagccccguuucauagagaauugaauguccuaguuaauaauuuaucacaguucuggcauaacauguaccuuuuguacaaagccaguugaaucuuacauuccgauuaugaaaaaggcuuacauggcauucuuuuuuuuuuuuuuuuuuuuuugagacagugagacagagucucacucuuuugcccaggcuggagugcagugcguaaucucagcucacugcaaacuccaucuccaggguucaagcuaucauccugccucagccucucaaguaccuagaauuacaggugcccuccagcacccccggcuaauuuuaauauuuuuaacagagacggaguuucaccauguuggccagguuggucucgaacuccuggcuucaagugguccacccgccuuguccuccacaacacaacacaaaguguaaacacaaaguguugugauuacaggcgugaaccacugcuccuggccuuacauggcauuccuaaggauauuugaaaaauuccugucaguccaucuuacuugcacacaucagaaggcugugauaggcauuugguauucaugaagugagauauaacauuuccucuucuuucuugguuacugagcaucuguagauaaggcaaguagugucuuuaauacuguguuuuuucacagguccaggucaccaauacauuucucuccuuuuccacuaugcuugcuuucucagaccccuuagucauccugccagcgucuuugcgguuacaucucccaagcagugucucuuaguaaauaaauuaguaaccugcuuucuaaaaauaacccucuugaaaaucaccuugaaugccgauuguaaacagggagccagaaugaauucauuauaaacucccauauuuuucuucaucaagcauuuuuuaucauuauaauguggugcauuugcaaauagucacuauaaccuagcuggugagaauaaaugcuuugagcagaaccuaagcuguggggcuugguguguaaccauguguaaccaccuguuaauaaagguggauaacugaagcguaggcuuguuuugauuuguuuuuuguuuugcuuuuuuuuggucugcuguaguaaauccucggcaaacugaaacuucaguuaaugcaagucguucuccagaaaagugugcccaacagagacaaaagagacuuaauucggccucacagagaucaucaucuuuaccaccuucaaaucguaaaucaaguacuccaaguaagaguuagauguguacaucucuuggguucaaaagcgugaucucugagucaaaucuauuugugcccgcugcuugccuguuucugguuucucuuguauccucagcaccuaguagaguacucugagcagaggaccccuaaauaagaucuuguucauaaauaaaauugucugaucacauagauacuacaaauguaaaugaagaaaucuguuuauuaaagugagauuuuuuauuguguccaguaaauuguuuacaacuaauacuaauaauuuauuguguccacuaaauuguuugcaacuaauacuuaaaaaugccagcuauccaaacauuaauucaaucaaauuaauccaagcuagucucaaauauacuucuuauguauuugaucucaaguacuuagcauuagucaccauuuuucuuuagccaauaacagguugguuuuaaaguugaagcauugaauuccuguccugaauuuccguuuucacaccagcugaggagauucuuauuauuguguuauaggaauguucaguaguguacugcuguuuccaucuuauuuccagucgacuucuaaaauccugaaaaaccaguuuugagucagagugcugaaaguacugucugauauacuacaguguuacagugguuaccucuagguguuaggauuaugagugauuuuauuuuuuuguacacucuuauuucucucucaaaguuuuacguugaaauuauauuccuuucaaaauuagaaaaaaaauacugaauaagaaacuguuaugcugauacauauagaaggaaaagaauauuuccucuucauuuucuucuauagcaaaaagagagauuaugcuaacaccagugacuguggcuuauaguccaaagcgauccccuaaagaaaacuuguccccaggauuuagucaucugcuuagcaaaaaugagagcaguccaauucgguaaguucucuaaaauuguagaauaaaguuuacuauauuagugauuuuuuucuaaauguugacuuaugucucuagcuaucacuaauuuuucaguuaccagugggaacucugugaauuucauuuaaaucauaagugaaugucauacuacaacuaaaguacugcaguacaaugaacacaguuuuuaacuauguaaacuugcuacuacuagauuuuaaauuaucaccucagcaccccugucagcuuuuguauguagaaugauaguucuuuguuuuccugaaaagguuuaugauacgggaaaacuuuugggccauuuguacaggaaagugggcuuuacugguauggcccuggcaccaaaugcauguuuaccugugcugcugagaaucuguccccuccgaagugugggcagcugugugugcuauuagcggggagggauguugcuucuugguuccagacccaacucugucaggcucuugcggagaugaguuaagcacauugaaccucaguuuccucuucuauaaaacggggauaauaauaacuacccugcuuauuucauaagguuuuuauaaauaucaaaugagauaauguauggguaaguguuuuaagucuuuaguuuguaaauacaauuuuguuagaaaauagaaauaaauuucaguuuuagacaauuacauaaccagcuuucuuuuaagaaaauacauaaauaugugaguuagcuggaugccagcucaucuuuguaguggagauagggaaaaucaguuaacauuuuuuuucucacaaguaacuugcuucauucaauagauuugauauacuuuuggaugauuuagauacuguuccugugucuacauuacaacguaccaauccaagaaagcaacuccaguuucuuccucuagaugacucggaagguaucuuuuccuaaaaaauauuaguuaugguuuuaaucauucauuuuuugagauucugguaucucucaguguucuaaauauuauaauaucuugcacuuaaauauuuucccacucaagggcgucugaaacuaagcacucaugaugcuacguguuguuaugucaauguuguuauccucauugaaaaguugggaaacugagguacagggaauguugauguuuaauuaccagggccacacugcucaguuauucucuuuacuuuuauucucuauaugcagcuuaggcuuuggguaacuuuuuuuuucucauuuauauucuaaauuuggaauaaagcuauaagacaauguaugugaaaucacuuggguaggcccucaaaacauuaacuguuuaguguugguguauguccacuaaaugugauguauuauuuaguuuuuaagcuuuuuuuuuuuuuuuugcuuuaaguuuacuuaaaguucauuuauguuuacaugaaguuugcuuaaguucauuaagggaaguugcaaagauugucaaacagagggcaaagcuuucagaauucuuuggagaaaaaagcacugaguaaauaagauugauuauuguaucucuuuucauuacuuuuuugggccacauagcagcuauauccagaaagugaaauugggcaacauauuuaauauauaugcaaccuacacgaaaaauugauaagaaauauaagcaauuucucuccucucugacagaaaaaacuuauucugagaaagccaccgauaaccauguuaaucauagcucuugcccugaaccggugccaaauggagugaagaaaguaucugugagaacagccugggagaagaauaaaucaguuagcuacgaacaguguaagccgguuucagucacuccacaggggaaugauuuugaauauacagcaaaaauucggacccuagcugaaacagaacgauuuuuugaugaacuuacaaaagaaaaggaccagguaaaaacaaacaaauauuuuuaaaaauuguuuucugaacuuaaugcuuaugucuaaggagaagggaauuauugagucaaaccugucucaggaaauuacaaugggauaacauaccagagcugugcuagcaacggauuugagccauguggucguuacuaauugacagagggaaauuaaguugagaugaaauggacaaggaaauacuaagccaaaaccuuuucuuuccauucugugugauaaaccucccugccaguaauuuaaacauauuuuuuucguguguuaacagauugaggcagcacuaagcaggaugccuucuccuggaggacgaaucacuuuacagacaagauuaaaucaggugaaaugucuuagcuugaaucugcuuuagaggcuugaugccagucaguguuccaguuaucuaagagggguuuaaaaaaucauggcacagugaaaauuagacacacugaagcagcagucaaaacuuuuagcuuuuacgggaaguguuugauuauagcaauuuuauaacugcaagcuagcuuucaggaauaaaaauugauuuuaccuuuagacuuagagaagaagguguucaugcccuuguauuuucaagaaacuaacuugagagcaaauggcaauaugcuuuucaacagauuuuacacuaaguuagugcucacagauugccucucuuuuuguuugauuucucccuccucaaaucuguaauuuauuucugaacuccuuuccauuagcaagcagauaaaaugguuacacuuuggaaacugaauagcuguagagguucaaaaagugagccguaggccgggcgcaggggcucacgccuauaaucccagcacuuugggaggcugaggcugguguaucaccugaggucaggaguuccagccacugugcccagcccccaacuucuuuuuuucugacuuugucuuuuuguucugauaaauauuagucaauaauuuauaggcugggcgugguggcucaugccgguaaucccagcacuuugggaggcugaugcaggcgggucaccugaggucaggaguucgagaccagccuggcccacauggugaaaccccgucucuacuaaaguacaaaaauuagccgggcauggugugggggugggcgccuguaauuccagcuacucgggaggcugaggcaggagaauugcucgaaccuggaagguggagguugcagugagccaagauggugccacugcacuccagccuggguaauagagcaagacucagucuuaaaaaaaaaaaaaaauaaacuuucaauugaacuuuucauguuaugaaauaucuuucuauaacauccuuuuaaauuaacguacaauauuccaucagcaguaacguauuuaaccaagaauguuuuaguagaaauuuggguugcuucuaauuuuggauaucauaaauaaggcugcaauaaaguucuuaaacauaucucuuugcacguguaaguauugccuuaggagucauucccagaaauaaaaaugcuagguccaaagaaaugcaaauuucuaaggauuuggauauaugucaaguuguaacccaggauguuugagacaauuucuacuccuaccugccguguaugaagauaagcucuuccccauccugaaaccuguauguuugggaaaacaacaacaacaaaaaaaacaaaaaaaaaccugccauggccaggcgcaauggcuuaugccuguaaucccagcacuuugggaggccgaggugggcggaucacgaggucaggaguucaagaccagccuggccaacauggcaaaaccccaucucuacuaaaaauacaaaaaauuagccaggcgugguagugcacgccugcaguccuagcuacucgggaggcugaggcaugagaaucgcuugaaccugggugguggagguugcauugagcugagaucgugccacugcacucggccugggugacagagcaagacuccgucucugaaaaagaauaauaaaaaaaaauaccugccaaugugaucauuuuuuaaaaggugugggguugucuuggcuaaucuuuuauuuaucuaguuuggagacggagucucgcugugucaccaggcuggagcgcagugacgcaaucucggcucacugcagccuccaacucccugguucaacugauucuccugccucagccuccugaguagcugggauuacaggcacaugggcccggccuaauucaaagauauuuugaggccgagaacaguggcucaugccuguaaucucagcacuuugggaggccaaggugggcagaucacuugaggucaggaguuugaggccggccuggccgauguggugaaacccugucucuacuaaaaauacaaaaaaauuagccgguugugguggugugccugcaaucucagcuacuuggaggcugaggcaggagguucacuugaacccaagaguuggagguugcagugagcugagauugcaccacugcacuccagucagggcaacagagugagacugugucucaaaaaaaaaaaaauugagauagaguuugauucucuucuuagguuucucuuuuaauuuuuuugagacagggucucauucugucacucaggcuggagugcauuggcacaaucauagcucacuguagucuugaccucugaggccucagccccuugaguaagcuaggacuacaggcaugcaccaccacaccuggcuaauuuuuaaaauuuuuuuguagaggcagggccuugcaguguugcccaggguggucucgaacuccuggccacaagugauucucccaccuuggucucccaaagugcugggauuacagguguaagccaucaugcuuggccuuauuuuucuuuuaaaaaugauacacggcugggugcagugguucacgccuguaaucccagcacuuugggaggcugaggugggcagaucagaucaccugcagucaggaguucaagaccagcuuggccaauauggcgaaacccugucucuacuaaaaauaugaaaaugagccgggcaugguggugggcaccuguaaucccagcuacuuuugaggcugagggaggagaaucgcuugaaccugggaggcagagguugcagugagcugagauugugccacugcacuccagucugggcaacagagcgagacuccgucucccccaaccaaaaaaaaaaaaauaaaauaaaagugguaugcauauauauguaugcagaaaaaacaggaaagaggaacaguuuuuuuuucuuuuuugcuuauuugucuucuaaauuuucuauauucuaaguguucuauaauccuuuuauaauuaaagaaaaaaauuuuaaguuuuauuucaggacaccauuggaauuaauacugaauaaauuaacuaaaaugaggcuggguauaguggcuuaugccuauaaucccagcacuuugggaggccgagguggguggaucacuugaggccaggaguucgagaccagccugggugacauagugagaucuugucucugcaaaaaaaaaaauguuuaaaaucagccaggugugguggugccugccuguaguuucagauacucgagaggcuaagguggaaggauugcuugaguccaggaguuugaggcugcaguaagcuaugaucaugccauugcaguucagcuuugggugacagagcaagacccugucucaacaaaaacacagaaguauguauaaugauauauaguccagguauuauuuaacaguaauauuguuuauuuuaaaauagcaauuguuaauucauugugaaaucuauuuuuuuuuuuaagaaaaguauccuucaguguuuuuuuuuuuuccuuuuuaacuuagaaauuuuggugagaagaaaguuauuugaucuauguaugugugggaugcagcacugaucaaauguguccauuucuucuggugaaaugugugaagcaccuccuaggcuccucuuguacuguucucacuucagcagagccaaagaauuauccucuuccaguugguuguauugcuauuacuagaauuuccauauacucaaugugucaaacauauugagaauauuuuaaaguacagcaguuauuuggaauaguugaaaagcuaauucauauuguccaguuuaaaagaaaucauaagauguuucguguagaaagcaaaauaauuguaauuuuaguguuuauacuugcucuuuugcuaaaagaaaggucaguuugguggugauuauagaacuugguauagaauucuaauuaaacuuuucccauuguuuucaccuaggaagccuuggaagaucguuuggaaaggauuaaucgagaacuggguucaguucgcaugacgcuaaagaaauuccauguuuugcgcaccucugcaaaucuuugagauuuguagccauuaaauuuugagacauuuuuguuugcacuaauguauaauuaugcagucagaaaaggcaaacuauuuuguacuguuuauaagccuucaaacaguaguuuuacaaucaugcuauucuuacacuugcuauuuuauacuucaaauggccacauauuuucaagauauuuuuguuaugcucaggaaucucuuguauauuuuacuauuuaaaaagcauuauuuuuaaauaguaucugucuccaauuuauaucaagaauaaggaaauauaaacagaggaagcagcuuguuucuaaacaaauaguguuauccuuuuacaauuaacugcacaucaauuuuauagacuuguucuacauuguaaauacaauucaguuuuuaaaaaauaaagcuuaauagcuuccauaa

SEQ ID NO: 191525 - RNA, 61333 nt, Homo sapiens
ugacucguauuuaauuuauuuagaaucuuacaaaaacaaaaaacaaaacaaaaaccaccacaacagaaaaaaaaacuaaauacagaauuuguuacgcuucacgguugaucguuuuuacuugcaagaguaaauaaaccuugcuaaaaugcagccaguacauuuuuauugcaugagaccaaauuuuucaguuacauaucaaaaaugauugggauaaucaauuccggacgcuugguaccgugcucccacgaaaggcuggaugcagcaaugcaguaucauuggaacagggcgcacccuucacacacugauggacacgcuacaacaggagcgauaacaaaagggagauuuaaaaaagagaaccaaaugaaaacacaccaagagcugacauccaccuuuguuucaaguugucuuuggaucccaucagauguugucuccagaugcaccaugucagauuaguaaaggagaaccaucuacaccuacauagaaaaguauccuuugcucagaggagguagaaccuggccaaaguuuuauugcagagauacaguguaccucuucccaccucucauggaugauggaagauacaagugguuauugaaaaaucauaucaguaguuugcaaauucaguauaaaccaugaacaggauauuuuucugauagcggugagacugcaaugugcuauguagaaaaaaagcucucucugccccauaaagugggagucagaaagagggcucaagcuucuuuauccucuucagugccauaaauacugucacagcaaaaaggccuucagugucugcuggccagaaacaucugcccaggcacaaaugggccacaagggcaggguacugguuaggggcccgcaguggaaaagccagacagguucucaccaggggccugcagaguggccuucacucuggaggacgccugaauuacaaguaucaaaaagaacccgccuuuuugggcuucuucuuuuccuugcuuagcccugcacuaaggggcagucuugcuggacggugcccugccacguugcggcagcccagauggccgcacugccaaccacagcacggcuuccccaugggcgccagagggagacugagcaaggagggucugcguggaggaugcacacuggaggcaaucugugacaggccccaauucacgacaaauuuaguucccaagacugauccaaauacagaaugcuuuuacauuuuucaccaagucuaccaaguugaauaguaaugaaugaaacuuguacaugaaugaaaaggccccaaagacgcucacggcaauccuugaaaguuauaaaggaacauuuucuuacaggugcaaaauugugaacaaauacccaaugucugccucccgggugcucaacaccaucauuuugaugaaccauccgggucuucccaacucgaauuauuaaaaacgccucgaucccgcucugcuucuaggcuuacggcugauguagacaagauccacucaccgauacaaggguggagagcacagccguucaggguaccccagggaccagugcugcaaugggaaucugcuugucucacccuccagcagagucagccuaggaggcuccagagcaguugcuuggcucucuuuuggaggacaauuguuccuuaauguacauucucucucuuuuuuuuuuuucgagacggagucucggucuguugcccaggcuggagugcaguggcgcgaucugggcucacugcaagcucugccucccagguucaugccauucuccugccucagccuccugaguagcugggacuacaggcacccgccaccacgccuggcuaaguuuuuuuuuuuuuuguauuuuuaguagagacgggguuucaccguguuagccaggagauggucucaaucuccugaccucaugauccgcccgccucggccucccaaagugcugggauuacaggcgugagccaccgcacccggccaauguacauucucuaaagucaccugucaauaacacacuaggccugccuccugccugcuauaaauauccucaacagguuauaaacagcagcaggcuaccuguguucauugcaaguaaauuacucaucauuuguagguuaaaagcauaggcccgacuucuuaaauaaacauagggaauuugcugcagcagcaggccagaaaccacuguuucaaaucugcaagauuuuccuaucaggugggaagacagagauaagaaauaugguaaggccugaaaaauugcaaaaguagaagcaagucagguuugcugaucuaagagcuaaguuugaucccaaaugcacugaagaaguuagaggagcuuaaagaagucucaggaagcauuuuuuaaaaugugaaaacaucaggcucacuauagcuuccaaagaacaacauaaacgagcaucagcagucauacaaugacaguaucagaaauggcacucaagugcauccccccaguacaaugcauugcacacaacacaauaagacauaguaaaaaacauuaacacaaaacaggaauucuacagcaaagaugcaaaacugaauucuaaaauacaggaacaaauacuuuucuaaaugaaaaguuuuccauacuuuucuuaaaaaaaaaaaaaaaaaaaagucauaagaugccccauaugggaaagucaagaaaagaauaaauagagcugaagggaagagggaaaagggagaaacaggugggcagagucccaauuuacaagaauuauuuacauucagaauccagaagaacucaacauuucucuauauauacauuuauguacauauauauaaauacagcacaaaauuagaggguggguuuuggauuuuaucucaaguacucaaaaaaaaaaugcuagcgagcuugaguugcagguauuuagguguguuucugucacuuaaaagacacugcauuuguaucagacaacuggcauucaaugagacauuuuuuuuuuuuuuugcaguuuuugcucucagcuguagcccugacaugaaacgcuugcuacguuucugcagcaaagugggccgagcgcaguacgcacaggugugguguuagccagggagaccgaagccacacagaaggggagucaguaaauguccaucuccacggugucugccuuugccauugggaggccugaacuaaucaaacguucauuaauaggaucccagccuaacagcaacgcuuauguagcaccauucuuagaaacuaccaaguaucacacagguacauguguauggggaccuuccucuugacugcuugucaagaaaaggauccagagggaacuucugccccuacuuccaugaagugagaugcaacaaucauuuccaaucuauuuuuuuaucucaugcuaaaaugaaaguggaggggagagggaagaaggcucccauucuacaauuauaaaugcuguccugguagccuuucuucucuugccggcuaacaauuguucuaacagcaucccauggaggccagcaaaugaaugccccagggacuacagccagaaaauugugccuguaaaauaucauauuccucuggagcuugguaauauagaaauuuuaccucuacagaugaggcaaacuaaaauauuguuguaacucaaaaaggcuucugaagugcugaguuagaauaaauauauauagauacauacacacacuacauugcuuuggaugcagguucuuacuaauuuauauacacauguaaagagaagauacugaagugucuaacuguaauuuagcagcagaaaaagaaaacugcuuaacauauuugcuucuuaaucaaguuguguuuaaagaaaugcauuaauacuccuaugaauuuguaucauugauaguguaucuggauaaucccaguaacuacagacagagaccuugugguauggagguugcuaaaugaggggaacacuaauucccccagagauaacaucugagcugcuuuagacucuggaagugguuuucaguacaauugacgcuguaaacucugaaaacacgaacaugauuuccaaccaaaucuuugugcucagagccauauugcuaaaaagaaaaaggcauugcagaggcaaaguggacaugggguuaauuaaacaaggccucugaauucagguguggcauuuagauccugcaaugaauggaccuauuuuacagaagucagcggcaaauuuuuuguauuuuuugguacagaugggguuuugccauguggaccaggcuggucucgaacuccuggccucaagugaugcaccugccuuggccucccgaagugcugggauuauaggagugagccaccacgcccggcuacgaguuggguuuuaacagaagaggaccuugaaugcugaagcuucacagggcggccaaacuaacucgcugauuuuugcaagaccacaguguaaaggucggauguccaccugaagaaggggugggugcaacucucugggugcugcacacaccaugaccagccugggcaugcagcaccccagcucccauccauucacacugguugccuuugugagguccauuuugagagggcuuucagaggccuuuuuaaugagaaaaaaaaauagcuguucuacaaagaaccuaagauacauacacuccuauuuaucaagauggcuaguccagagcaaacauuacaucauaggccauggggguugucacuuagcugcaugcuaagaauccucauaugcugcuuugaaaacgccauaaaaaacuaagaugcccucauacacagaaaagaggaguugggccaacagccugcgagagaagauccuucccaacucugccauucuuacugcaggaggguuuguaaugcuuccccacuuccucagguccagcgacugcaccuccaccacuggagugggggacacuuccauugcugauggaagcugccuacugcuuuuaaaaacacacacaugagcugagaaguucugcugaagguggggagagugcugcucuuggcugccagccgggucuagcggcccuaacaagggaaacuggcugauacaaaauggaucacugccugagauauaugaacuggacugaggauagaaguugcauccgcugggcaaaaugugccaaagaacagaaaguacuuucaauuuauucuuuuaggcaccaagaauaaauaaauccuaagaaaacuuacgguaagcuugacauaaccaaacucaggcuaaaggagacacaagaggaugaacgcccuaagcuuucagccagguuugucaguuuuaacacacaucucacccaauucugcaagaaguuuacaaacaauucaacuuaaaaaacauucagaaguacuaucauuauacccuuucccucaaugccaucuuacauuuuagggauaaguuuuaagccaaacuauaaggcuaccuggaaugcugagacaacacacaaauucugcugaguccccgucacagacuacuucugaaggucaccagugagggccuaaacaagaguccacuucuuguuaguauaauaacuuuuuauuugacaucuacaagauuuuggcaucuugcagcuuuuuaccagguuuauacaaucucgauuuuucaauagugcaaccuguggaagcaaaaaaaaaaaaaaaaaaaaaaaaaaagaaaaaaagaaaagaaagaaaaagaaagaaaagauaaaaagaccaacuguccccucacuuguuuuuauaaacaucuauuauaggcgaaacaaaacuuacccauauuauauagauaagugucuauucacauuuguacauuaccauuuuuaacagcuugagauaaacucuacgucuuacaacacauuaaacaauauucaaguuacugaguaacaacaauaacaacaauaacaaaagaacacacagcagaagccucaaguguuuccucauugucuacaacucagguaugguuuccuuuuuaugagugacaaagcaaauuaagauaaugaaguaaaaaacgauuguuugcaagaugaaagccaauuuguacuuccuucuaaaacuaccuuuaaguugcaaauguaaauuuaagaggcucauagccauuucugcagcacacauuaggaauacuauuaauacauuaaaauuaacuuuuaagaguuuuaucacagaaaaauguauguauucauuaccuugaccagaaacccagggcagggagaaggggaaggaggggucugcaggguuugaagcaauacccagguauaaacacuauaaaaaugcaauaaccaaugcuguacaucuaacaaauguuucucucuguuacucgacuccuguguuaaucuuguuucagcaugcuuccaaagacaugcacugucagaacaaaaauuagaaaauaaccugaaugcaugauaugcaaccuuucauuucaugcuuuaauaaaccuauuaaguuggaaaaagaaaccaauauauauuuucuauauuuauagacucaaaacacaugcauccggggauaccucccacagcaauggcauggauguacugcguuaacccugagcacuguauaaacauaaaguaaagccaguuugggaaguuccaagcauuuuaaaccaacuguggucuguagccuuuaacacacucacaaacagacugacacacacgcacacacacaucccccucugcucacccgaaguaaaagcagaugggaauuaucaggggagaagcuaaaggaaagacauauguaccaccaucagcacugcugauuuucaguuuugcuaucuauuccagguuuguccuuacucccaaaaaaacuaacuagagagcacaacugaaaaaaauauauaauucuuuggaaacugucccugauuuuuaugcaaaugauaugcuucaacagcauuucagauccauccauguugaaaccugucuguucuucaugcguugcucaaguuggugaugcucugagggugaugcuguugccauagcuguuucuguuggaccgcaagcuguugagacuggucugaaguugauaggagauuuacaagaggagacacacaauuugccggaaugaucaaaccuguaauuaguaacaagaauuuaucaaguuguguccagaagaaaccacacuguacagcuucacagcagauuccaaaugaggcauaauauuaagcguaauggacaagaaguucacacaaaaauuaaacgacuaccuaauaaaugaaauggccauugagauguagucugauucuuccacagcauuucccacaaauacccaagcauaugcauguguuuaguguaaugcuaucuuguuggaggaauaggaagucaagaauaucuauuauucucuuuuuaacaggagguuaagaauaucuauuauucuauguauuaucuuuuaaugcaccaaaagacuacagaacagaaguugcaaauucaaaugcuaaccgaaacagguuaacuuagaagagcagauacuagcaaacuggaaaggauacucucugggugcugguuaagggaacuuuaaguccugcauguaggauugaaggcucaauguuccagauaaauugcaugcauauauauauguguuuuuuuuuuuguuuuuuuuuucugagauggaguauugcucugucgccaggcuggagugcaguggcacaaucuuggcucauugcaaccuccgccucccggguugaagugauucuccugccucagccucccaaguagcugagacuacaggcaccugccaccacgccugguuaauuuuuguauuuuuaguagagacaggguuucacgauguuggccaggaugaucucgaucucuugacuucaugauccaccugccucggccucccaaagugcugggauuauaggugugagccaccgugcccggcccuauuuguuuuuuuuuuaaauagagacaaggucucacuguguugccuaggcuggucucaaacuccuggacuccagcaauccuccugccucagccucccaaaaugcugggauuacaaggugaacuaccaugcccagcugaugggcugcuuuugaaacuggaaaucuagacuuuuauaugaaaccucuugauuuuuaaauguuggcaauuaauucaaaugaggcugggcucgguggcucacgccuauaaucccagcacuuugggaagcugaggugggcggaucacuugaggucaggaguuugagacuagccuggccaacauggugaaaacccaucuccacuaaaaaaauauaaaaauuagccaggugugguggugcaugccuguaaucccagcuacucgggaggcggagguugcagugagccgggagcacgccacugcacuccagccugggcgacacagugagacucagucucaaaaaaaaaaaaaaaaaaaaaaauucauuaauucaaaugaaaaccuacaacaucccaaaauacugguguccaaaaaaaaaaaaaaaaaaaaaauuccauagacugacuuuggcccaugaacucccgauaugcaauccgugguagaggaaggcugcuguaagcgaaaccaagauaagcaaacagaguccaguugcugcccugcuuccuggacaccuguaguugagcacacggugagaauagcuggccuagucuacccuugcucccugcaggacaccaagccauucucugugcacaguggcuuuugaauuccagagucuuaaguuagcucaauggagaacuccugggcaagaggcugaacugucuacacaccagggagccugcacagccaccaagaguagagaaggagagcaagagcagcugagagcagcaucaaagagaugaccacaucauaacuucaaccagaaccaacaaugucuguuugaaggcuuaacuucuguucaaccuuguaagaaauauaaaacgggucccauacccacuacuggaagagauguuagaugcauguggaauaaagcuaagauauuagcaaugagaaaaaagucggauccgauuuuuuccugcaacucaaaccaaaacaaaaauuagacucaccuacaauccguugcccaucuuccguucuuagccgcacgaucugcaucuucacguuugugccacugacagaugcuagaacacccucaacuuuuguccagacacucagcacugaaccacauaauacauaauauguacggcaacgaagaccuauuucacaaacuagccccaagcuugcuuuuuugcaauugccgcgccuaagaaaaaugggaaagaaauacauaugagugucuauauaugcacacagacacguuucuaaaagauuuacaaggucaacucaaauuucuuuucuuuucuuuuuuuuuuguugagauggaguuuugcucuuguugcccagacuggagcgcaguggugcgaucucggcucauugcaaccucugccucccagggucaagugauucuccugccucagccucccgaguaacugggacuuuuuuuuguuguuguuguuguuuuguauuuuuaguagagacgguguuuugccauguugggcaggcuggucuuaaacuccugaccucaggugauccacccuuggcuucccaaagggccgggauuacaggcgugagccaccgcucuuggccucaaauuucaaauaaacaauguuucagcaguauuugccuuuacuauuucuuagauuauaauucuguuggcccauuggguuagcauuuccaauuuaagguaucaggcugauuuuuaaaaccacgauuuuuucaggggccugccucccaauaaaaaggguugaauuuauuguguuugcuaucuguugaagcauuuuagucauuuuaauauccauuauuuuacugcaauauugcuacuuuauaaaaugaucuugcuagccgggcaggguggcucaugccuguaaucacagcucuuugggaggcugaggagggaguauuguucgaguucaggaguuugagaccagccugugcaacauggcgaggcucuaucucuacaaaaaguuuaaaauaauuagguaugguggcucaugccuguaaccccagcacuuugggaggcugaggcaugcagacagcuugagaccaggaguuugagaucagccuggccaacguggagaaaccucauuucuacugaaaauacaaaaauuagccagguaugggcugggugcgguggcucacgccuguaaucccagcacuuugggaggacaaggccggcugaucacaaagucaggagacugagaccauccuggcuaacacggugaaacccugucucuauuaaaaauacaaaaaauuagccaggagugguggcaggcaccuguagucccagcuacucgggaagcugaggcaggagaauggcgugaacccaggaggcggagcuugcagugagccgagaucgugccacugcacuccagccugggcaacagagugagacucugucucaaaaaaaacgaaacaaaacaaaacaaaaaacuggcugggcacgauggcucacgccuguaaucucagcacuuugggaggccgaagcaggcagaucaugaggucaggagauccagagcauccuggcuaacauggugaaaccccgucucuacuaaaaauacaaaaaauuugcagggugugguggcgggcaccuguagucccagcuacucgggaggcugaggcagaagaauggcguaaaccucagaggcggagcuugcagugagccaagaucaggccacuacacucuggcaugggcgacacagcaagacucugucuucaaaaaaaaaaaaaaaaaacaaaaaagccaaguguguuggcgcaugccuguaaucccagcuacucaggugguugaggcacgagaaucgcuugaaccugggaggcagaaggugcagugagccaagauggugccauugcacucaagcccucuguuuaaaaaagaaaaaagauccugagagauccugccaugaaaaaacaagcaauaccugugaaaagaaaagaaggaggggggaagauccugccaguuauuucuauauuaugaaacuacugauacacugguucuaaaucacauuagugggaaggacucagcaaucuagagagauggaaaggggugggaggggagcgagaggcuacauguaaauuuaagaagaaaugagaaaaaggagaaauaccaucaauguuuucugguuaaaauuaucuucagaauauucaucaauaaagaugcccuucugguuaguacuaacucaagacgaaucuaauacaguguuaaauguagguauauaggacacuuuucuugcuauaacucaaagcaaauguuuguuguuuuuuaaguuaauuuuuuguagagauggagucuugcuguguugaggagguuggucucaaacucccggccucaagcaauccucucaucuugaucucccaaagugcuaggagccacugcacuguccccagaggaaauguuuuagaaaauguuuaggccaggcgcaguggcucaagccuguaaucccagcacucugggaggcagaggcaggcggaucacgaggucaggagaucaagaccaucauggcuaacacggugaaaccccgucucuacuaaaaauacaaaaaauuagccgggcgugguuggcgggugccuguagucccagcuacucaggaggcugaggcagaagaaugccgugaaccugggagguggagcuugcagugagccgagaucacaccacugcacuccagccugggugacagagcgagacuccaucucaaaaaaaagaaauguuuguaggggcaaggcgcgguggcuuaugccuguaaucccagcacuuugggaggccguggugggcagaucacaaagucaggaguucgagaccagcuuggccaacaugguaaaacccugucucuacuaaaaauacaaaaauuagcugcgcaugguggcaggcacuguaguccuagcuacucgggaggcugaggcaggagaacugcuugaaccugggagauggagguugcagugagcugagaucgugccacugcacuccagccugggugacagagcaaggacaccaucucaaaaaaaaaacaaaaaaaaacaaaaaaaaaacccaaguuaguagguuaacuuuuaaaacuuuuuuuuuuagaccacgucuugcugucauccagacaggggugcagugccacgaucucagcucaccgcaacuuuugccucacaggcucaagcgauucucaugccucagccucccaaguagcugggauuacaggcgucugccaccaugcccugcuaauuuuuuuauuuuuaguagagacgugguuucaccauguuggccaggcuggucuugaauuccuggacucaugugauccaucucgaccucucaaagugcugguacuaccagcaagccaauggugccuagccagccuaccuuuuaaaacauuuuaucuuacagauuuuuucuaauuuucaguggcacuaauuuacucucauaaugaaaaccaaaagcacuacucacaucaaagccaacuuaucuaccugcagaacagcccaaacaaucaaaacaaacaaaaagccccucaagcuaaaauucauuuacaucucauauuccuuuucaugaagugggccagauacuguaagagcauuaacuacuuaaugagggagagaacaaugagaagaaaacuaugauuugcagaguauaagaguauacgaggucacaaagugaacacuguaagccaaggggugagggggcacagcaggaagagcuccaagacucaacaacaaaaguuugcaugugcugugcuauuaacuuugggaaucucccugguuucuuagacauucccuagaucugggacaccaguaaagcuuuuuuaaaaaagagaggaagaaagaaaagagcccagcuacucaggaggcugagaugggaggaguuugaggcugcagugagcuaugauugcugcacuguacuccagccuaggugauauagggagacugucucuuuaaaauaaccaaccaaacaaaaaaacaugaagggagagugacagaaggagggcgaaaaagugguuuguuuuuuuuuuuaagagacaguuuuugcucuuguugcccaggcuggagugcaguggugcaaucucggcucaccacaaccuccgccucccggguucaaacaauucugccucggccuccugaauagcugagauuacaggcaugcgccaccacacccagcuaauuuuuuuuuuaguagagaggguuucuccauguuggucaggcuggucucgaacucccgaccuuagauuauccaccugccuuggccucccaaagugcugggauuacaggcguaagccaccacaccuggccuuauuguuuuuuuuuuuguuuuuuuuuuuuaauggagucucgcucugucccccaggcuggagugcaauggcgcaauuuugacucacugcaacuuccaccuuccggguucaagcgauucuccugccucagccucccaaguagcugggauuacaggugccugccaucacaccggcuaauuguuuuguauuuuuaguagagaugggguuucaccauguuggccaggauggucuugaacuccugaccucaggugauccgcccaccucagccucccaaagugcugggauuacaggcgugagccaccacacccagccgugaaaaagcaaguucuaauaugaaggauaacuguuaaggucaugcugccagacaacaguuggcuggaaauaagaaagcaucagugaagaguaaggagguacauaaacuaaacaguuucuagucuacaacuguccaguaaauauuccugauggaacacaccacgccugacaauacuuaaucuguuaguuaauucaugaggacauacugauaaagagugaagguguauuuaaaucucaauuaaauuuuggaaaauuugguaggaaacacgaaaauacuaaccaauaagcaugaguacaaguaucugcagaugaauuauacugaucuaaccagugcaucagggcaucaucugagacgaccuguaaaaaugagaagaauuucauugaaaacaguauugcuuuaaauaaacugguuaccuagucuggucuguaauucuagagguagccaauuuaaaauaaucucuacacaaaaagccuaacccuugcuauuaacugaaucugaacgccauuugaaaagcucugucaugcugguuccucuuauguaauacauuuuucaaauaacuacuuaacuauaauuguuuucaaaucagaauggcuacaaauaauaauauaagguaauauuaauaaaauaaaaccuaauaguaaauguuaggaaaaguggucgcuuaacauuuucuauaaaucauugcaaaauauaaacauagaggcauccucacaauaaaacuaagagguagugagaagggcuuuaaacauucuaacuuuugugauuagcacuggaagcuuccuuuacugaagagauaagcuguuucaaauaaucauuuuaggcugggcacgguggcucaugccuauaaucccagcacuuugggaggcugaggcggguggaucacuuaaggccaggaguucaagaccagccuggcuaacauggugaaauuccgucucuacuaaacauacaaaaaaaaacuagccagguguguggcacaugccuauaaucccagcuacuugggaagcugaggcaugagaaucacuugaacccgggaggcggagguuacagugagccaagaucgcgccacuacacucccagccuggguaacagaaccuuagaaguuucuuaaggcugguaacauuaagacugugauauuagcauaacaaaaguugacacuuuccuuaaaccaggcugggugcgguggcugacaccuguuaauucuagcacuuugggaggcagaaguggacaaucacuugagcccaugaguuccagaccagcucagccucugcaacacagugagaccucauuuaaaaaaaaagaaagaaagaaaaagaaaauauaauuucauaccuagaaaagcuaucuuaaacaauuucaauauauuauaaaauaaguauucuuuuuuuuuuuuuuuuuuuuuugagacggagucuugcucugucucccuggcuggagugcaguggugcaaucucggcuuacugcaagccuccuccacuucacagguuaaagugauucuccugccucagccuccugaguaacugggauuacaggcaugcaacacuacgccuggcuaucuuuucuaucuuuaguagagaugagguuucgccauaugggccaggcuggucucaaacuccugaccucaggugauccaaccgccuuggccucccaaaguacuaagauuacaggcgugagccacugugcccagcuaaaguaaguauucuuuuuuuugagacgaaguuucgcgcuuguugcccgggcuggagagcaauagcgugaucuuggcucacugcaaccuccgccucccggguucaagugauucuccuaccucggccucccaaguggcuggaauuacagguaugcaucaccauccugggauaauauuuugcauuuuuaguagagacgggguuucuccauguuggucaggcuggucucgaacuccugaccucaggugaucugcccaccucggccucccaaagugcugagauuacaggugugagccacauugccuggcccaaaguaaguauuccuauauaauauaauguacaaaugaaaaaauaccuucuuauauuucuuuuuuagaucagcauaaauuucuaauuugagcugcuucccaguauuuggucgauaaacuaagaaaaguuucuuuuuaggauucacuucuuuaacuaagauggcaguuuucuuguuguuccuuaucuguuuaaagaaaaugacaaaauauaaagauuuuauaauacacacuuuaagacauguuucuguaccaucacgucagcaaacauaaucauuugagacuauaacacuaaguaaguacacgguaacuucaaaaaggaccgaaaaugcuuguuuaaaagacuaacacagucacacccaagaggcaguuauuggaccuuaauucuggcuaaagaugaagguuaaagaccaaaguuaucuucagaaaacuacguggaauuagcuuuaaugcacaaauguccaacacagaucauuuugcuucuuuuauuuccuguaccuggaaucccagucaagcagccucagagagguaagaaaaaccaaguguaauaaaauguuaacaguggaauccaggcaguaggcauuaggggucuucagagaaaauucuuuaagcucugcuguauguuuuuaaacauuucucaguaaaauggaaaaagaaauguuacucuccuuucaaguuaacaauagaauucaagccccuccaagauaaggccuuggauggccccaguccucugcacuugucuacuccgucaguacugccuuucccgaugucacaggguuuugaagggcaaagugagagaucacaugauaaaguguucuguaaacaucaaagcugcuauggcagcagaaagcaaaaauguugaacaaauuguccacacauauggagguaaaaauggaagaaagggaagcauuagagaaauguuggaauuuagguauguauuuuuaacuuuuuuuuuuguuuuugagacagucuugcucugucaccagccuggagcacaagggcgcgaucucggcucacugcaagcuccgccucccagguucaaggcgauucuccugccucagccucccgaguagcugggacuacagguacucaccaccaugccuggcuaauuuuguauuuuuaguagagaugggguuucuccauguuggccaggcuggucucaaacuccugaccucaggugauccacccgccccggccucccaaagugcuaggauuacagacgugagccaccacgccuggccuauuuuuaacuuuuuaaaguuggauuuaugagaaaaacuuuaagaggaaggaguuacucuuaaaacuccauuuaacucaaggaaaaacaacuggaaaauucauuucuucuuuauaaagacugaacagcuucuaaacaaucauuucuggagcaaaacggaaggaaaaagaaaaguuucaaaguaaaaccauuuucccagcccucuacacaauaaaucauuguuugcggggcuauuaacuuuuuauauucauucuuauaaugaaaaacacaauauuuuacuuuccucuucauggauauuaaagacccuuggucucuuacuuuuuccaacgaauugaaacauuguuuauauaauuacuguaaagucauaaaacaaugguuaaggugaagauuauauuuaaaauuauuuaucagcugacaggaaauauccaaaccuauacuuagaggauaguguuuaagacacuuaacaaugggcucugucuugacagugucagguuaauuauacaucaucacagaacaguggaaagugauucugacauuguuuucccaauggcagcacaggcuacacacacugaaaaguaugguggccuaaugcaguggagguucaaaggcaaacgaagaccaggaaugaggucucuaggaccaccacuccucacgcccagccaccuguugccacacagagaaugaaggaccaguauuaucacauccuucaaccuaagagaagcuggggaucaggacuuucaucacaaucuaccaacggugauauucuggcaauaauuucaauuuaaaaauaauaaccaagagccaggugcaguggugcaugccuguaaucccagcuauucagguggacaaggugagaggauggaucaagcccaggaggaguucgagacuguccugaaaauaaccaacaccuuauguggaccaaucaaaauugcaucuaugggggauagccgaguaaaauacuugaauucuaccaauaucaacaucuugguugugauauuacacuacaguuuuaaaaaauauuaccacugggguaacugauaaaaguaugcaagauguuuaucuguacuguuucuuauaaugacaugcaaaucaaccuacaguucaaucaguauuucaaaaaccccaaaaccagcaaggcacaguagcucacaacuguaauccagcacuuugggaggccgaggugggaggaucauuuaagccuaggaguuugagaccagccuggacaacacagugagacaucaacugcauuaaaaaaaaaaaaaaaaaaaaaagccaaaugugguggaguguaccuguggucccagcuacuuaagaggcugaggugggaggauugucugagcccaggagguugaagcugcagugagccaugaucacgcacgccacugcuuaucagccugggugacagagcgagcgagaucccauuacaaaaaacaaaaccaaaccaaaaaaccccaacucaacuaggagccagauccuuugagagcuuuucucuaggucaaggaucagcagcuuaggccuguggaauaaaucuagcuuggcacuccuaaacugaaguaagauuaagaaggaaugaaggaaggugggaaaaaaaagagaaaggaaggaaggaaaacacagaggacaugcaauauagaccacauauggccuacaaaaccauacauaucagaccuucauagaaaaaguuuagcaacuccugcccuagaucauuuaugacuucauccugccugugccaucaucauacauguagguacuucauaugagcaagaaccaggucuuacuugcagucacuccauaaauauuuguaaacagaaagcaaaauauguuauauacaaccaaugaaauauuacucagccuuguaaaaaagaacgaaggggccaggcagcgugguucacaccuguaaucccagcacuuugggaggcagaggugggaggaucacuugaggccaagaguuucaaaccagccuggucaacauagugagacaccaucucuacaaaagaaaaauuaaaaaauuagccacaugccaggcgcgguggcucaugccuguaaucccagcacuuugggaggccaaggcaggcggaucaccugaggucaggagaucgaggccauccuggcuaacacagugaaacccugucucuacuaaaaauaagaaauuuagccaggcgugguggugcgugccuguagucccagcuacucgggaggcuguggcaggagaaucgcuugaaccugggaggcggagguugcaguaagccaagaucgugccacugcacuccagccugggcgacagauugaaacugccucaaaaaacaaaacaaaacgaaacaacacaaccccaaauaucuuagagaacuggcgaaauaaaauuucuguugucuuggaucugaguaaguaaauaugaaacucaagauacugcugaauaucuacauacuguugaguaucuacacauacauguauagaugugugcgcacacacaccccuuaguucuguccacagagacaaaucauaacugaaagaauguagcuauuuuacuaacugaaaaaugagucuuaaagauauaaagcauuauuaagacuaaaguaagucucugucuuaugaaaaaugcuuaauuuaagaaaauguuggccaggugcaguggcucaagccuguaaucccagcacuuugggaggccaaggcgggcagaucacgaggucaggagaucgagaccaucuuggcuaacacggugaaacccugucucuacuaaaaauacaaaaaaaauuagccaggcgugguggcaggcgccuguagucccugcuacucucgggaggcugaggcaaagagaauggcaugaacccgggagguggagcuugcagugagccgagaucgcaccacugcacuccagccuggguaacacagcaagacucaaucucaaaaaaaaguuaauucagccaggugugguggcucacaucuauaauuccuuugggaggacaaggcaggcagaucaccugaggucaggaguucgagaccagccuggccaacauggugaaacuucaccucuacuaaaaauaaaaaaauuaggcugggcacaguggcucacgccucuaaucccagcacuuuggaaggccgaggcaggcaggucaccugaggucgggaguuugagaacagccugaccaaagugaagaaaccccgucucuacuaaaaauacaugucagccaggccuaguggcacaugcuuguaaucucagcuacucgggaggcagaggaugaggugagcugagaucgugccauugcacuccagccugggcaacaaagagcgaaacucugucucagaaagaaaaaaaaagaagaaaauguaacaauucuaaacccacaccuaauaacauccuuuaaaaugcauuaaguaaaaacauaacacaaauggacaaacacacaauuacaaugauaaauuaccaaaauagacaaagcuaaacacaacugggaaacagguacaaagugaagagacaauuacaaugcuggccauuaaaaaguauuauauaucugaauagaauuuaaaggaaaagucguacuugcaaugacaaguaaaagccaucgucugguccugucagcucagcccaaaucuugguagcuuccucccaugacauuccccucucuacacuaaucuguaagagaaacaacgaaauuuaaacucauuucuguaaaugcaucucaugggaagacgauacuucacaacauuuucuaaacuuacuguguauaauucuacguggccagagguugaauauccuggagucagaaacuuuuuaacaucacuuuuccgcacuuuuucaucuccagaaccaagaucuugaacaagaaaaagaaacauguaaauguaaaaagaacauuuuuaucagguacacacguuuaaagaauuucuccacuccacauuuucccuggggacauugugggggggaaauuuucccuacuuaccuaagauucccauaucauaucuuccauuuuuuuuggcauuuugaacaacugcaguaaguguguccgcaaaauacugaaauaacgcauucugcugaugcaccuccaugccuaaaauucuauuuaagaauuuuccuauguuguuauaaucuguaaugacaaaagauaaacguuuucaugcaaaugauaauuaaaaauuuuuuauucaucuaggcuuaguucaagucccacuuucucuucuaaaagucuuccuucuuaacucuuacacuguccucacaacaaggcuguaaucugcccauuucucucucuagcaauuagcaccacugcaggacacgcucaaaagagguuugucaaauugaauuuuugcaucuucagccucacuuauggaaaguaugaacacaauucaguacauaagaaaguuaguucuccaacacugaauucucaacuguaguggcacuauuagaaugucugggagcuuuggaaaacuaccgaugucugagcuccacccgacuucaguaauuuuucguuuuguuuuguuucuugagacggagucuugcucugcuguugcccaggcuggagugcagucaugcaaucuuggcucacugcaaccucccccugccagauucaagcaguucuccugccucagccuccugaguagcugggauuacaggcgcccgccacuaugccuggauaauuuuuguauuuuuaguagagacaggguuccaccaucuuggccaugauggucuuggacuccugaccuugugauacgccugccucagccucccaaagugaugggauuacaggcgugagccaccgcgcccgaccaauuuuuuuuuauuuuuuuagacggagucuugcucuauugucgccgaaguuggagugcaguggugcaaucucggcucacugcaaccucugccucgcggguucaaguaauucucuugccuuagccucccgaguagcugggacuacaggcacccgccaccaggcccggcuaauuuuuguauuuuuaguagagaugggguuucaucauauuggccaggcugguugcaaacuccugaccuugugaucuacccaccucagccucccaaggugcugggauuacaggcgugagccaccgugcccagcagacuucaguaauuuuuaaaagcuugagagcugaucauaucagcagccagugcugaaaacugcuucucuaugcauggaucuuuuacacauaccccacagcagccaaaaccacccagaauguuuuaagaacaugaagcuuccccuucagcucaaaagcauauaucauaauggacuuuaauacuauagcaacaguuauaugcccacacaaagcuaauaguaguaccuuuaucgagaguaagaauucccgagcgaucuucuacauuuaucaggccaacgccuaucaguccuugucgaacaucuguaagaacaggaucaauucugacucauaaauuacaagggaugucuacaauguaccacuaagugagaaaaguauguuguaaguaguaucaugccauuuuaaaaaaacaccuugauauuuauauaaacauggagaaaauguggagagaacugcccuuguucacucugucaucugugaccuaagaaggugagaauggaaggaggguuaaggggacuguauuaacucucuucauuauacauguuaagauucuuuucuuuuuuuuugagacggagucucacucugucacccaggcuggagcgcagugcgcgaucucagcucacugcaaccucugccucacggguucaagcaauucuccugccucagucuccugaguagcugggacuacaggcuaaguuucauauuuuuaguagagucgggguuucgccauguuggccaggcuggucucaaacuccuaaccuccggagauccacccggcucggccucccaaagugcugagauuacaggugugagccacugcgcccagcugcaagauuacugucauuacuuauaauaaacaaguaaccuaucuaucuaucuaucuaucuaucuaucuauauauauauauauauauauauauauauuuuugcgacagagucugacuacguugcccaggcuggagugcaauggcaucaucuugguucacugcaaccuccgccucccaggcucaagggauccucccaccucagcuucccgagcagcuggaacuacaggcgugcaccaccgugccuggcuaauuuuuuuuuguaauuuuuuuagagaggggguuucuccauguugcccaggcuggucuugaucuccugagcuuaaaugauccaccugccuuggccucccaaagugcugaaauuacaggugugagccacugcgccuagccauaaccuguaauuuuaagaaguuagaaguaaaucaaggaaucuuuuuuuuuuuuuucugagacagggucucucucaccagucuggaaugcaguggugccaucacagcucacuacagccuccaccuccuaggcucaagcaauccucacaccucagccucccaaagugcugggauuacgggcaugagccacugugcccagaccagggaguuguuucugacacuccugaugucaaaaggagugaagguguaggguuaagacuuuacugcuuuuguugaaagccgagaguaaugaugaacaccucuaacugguaugucaauaugaacuguuaacaacacauaucaguaugugcuaaucuaccaaaaggacuuccuagugaaaaaugcuaacuccaucugggugccuuggcucacaucuguaaucccagcacuaugggagguugaggugggaggaucacaugcggccaggauuucaagaccagccuggucaacauggcgaaaccccaucucuauugaaaacacaaaaauuagccagguaugguggcgggcaccuguaaucccagcuacucgggagguucagggaggagaacccuuugaaccugguggcggagguugcacugagccaagaucacaccauugcacuccagcccaggugacagcacgagaccccgucucgaaaaaaaaaaaaaggacauuuccaaauacacgaaagaaaaaaggcuaagcuaugagccacauguauccaucacccaguuuaaacaacugugaauucauggccaauuuuguuucauccaaaccucccaccccaaccaaucaauccucacagauuauuuaccuagguacuuuuucaacuuuaaaauuaaauugaauuuuaaaagcuauuuggggcugggcacgguagcucaugccuguuaauuccagcacuuugggaggcuaaagcgggcagaucaugaagucaggagaucgagaccauccuggccaacauggugcaacgccgugucuacuaaaaauacaaaaauuagcugggugugguggcaugugccuguaaucucagcuacucaggaggcugaggcaggagaauggcuugaaccuguuggcagagguugcagugagccgagaucaugccacugcacuccagccuggcgacagagcaagacucggucuuaaaauaaauaaauaaauaaauaaauaaauaaauaaauaaauaaauaaauaaauaauuuuuaaaaaagacucggucuuaaaaaaaauaaaauaaauaaauaaauaaauaauuuuuaaaaaaggcuauuuggcaaagugauuuuacucaauguacuaaaacaacuuuccucuauuaaaucucuuauuagacaaacaugcuuucaccauaucaacaguaagagcacuuucauuugaauaaaauuugcuuuaauaaaucuguuuaauacaagauaauuauguguccuaguaaccauuaauuucaaaguuuuauacaauuuauguccaaagaaaaaaacuaauauaacagcaaacauuacaacagguuugaguacaucuuugucaauaaucauugucauuguuaugaauauuuguagaaguuaccuuuaaaaaauucuccaggauagucuggagguggugauaccauaggagaauccaaguuuacaauggauuucaugacaauuucuaaagcauuucuuccauacugcaaaaaaaaaucaaaaccuuuaaccaguuucagcauuuggauacucuucaaucacaugaccaccuaaauacuauaaaaacuacuggcugggugcgguggcucaugccuguaaucccagcacuuugggaggucgagguggguggaucacccgagguugggaguucaagaccaaccugaccaacauggugaaaccccaucucuacuacaaaaaauuagcugggugugguggcagacaccuguaaucccagcuacuuggaaggcugaggcaggagaauugcuugaaccuaggaggcggagguuguagugagccgagauggcgucauugugcuccagccugggcgacaagagcaaaaaacucccucucaacaaaaccccaaaaaacccacaaacuuauuguaccaaagauucaaaaaagcaauucucaauuaucuuuauauguauuuauuuauuuuuucuuuuuuuggagacagaguuuugcucaucgcccaggcuggaauguaauggcacgaucucuacucacugaaaccuccgccuccuggguucaagcgguucuccugccucagccucccaaguagcugggauuauaggugcccgccaccaugcccaacuaaauuuuuuuuuucuuugagacggagucuugcucuguugacaggcuggagugcagugguguaaacucggcucacugcaaccucugcaucccagguugaagugauuuuccugccucagccucccaaguagcuaggacuacaggcgcacaccaccacgcccagcuaauuuuucuauuuuuaguagagacaggguuucaccauguuggccaggauggucucgaucucaugaccucgugauccacccaccucggucucccaaagugcuggauuacaggcgugagccacugugcccagccacgcccaacuaauuuuuguauaauuuuuugagacagagucuugcccuauugcccaggcuggagugcaguggcaugaucucggcucacugcaaccuccgccuuccaaguagcugggacuacagaugcaugccaccacgcccaucuaauuuuuguagagaugggauuucacuauguuggucaggcuggucucgaauuccugaccucaggugacccaccugccuuggccuccuauauucugggauuauaggugugagcaacugaucccggccuaauuuuuguauuuuuuuuuuuuuuuuaguacagaugugguugcaccacguuggccaggcuggucucgaacuccugaccucaagugauccaccugccuuggccucccaaagugcugggauuacagacaugagccacagcgccuggccuuuauauauauuuuauacugccuaguucaugucucuacacauaaaaaacaugagaaaaauuaacuuccuuugcuucugagaacucacaguuaauucagucucauuuauucuuguuuuccaaaaggaauaaagacaacuacauugcuguacugauacuuaacaugcgaucuaacauacaugugaaauucugucuuauaggaagccaugauuuuaaagcaaaugcauaggagaggcaguuuuguuuuagacaguaacuacuuuccuuuuguguucccgaaagacaccauacacuaucacaaguuuucagagauacugaaaauugaaauguaccuuauuaucaaaguugaaccugcucagaucucuagauucuguugcccuucuaucaccauguguaagugcccccuguuaaaaacaaaaauuucaaucaaggcacagguaaccuuuuaccagaaaacagguacaauagaucaucauuuacacacagccacacaacuccaaaacucaccaaacucucaagucuuuuagcaacaauagaugcaaaucuuuguucuccugccaguucagauaucagaaagacauacucaggagcaguaacuugguuugaucuaugaguacguccugcaacgaaauuuuguuuuaaagaucauugauuguguucgcuggacagagaauauucugagauguauuccuagcauuuaacacuaaacugguauugggaaaccacuaaacaauaaaaauuacagauaauguaaaauuaccauaacacacauaaaacugcucaaugacagaaguauuagcauugcuaccccaauuuugcuuaaccacauguuacugaugcacaauuacucuggauuuucccaaaauuguuuuucaaaucauuggucacaagaacaugaagauggagggaggagcuaugggccuuuggugaagcuacugagguuggaaacacauauagaaguagcagcuucucugauauggaccuaauacauccuuaaguuuuauaaggacacuccuugaggaacccuguucuuggaaccccacaaauucccaccacauauauauuuuuuacaacuuguaaacaagcaaaaaaugaauccacaaugcaucauauacuauaaaguauauauauaacacuccuuaaaugcaagaucugagauuucgagauaagauauaagacauuaaacaggauuuuuuuguuguuguuagaguuucgcucuuguugccaaagguagagugcaauggugugaucuuggcucacugcaaccuccgccucccggguucaagcgauucuccuaccucugccuccugaguagccaggauuacaggcaugcaccaccacgcccggcuaauuuuguauuuuuaguacagacaggguuucuccauguuggucauccuggucuugaacucccgaccucaggugauccacccaccucagccugccaaagugcugggauuacaggcgugagccgcugcgcccagccuguuuuuguuuuuugagacaaggucacgcucugucacccaggcuggagugcaguggugaaaucauaucucacugcaaccuugaacuccuggacucaaguaauccuccuaccucagccuccugaguagcugggacuacaggcacacgccaccacacccagcaaguuuuucuuuucuucuucuuuuuuuuuuuuuuuuugagauggaaucucccuauguugcccaggcuggagugcaauagcgugaucucagcucacugcagccugcgccucccagguucaagcaauucucccgucucagcacccuaaguagcugggauuacaggugugugccaacacacccaguuaauuuuuguauuuuuaguagaggcuggguuucaccauguugaccaggcuggucucaaacuauuaccucaagugaugcacccaccucagccucccaaagugcugggauuacaggcacgagccacugcucucagcuguuuuucuuuucuuuugguggagaaagggucucacugcguugaccaggcuggucucaaacucccggacucaaguuauccucccacaguggccucccgaaauguuggaauuacaggcgugagccucugugcccggccuaaaccuagguuuugguaugcgcaaauuuaccccaaugauuccuagcuauccauuaagugaaauccaguuuguaggaacuuaccgaacuguugaauugcucuaucagcgcuccaagguaauucuaaagucauaugaacucuucgccuuugauuuuuagcucuccuaucugcuuguaaugaaauacccgagcuggcagcuucugagaugauagcaauauucugugucaaauauaagaaaaauaaagucacuuuugcauaagaacaagcaggccagugccuuaaaugaaguccuucagcagacugccuauucucuccuucuuucucaauaaugaagacuuccaguuuuauuucccagucucccuuacggcuaagugugaacauucuccagccagcaagguguagguaaaauguaugaugcacaggaaauguccuuaaaaguaggcgacaugcccuucucauccccuugucuccucucuguuagguaaaauguagagguacugacaagagucuggaacagguaucuuggaauacaaagguaacuuggaaauggaggcccacauaauuuaaugaacaacacggaagaugccuggacuucaagagggcauacaagcccugcuccaccuacccaaauguguccaugagagaaauaaucuaucuuauugaagucaacacuuaacagacuuuguauuuucuguuauuuaacaaccaaaacuaauuccaacuaauguaauuccuaaugcauaugggccuagauucaugaagcaauuauauaaaauaacuaauaccuguaccuacaaucuugaaaauacguaacauuaucuuuuuguauauauauauuuuuugagacagggucucacucugucacacaagcuggagugcaguggugcaaucauagcucucuacaguuuucaccucucaagcucaagugauccuuucaccucagccuccucaguagcugggacugugggcaugugccaucaugugacuauuuucccuguacagggcagggucccauuauguugcccaggcuggucucaaacucuuguaauccuaguacuuugagaggccgaggcagacggaucauuugaggucaggaguucaagaccagccuggcaaacaugacgaaaccuugucucuacuaaaaauucaaaaauuagccaggugugguggugugugccuauauucccagcuacucaggaggcugaggcagagaacugcuugaacccgggagguggagguggcagugagcugagauccagccugggggacaaagugacgguccuucucaaacaaagucuacagaaagagucucugggccagcacaguagcucacgccuauaaucccagcauuuugggaggcagagguggguacaccacuugaggcauggaguucaagaccagccaggucaauauggugaaaccugucucuaucaaaaaauacaaaaauuagccaggcgugguggcgcgugccuguagucccagcuacucgggaggcugaggcacaagaaucacuuggacccaggaggugaagguagcagugaguugagaucaugccacugcacugcacuccagccugggcaacagaguaagacucugucucaaaaaaaaaaaaaaaaagagucucuggaggcacccaaaaucucuacaaugguuggauaugggaauguaaucuguaagccauuuacaguaaaucgucuuaauauaacaugacauagcaauaaaauaaacagugaaaccaaaauuacuaguaauauggacacacauaaauauuuuagucucaaaaucggaaugacauuagaugucacaacaccaagaugaacuaagggaacguuuuuuuuuuuuuuuugagacagucucacucugcugcccagguggaaaugcaauggugcagucuuggcucacugcaaccccugccucccagguuccagcuauucuccucccucagccuccugaguagcugggacuacaggcacaugccaccacacccgaccaauuuuuguauuuuuaguagagaugggguuucaccaccauguuugccagccuggucuugaacuccugaccucaugaucugcccaucucggccucccaaagugcugggauuacaggcgugagccaccacgccuggagaaaacacaguauuuuuauaucaugauuaaauauuucaaaagccuccaaagcacucaagagccauaucugauucuaugcauuacacacaauacuuauuauauucaaugauaaaauaauaaaaacaugcaaaauauucagugaguaaaggcaauuacuaaaaaaauuuguguaauagcucuguugcacaggcuggaguguaguggugcgaucucggcucacugcaaccugcauagcccaggguuaagcuauccucccaccucugccuucugagcagcugggacuacaggcaugcacuaccacacccagcuaaauuuuuguauuuucaguagagacgggguuucaccaugcugcccaggcuggucucaaacuccagagcucaagugaucugcccaccuuggccucccaaagugcuggaauuacaggccugagccacugcacccagccaauacuuacuauauucaaugauaaaauaauaaaaacacguacaauauucaguauguacaauuacuaaaaaauacagaaugacaauacucaauggacaugacuuauauuaaaaggaaaaagacucuucuaaagcuuaaucuaaauauacaggcauuguucuuuucacugagaagcaucucaguaaaacauaccuuaucuccauccauaaaucguuguuuuucugugauguuuaguauuuccacaggcacaucaaguucagaucuugacucauaagauaugcuuccaucaucauugcucacaacccgucccuugcggccagucaucugagaagccaaacaaugucauuacaaugaagguaucugacugcgguggauggacucagugccucuuuccuugaagacacuugggagauaagagcacaggcugugcugcaccacacacugaaggauacagaacacugcaacagagucccuggaaaaaccuugacacauggccacgaucacaaaagaugcgugauaagugcaguaacuaggaccaguggcuugggacagacacucagauacugcaggcagcaguucauuggauguaggauggcaacuaaaguagaacaagaauucuaugaucuaagaaauuuagauuauuaugugaagacagucaaaauacaacucauuuuacagggguucaaauggcaaaaaugucaccaagagauacaggccuauuuaccucagcaacguucucagggccaccaaguucaucgauaaguucauccaggguauuaggggggaggucuucagcuaauuuuucuagcuuaucaagcaggucuuucuucaucugcugagcccuuuccacagcauccugacuuguuauaaggcuacuguuacuguugguguuacuguuagcuagauaaagaacauuugcuaaaaguuaguacaaaguuuaaauauuuuuguuuaaaacaguauuucaaaaaggaaguuucuguauggauaccugguguacuguuaggagcaggugagauaacugguguagaugaaaaacuaggucguuuugauccaagaccugaugcuaauaaggcacuuugaauagaaucuggaucuauacuuuucuucuuuuuuuucucuuuguuuuucuuguggucuuuucuaauuaaccagggaucugaguguuaaggaaagauacaugucaaaucauuuguuaaaacaaguacagaaucuucaaaggaaacaaccuuugaaauuuuauuuuuuugagacaauguuucgcuguuguagcccaggcuggagugcaauggcgcaaucucagcuuacugcaaucuccaccuccuggguucaagcgauucuccugccucagccuccugaguagcugggauuacagguaugugccaccacaccuggcuaauuuuguauuuuuaguagagaugggguuuuuccacguuggucaggcugaucucgaacucccagccucaggugauccacccaccuuagccucccaaauugcugggauuacaggcaugagccaccgcgccuggaugaaauuuuuuauauuguuaacugauaacuuaucaccaccuacauugguucauccauacaccaugggguacaaauccauguuuucaaguuaaaaauaacugcacaaaauugagguuaucuucucacauauaugaggcucaaacuuccagaagguagauaagccuggagcuuuccaccaagcaaagauuauaaucugugugaucauuuguacuguacagaagaaaagguuucauaucccauuuucaaauauacugaaauauuauaugcuuucguguauauuuaauauacugaacuuaccauuuucaucauccucauuagacucaucuaaaaauggguugaaaucgucaucaucuccagaacucauguuuuuagagcucucauagucacuuucuucauuaucagaggcaucagauucacuuccacugucgucagaacugcuaccaguaaggccaccuacuuuucgugcuuuuuuggcuucucgaguuauuucuucaccuacccuccgccacaaacaagagagucagcccaaauucaauguuucuuaagauccaguacaucacauuuaguucaugaauuaauucaaaugaaaagugcagaggaaaaguauuuagguuaagucaaaaaacaaacagaauucacaaaccagcacuaaccuuuuggacucccauaaaaaauaagguuauaaacauuuauucugaagaagaaauuggauacaaaaguacuaagucaagacugccuucaagugcacaaguuucaaaacauauucaggacaacagaguaaaagcagaaccucuggcauagucacaauuugacuguguaucagauuugagaagaggccuaauaauuacagguuuauagacauggaauacuuagaaaaucaauagaaaaucaauuuauaaaaccuuuuuauuuuuggagacagggccucacuguugcccaggcuggagugcaguggcacaaucauagcucacugcagccucgacuucccuggcucaugugauccucccaccucagccucccaaguaccugggacuacaggcacaugcaaccaugaccagauauuuuuuuuuuuuccccagacagugucuacucugucucccaggcuaaagugcaguggcauaaucuuggcucacugcaaccucugccucccgaguucaagugauucuaaugccucagccucccuuauagcugggauuauaaggcgccccugccgccaguccuggcuaaguuuuuaauuuuuaguagagaagggguuucgccauguuggccaggcuggucucgaacuccugaccucaggugauccgccuguuucaacucccaaaaagcugggauuacaggcgugagccacugugcccggcgagaagucaacuucuaaaaccaaaacagggcugggcgagauggcucacaccuguaaucccagcacuuugggaggccuaggugggugcauugcuuaagcucaggaguuugagaccagccuggccaacauggugaaaccccaucucuacuaaaaauacaaaaauuagcagggcgugguggugcaugccuguaaucccagcuccuugaacccaggaggcagagguugcagugagccaagaugguaccacugcacuccagccugggugacggagacggagacccugucucaaaaaaaaaaaagaaaaaaaaagaaaaggcucuuuuaaagaaaacuacugaaacacccagcugucuauauauuaaagaacaggucugacaauacaaagacacagguuuuaguucccaugcaucauuaacuaucucugugaaacuaggaaaacucuuuaaucuuuaaaucuuucugugcuucaaugaucucugucuauaaaauuggaaaaauaagaccuaauuucguauggaccucugccagguuauaugguagaauguauauagccaagugcuuaacacacugccaaccaccagugaauugcucaauuccuaauuuaaaacggggauaacuugugcauucaaaauuguacaagugacagugaaaauuuggaaccauuugugaauucauggaaggcaguucauucccaaaauauagccacuuuaaaaugcuuauguuuuaauuucaacaguauuuucaacgucaacuauuuucuuuuuucuuuuucuuuuuugagacagagucucgcucugucauccaggcuggagugcagcagcgcuaucucggcucacugcaagcucugccuccuggguucacgacauucuccugccucagccucccgaguagcugggacuauaggugcccaccacgaugcccggcuaauuuuuuguauuuucaguagagaugggguuucaccguguuagccaggauggucucgaucuccugaccucgugaucugcccaccucagccucccaaagugcugggauuacaggugugagccaccgcaccuggccuauuuuuucuuuuuuaaagugcucaccuuuccgcuucuuuauuuuauuuucuuuacaaggacuaucucuuggcgaacuguuguuacuuggagcugucaaaucgauuccuaguaaacuauaaaguuuuuuccugucuggagcaggaaaauguuuuucaaugagugacugcaacacaccucuguaggagagaaacagugacaauuacugcuucaguugacaaaauaauuauauguaaaguauuauuaaauauauugaaauauacuuuguucaguuuuacaaaauacugauaaacgagcucaaauaaauuuuaauuuucuagcccaaagcuguccaacuaaauaauaagaaugcaagccaaaccacauacacaauuauuguauuuucugguagcuuaaauuaaaaaaguaaaaaauaaauaaaacugguggaacuaauuuuaauaauacauuuuaacucaauauaccaugucaacacauauguuuuauguuauuuucucuuaaggagucuuugaaaccuggcucaguacacauauaauaacaucucaauauggaccagucauuucaacugcucaauagccacaugugacaagcggcugccauucuggacacgguaguucuaggcaauuauguacagaaaaauauagauuagcagguguaugucuugcuuuuuucuuuuuuuuuuuuuuuuugagaccgagucucucugucacccaggcuggagugcaauggugccaucucagcucacugcaaccuccgccgccuggguucaagcaauucuccugccucagccucuccaguagcugggauuacaggugcccgccaccacgccuggcuaguuuuuguauuuuuaguagagacgagguuucaccguguuggccaggcuggucucaaacuccugagcucucgugauccaccagacucagccucccaaagugccuggauuacaggcgugagccccauguauugcuuuugaaaggagcaucugaaugcaucccgaggcacaaaauaguagagcagcaaguuuauuuugcucaguuuacuaccagaguuugaauguggagguuaggcaaacuaaaaacaaugccuaaaacauuuuaaaaucuauuucugaagaucucaugcuuauuuucaacuuuuaaaguagacuuuauuuuauuuuauuuuuuuuugagacagggucucacucugccgcccagaggggaguggaguggaguggugcgaucuuggcucacugcaaccuccaccucacggguucaauggauucuccugccucagccucccagguaggugggacuacaggacgugugccaccaugcccaacuaauuuuuuuuauuuuuaguugagaugggguuucaccauuuuggccaggcuggucucaaacuacugaccucaagugaugugcccauguuggccucccaaagugcugagauuacagcugugagccaccaugcucagccaacuuauaaaguagacuucguuauauuaggacaaacuauaguuacuguuccuguggauaacgguaauuucaaauacaguacacuaaaacugaaucuaagccaagcugucacagauuuccaagauguacaagauaaacaaagucuagcccuucuguuaguucacauacucuguguaauauuagcaaaaugcuuaacauuuuaggauuaugagauuucuguuauuguuuuccaauagauacacuguuacagaaaagcagaaaacucagaucaagaaaacuuaaagaugaugcaggugaaacaaaaguuuugucuccaggaaaugcccacauuggaacuaagguaaggaagaacucaaaaagaaacaaaaacauuaaaagaacaaaaacauuacuuggcaguugaaacaaaaucauucaauucucccccgcccucuuccaaagcuucuaauguucuagcuucuccuguagacugcagaccaauuacaacacacuggagaaaaaagaaaacauguuaauuaugaauaauaauguuuguggcuucuuaccaagacauauuuuaaacauuuagcuaaacaaagauuucaaacaagaauguccucauuauuauaaaacacaaauuuguuuuacuuauuucuucuacauauuugagacagguuauuugucaaaaauuuaggcaggagauaggauuacagacaguaguaagcaugagugaagccccugcccuuguacaguuuauaguaucuuaugcuuuaaguagauaaauauucaccgaaaagaaaaaaccuuaacgcaauacacauccauauguuaccagugcuaccagcuauggaugaccaauuauagugauguuuacuuuguuauacuuuucugaacucucuaaauucucuaagcaggcauugcuuuuauaauuuuaagaaauguauuuuuuagaaguuuuacuauccuuuaggaaaaccagauuuuacaagcagaaaaccucagcacccacaaagacuaaacaacauaacccccaaacaaucucuuaaugaguucuucuacuuacuuuuccauucuugauuuccucucgagcuaguugcacaacccuuuuaacuuuggaugcuaugcauaaguauuugaagaaccucuggugagcagaccagaacugaccccacauggacuucuucauucguugcucagcaucaaucagaucugcagcuugcugaaaccgcucucuggcgaugacccacugaagauacauaaucaacauuucagacacuucaucuuugagucuaguuauuuaaaaauaccaauuaaaucaaaacaauguuaagugcaagaccauuuaauauuaauuuaauaaaucaucuuuaguaacuugggaaucuauuucucaggauacucacacaguugucucaaguuucuuauuaccuaaugcagucauuuuagaaaauaaugugauuuuaagaacuaugcaacugaaauaaauggcuauaacuuaugaauuaccuuaacaaaaugaaaacauggacaaucugaaauauaagaacauugguuaggccaggcgcaguggcugaugccuguaaucccagcacuuugggaggcugaggcagguggauugcuugagcccaggaguuccagaucaggcugggcaacacuguaaaaccucaucucuaccaaaaaauacaaaaaucagccaggcacauugacaugcgccugcagucccugauacucaggaggcagagucuggaggacuccuugaaccugggagguagagguugcaguaagccaagaucacaccacuguacuccagucugggugacagaguaagacccugcuucaauuaaaaacaaaaacaaaaaaaaacacauugguuaaacagccuaucaucugguaacucaucuguuuguuuuuguuuuuuguuuuuguuuuuguuuugcgauggaguaucccucuguuacccaagcuggagugcacuggcaccaucuuggcucacagcaaccuccgccuccuggguucaagcgauucuccugccucagccuccccaaguagcuggcacuacaggcgcacaccaccaugcccagcuaauuuuuuuucguauuuuuaguagagaugagguuucaacauguaggccaggcuggucuugaacucuugaccucaggugaccugcucgccucagccucccaaagugcugaggcaugagacaccgugccuggcuucaucuguuguuuuauaguagaaauacauucccaugggcaggaggcaucgcaaucgccaaaacuaacagaaacauuaucagauacauuaaauaaacacuaggaauuaagaaaaauuccucaccagcuugacagcuuuguuauacauuuuaacguagcucugagaaagaagaacuuccucaauuuugaaggucacuccaguaaagcucaguugucgagcaauguacauuccucuaagcuucauauccauagcaacuauuuccauggcaccaacuccucugaauaaaauuaaaacauacaguaauuaccaauacaguagaauuuuaacauacagagaaugggcuuuaggaauaacacacuucuuagauugcuacugagaagaguauauaccguaaacugcauuaccuccguucuacugcuugaauaaaaucacugaauucucuaaauggaguacccucaccccauaugccaagacgguucauauaggccauguugcgugguucagaagcaccugaaaaucccacaaaugaaauauauuauaguugaaaaaauaaccuacaauauauauuuuuaaauaaauaaauacucaccaguugcacuagcauaaacaacucuggcuuuuggcaauuuguucugaagcucuaaaacugcuaagccugucuugguuggcuuugaagaaccaacaggacauaaguuuuuggcuuuaugacacucaucaaacacuaucuaaauggaaugaguuaaggaauguaucacauuaguauuaaguaagaaucuccagucuuucaagaagaguuaacuuuuauuucccugaggccuucugauugccuauuucaugacugcaaauacaaaggaaguccuaugggccuuuccccaguuacauccuccucccucucuagccucaaagacauucacugaauuuggaauuuaaaccagcaauuugccucuaaauuaaaacagagaaaagaacccacugcagcaagaaguuguuaucugguaacuuguaaaaguagaagcaugauugguaaccaacuuaaucagcauuucaaaaagugauguuccucaugcaggacaguuaaaagauauacugugaacaaguuugggaccacuaaguucuaacaguuuucuuucacuuagucuucucggguauucugcuauguaaauaugcaauguuaauccucaaaaggggaauacaguauucaguauuccucauaucuauuaacauuuuucuaaaccaggagauuaaacauuggucuccuaucugacagguaaaaaaccgaaucaacuuuccaaucccuuuggacucuagguaaucauuaaaguuuucacuccagcaacucguuuaaucucaagauuccuguuucccaaaggucuacccuuuuauaauuuucuugucguuaaaaaauagaaaaauauuugccauaaaggauaccacuccaucgaagucaucaccgcaccaaugcagaaguuguuuuaaccuaguuuuauacuugccgccagacuggcuuucaccaauaagugaagaguaaguagcaaaaauaacacccuuuuucacacucccauuauguuuggaagaaauuuuuccguauuuaaacuaaaaaagaaaagaaaagaauuuaguuaauuaguauaccuuucucucugcaacauucaucccaacuaaacauucacaagcaggaacucuuguuaggcccaugacaggcuucagaaaacauaaaaguacagagacgcaaauuuauuuguauaaauguacacaacacaaacacacaacuuuauaguacaaaaauccaguuuuugguaggacacaguggcucacaccuguaaucccaacacuuugggaggucaagguggguggaucgcuugagcucaggaguuccaagaccagccuggccaacauagugaaaccccaucccuacaaaaaauacaaaaauuagccaggcaucguggugcgugucugcagucccagcuaccacaggggcugaggugggagaacugcuugagccugggagauggagguugcagugagccgagauugugccacugcacuucagccugggcaacagagcugagaucuuuuuuuuuuuuuuuuaaauccaguuuucaaagucuuaaaaacuuuuaucaucacaaaaaaaaacauuaaaaaccagacaaacuucccuauaagaauaaaaagucacaauuuacaaacauuuauugugcacuuacuauaugcaaaacacugugauuaauuucugauacauaagaauuaugaguaauuguuaaugugccuuucuaauacuacucugaaauuuaaaaaaaaaauucuagaugccacuuacauccuuuuaguucugaauuguauacagucauucaagacacaguacuuuauagcuacaaauccacccaguaaaacccacccuaacaagccacuguuuagggcaacacugaauucaacuuaggacucacaugggaaguagaggugcaguuacuuauuuucaaagggcuacuagggaggcccuuccaggaacccuaucagucuauuuuaaccuuauagcaccaacaauuggugcaugcauaguaagucaauaaagauuugcuaacugaaccuuaacauucuaaaacacacuggcacacauugucuuucagcuuacagaauuguuuucaugugagcagagguaugaguaacucaaguccauuagcuguacaaauacugaaaccagucugcccaagccauaacuaucuacaucgcauaugauuuggugaccuauagugcaagguaugccaccugucuaaacugcacccuuauggcauauaaacuauaaaagaaagauaaaaauaacacugaaaauugagagaaucaacuggugugcacuguacacuugagagcacaucucaauuuggacuggucacuuacacuguucaauagccacaugugaugaguggcuacugccugucaguguuuagcauauaggaauccacaaaccaacaauaguggcuagcacucacuaugcuuucuguggaguaacaucaaaguuuuccaaaaaguguccccuuauauacauagcuauuauuauugucaucucacagaugagucaauauuuauugaaugaccaacugaauaaaaagauuucauaccuuauuuaacgaaugaaccaaaauguuuuuugcuccaauaucccuuaaaucucuuucagcaucauacuuuaagucauuugaaacacuaaaccugccaaaauauuaaaaagcacaaauuaaauacaaauuauaucauucuagaauucaggaauaaaauuaauaaagccaggucuugacacuuaaaaaaaaaaaaaaaaagaaaaagaaaauacacuuacucauuaaaacaccaucccacugagugcaguggcucacacccauaauccuagcacuuugggagccuaaggcaggaggacugcuugagcccaggaguucgagaccagccugagcaacacaagaagagcccguaucuacaaaaaauuagccaagcaugguagugcaugccuguagucccagcuacucaagaggcugaggcagaacugcuugagccccugagguagaggcugcagugagccaugaauaugccacagcacuccagccugggugacaaagauccugucuagauggggaaggcggaucccauccccacaugcuaaaguaauuacuaacaaaaccuuccauugagacggagucgcacucugucacccaggcuggagugcagaggaacaaugucggcucacugcaagcuaugccuccaggguucacgccauucuccugccucagccuccugaguagcugggacuacaggaacccaccaugacgaccggcugauuuuuuguacuuuuaguagagacggaguuucacuguguuagccaggauggucucgaucuccuaaccucgugauccgcugcgccuggcccacagccaguuuuuaaacacuuaccacaaugcucguuuucuacucaacaaauaauuuucauagaugauuccugcuaucguccuuccuuuuccuacaccggcaccaucaccuauuaagaagccagcacgaucuccauuagguaggaaaguuucauguugcugaaaaacaaaaggcugguaauuaauauaauccuucagauauuuuggugaucaaucuuucauacacuguuuuaggaguaggaauauguuauguuuuuuguuuuguauauguauuuugugacuuuauuuuuacauaaauuucauagaguuuuggauuuuuuuuugagacggagucucgcucugucgcccagguuggagugcaguggcgcgaucuuggcucacugcaaucucugccucccggguucacaccauucuccuuccucagccuccugaguaggugggacuacaggcgcccgccaccacgccuggcuaauuuuuucuauuuuuaguagaaacggguuucaccauguuagccaggaugaucucgaucuccugaccucgugauccgcccgccucagccucccaaagugcugggauuacaggugugaggcacugcacccagccaaauuuuauaguuuuggcuuuaauguggauacuuucuuuuuuuucuuuuuuugaaacggggucucgcucuguugccaggcugaagugcaguggcacaaucucggcucacugcaaccucugaauuccuguucaagcuauucuccugcuucagccucccgaguagcugggauuacagguaugcaccaccacgcccagcuaauuuuuuguauuuuuaguagacaggguuucaccacguugaccaggauggucucgaucuccugaccucaugaugcacccgccuuggccucccaaagugcugagauuacaggcacgagucaccgcgcccagcucaaugugaauacuuucuacauauuuacuguauauuaucuccugcuacucuuccaugcaccagguaaugaaaguuaacaaauuagugaggagcccgccauaccccuuaucaacaccugcagaaucaaacagguuuuuguuuguuuuuguuuuguuuuguuuuugagacaguuuugcucuuguugcccaggcuagagugcaauggcacaaucucggcucaccgcaaccuccgccuccugaguucaagugauucuccugccucagccucccgaguagcuaggauuacaggcaugugccaccacgcacagcuaguuuuuguauuuuuaguagagacaggguuucaccauguuggccaggcuggucucgaacucccaaccucaggugauccgccagcuucagccucccaaagugcccggccagugguuuuuuaguuuuuuucagacagagucucacucugucguccaggcuggagugcaguggcacaaucucagcucacugcaaccuccaccuccuggguucaagugauucuccugacuuagcuucccaaguagauggcacuagagguguguaccaccaugccuggcuaauuuuuguauuuuugguagagacaggguuucaccacguuggccaggcuggucucuaacuccugaccucagggugacccgccugccucagccucccaaaguacugggauugggccgggcacgguggcucacaccuguaaucccagcacuuugggaggccgagauggguggaucaugaggucaggagaucgagaccauccuggcuaacacgguaaaaccccaucuccacuaaaaacagaaaaaauuagccgggcguggcggugggugccuguagucccagcuacucgggaggcugaggcagaagaauggcaugaaccugggaggcggagguuccagugagccaagaucgcaccauugcacuccagccuggacgacacagugagacuccaucucaaaaaaaaaaaaaaagugcugggauuacaggcgugagccaccaugcccagccaaauuaaaaguuuuauaucacacaaaauauggaggauaaauggcuauuuuggucauuacuuauuuuacagauauggaauaugacugaaaucauuucaagacaacugcuuaacucuaccucacaucauuuuaaaagcccacacaacaccccacuguccaauaauaucacaguuuaugcaauuaccccccaauaauguggaugcucaaaucuuuuccagcuggagggacaaaagguacaacaaauaucauucugcauauguucuuaucuaacaguuccagggaacacacuccuaggaauggguauauauacacacacauauacauauauauaauuuuuuuuuuuugagacagggucucguucccaucacccaggguggagugacaagaucacagcuuauugcagccucgacuuccugggcugaggugauuccccuaccucagcuucccgagaaacugggacuacaggugcgugccacuacacucagcuaauuuuuuguauuuuucguagacaugauguuucaccauguuacccagacuggucgcgaacuccugggcucaagcaauccacccaccucagccucccaaacuguugggauugcagacaugagccacugugccuggucgauauacauauuuuuaauuuuaauaaauauucccaguaaauuccaagcaaguuauaacauuugccauuuccacuggaaaugcacuaucuguaucucugcuacacuucuaaaauuuaauuuuccaacacauuaaacuuucauaaauauuacauuuacaagguuuucauacaaggaaaaguuaccuuuagauugaaacaacucuguuauauagaauaggauaaaauaauuauuguauuaugaaauauuauugcuuaccugggcugcauauguaauugccucaagcugcaaugcugauaaccagccauuaucaaugguuuccucagaaauggauguuuuguaccaaacaucaggaggaguaacacuggauaaagagcugguuuccacuacagcaucuggaugacguaggccaauuuuuacuaaacaaaaauguaaaaacauuuuauuuuaauuauucuaaguaauaacauuuccaguuucauuauaagauauuucaauguuuuucuuauaacauagaaaaauaauuaaaaaguauucacucugagcuuccauaaaaaguaacugaugacaaaguacuaucuauauuugacuaaaaugauuuaucaacuacauaugguuaaaacagagauuugggccagguggguggcucacgccuguaaucccagcacuuuggggggccaagguggagggaucacuugaggucaggcguucaagaccagccuggccaacacagcaaaucccugucucuacuaaaaauacaaaaauuagcugggcauguuggcacgcgccuguaauuccagcuacucaggaggcugaggaacgagaauugcuugaacccaggagacggagguugcagggagccgagacugugccacugcacuccagccugagugaugcagugagacucugucucaaaaaauaaauaaauaaaauuaaauaauaaauaaaauaaaauagagauuugcugauaaaaaaaagaucuaaaaaaacaccacuugguucauaacagcagguucucuaguaguaacagaacauaaugccagauuaaggaguucaguuacuucaagcauucauucaguaaaacaaaaguuugcaauacaauuuuauuuugaggcuaggcaugaagguucaugcuuguaaucucagcacuuugggaggccaaagcaggaguaucauuugaggccaagaguucaagaccagccuuggcaauauagugagacccucaucucuacaauuaaaauccaaaaauuagcugggcaugguggugggaccugugguccgagcuauucaggagucugagacaggaggauugcuugagccuuguaggcuaaggcugcagugagcuaagauugcgccacugccuggcugggcaugguggcucacgccuguaaucucagcagcugggaggccaagguggguggaucuccugaggucaggcauucgagaccagccuggccaacacggugaaaccccaucucuacuaaaaauacaaaaaucagccaggcaugauggugcacaccuguaauccuagcuacucaagaggcugaagcacgagaauugcuagaauccaggagggauccugggagguggagguugcagugaggcaagagcaugccacugcacuccagacugaguaaagagccagaccccgucuuaaaaagaacauauuuuacuuugaaaaguauucgaaagacaacuuggcuauaaaauuuaacaaccaaguccccaaaauguacaacaugaauacauuaaaauaaugaucuggaagcuuuuucuguaaagggucagagaaugauuuugccguuuuaggccauccugucucuuguacaacuacuuaacauugcugcuguagugucaacgcagccauagauaauaaguaaaccaauaaacaugucuauguuccaauaaaaccuuauuuacuauaaaaaagcgagugguccagauuuaguuugcuguccucugguuuaaagggccauaaacucuuucaauccuuuugcaaaaugauuauuggaauaagaaaaacagaauuucagauaggacuucuaaaauucauuguaggugagcagaaaaggauggaaucuugagucuaucaguaguugauaaaaagagaauuguaguucaauucaaaugguauuauuagugguuuuuuauagaaaccaagacuacaugaaagacaaauucuagacauagauuuguuuccuguaaugaaaaagugaaaauuuuaugcaaauauuaaaaaccuaauuuucgacuucauacaguggcugcuaaaaaaagaaccauguuauacaaaagggagaaacaaaaacuauggaauucaaauagcacaauuauuuuuauaauuucaauguuuuuacaauuuuagacaaguuguauuaaauaucuuagcuuuauauaucuuuacaauuaccuuugauuuuuauaaucacuacuccuaugaacaaaauuaaaauaaaauccaagcuucuuuaguuuugguuuuaaaagacuuugaccuaaagcaagauucuaaauuuauauggaaaaaaacaaaacaaaaagaaccaaagaaaccacaggaaaacuuugauguaaauaucugacaaaucccgaagacauacauuuuauuggcauguauucugcauagguuucugcaugacccauuucuucuucaucuucuuccucugguucaucaucuucuuuuacaacaggaaccuucugcaacacagaaagagcacaaucaaucccaaauccagggaccagacgcccagccaacacacagaaaaacucucuuguaggaacaccuacaaauuuccaucauggaaacaugacgcgccaccucaauacucccuaaaaucugggccacacuucguggcuuuccugcuucuccaauaaugagcacagacaaugagguccuacucugucucuuacccacaaaugggucacaagacuccacguccuuccggccaccaucgugucaagcuacuuuccccuucaauacugccuaucaccccuccuugaugcccagaacucucucugcacucagacuucgccuucauucuaguuccaggagaaagagcaagcagugugucuggcucuuccuagugcaaaacuggagugaacccuagcaaagguggauuggccccaaaggacccugcaucaccacaagcaaggccucucagucucacauuccaccuucuucucaguucacuucuauuugccugcuuucccgcauauccuaaaaccaaaaccccagaagacuggaguuuauuuuagaggcccuuaugaagaacagaaaaauuuacuucagacuucugugucuccacagaugcaaucgugaucauauauaagauggccauauaauuuauuuuccaaacccuggcacauuugaguuggggagcuauugaggauuacacugagaaaacagaaguaaacccagacuguccucggcaaaccaagugaauggucaccacgguuaugcuucccuuuucuuccucuacaggaucuuaaaggaauaaaggaagauccggaauaagccacuuuucacuaccaguacaaucauuaggcaacuguuuauuagcaugcacuuguucagggaagaauauaaagaaacuguugugaaacucaguaugccaagggaagaggacaacaaaaaccuacagguuaaggcaaauuaaggcaagaucgagacagcauuaaaagugaaggacaggcucuuuuuucauuuaccucagaaucuagagcagaauaugguugcaaauagauaacaaacgugaaaaggaaaagaagugggacauaaccauccaaucaacauuaaccuauggagucuuuagauaaaaucuaaaaacuuggaauguucucagaaauuaugcuaaaauaaaacucaauuucggaaauucgagacaaaacaggacuggccaaaugaauagauuugaaucccaauucugcuguuauuuaauuguguagucuguuuuuuaauuuaggcaaauuaccuaaauucuggguccucuccacccccaccgucuaacccuguccucgcuuauaaaauaaaaauguauucuauguuaagauaagcagccuccuuucucccuccauccuuuauucuccuaccuauaguuuuuuaaaaucaucauaaaauugaugauaauugaauaacugaaggauaaguugguaauacugaaggaccacuauauccagggaacaaacaaguaauaccuugaagccaggugcaugugagauagcaacugacaucaaauuuaggucaaagagauaacucgggugagggagaccacgguaccugggaaauguuugcccaacauaccauguagauguucacuacacaacgcugggcaaaucuuccuagauggggaacgugggccugggguugucagguacucccauuuuucaaaauaaccgggaaaucaggauuuguauaugucagcaaacaaauucaaaauucuucaaaauaccaugaaggccaaacaaaauacauuugucagccaggcaugguggcucacgccuguaaucccagcacuugggcaagcaggggugggcggaucaccugaggucaggaguucaagaccagccuggccaacauggcaaaaccccgucucuacuaaaaaauacaggccaggcacaguggcucacgccugaaaucccagcacuuugggaggccgaggcgggugaaucacgaggucaggaguucaagaccagccuggccaagguagugaaaccccaucucuauuaaaaaauacaaaagaaaauuagcagggcguaguggcgggcgccuguaaucccagcuacuugggaggcugaggaagagaauugcuugagcccgggaaggggagguugcagugagccaagacugcaccaaugcacuccagccugugacagagcgagacuccaucucaaaauaaauaaacaaaauaaaagaaacaaaaauuaucuggguguggugguggugguggggggcgccuguaaucccagcugcucaggaggcugaggcagaagaaucacuugaaccugggaggcagaaguugcagugagcugagauugcaccacugcccuccagccugggugacagcaagacaccgucuaaacacacacacacacacaccccgacacacacacacacacacgccccccccccccuccccgacuaguuugguugaugggcuaucaguuugcagucucucugagauguuacuuaacugcuaagccaauaaaaaacuuuugguauauaauggacugaaauggaaaugugagaaccacauaaaacauuucuugaagaaauaugcauucuuaguuuccaaaaaucaccuuccaagugcuguugguagacaaucacuaaguaaacuggguaccgccaguagcacuauuguucuccugguucccauucaaaaccucagcuacaguuugcugcacugucuccaauuccauauucuagaaccaagucccaaaauucuuuugguaucguuauguacagucaucucuuuuuuuccuuuccccucuccguuuuucaauccccucugcaaggucucuaguaccccuucuuacuucccccuuagguuaaccaacuuuccaaccucucucuuuugccuacuccuacucaucccgaaucugucuucccuaccccuuuacucagucugcaccccaacuucuccugaaucacuaacaggucccuccaugucuacuggcucaauggugcuagacuaaguccaaaguccuucaaacucaauucagcacagggcaccuuggccucccagcacuuugggaggccgagcuggagggaucacuugaggucagguauucgagaccagccuggccaaugugguaaaaccccgucucuacuaaaaacacaaaaauuagccagggcugguggugggcaccuguaaucccaccuacucaggaagcugaggcagaagaaucgcucgaaccugggaggcggagauugcagugagccaagauugcaccacuacacuccagccuggucaacagagcaagacuccaucucaaaaacaacaacaacaauaaaaaccucaauucaggacccuccauggagcccagaccuacuauucccacuucuuucuacaagcuaagcuuccuggcuuauuuucaccgaagcacauacucacuaccuccccucugugcccauuaauccuuuagcucccuuccuaauaucccaccucaaagucucgucauacucaaaacccaagcuccauuauucccucuccauaaaguccaccaggccacuagaguucaggaaggucaccucuuccuccaaauuccuaaccuuuauugugaguagcacauugcauaccauuugauguacuuuucauuauuacuacuuaauccagaugguugucaaauuuugcuuacugaagguagaaucauguaauaaauauacuucuuguagaaaccuacuacauauuaacaauguuauacauggagaauuuauuaaauaaauguauggaaucaauugauccaaagcauacagcauuuucaaaauguuaagaauucuaaccaggccgggugcaguggcucacgccuguaaucucagcacuuucggaggcugaggcgggcagauuaccugaggucaggaguucgagaccauccuggccaacauggugaaaccccauuucuacuaaaaauacaaaaauuagccaagcaugguggcacaugccuguaaucccagcuacuugagaggcugaggugggagaaucacuugaaccugggagguggagguuacagugagccaagauagcaccacugcacuccagccugggcgauaagaguaagacucugucucaaaaaaaaaaaaaaaaaaaaaaaagaaucacucauaaccagaucauuauaugaucugucaaugcauuaugagcuuucuauucaaguucgguccuaaaaugaacacaguuaucaaauacuuuucguuaaccccacauugucuuuuuuucugcucagaugagauuuuuaacaguaagauaucaguacugcauguuagugccacacuccaucaaucugcaaguuuuaaccacccugguuaguaucuauauuacuccagcgagguuuaagcauauccauuaguucccacgccuguauagcuucuucccaacccaaaaacagcuuucugaggguuguuccauauagaacacuuuuaguugaguacacucucauacuacacaaaaauaaagacacaguuauuugaaacucaccaugguuggggaaaaacuccucaucuucaugucguuuauccacauucuagcuccuucuuuauuagaagacucuuucuuuacuguaccauugcuuacaucagcugaggaggaaaaagucaaauuacauuuagaagaaaauucugaacuuauuuucccauuauuuaaaaauccagaaguuuaaggcugcugcgguggcucacaccuguaaucccagcauuuuugggacaccaaggcgggugaauuacaaggucaggaguucaagaccagccuggccaagauugugaaaccgcaucucuacuaaaaauacagaaacaagcugggcgugguggcgggcaccuguaaucccagcuacucgggagacugaggcagagaauugcuugaaccugggagguggagguugaaaugagccgagauugcaccacugcacuucagccugggugacagaacaagacuuugucuaaaaaaauaaaaauaaaaaacccagaaguuuacauauuucaaaaaccaaagaaugucaaucugccuauaacuaauuuauuuuuauuuauuuauuuuuggaguuucacucuuguugcccaggauggagugcguuggcgcaaucucagcugacugcaaccuccuccucccgaguucaagcgauucuccugccucagacccccaaguagcugggauuacaggaaugcgccaccaugccugccuaauuuuguaauuuuuuuuuuaaguaaaaacggaguuucuccauguuggucaggcuggucuugaacucccaaccucaggugaucugcccacuuuggcaucccaaagugcugggauuacaggcgugagccaccgcaccuggccucuauuacuaauuuaaauuaagcacaggcaugaaaacauguaaacccaugugucuuuauggaaguaaagaauuaacuuuagaaaacaacucaaaaggaacgugugcaagggaagcuugaaaauuauuuaucagaaagauacccaaaagccagcauuacuuugagacacuucauuugacucauuaaaaauaaacaaggccggcgcaguggcucacgccuguaaucccagcacuuugggaggccgaggaggcccagucucuacuaaaaauacaaaauuagccgggcaugguggcgcaugcucauaaucccagcuacuugggaggcugaggcagagaacugcuugaacccgggaggcggaggcugcagugagcugagauugcaucauugaacuccagccugggcaacaagaguaaaacucugucucaaaaaaauuaauuaauuaauuaauuaaaauuuaaaaaaauacaaaaaaaaauuagcugggcgugguggcgggcgccuguagucccagcuacuagggaggcugaggcaggagaauggcaugaaaacaggaggcagagccugcaaugagccgagaucgcgccacugcacuccagccugggcgacagaucaagacucucaaaaaagaaaaaaaacaaaaaaacccaaaaccugggguuaucacccaaacagaaucaauuucaugugaucuggugguacuuacuaauuuucaaggcaaaauaauuauuucuagaagaagaaaaaucaauuugggaacuccuuacuuccuccugcucccagaguaaagaucuaaacaaugaacacuuucuucuauaccacugguuuucaaacucuuuuaaauauagcaauaaaaucucagaauccacuuaucaaucagcagagcuacuugacugaauaggggugggagguauccaguccagaaccccuggaaccagccuucagccuccaagaaucccugaaguccucacaguaccuggaauucuugagauagaggugcggaaaucacugccuuuagggaagagagugcuaacaucaggagagcugaucagcauuucaucuauucuagcaaaagaugaagaguauuugggaggacuaucacuuagacuccaaaacgaguacaacuaauuaaaguauuaacaggccaggugcucacgccuguaaucccagaacuuugggaggccgaggugggcugaucacuugaggucaggaguucaagaucagcauggccaacauggugaaacccugucucuacuaaaaauagccaggcuugguggcucaugccuguaaucccagcuauuugggaggcugaagcaggagaaucacuugaauucaaguggcagggguugcaggaagccgaggucgcgccauugcacuccagccugggcgauggaaugagacuucgucucacaaaaaaauaaaaaauaaaaauaaaguauuaacuaaacaaggaaacuagaacagagaugauauuugggggcaugguuuguuuauuuuaacugugaaagagccagugaucagcuccuaguuuuaagaccagagaaauugugacagguuagaacccaaaggggcaacaaccacacagauaagaaguagaacaugcaacaccuugcuuucugcaguuucauauuuucaauguuuuuccccuucaguaaaaagaggaccaucuccuacaacaaaaaacuuugcuugucuucagcauucacuuaccaucuuuuuuuuuuuuuuuuuuugagauggagucuugcucugucgcccaggcuggagugcaguggcgccaucucagcugacugcaaccucugccuccuggguucaagcaauucccugccucagccucccaaguagcuggaauuacaggugcccaucaucaugcccagcuaauuuucauauuuuuaguagagguggaguuucaccaucuuggccaggcuggucuugaacuccugaccucgugauccacccaccuugggcuccaaacgugcugggauuacaggcaugagccaccgcguccggcccaucuuuguuucuuaguccugaccuagcuugacaguuucucaggcuuccauacauggauagucuugcugugcagccugauaaaugucugcauuugucuuuuaaaaaucacuaccuuaaaugugggagaauuuacuguacuagauaucuuguucagucagcuccaaaucuaucccguuuucuguuguguucucuaaauucuucccucacaauggcauacauccacuccuuuaaguuaugauggcauaugcugaugugaggaguacaaugcucagaaagccacucauauaagaagcaggcuuccucauuaaauccaaagaccguaacgagaagcaucuuccaccaacugucgaccauccccaagucccuugcgagugauuccagaaacugcccugcaccucagccaggucagggucacagugcugcacuccacggcagaaaaugguaucaguccuaagacagcuaaaaugauuucccaacuugcaucucacugccagguugcagucaguucaggacaaugaccuugagaggagaaccaaaaaacgaaaaccaaaagacaaaaaacuacagccacaaggacacagugguauggacccaaacauaaaaaccagaugaucugaaaauuuuaaugacaucugucacuuaagacaaaguucuacaucuuccuauaaacacuuaucgcccauucuuuuagaaugcucuuagcccucuauuucauaaaaacacaagcaggccgggcaugguacucacgccuguaaucccaacaacacuuugggaggcuaaggugggcagacugccugagcucaggaguucgagaccagccuggccaacacagugaaaccccgucucuauuaaaaauacaaaaauuagcuaggugugguggcaagcaccucuaauuccagcuacucgggaggcugaggcaggagaaucacuugaauccaggagacggaagcugcagugagcagagaucgcaccacugcacuccagucugggugacagacugaaaauccgucucaaaaaaagaaaaaagaaauguagaauugugggcucuacugagaaucagauucugcuuucaaacaagauccacagaugagucacaaguaaacagcuauuuguaaaggauuuguaaaggauuaagaaaaauguuaacugacuaccuauaauauauaaaacugguaagauuucauguugcuaacguagcuaccugaugauccuagaaaucacauuucaaagcuaaacaaccuacccaaggcaucuaaacuuuugcuucccuugaauuguguuaaagacuguaaguacgcaaaauaaugcauauaacacccuuuuauggccaguucuuuaaaaacccaagcaaaucguuuaaaaaaacaugcugacauagcuuaccagagagagaaaguugauacuauugaaaacagacuuacuagcugcuguugcuacuggcugagcaauauuagcagguggcuuuaguuucaucaguucauuaagacuauuauuuuucaguagaucuuuaagcugaacuuggucuuuugaaggugcagaggucauggcauuucguacuguuggugcugagacugacgggcgugugcuugcaguagucuggauaaacuuaguuaaagugaugguuugccuguugguuguuacaggugguguuuuagucauuacaauuguagaucccaaggguggaagaugauuuauuugauucagcacaaauguuguaguagauggaggcugcugcuagauagaaaacaaaaaacacaccacugaaaaaugcuucauucucuaaugaagcuuauauccacaaaccuggaaggacaacuaaaaaucuaaaaugcacuuuuauuauugcuuuuuuuuuuucuuugaagcagucucauucugucaugcaggcugaagugcgaucauagcucacugcagccuugcccaacugggcucaagugauucuuguaccucaaccucugaaguagcugggacuacaggugcacaccaccaugcccggcaaauuuuuuuuagagauaagagucucccuauguugcucagguuggucucaaacuccugggcucaugccauucucccaccucagccucccaaagugcugggacuacaggcgugagccacugugcccagccuugccuaaauauuaguacuucauuucugauuugauuagcuacaaauuaccaaguuaaacggacaacuuugacgaaaagaagguauaguuguaauauaacccuuucuauaacugucagggauggcaagcauaaaauggaacuaucccacacaaaccgaaaauaacaggacuaagccaggcacaguggugugcaccugcauuuccagcuaauugggagggugacacaggagguucacuugauuuuaagaccagccuuggcaaaauagcaagaccccucccaccccaaucuccccaaaagacuaguaacagaaaguuucuaaugccuugauugaugacauuuucacuuuuuuccuccucaacacuauuugcuauuucuccacuacuccuuuaauaaugagucuuuaauaaagagucuacuauuggccgggcgcgguggcucacacuuguaaucccagcacuuugggaggcugaggcgggcggaucacgaggucaggagaucgagaccauccuggcuaacacggugaaaccccgucucuacuaaaaauacaaaaaauuagccgggcgugguggcggaugccuauagucccagcuacucgggaggcugaggcaggagaauggccugaacacaggaggcggagguugcagugcgccgagaucgcgccacugcacuccaaccugggcgacagagcgagacuccaucucaaaaaauaaaaaauaaaagaauaaaaauaauaaagucuacuauuuacaacuuuuuucaauauuuugacuugucaucaaugaccguguuauauaucuucacguacaaaucuguuuuuaaaaauaucuuuguggggcugggagcgguggcucacaucuguaaucccagcacuuugggacgcugagaugggcacauuaccugaggucaggagcucaagacuagcauggccaacaugguaaaacccugucucuacuaaagauacaaaaauuagccaggcaugguggugggcgccuauagucccagcugcuuggaagguuaaggcagaagaauugcuugaacccaggaggcagagguugcagcgagccgagauggugccacugcacuccagccugggcgacaaagcgagucuccgucucaaaaaaaaaaaaaaagaaacaagaaugaaagaaaugugucgcaaaguaggagguaaggguaggauauugggaaagcggcaaaaagcagaacuagagagagaaaacuauuucacacuaaaaaguuuuuuauuuuuuauuaauuaugcuuuuuuguuguuguuguuguugagacagagucucgcucugucacccaggcuggagugcagcggucccaucucggcucacugcaaguucuaccucccggguacaugccauucuccugccucagccucccgaguagcugggacuacaggcgcccgccaccacacccggcuaauuuuuuguauuuuuaguagagacgggguuucaccauguuaaccaggauggucucgaucuccugaccucgugauccacccucccuggccuccaaaaguguugggauuacaggcgugagccacugugccuggccucuuuuuuuauguuuuuugagaugaagucucacucugucgcccaggcuggagugcaguggcuuggucucugcucacugcaaccuccuccacuuccuggguucaagagauucuccugccucagccucccaaguagcuaugacuauaggcgugcaccaccacaccaagcuaauuuuuguauuuuuaguagagauagagauggaguuucaccauguuggccaggcuggucuugaacuccugaccucaagugauccacccaccuuggccucccaaagugccaggauuacaggcaugagccacugugcccagcccauuucuucuuuuauagagaugggguccugccauuuugcucaagcuggucuugaauuccucggcucaagcaauccuccuaccucagccucucaaagugcugagacuacaggugcgaaucaccacacccggccauguuuucucacuacacuucuaaacuauuuuagaaguaacgacgaaucuaaaucauucuuacccucacauuuaauagugcuggaguagguacagucucugguucuuguuuaacaggaacugcugcuucggucuccaaaccuaguucuaaugcacuaaguggcacugacuggagagaaaacaacaucagacaaaaaauaaaaggacagcaguaaauucuguuucaaggacaagguuugcauuuauuaaaaaauaucaaguuuaacauucaaacugacguuaaaucacuaacagcagauuuauaauguaauaaucuuugcaagcacaagaucuccacaaaacgguacuaacaauuccuuuuuuaaaacauuuuuguaggccgggagugguggcucaugccuguaaucccagcacuuugggaggccgaggugggcggaucaugaggucaggaguuugagaccagccuguccaacauggugaaaccccaucucuacuaaaacacaaaaaauuagcugggcuuggccaggcgcaguggcucacgccuguaaucccagcacuuugggaggccaaggcaggaggaucacaaggucaggagaucgagaccauccuggcuaauguggugaaacccugucucuacuaaaaauacaaaaaauucaccgagugugguggugggcgccuguagucccagcuacuugggaagcugaggcaggagaauggcgugaaccugggaggcggagguugcagugaguggagauugcaccacugcacucuggacugggugacagagcgagacucggucucaaaaaaaacaaauaaauaaaacaaauaacuaaauaaauaaaaacauuagcugggcuuggcggcggcccccuguaaucccagcuacucgggaggcugaggugggagaacugcuugaaccugagagguggagguugcagugagccaagaucgugccacugcacuccagccugggugacagagugagacucugucucaagaaaaaaaaauuuuuuuuagucuuuuuuuuuuuuuuuuuaaggcuagucaggugaagcagucggaguagaggagaaacaaagaaaucuguaacuggcugugaucaauuaccuguaaacaacacugcacucggaccagucuauuuuuuuauuuuucagaaacaaggucuugcucugucacccaggcuaaagugcaguggcacgauaacaauucacaacagccucaaacuccugagcucaagcgauccucccaccucagccuccuggguagcugggacaucaagugcacacaaccacggccaccuaauuuuauuuaacuuuuuguagagacaaggucuugcuacguugcccaggcuggucucaaacuccugggcucaagcaauccuucagccucagccucccuaagugcugggauuacuggcaugagacacuaugcccagccagaaucuuacguuuuugcuuucagagaauguauauaaugaaaucacagaagaauaucccuaaauaauuaaacaacuauuaaggaaauuaaagauacucccacaagaacacuaaacaucucuuacacuaucuauacguuuauaauaacaucaaagcagaaaauaauguuuugguuuucauuauuauuuucugccucauaaaucaaaaugaauacucaacauaaaaauaacauuuggccgggcacaguggcucacgccuauaaccccagcacuuugggaggcugaggcaggcagaucacaaggucaggaguucgagaccagccugaacaacauggugaaaccccaucucuacuaaaaauauaaaaauuagccaggcgucguggcccaugccuguaaucccaacuacucaggaggcugaggcaagagaauugugaacccaggaggcagagguugcagugagcugagauugcgccacugcacuccagccugggugacagagcaagacuccgucucagaaaaaaaaaaaaauuaacacauguauuuaaaauuaaggcuucacauguauauuuaaaauugggccaagcuuggcucgcaccuguaaucccaacacucugggaggccgagguuggcaaucgcuugagcucaggaguucaagaccagccugggcaacauggcaaacccugucucuacaaaaaagacaaaaaauuagcgggaugugguggcacgugccuauagucccagcuacuuggggggcugaggcagaaggaugguuugagccugggagguugaggcuucaguaagccaugacugcaccacugcaccccagccugggccacagagugagacuaucuuaaaaaaaaauacuguaagcggaaaucacuaagaaagagaggcuuuggaaaacucuuaccugcugaacugacgggguaggcauuggaguugcaagcccugcaucuccaccaucaauaucaaagaggucauucggacuaauuccacucucacucaaagcagcaagcaguaaaucuugcccuggcuccaccau

SEQ ID NO: 191526 - RNA, 61333 nt, Homo sapiens
augguggagccagggcaagauuuacugcuugcugcuuugagugagaguggaauuaguccgaaugaccucuuugauauugaugguggagaugcagggcuugcaacuccaaugccuaccccgucaguucagcagguaagaguuuuccaaagccucucuuucuuagugauuuccgcuuacaguauuuuuuuuuaagauagucucacucuguggcccaggcuggggugcaguggugcagucauggcuuacugaagccucaaccucccaggcucaaaccauccuucugccucagccccccaaguagcugggacuauaggcacgugccaccacaucccgcuaauuuuuugucuuuuuuguagagacaggguuugccauguugcccaggcuggucuugaacuccugagcucaagcgauugccaaccucggccucccagaguguugggauuacaggugcgagccaagcuuggcccaauuuuaaauauacaugugaagccuuaauuuuaaauacauguguuaauuuuuuuuuuuuucugagacggagucuugcucugucacccaggcuggagugcaguggcgcaaucucagcucacugcaaccucugccuccuggguucacaauucucuugccucagccuccugaguaguugggauuacaggcaugggccacgacgccuggcuaauuuuuauauuuuuaguagagaugggguuucaccauguuguucaggcuggucucgaacuccugaccuugugaucugccugccucagccucccaaagugcugggguuauaggcgugagccacugugcccggccaaauguuauuuuuauguugaguauucauuuugauuuaugaggcagaaaauaauaaugaaaaccaaaacauuauuuucugcuuugauguuauuauaaacguauagauaguguaagagauguuuaguguucuugugggaguaucuuuaauuuccuuaauaguuguuuaauuauuuagggauauucuucugugauuucauuauauacauucucugaaagcaaaaacguaagauucuggcugggcauagugucucaugccaguaaucccagcacuuagggaggcugaggcugaaggauugcuugagcccaggaguuugagaccagccugggcaacguagcaagaccuugucucuacaaaaaguuaaauaaaauuagguggccgugguugugugcacuugaugucccagcuacccaggaggcugaggugggaggaucgcuugagcucaggaguuugaggcuguugugaauuguuaucgugccacugcacuuuagccugggugacagagcaagaccuuguuucugaaaaauaaaaaaauagacugguccgagugcaguguuguuuacagguaauugaucacagccaguuacagauuucuuuguuucuccucuacuccgacugcuucaccugacuagccuuaaaaaaaaaaaaaaaaagacuaaaaaaaauuuuuuuuucuugagacagagucucacucugucacccaggcuggagugcaguggcacgaucuuggcucacugcaaccuccaccucucagguucaagcaguucucccaccucagccucccgaguagcugggauuacagggggccgccgccaagcccagcuaauguuuuuauuuauuuaguuauuuguuuuauuuauuuguuuuuuuugagaccgagucucgcucugucacccaguccagagugcaguggugcaaucuccacucacugcaaccuccgccucccagguucacgccauucuccugccucagcuucccaaguagcugggacuacaggcgcccaccaccacacucggugaauuuuuuguauuuuuaguagagacaggguuucaccacauuagccaggauggucucgaucuccugaccuugugauccuccugccuuggccucccaaagugcugggauuacaggcgugagccacugcgccuggccaagcccagcuaauuuuuuguguuuuaguagagaugggguuucaccauguuggacaggcuggucucaaacuccugaccucaugauccgcccaccucggccucccaaagugcugggauuacaggcaugagccaccacucccggccuacaaaaauguuuuaaaaaaggaauuguuaguaccguuuuguggagaucuugugcuugcaaagauuauuacauuauaaaucugcuguuagugauuuaacgucaguuugaauguuaaacuugauauuuuuuaauaaaugcaaaccuuguccuugaaacagaauuuacugcuguccuuuuauuuuuugucugauguuguuuucucuccagucagugccacuuagugcauuagaacuagguuuggagaccgaagcagcaguuccuguuaaacaagaaccagagacuguaccuacuccagcacuauuaaaugugaggguaagaaugauuuagauucgucguuacuucuaaaauaguuuagaaguguagugagaaaacauggccggguguggugauucgcaccuguagucucagcacuuugagaggcugagguaggaggauugcuugagccgaggaauucaagaccagcuugagcaaaauggcaggaccccaucucuauaaaagaagaaaugggcugggcacaguggcucaugccuguaauccuggcacuuugggaggccaagguggguggaucacuugaggucaggaguucaagaccagccuggccaacauggugaaacuccaucucuaucucuacuaaaaauacaaaaauuagcuuggugugguggugcacgccuauagucauagcuacuugggaggcugaggcaggagaaucucuugaacccaggaaguggaggagguugcagugagcagagaccaagccacugcacuccagccugggcgacagagugagacuucaucucaaaaaacauaaaaaaagaggccaggcacaguggcucacgccuguaaucccaacacuuuuggaggccagggaggguggaucacgaggucaggagaucgagaccauccugguuaacauggugaaaccccgucucuacuaaaaauacaaaaaauuagccgggugugguggcgggcgccuguagucccagcuacucgggaggcugaggcaggagaauggcauguacccgggagguagaacuugcagugagccgagaugggaccgcugcacuccagccugggugacagagcgagacucugucucaacaacaacaacaacaaaaaagcauaauuaauaaaaaauaaaaaacuuuuuagugugaaauaguuuucucucucuaguucugcuuuuugccgcuuucccaauauccuacccuuaccuccuacuuugcgacacauuucuuucauucuuguuucuuuuuuuuuuuuuuugagacggagacucgcuuugucgcccaggcuggagugcaguggcaccaucucggcucgcugcaaccucugccuccuggguucaagcaauucuucugccuuaaccuuccaagcagcugggacuauaggcgcccaccaccaugccuggcuaauuuuuguaucuuuaguagagacaggguuuuaccauguuggccaugcuagucuugagcuccugaccucagguaaugugcccaucucagcgucccaaagugcugggauuacagaugugagccaccgcucccagccccacaaagauauuuuuaaaaacagauuuguacgugaagauauauaacacggucauugaugacaagucaaaauauugaaaaaaguuguaaauaguagacuuuauuauuuuuauucuuuuauuuuuuauuuuuugagauggagucucgcucugucgcccagguuggagugcaguggcgcgaucucggcgcacugcaaccuccgccuccuguguucaggccauucuccugccucagccucccgaguagcugggacuauaggcauccgccaccacgcccggcuaauuuuuuguauuuuuaguagagacgggguuucaccguguuagccaggauggucucgaucuccugaccucgugauccgcccgccucagccucccaaagugcugggauuacaagugugagccaccgcgcccggccaauaguagacucuuuauuaaagacucauuauuaaaggaguaguggagaaauagcaaauaguguugaggaggaaaaaagugaaaaugucaucaaucaaggcauuagaaacuuucuguuacuagucuuuuggggagauuggggugggaggggucuugcuauuuugccaaggcuggucuuaaaaucaagugaaccuccugugucacccucccaauuagcuggaaaugcaggugcacaccacugugccuggcuuaguccuguuauuuucgguuugugugggauaguuccauuuuaugcuugccaucccugacaguuauagaaaggguuauauuacaacuauaccuucuuuucgucaaaguuguccguuuaacuugguaauuuguagcuaaucaaaucagaaaugaaguacuaauauuuaggcaaggcugggcacaguggcucacgccuguagucccagcacuuugggaggcugaggugggagaauggcaugagcccaggaguuugagaccaaccugagcaacauagggagacucuuaucucuaaaaaaaauuugccgggcaugguggugugcaccuguagucccagcuacuucagagguugagguacaagaaucacuugagcccaguugggcaaggcugcagugagcuaugaucgcacuucagccugcaugacagaaugagacugcuucaaagaaaaaaaaaaagcaauaauaaaagugcauuuuagauuuuuaguuguccuuccagguuuguggauauaagcuucauuagagaaugaagcauuuuucagugguguguuuuuuguuuucuaucuagcagcagccuccaucuacuacaacauuugugcugaaucaaauaaaucaucuuccacccuugggaucuacaauuguaaugacuaaaacaccaccuguaacaaccaacaggcaaaccaucacuuuaacuaaguuuauccagacuacugcaagcacacgcccgucagucucagcaccaacaguacgaaaugccaugaccucugcaccuucaaaagaccaaguucagcuuaaagaucuacugaaaaauaauagucuuaaugaacugaugaaacuaaagccaccugcuaauauugcucagccaguagcaacagcagcuaguaagucuguuuucaauaguaucaacuuucucucucugguaagcuaugucagcauguuuuuuuaaacgauuugcuuggguuuuuaaagaacuggccauaaaaggguguuauaugcauuauuuugcguacuuacagucuuuaacacaauucaagggaagcaaaaguuuagaugccuuggguagguuguuuagcuuugaaaugugauuucuaggaucaucagguagcuacguuagcaacaugaaaucuuaccaguuuuauauauuauagguagucaguuaacauuuuucuuaauccuuuacaaauccuuuacaaauagcuguuuacuugugacucaucuguggaucuuguuugaaagcagaaucugauucucaguagagcccacaauucuacauuucuuuuuucuuuuuuugagacggauuuucagucugucacccagacuggagugcaguggugcgaucucugcucacugcagcuuccgucuccuggauucaagugauucuccugccucagccucccgaguagcuggaauuagaggugcuugccaccacaccuagcuaauuuuuguauuuuuaauagagacgggguuucacuguguuggccaggcuggucucgaacuccugagcucaggcagucugcccaccuuagccucccaaaguguuguugggauuacaggcgugaguaccaugcccggccugcuuguguuuuuaugaaauagagggcuaagagcauucuaaaagaaugggcgauaaguguuuauaggaagauguagaacuuugucuuaagugacagaugucauuaaaauuuucagaucaucugguuuuuauguuuggguccauaccacuguguccuuguggcuguaguuuuuugucuuuugguuuucguuuuuugguucuccucucaaggucauuguccugaacugacugcaaccuggcagugagaugcaaguugggaaaucauuuuagcugucuuaggacugauaccauuuucugccguggagugcagcacugugacccugaccuggcugaggugcagggcaguuucuggaaucacucgcaagggacuuggggauggucgacaguugguggaagaugcuucucguuacggucuuuggauuuaaugaggaagccugcuucuuauaugaguggcuuucugagcauuguacuccucacaucagcauaugccaucauaacuuaaaggaguggauguaugccauugugagggaagaauuuagagaacacaacagaaaacgggauagauuuggagcugacugaacaagauaucuaguacaguaaauucucccacauuuaagguagugauuuuuaaaagacaaaugcagacauuuaucaggcugcacagcaagacuauccauguauggaagccugagaaacugucaagcuaggucaggacuaagaaacaaagaugggccggacgcgguggcucaugccuguaaucccagcacguuuggagcccaagguggguggaucacgaggucaggaguucaagaccagccuggccaagauggugaaacuccaccucuacuaaaaauaugaaaauuagcugggcaugaugaugggcaccuguaauuccagcuacuugggaggcugaggcagggaauugcuugaacccaggaggcagagguugcagucagcugagauggcgccacugcacuccagccugggcgacagagcaagacuccaucucaaaaaaaaaaaaaaaaaaagaugguaagugaaugcugaagacaagcaaaguuuuuuguuguaggagaugguccucuuuuuacugaaggggaaaaacauugaaaauaugaaacugcagaaagcaagguguugcauguucuacuucuuaucugugugguuguugccccuuuggguucuaaccugucacaauuucucuggucuuaaaacuaggagcugaucacuggcucuuucacaguuaaaauaaacaaaccaugcccccaaauaucaucucuguucuaguuuccuuguuuaguuaauacuuuauuuuuauuuuuuauuuuuuugugagacgaagucucauuccaucgcccaggcuggagugcaauggcgcgaccucggcuuccugcaaccccugccacuugaauucaagugauucuccugcuucagccucccaaauagcugggauuacaggcaugagccaccaagccuggcuauuuuuaguagagacaggguuucaccauguuggccaugcugaucuugaacuccugaccucaagugaucagcccaccucggccucccaaaguucugggauuacaggcgugagcaccuggccuguuaauacuuuaauuaguuguacucguuuuggagucuaagugauaguccucccaaauacucuucaucuuuugcuagaauagaugaaaugcugaucagcucuccugauguuagcacucucuucccuaaaggcagugauuuccgcaccucuaucucaagaauuccagguacugugaggacuucagggauucuuggaggcugaaggcugguuccagggguucuggacuggauaccucccaccccuauucagucaaguagcucugcugauugauaaguggauucugagauuuuauugcuauauuuaaaagaguuugaaaaccagugguauagaagaaaguguucauuguuuagaucuuuacucugggagcaggaggaaguaaggaguucccaaauugauuuuucuucuucuagaaauaauuauuuugccuugaaaauuaguaaguaccaccagaucacaugaaauugauucuguuugggugauaaccccagguuuuggguuuuuuuguuuuuuuucuuuuuugagagucuugaucugucgcccaggcuggagugcaguggcgcgaucucggcucauugcaggcucugccuccuguuuucaugccauucuccugccucagccucccuaguagcugggacuacaggcgcccgccaccacgcccagcuaauuuuuuuuuguauuuuuuuaaauuuuaauuaauuaauuaauuaauuuuuuugagacagaguuuuacucuuguugcccaggcuggaguucaaugaugcaaucucagcucacugcagccuccgccucccggguucaagcaguucucugccucagccucccaaguagcugggauuaugagcaugcgccaccaugcccggcuaauuuuguauuuuuaguagagacugggccuccucggccucccaaagugcugggauuacaggcgugagccacugcgccggccuuguuuauuuuuaaugagucaaaugaagugucucaaaguaaugcuggcuuuuggguaucuuucugauaaauaauuuucaagcuucccuugcacacguuccuuuugaguuguuuucuaaaguuaauucuuuacuuccauaaagacacauggguuuacauguuuucaugccugugcuuaauuuaaauuaguaauagaggccaggugcgguggcucacgccuguaaucccagcacuuugggaugccaaagugggcagaucaccugagguugggaguucaagaccagccugaccaacauggagaaacuccguuuuuacuuaaaaaaaaaauuacaaaauuaggcaggcaugguggcgcauuccuguaaucccagcuacuugggggucugaggcaggagaaucgcuugaacucgggaggaggagguugcagucagcugagauugcgccaacgcacuccauccugggcaacaagagugaaacuccaaaaauaaauaaauaaaaauaaauuaguuauaggcagauugacauucuuugguuuuugaaauauguaaacuucuggguuuuuuauuuuuauuuuuuuagacaaagucuuguucugucacccaggcugaagugcaguggugcaaucucggcucauuucaaccuccaccucccagguucaagcaauucucugccucagucucccgaguagcugggauuacaggugcccgccaccacgcccagcuuguuucuguauuuuuaguagagaugcgguuucacaaucuuggccaggcuggucuugaacuccugaccuuguaauucacccgccuuggugucccaaaaaugcugggauuacaggugugagccaccgcagcagccuuaaacuucuggauuuuuaaauaaugggaaaauaaguucagaauuuucuucuaaauguaauuugacuuuuuccuccucagcugauguaagcaaugguacaguaaagaaagagucuucuaauaaagaaggagcuagaauguggauaaacgacaugaagaugaggaguuuuuccccaaccauggugaguuucaaauaacugugucuuuauuuuuguguaguaugagaguguacucaacuaaaaguguucuauauggaacaacccucagaaagcuguuuuuggguugggaagaagcuauacaggcgugggaacuaauggauaugcuuaaaccucgcuggaguaauauagauacuaaccagggugguuaaaacuugcagauugauggaguguggcacuaacaugcaguacugauaucuuacuguuaaaaaucucaucugagcagaaaaaaagacaaugugggguuaacgaaaaguauuugauaacuguguucauuuuaggaccgaacuugaauagaaagcucauaaugcauugacagaucauauaaugaucugguuaugagugauucuuuuuuuuuuuuuuuuuuuuuuuugagacagagucuuacucuuaucgcccaggcuggagugcaguggugcuaucuuggcucacuguaaccuccaccucccagguucaagugauucucccaccucagccucucaaguagcugggauuacaggcaugugccaccaugcuuggcuaauuuuuguauuuuuaguagaaaugggguuucaccauguuggccaggauggucucgaacuccugaccucagguaaucugcccgccucagccuccgaaagugcugagauuacaggcgugagccacugcacccggccugguuagaauucuuaacauuuugaaaaugcuguaugcuuuggaucaauugauuccauacauuuauuuaauaaauucuccauguauaacauuguuaauauguaguagguuucuacaagaaguauauuuauuacaugauucuaccuucaguaagcaaaauuugacaaccaucuggauuaaguaguaauaaugaaaaguacaucaaaugguaugcaaugugcuacucacaauaaagguuaggaauuuggaggaagaggugaccuuccugaacucuaguggccugguggacuuuauggagagggaauaauggagcuuggguuuugaguaugacgagacuuugaggugggauauuaggaagggagcuaaaggauuaaugggcacagaggggagguagugaguaugugcuucggugaaaauaagccaggaagcuuagcuuguagaaagaagugggaauaguaggucugggcuccauggaggguccugaauugagguuuuuauuguuguuguuguuuuugagauggagucuugcucuguugaccaggcuggaguguaguggugcaaucuuggcucacugcaaucuccgccucccagguucgagcgauucuucugccucagcuuccugaguaggugggauuacaggugcccaccaccagcccuggcuaauuuuuguguuuuuaguagagacgggguuuuaccacauuggccaggcuggucucgaauaccugaccucaagugaucccuccagcucggccucccaaagugcugggaggccaaggugcccugugcugaauugaguuugaaggacuuuggacuuagucuagcaccauugagccaguagacauggagggaccuguuagugauucaggagaaguuggggugcagacugaguaaagggguagggaagacagauucgggaugaguaggaguaggcaaaagagagagguuggaaaguugguuaaccuaagggggaaguaagaagggguacuagagaccuugcagaggggauugaaaaacggagaggggaaaggaaaaaaagagaugacuguacauaacgauaccaaaagaauuuugggacuugguucuagaauauggaauuggagacagugcagcaaacuguagcugagguuuugaaugggaaccaggagaacaauagugcuacuggcgguacccaguuuacuuagugauugucuaccaacagcacuuggaaggugauuuuuggaaacuaagaaugcauauuucuucaagaaauguuuuaugugguucucacauuuccauuucaguccauuauauaccaaaaguuuuuuauuggcuuagcaguuaaguaacaucucagagagacugcaaacugauagcccaucaaccaaacuagucggggaggggggggggggcgugugugugugugugugucgggguguguguguguguguguuuagacggugucuugcugucacccaggcuggagggcaguggugcaaucucagcucacugcaacuucugccucccagguucaagugauucuucugccucagccuccugagcagcugggauuacaggcgccccccaccaccaccaccacacccagauaauuuuuguuucuuuuauuuuguuuauuuauuuugagauggagucucgcucugucacaggcuggagugcauuggugcagucuuggcucacugcaaccuccccuucccgggcucaagcaauucucuuccucagccucccaaguagcugggauuacaggcgcccgccacuacgcccugcuaauuuucuuuuguauuuuuuaauagagaugggguuucacuaccuuggccaggcuggucuugaacuccugaccucgugauucacccgccucggccucccaaagugcugggauuucaggcgugagccacugugccuggccuguauuuuuuaguagagacgggguuuugccauguuggccaggcuggucuugaacuccugaccucaggugauccgcccaccccugcuugcccaagugcugggauuacaggcgugagccaccaugccuggcugacaaauguauuuuguuuggccuucaugguauuuugaagaauuuugaauuuguuugcugacauauacaaauccugauuucccgguuauuuugaaaaaugggaguaccugacaaccccaggcccacguuccccaucuaggaagauuugcccagcguuguguagugaacaucuacaugguauguugggcaaacauuucccagguaccguggucucccucacccgaguuaucucuuugaccuaaauuugaugucaguugcuaucucacaugcaccuggcuucaagguauuacuuguuuguucccuggauauagugguccuucaguauuaccaacuuauccuucaguuauucaauuaucaucaauuuuaugaugauuuuaaaaaacuauagguaggagaauaaaggauggagggagaaaggaggcugcuuaucuuaacauagaauacauuuuuauuuuauaagcgaggacaggguuagacgguggggguggagaggacccagaauuuagguaauuugccuaaauuaaaaaacagacuacacaauuaaauaacagcagaauugggauucaaaucuauucauuuggccaguccuguuuugucucgaauuuccgaaauugaguuuuauuuuagcauaauuucugagaacauuccaaguuuuuagauuuuaucuaaagacuccauagguuaauguugauuggaugguuaugucccacuucuuuuccuuuucacguuuguuaucuauuugcaaccauauucugcucuagauucugagguaaaugaaaaaagagccuguccuucacuuuuaaugcugucucgaucuugccuuaauuugccuuaaccuguagguuuuuguuguccucuucccuuggcauacugaguuucacaacaguuucuuuauauucuucccugaacaagugcaugcuaauaaacaguugccuaaugauuguacugguagugaaaaguggcuuauuccggaucuuccuuuauuccuuuaagauccuguagaggaagaaaagggaagcauaaccguggugaccauucacuugguuugccgaggacagucuggguuuacuucuguuuucucaguguaauccucaauagcuccccaacucaaaugugccaggguuuggaaaauaaauuauauggccaucuuauauaugaucacgauugcaucuguggagacacagaagucugaaguaaauuuuucuguucuucauaagggccucuaaaauaaacuccagucuucugggguuuugguuuuaggauaugcgggaaagcaggcaaauagaagugaacugagaagaagguggaaugugagacugagaggccuugcuuguggugaugcaggguccuuuggggccaauccaccuuugcuaggguucacuccaguuuugcacuaggaagagccagacacacugcuugcucuuucuccuggaacuagaaugaaggcgaagucugagugcagagagaguucugggcaucaaggaggggugauaggcaguauugaaggggaaaguagcuugacacgaugguggccggaaggacguggagucuugugacccauuuguggguaagagacagaguaggaccucauugucugugcucauuauuggagaagcaggaaagccacgaaguguggcccagauuuuagggaguauugagguggcgcgucauguuuccaugauggaaauuuguagguguuccuacaagagaguuuuucuguguguuggcugggcgucuggucccuggauuugggauugauugugcucuuucuguguugcagaagguuccuguuguaaaagaagaugaugaaccagaggaagaagaugaagaagaaaugggucaugcagaaaccuaugcagaauacaugccaauaaaauguaugucuucgggauuugucagauauuuacaucaaaguuuuccugugguuucuuugguucuuuuuguuuuguuuuuuuccauauaaauuuagaaucuugcuuuaggucaaagucuuuuaaaaccaaaacuaaagaagcuuggauuuuauuuuaauuuuguucauaggaguagugauuauaaaaaucaaagguaauuguaaagauauauaaagcuaagauauuuaauacaacuugucuaaaauuguaaaaacauugaaauuauaaaaauaauugugcuauuugaauuccauaguuuuuguuucucccuuuuguauaacaugguucuuuuuuuagcagccacuguaugaagucgaaaauuagguuuuuaauauuugcauaaaauuuucacuuuuucauuacaggaaacaaaucuaugucuagaauuugucuuucauguagucuugguuucuauaaaaaaccacuaauaauaccauuugaauugaacuacaauucucuuuuuaucaacuacugauagacucaagauuccauccuuuucugcucaccuacaaugaauuuuagaaguccuaucugaaauucuguuuuucuuauuccaauaaucauuuugcaaaaggauugaaagaguuuauggcccuuuaaaccagaggacagcaaacuaaaucuggaccacucgcuuuuuuauaguaaauaagguuuuauuggaacauagacauguuuauugguuuacuuauuaucuauggcugcguugacacuacagcagcaauguuaaguaguuguacaagagacaggauggccuaaaacggcaaaaucauucucugacccuuuacagaaaaagcuuccagaucauuauuuuaauguauucauguuguacauuuuggggacuugguuguuaaauuuuauagccaaguugucuuucgaauacuuuucaaaguaaaauauguucuuuuuaagacggggucuggcucuuuacucagucuggagugcaguggcaugcucuugccucacugcaaccuccaccucccaggaucccuccuggauucuagcaauucucgugcuucagccucuugaguagcuaggauuacaggugugcaccaucaugccuggcugauuuuuguauuuuuaguagagaugggguuucaccguguuggccaggcuggucucgaaugccugaccucaggagauccacccaccuuggccucccagcugcugagauuacaggcgugagccaccaugcccagccaggcaguggcgcaaucuuagcucacugcagccuuagccuacaaggcucaagcaauccuccugucucagacuccugaauagcucggaccacaggucccaccaccaugcccagcuaauuuuuggauuuuaauuguagagaugagggucucacuauauugccaaggcuggucuugaacucuuggccucaaaugauacuccugcuuuggccucccaaagugcugagauuacaagcaugaaccuucaugccuagccucaaaauaaaauuguauugcaaacuuuuguuuuacugaaugaaugcuugaaguaacugaacuccuuaaucuggcauuauguucuguuacuacuagagaaccugcuguuaugaaccaagugguguuuuuuuagaucuuuuuuuuaucagcaaaucucuauuuuauuuuauuuauuauuuaauuuuauuuauuuauuuuuugagacagagucucacugcaucacucaggcuggagugcaguggcacagucucggcucccugcaaccuccgucuccuggguucaagcaauucucguuccucagccuccugaguagcuggaauuacaggcgcgugccaacaugcccagcuaauuuuuguauuuuuaguagagacagggauuugcuguguuggccaggcuggucuugaacgccugaccucaagugaucccuccaccuuggccccccaaagugcugggauuacaggcgugagccacccaccuggcccaaaucucuguuuuaaccauauguaguugauaaaucauuuuagucaaauauagauaguacuuugucaucaguuacuuuuuauggaagcucagagugaauacuuuuuaauuauuuuucuauguuauaagaaaaacauugaaauaucuuauaaugaaacuggaaauguuauuacuuagaauaauuaaaauaaaauguuuuuacauuuuuguuuaguaaaaauuggccuacgucauccagaugcuguaguggaaaccagcucuuuauccaguguuacuccuccugauguuugguacaaaacauccauuucugaggaaaccauugauaauggcugguuaucagcauugcagcuugaggcaauuacauaugcagcccagguaagcaauaauauuucauaauacaauaauuauuuuauccuauucuauauaacagaguuguuucaaucuaaagguaacuuuuccuuguaugaaaaccuuguaaauguaauauuuaugaaaguuuaauguguuggaaaauuaaauuuuagaaguguagcagagauacagauagugcauuuccaguggaaauggcaaauguuauaacuugcuuggaauuuacugggaauauuuauuaaaauuaaaaauauguauaucgaccaggcacaguggcucaugucugcaaucccaacaguuugggaggcugagguggguggauugcuugagcccaggaguucgcgaccagucuggguaacauggugaaacaucaugucuacgaaaaauacaaaaaauuagcugaguguaguggcacgcaccuguagucccaguuucucgggaagcugagguaggggaaucaccucagcccaggaagucgaggcugcaauaagcugugaucuugucacuccacccugggugaugggaacgagacccugucucaaaaaaaaaaaauuauauauauguauauguguguguauauauacccauuccuaggaguguguucccuggaacuguuagauaagaacauaugcagaaugauauuuguuguaccuuuugucccuccagcuggaaaagauuugagcauccacauuauugggggguaauugcauaaacugugauauuauuggacagugggguguugugugggcuuuuaaaaugaugugagguagaguuaagcaguugucuugaaaugauuucagucauauuccauaucuguaaaauaaguaaugaccaaaauagccauuuauccuccauauuuugugugauauaaaacuuuuaauuuggcugggcaugguggcucacgccuguaaucccagcacuuuuuuuuuuuuuuugagauggagucucacugugucguccaggcuggagugcaauggugcgaucuuggcucacuggaaccuccgccucccagguucaugccauucuucugccucagccucccgaguagcugggacuacaggcacccaccgccacgcccggcuaauuuuuucuguuuuuaguggagaugggguuuuaccguguuagccaggauggucucgaucuccugaccucaugauccacccaucucggccucccaaagugcugggauuacaggugugagccaccgugcccggcccaaucccaguacuuugggaggcugaggcaggcgggucacccugaggucaggaguuagagaccagccuggccaacguggugaaacccugucucuaccaaaaauacaaaaauuagccaggcauggugguacacaccucuagugccaucuacuugggaagcuaagucaggagaaucacuugaacccaggagguggagguugcagugagcugagauugugccacugcacuccagccuggacgacagagugagacucugucugaaaaaaacuaaaaaaccacuggccgggcacuuugggaggcugaagcuggcggaucaccugagguugggaguucgagaccagccuggccaacauggugaaacccugucucuacuaaaaauacaaaaacuagcugugcgugguggcacaugccuguaauccuagcuacucgggaggcugaggcaggagaaucacuugaacucaggaggcggagguugcggugagccgagauugugccauugcacucuagccugggcaacaagagcaaaacugucucaaaaacaaaacaaaacaaaaacaaacaaaaaccuguuugauucugcagguguugauaagggguauggcgggcuccucacuaauuuguuaacuuucauuaccuggugcauggaagaguagcaggagauaauauacaguaaauauguagaaaguauucacauugagcugggcgcggugacucgugccuguaaucucagcacuuugggaggccaaggcgggugcaucaugaggucaggagaucgagaccauccuggucaacguggugaaacccugucuacuaaaaauacaaaaaauuagcugggcgugguggugcauaccuguaaucccagcuacucgggaggcugaagcaggagaauagcuugaacaggaauucagagguugcagugagccgagauugugccacugcacuucagccuggcaacagagcgagaccccguuucaaaaaaagaaaaaaaagaaaguauccacauuaaagccaaaacuauaaaauuuggcugggugcagugccucacaccuguaaucccagcacuuugggaggcugaggcgggcggaucacgaggucaggagaucgagaucauccuggcuaacauggugaaacccguuucuacuaaaaauagaaaaaauuagccaggcgugguggcgggcgccuguagucccaccuacucaggaggcugaggaaggagaauggugugaacccgggaggcagagauugcagugagccaagaucgcgccacugcacuccaaccugggcgacagagcgagacuccgucucaaaaaaaaauccaaaacucuaugaaauuuauguaaaaauaaagucacaaaauacauauacaaaacaaaaaacauaacauauuccuacuccuaaaacaguguaugaaagauugaucaccaaaauaucugaaggauuauauuaauuaccagccuuuuguuuuucagcaacaugaaacuuuccuaccuaauggagaucgugcuggcuucuuaauaggugauggugccgguguaggaaaaggaaggacgauagcaggaaucaucuaugaaaauuauuuguugaguagaaaacgagcauugugguaaguguuuaaaaacuggcugugggccaggcgcagcggaucacgagguuaggagaucgagaccauccuggcuaacacagugaaacuccgucucuacuaaaaguacaaaaaaucagccggucgucaugguggguuccuguagucccagcuacucaggaggcugaggcaggagaauggcgugaacccuggaggcauagcuugcagugagccgacauuguuccucugcacuccagccugggugacagagugcgacuccgucucaauggaagguuuuguuaguaauuacuuuagcauguggggaugggauccgccuuccccaucuagacaggaucuuugucacccaggcuggagugcuguggcauauucauggcucacugcagccucuaccucaggggcucaagcaguucugccucagccucuugaguagcugggacuacaggcaugcacuaccaugcuuggcuaauuuuuuguagauacgggcucuucuuguguugcucaggcuggucucgaacuccugggcucaagcaguccuccugccuuaggcucccaaagugcuaggauuaugggugugagccacugcacucagugggaugguguuuuaaugaguaaguguauuuucuuuuucuuuuuuuuuuuuuuuuuaagugucaagaccuggcuuuauuaauuuuauuccugaauucuagaaugauauaauuuguauuuaauuugugcuuuuuaauauuuuggcagguuuaguguuucaaaugacuuaaaguaugaugcugaaagagauuuaagggauauuggagcaaaaaacauuuugguucauucguuaaauaagguaugaaaucuuuuuauucaguuggucauucaauaaauauugacucaucugugagaugacaauaauaauagcuauguauauaaggggacacuuuuuggaaaacuuugauguuacuccacagaaagcauagugagugcuagccacuauuguugguuuguggauuccuauaugcuaaacacugacaggcaguagccacucaucacauguggcuauugaacaguguaagugaccaguccaaauugagaugugcucucaaguguacagugcacaccaguugauucucucaauuuucaguguuauuuuuaucuuucuuuuauaguuuauaugccauaagggugcaguuuagacagguggcauaccuugcacuauaggucaccaaaucauaugcgauguagauaguuauggcuugggcagacugguuucaguauuuguacagcuaauggacuugaguuacucauaccucugcucacaugaaaacaauucuguaagcugaaagacaaugugugccaguguguuuuagaauguuaagguucaguuagcaaaucuuuauugacuuacuaugcaugcaccaauuguuggugcuauaagguuaaaauagacugauaggguuccuggaagggccucccuaguagcccuuugaaaauaaguaacugcaccucuacuucccaugugaguccuaaguugaauucaguguugcccuaaacaguggcuuguuaggguggguuuuacuggguggauuuguagcuauaaaguacugugucuugaaugacuguauacaauucagaacuaaaaggauguaaguggcaucuagaauuuuuuuuuuaaauuucagaguaguauuagaaaggcacauuaacaauuacucauaauucuuauguaucagaaauuaaucacaguguuuugcauauaguaagugcacaauaaauguuuguaaauugugacuuuuuauucuuauagggaaguuugucugguuuuuaauguuuuuuuuugugaugauaaaaguuuuuaagacuuugaaaacuggauuuaaaaaaaaaaaaaaaagaucucagcucuguugcccaggcugaagugcaguggcacaaucucggcucacugcaaccuccaucucccaggcucaagcaguucucccaccucagccccugugguagcugggacugcagacacgcaccacgaugccuggcuaauuuuuguauuuuuuguagggaugggguuucacuauguuggccaggcuggucuuggaacuccugagcucaagcgauccacccaccuugaccucccaaaguguugggauuacaggugugagccacuguguccuaccaaaaacuggauuuuuguacuauaaaguuguguguuuguguuguguacauuuauacaaauaaauuugcgucucuguacuuuuauguuuucugaagccugucaugggccuaacaagaguuccugcuugugaauguuuaguugggaugaauguugcagagagaaagguauacuaauuaacuaaauucuuuucuuuucuuuuuuaguuuaaauacggaaaaauuucuuccaaacauaaugggagugugaaaaaggguguuauuuuugcuacuuacucuucacuuauuggugaaagccagucuggcggcaaguauaaaacuagguuaaaacaacuucugcauuggugcggugaugacuucgauggagugguauccuuuauggcaaauauuuuucuauuuuuuaacgacaagaaaauuauaaaaggguagaccuuugggaaacaggaaucuugagauuaaacgaguugcuggagugaaaacuuuaaugauuaccuagaguccaaagggauuggaaaguugauucgguuuuuuaccugucagauaggagaccaauguuuaaucuccugguuuagaaaaauguuaauagauaugaggaauacugaauacuguauuccccuuuugaggauuaacauugcauauuuacauagcagaauacccgagaagacuaagugaaagaaaacuguuagaacuuaguggucccaaacuuguucacaguauaucuuuuaacuguccugcaugaggaacaucacuuuuugaaaugcugauuaaguugguuaccaaucaugcuucuacuuuuacaaguuaccagauaacaacuucuugcugcaguggguucuuuucucuguuuuaauuuagaggcaaauugcugguuuaaauuccaaauucagugaaugucuuugaggcuagagagggaggaggauguaacuggggaaaggcccauaggacuuccuuuguauuugcagucaugaaauaggcaaucagaaggccucagggaaauaaaaguuaacucuucuugaaagacuggagauucuuacuuaauacuaaugugauacauuccuuaacucauuccauuuagauaguguuugaugagugucauaaagccaaaaacuuauguccuguugguucuucaaagccaaccaagacaggcuuagcaguuuuagagcuucagaacaaauugccaaaagccagaguuguuuaugcuagugcaacuggugaguauuuauuuauuuaaaaauauauauuguagguuauuuuuucaacuauaauauauuucauuugugggauuuucaggugcuucugaaccacgcaacauggccuauaugaaccgucuuggcauauggggugaggguacuccauuuagagaauucagugauuuuauucaagcaguagaacggagguaaugcaguuuacgguauauacucuucucaguagcaaucuaagaaguguguuauuccuaaagcccauucucuguauguuaaaauucuacuguauugguaauuacuguauguuuuaauuuuauucagaggaguuggugccauggaaauaguugcuauggauaugaagcuuagaggaauguacauugcucgacaacugagcuuuacuggagugaccuucaaaauugaggaaguucuucuuucucagagcuacguuaaaauguauaacaaagcugucaagcuggugaggaauuuuucuuaauuccuaguguuuauuuaauguaucugauaauguuucuguuaguuuuggcgauugcgaugccuccugcccaugggaauguauuucuacuauaaaacaacagaugaagccaggcacggugucucaugccucagcacuuugggaggcugaggcgagcaggucaccugaggucaagaguucaagaccagccuggccuacauguugaaaccucaucucuacuaaaaauacgaaaaaaaauuagcugggcaugguggugugcgccuguagugccagcuacuuggggaggcugaggcaggagaaucgcuugaacccaggaggcggagguugcugugagccaagauggugccagugcacuccagcuuggguaacagagggauacuccaucgcaaaacaaaaacaaaaacaaaaaacaaaaacaaacagaugaguuaccagaugauaggcuguuuaaccaauguguuuuuuuuuguuuuuguuuuuaauugaagcagggucuuacucugucacccagacuggaguacaguggugugaucuuggcuuacugcaaccucuaccucccagguucaaggaguccuccagacucugccuccugaguaucagggacugcaggcgcaugucaaugugccuggcugauuuuuguauuuuuugguagagaugagguuuuacaguguugcccagccugaucuggaacuccugggcucaagcaauccaccugccucagccucccaaagugcugggauuacaggcaucagccacugcgccuggccuaaccaauguucuuauauuucagauuguccauguuuucauuuuguuaagguaauucauaaguuauagccauuuauuucaguugcauaguucuuaaaaucacauuauuuucuaaaaugacugcauuagguaauaagaaacuugagacaacugugugaguauccugagaaauagauucccaaguuacuaaagaugauuuauuaaauuaauauuaaauggucuugcacuuaacauuguuuugauuuaauugguauuuuuaaauaacuagacucaaagaugaagugucugaaauguugauuauguaucuucagugggucaucgccagagagcgguuucagcaagcugcagaucugauugaugcugagcaacgaaugaagaaguccauguggggucaguucuggucugcucaccagagguucuucaaauacuuaugcauagcauccaaaguuaaaaggguugugcaacuagcucgagaggaaaucaagaauggaaaaguaaguagaagaacucauuaagagauuguuuggggguuauguuguuuagucuuugugggugcugagguuuucugcuuguaaaaucugguuuuccuaaaggauaguaaaacuucuaaaaaauacauuucuuaaaauuauaaaagcaaugccugcuuagagaauuuagagaguucagaaaaguauaacaaaguaaacaucacuauaauuggucauccauagcugguagcacugguaacauauggauguguauugcguuaagguuuuuucuuuucggugaauauuuaucuacuuaaagcauaagauacuauaaacuguacaagggcaggggcuucacucaugcuuacuacugucuguaauccuaucuccugccuaaauuuuugacaaauaaccugucucaaauauguagaagaaauaaguaaaacaaauuuguguuuuauaauaaugaggacauucuuguuugaaaucuuuguuuagcuaaauguuuaaaauaugucuugguaagaagccacaaacauuauuauucauaauuaacauguuuucuuuuuucuccaguguguuguaauuggucugcagucuacaggagaagcuagaacauuagaagcuuuggaagagggcgggggagaauugaaugauuuuguuucaacugccaaguaauguuuuuguucuuuuaauguuuuuguuucuuuuugaguucuuccuuaccuuaguuccaaugugggcauuuccuggagacaaaacuuuuguuucaccugcaucaucuuuaaguuuucuugaucugaguuuucugcuuuucuguaacaguguaucuauuggaaaacaauaacagaaaucucauaauccuaaaauguuaagcauuuugcuaauauuacacagaguaugugaacuaacagaagggcuagacuuuguuuaucuuguacaucuuggaaaucugugacagcuuggcuuagauucaguuuuaguguacuguauuugaaauuaccguuauccacaggaacaguaacuauaguuuguccuaauauaacgaagucuacuuuauaaguuggcugagcaugguggcucacagcuguaaucucagcacuuugggaggccaacaugggcacaucacuugaggucaguaguuugagaccagccuggccaaaauggugaaaccccaucucaacuaaaaauaaaaaaaauuaguugggcaugguggcacacguccuguagucccaccuaccugggaggcugaggcaggagaauccauugaacccgugagguggagguugcagugagccaagaucgcaccacuccacuccacuccccucugggcggcagagugagacccugucucaaaaaaaaauaaaauaaaauaaagucuacuuuaaaaguugaaaauaagcaugagaucuucagaaauagauuuuaaaauguuuuaggcauuguuuuuaguuugccuaaccuccacauucaaacucugguaguaaacugagcaaaauaaacuugcugcucuacuauuuugugccucgggaugcauucagaugcuccuuucaaaagcaauacauggggcucacgccuguaauccaggcacuuugggaggcugagucugguggaucacgagagcucaggaguuugagaccagccuggccaacacggugaaaccucgucucuacuaaaaauacaaaaacuagccaggcgugguggcgggcaccuguaaucccagcuacuggagaggcugaggcaggagaauugcuugaacccaggcggcggagguugcagugagcugagauggcaccauugcacuccagccugggugacagagagacucggucucaaaaaaaaaaaaaaaaagaaaaaagcaagacauacaccugcuaaucuauauuuuucuguacauaauugccuagaacuaccguguccagaauggcagccgcuugucacauguggcuauugagcaguugaaaugacugguccauauugagauguuauuauauguguacugagccagguuucaaagacuccuuaagagaaaauaacauaaaacauauguguugacaugguauauugaguuaaaauguauuauuaaaauuaguuccaccaguuuuauuuauuuuuuacuuuuuuaauuuaagcuaccagaaaauacaauaauuguguaugugguuuggcuugcauucuuauuauuuaguuggacagcuuugggcuagaaaauuaaaauuuauuugagcucguuuaucaguauuuuguaaaacugaacaaaguauauuucaauauauuuaauaauacuuuacauauaauuauuuugucaacugaagcaguaauugucacuguuucucuccuacagagguguguugcagucacucauugaaaaacauuuuccugcuccagacaggaaaaaacuuuauaguuuacuaggaaucgauuugacagcuccaaguaacaacaguucgccaagagauaguccuuguaaagaaaauaaaauaaagaagcggaaaggugagcacuuuaaaaaagaaaaaauaggccaggugcgguggcucacaccuguaaucccagcacuuugggaggcugaggugggcagaucacgaggucaggagaucgagaccauccuggcuaacacggugaaaccccaucucuacugaaaauacaaaaaauuagccgggcaucguggugggcaccuauagucccagcuacucgggaggcugaggcaggagaaugucgugaacccaggaggcagagcuugcagugagccgagauagcgcugcugcacuccagccuggaugacagagcgagacucugucucaaaaaagaaaaagaaaaaagaaaauaguugacguugaaaauacuguugaaauuaaaacauaagcauuuuaaaguggcuauauuuugggaaugaacugccuuccaugaauucacaaaugguuccaaauuuucacugucacuuguacaauuuugaaugcacaaguuauccccguuuuaaauuaggaauugagcaauucacuggugguuggcaguguguuaagcacuuggcuauauacauucuaccauauaaccuggcagagguccauacgaaauuaggucuuauuuuuccaauuuuauagacagagaucauugaagcacagaaagauuuaaagauuaaagaguuuuccuaguuucacagagauaguuaaugaugcaugggaacuaaaaccugugucuuuguauugucagaccuguucuuuaauauauagacagcuggguguuucaguaguuuucuuuaaaagagccuuuucuuuuuuuuucuuuuuuuuuuuugagacagggucuccgucuccgucacccaggcuggagugcagugguaccaucuuggcucacugcaaccucugccuccuggguucaaggagcugggauuacaggcaugcaccaccacgcccugcuaauuuuuguauuuuuaguagagaugggguuucaccauguuggccaggcuggucucaaacuccugagcuuaagcaaugcacccaccuaggccucccaaagugcugggauuacaggugugagccaucucgcccagcccuguuuugguuuuagaaguugacuucucgccgggcacaguggcucacgccuguaaucccagcuuuuugggaguugaaacaggcggaucaccugaggucaggaguucgagaccagccuggccaacauggcgaaaccccuucucuacuaaaaauuaaaaacuuagccaggacuggcggcaggggcgccuuauaaucccagcuauaagggaggcugaggcauuagaaucacuugaacucgggaggcagagguugcagugagccaagauuaugccacugcacuuuagccugggagacagaguagacacugucuggggaaaaaaaaaaaauaucuggucaugguugcaugugccuguagucccagguacuugggaggcugaggugggaggaucacaugagccagggaagucgaggcugcagugagcuaugauugugccacugcacuccagccugggcaacagugaggcccugucuccaaaaauaaaaagguuuuauaaauugauuuucuauugauuuucuaaguauuccaugucuauaaaccuguaauuauuaggccucuucucaaaucugauacacagucaaauugugacuaugccagagguucugcuuuuacucuguuguccugaauauguuuugaaacuugugcacuugaaggcagucuugacuuaguacuuuuguauccaauuucuucuucagaauaaauguuuauaaccuuauuuuuuaugggaguccaaaagguuagugcugguuugugaauucuguuuguuuuuugacuuaaccuaaauacuuuuccucugcacuuuucauuugaauuaauucaugaacuaaaugugauguacuggaucuuaagaaacauugaauuugggcugacucucuuguuuguggcggaggguaggugaagaaauaacucgagaagccaaaaaagcacgaaaaguagguggccuuacugguagcaguucugacgacaguggaagugaaucugaugccucugauaaugaagaaagugacuaugagagcucuaaaaacaugaguucuggagaugaugacgauuucaacccauuuuuagaugagucuaaugaggaugaugaaaaugguaaguucaguauauuaaauauacacgaaagcauauaauauuucaguauauuugaaaaugggauaugaaaccuuuucuucuguacaguacaaaugaucacacagauuauaaucuuugcuugguggaaagcuccaggcuuaucuaccuucuggaaguuugagccucauauaugugagaagauaaccucaauuuugugcaguuauuuuuaacuugaaaacauggauuuguaccccaugguguauggaugaaccaauguagguggugauaaguuaucaguuaacaauauaaaaaauuucauccaggcgcgguggcucaugccuguaaucccagcaauuugggaggcuaagguggguggaucaccugaggcugggaguucgagaucagccugaccaacguggaaaaaccccaucucuacuaaaaauacaaaauuagccaggugugguggcacauaccuguaaucccagcuacucaggaggcugaggcaggagaaucgcuugaacccaggagguggagauugcaguaagcugagauugcgccauugcacuccagccugggcuacaacagcgaaacauugucucaaaaaaauaaaauuucaaagguuguuuccuuugaagauucuguacuuguuuuaacaaaugauuugacauguaucuuuccuuaacacucagaucccugguuaauuagaaaagaccacaagaaaaacaaagagaaaaaaaagaagaaaaguauagauccagauucuauucaaagugccuuauuagcaucaggucuuggaucaaaacgaccuaguuuuucaucuacaccaguuaucucaccugcuccuaacaguacaccagguauccauacagaaacuuccuuuuugaaauacuguuuuaaacaaaaauauuuaaacuuuguacuaacuuuuagcaaauguucuuuaucuagcuaacaguaacaccaacaguaacaguagccuuauaacaagucaggaugcuguggaaagggcucagcagaugaagaaagaccugcuugauaagcuagaaaaauuagcugaagaccuccccccuaauacccuggaugaacuuaucgaugaacuugguggcccugagaacguugcugagguaaauaggccuguaucucuuggugacauuuuugccauuugaaccccuguaaaaugaguuguauuuugacugucuucacauaauaaucuaaauuucuuagaucauagaauucuuguucuacuuuaguugccauccuacauccaaugaacugcugccugcaguaucugagugucugucccaagccacugguccuaguuacugcacuuaucacgcaucuuuugugaucguggccaugugucaagguuuuuccagggacucuguugcaguguucuguauccuucaguguguggugcagcacagccugugcucuuaucucccaagugucuucaaggaaagaggcacugaguccauccaccgcagucagauaccuucauuguaaugacauuguuuggcuucucagaugacuggccgcaagggacggguugugagcaaugaugauggaagcauaucuuaugagucaagaucugaacuugaugugccuguggaaauacuaaacaucacagaaaaacaacgauuuauggauggagauaagguauguuuuacugagaugcuucucagugaaaagaacaaugccuguauauuuagauuaagcuuuagaagagucuuuuuccuuuuaauauaagucauguccauugaguauugucauucuguauuuuuuaguaauuguacauacugaauauuguacguguuuuuauuauuuuaucauugaauauaguaaguauuggcugggugcaguggcucaggccuguaauuccagcacuuugggaggccaaggugggcagaucacuugagcucuggaguuugagaccagccugggcagcauggugaaaccccgucucuacugaaaauacaaaaauuuagcugggugugguagugcaugccuguagucccagcugcucagaaggcagaggugggaggauagcuuaacccugggcuaugcagguugcagugagccgagaucgcaccacuacacuccagccugugcaacagagcuauuacacaaauuuuuuuaguaauugccuuuacucacugaauauuuugcauguuuuuauuauuuuaucauugaauauaauaaguauuguguguaaugcauagaaucagauauggcucuugagugcuuuggaggcuuuugaaauauuuaaucaugauauaaaaauacuguguuuucuccaggcgugguggcucacgccuguaaucccagcacuuugggaggccgagaugggcagaucaugaggucaggaguucaagaccaggcuggcaaacaugguggugaaaccccaucucuacuaaaaauacaaaaauuggucgggugugguggcaugugccuguagucccagcuacucaggaggcugagggaggagaauagcuggaaccugggaggcagggguugcagugagccaagacugcaccauugcauuuccaccugggcagcagagugagacugucucaaaaaaaaaaaaaaaacguucccuuaguucaucuugguguugugacaucuaaugucauuccgauuuugagacuaaaauauuuauguguguccauauuacuaguaauuuugguuucacuguuuauuuuauugcuaugucauguuauauuaagacgauuuacuguaaauggcuuacagauuacauucccauauccaaccauuguagagauuuugggugccuccagagacucuuuuuuuuuuuuuuuuugagacagagucuuacucuguugcccaggcuggagugcagugcaguggcaugaucucaacucacugcuaccuucaccuccuggguccaagugauucuugugccucagccucccgaguagcugggacuacaggcacgcgccaccacgccuggcuaauuuuuguauuuuuugauagagacagguuucaccauauugaccuggcuggucuugaacuccaugccucaagugguguacccaccucugccucccaaaaugcugggauuauaggcgugagcuacugugcuggcccagagacucuuucuguagacuuuguuugagaaggaccgucacuuugucccccaggcuggaucucagcucacugccaccuccaccucccggguucaagcaguucucugccucagccuccugaguagcugggaauauaggcacacaccaccacaccuggcuaauuuuugaauuuuuaguagagacaagguuucgucauguuugccaggcuggucuugaacuccugaccucaaaugauccgucugccucggccucucaaaguacuaggauuacaagaguuugagaccagccugggcaacauaaugggacccugcccuguacagggaaaauagucacaugauggcacaugcccacagucccagcuacugaggaggcugaggugaaaggaucacuugagcuugagaggugaaaacuguagagagcuaugauugcaccacugcacuccagcuugugugacagagugagacccugucucaaaaaauauauauauacaaaaagauaauguuacguauuuucaagauuguagguacagguauuaguuauuuuauauaauugcuucaugaaucuaggcccauaugcauuaggaauuacauuaguuggaauuaguuuugguuguuaaauaacagaaaauacaaagucuguuaaguguugacuucaauaagauagauuauuucucucauggacacauuuggguagguggagcagggcuuguaugcccucuugaaguccaggcaucuuccguguuguucauuaaauuaugugggccuccauuuccaaguuaccuuuguauuccaagauaccuguuccagacucuugucaguaccucuacauuuuaccuaacagagaggagacaaggggaugagaagggcaugucgccuacuuuuaaggacauuuccugugcaucauacauuuuaccuacaccuugcuggcuggagaauguucacacuuagccguaagggagacugggaaauaaaacuggaagucuucauuauugagaaagaaggagagaauaggcagucugcugaaggacuucauuuaaggcacuggccugcuuguucuuaugcaaaagugacuuuauuuuucuuauauuugacacagaauauugcuaucaucucagaagcugccagcucggguauuucauuacaagcagauaggagagcuaaaaaucaaaggcgaagaguucauaugacuuuagaauuaccuuggagcgcugauagagcaauucaacaguucgguaaguuccuacaaacuggauuucacuuaauggauagcuaggaaucauugggguaaauuugcgcauaccaaaaccuagguuuaggccgggcacagaggcucacgccuguaauuccaacauuucgggaggccacugugggaggauaacuugaguccgggaguuugagaccagccuggucaacgcagugagacccuuucuccaccaaaagaaaagaaaaacagcugagagcaguggcucgugccuguaaucccagcacuuugggaggcugaggugggugcaucacuugagguaauaguuugagaccagccuggucaacauggugaaacccagccucuacuaaaaauacaaaaauuaacuggguguguuggcacacaccuguaaucccagcuacuuagggugcugagacgggagaauugcuugaaccugggaggcgcaggcugcagugagcugagaucacgcuauugcacuccagccugggcaacauagggagauuccaucucaaaaaaaaaaaaaaaaagaagaagaaaagaaaaacuugcugggugugguggcgugugccuguagucccagcuacucaggaggcugagguaggaggauuacuugaguccaggaguucaagguugcagugagauaugauuucaccacugcacuccagccugggugacagagcgugaccuugucucaaaaaacaaaaacaggcugggcgcagcggcucacgccuguaaucccagcacuuuggcaggcugagguggguggaucaccugaggucgggaguucaagaccaggaugaccaacauggagaaacccugucuguacuaaaaauacaaaauuagccgggcgugguggugcaugccuguaauccuggcuacucaggaggcagagguaggagaaucgcuugaacccgggaggcggagguugcagugagccaagaucacaccauugcacucuaccuuuggcaacaagagcgaaacucuaacaacaacaaaaaaauccuguuuaaugucuuauaucuuaucucgaaaucucagaucuugcauuuaaggaguguuauauauauacuuuauaguauaugaugcauuguggauucauuuuuugcuuguuuacaaguuguaaaaaauauauauguggugggaauuugugggguuccaagaacaggguuccucaaggaguguccuuauaaaacuuaaggauguauuagguccauaucagagaagcugcuacuucuauauguguuuccaaccucaguagcuucaccaaaggcccauagcuccucccuccaucuucauguucuugugaccaaugauuugaaaaacaauuuugggaaaauccagaguaauugugcaucaguaacaugugguuaagcaaaauugggguagcaaugcuaauacuucugucauugagcaguuuuauguguguuaugguaauuuuacauuaucuguaauuuuuauuguuuagugguuucccaauaccaguuuaguguuaaaugcuaggaauacaucucagaauauucucuguccagcgaacacaaucaaugaucuuuaaaacaaaauuucguugcaggacguacucauagaucaaaccaaguuacugcuccugaguaugucuuucugauaucugaacuggcaggagaacaaagauuugcaucuauuguugcuaaaagacuugagaguuuggugaguuuuggaguuguguggcuguguguaaaugaugaucuauuguaccuguuuucugguaaaagguuaccugugccuugauugaaauuuuuguuuuuaacagggggcacuuacacauggugauagaagggcaacagaaucuagagaucugagcagguucaacuuugauaauaagguacauuucaauuuucaguaucucugaaaacuugugauaguguauggugucuuucgggaacacaaaaggaaaguaguuacugucuaaaacaaaacugccucuccuaugcauuugcuuuaaaaucauggcuuccuauaagacagaauuucacauguauguuagaucgcauguuaaguaucaguacagcaauguaguugucuuuauuccuuuuggaaaacaagaauaaaugagacugaauuaacugugaguucucagaagcaaaggaaguuaauuuuucucauguuuuuuauguguagagacaugaacuaggcaguauaaaauauauauaaaggccaggcgcuguggcucaugucuguaaucccagcacuuugggaggccaaggcagguggaucacuugaggucaggaguucgagaccagccuggccaacguggugcaaccacaucuguacuaaaaaaaaaaaaaaaauacaaaaauuaggccgggaucaguugcucacaccuauaaucccagaauauaggaggccaaggcaggugggucaccugaggucaggaauucgagaccagccugaccaacauagugaaaucccaucucuacaaaaauuagaugggcgugguggcaugcaucuguagucccagcuacuuggaaggcggagguugcagugagccgagaucaugccacugcacuccagccugggcaauagggcaagacucugucucaaaaaauuauacaaaaauuaguugggcguggcugggcacaguggcucacgccuguaauccagcacuuugggagaccgagguggguggaucacgaggucaugagaucgagaccauccuggccaacauggugaaacccugucucuacuaaaaauagaaaaauuagcugggcgugguggugugcgccuguaguccuagcuacuugggaggcugaggcaggaaaaucacuucaaccugggaugcagagguugcagugagccgaguuuacaccacugcacuccagccugucaacagagcaagacuccgucucaaagaaaaaaaaaauuuaguugggcaugguggcgggcaccuauaaucccagcuacuugggaggcugaggcaggagaaccgcuugaacccaggaggcggagguuucagugaguagagaucgugccauuacauuccagccugggcgaugagcaaaacucugucuccaaaaaaagaaaaaauaaauaaauacauauaaagauaauugagaauugcuuuuuugaaucuuugguacaauaaguuuguggguuuuuugggguuuuguugagagggaguuuuuugcucuugucgcccaggcuggagcacaaugacgccaucucggcucacuacaaccuccgccuccuagguucaagcaauucuccugccucagccuuccaaguagcugggauuacaggugucugccaccacacccagcuaauuuuuuguaguagagaugggguuucaccauguuggucagguuggucuugaacucccaaccucgggugauccacccaccucgaccucccaaagugcugggauuacaggcaugagccaccgcacccagccaguaguuuuuauaguauuuagguggucaugugauugaagaguauccaaaugcugaaacugguuaaagguuuugauuuuuuuuugcaguauggaagaaaugcuuuagaaauugucaugaaauccauuguaaacuuggauucuccuaugguaucaccaccuccagacuauccuggagaauuuuuuaaagguaacuucuacaaauauucauaacaaugacaaugauuauugacaaagauguacucaaaccuguuguaauguuugcuguuauauuaguuuuuuucuuuggacauaaauuguauaaaacuuugaaauuaaugguuacuaggacacauaauuaucuuguauuaaacagauuuauuaaagcaaauuuuauucaaaugaaagugcucuuacuguugauauggugaaagcauguuugucuaauaagagauuuaauagaggaaaguuguuuuaguacauugaguaaaaucacuuugccaaauagccuuuuuuaaaaauuauuuauuuauuuauuuauuuuauuuuuuuuaagaccgagucuuuuuuaaaaauuauuuauuuauuuauuuauuuauuuauuuauuuauuuauuuauuuauuuauuuuaagaccgagucuugcucugucgccaggcuggagugcaguggcaugaucucggcucacugcaaccucugccaacagguucaagccauucuccugccucagccuccugaguagcugagauuacaggcacaugccaccacacccagcuaauuuuuguauuuuuaguagacacggcguugcaccauguuggccaggauggucucgaucuccugacuucaugaucugcccgcuuuagccucccaaagugcuggaauuaacaggcaugagcuaccgugcccagccccaaauagcuuuuaaaauucaauuuaauuuuaaaguugaaaaaguaccuagguaaauaaucugugaggauugauugguuggggugggagguuuggaugaaacaaaauuggccaugaauucacaguuguuuaaacugggugauggauacauguggcucauagcuuagccuuuuuucuuucguguauuuggaaauguccuuuuuuuuuuuuucgagacggggucucgugcugucaccugggcuggagugcaauggugugaucuuggcucagugcaaccuccgccaccagguucaaaggguucuccucccugaaccucccgaguagcugggauuacaggugcccgccaccauaccuggcuaauuuuuguguuuucaauagagaugggguuucgccauguugaccaggcuggucuugaaauccuggccgcaugugauccucccaccucaaccucccauagugcugggauuacagaugugagccaaggcacccagauggaguuagcauuuuucacuaggaaguccuuuugguagauuagcacauacugauauguguuguuaacaguucauauugacauaccaguuagagguguucaucauuacucucggcuuucaacaaaagcaguaaagucuuaacccuacaccuucacuccuuuugacaucaggagugucagaaacaacucccuggucugggcacaguggcucaugcccguaaucccagcacuuugggaggcugaggugugaggauugcuugagccuaggagguggaggcuguagugagcugugauggcaccacugcauuccagacuggugagagagacccugucucagaaaaaaaaaaaaaagauuccuugauuuacuucuaacuucuuaaaauuacagguuauggcuaggcgcaguggcucacaccuguaauuucagcacuuugggaggccaaggcagguggaucauuuaagcucaggagaucaagaccagccugggcaacauggagaaacccccucucuaaaaaaauuacaaaaaaaaauuagccaggcacgguggugcacgccuguaguuccagcugcucgggaagcugaggugggaggaucccuugagccugggaggcggagguugcagugaaccaagaugaugccauugcacuccagccugggcaacguagucagacucugucgcaaaaauauauauauauauauauauauauauauagauagauagauagauagauagauagauagguuacuuguuuauuauaaguaaugacaguaaucuugcagcugggcgcaguggcucacaccuguaaucucagcacuuugggaggccgagccggguggaucuccggagguuaggaguuugagaccagccuggccaacauggcgaaaccccgacucuacuaaaaauaugaaacuuagccuguagucccagcuacucaggagacugaggcaggagaauugcuugaacccgugaggcagagguugcagugagcugagaucgcgcacugcgcuccagccugggugacagagugagacuccgucucaaaaaaaaagaaaagaaucuuaacauguauaaugaagagaguuaauacaguccccuuaacccuccuuccauucucaccuucuuaggucacagaugacagagugaacaagggcaguucucuccacauuuucuccauguuuauauaaauaucaagguguuuuuuuaaaauggcaugauacuacuuacaacauacuuuucucacuuagugguacauuguagacaucccuuguaauuuaugagucagaauugauccuguucuuacagauguucgacaaggacugauaggcguuggccugauaaauguagaagaucgcucgggaauucuuacucucgauaaagguacuacuauuagcuuugugugggcauauaacuguugcuauaguauuaaaguccauuaugauauaugcuuuugagcugaaggggaagcuucauguucuuaaaacauucugggugguuuuggcugcugugggguauguguaaaagauccaugcauagagaagcaguuuucagcacuggcugcugauaugaucagcucucaagcuuuuaaaaauuacugaagucugcugggcacgguggcucacgccuguaaucccagcaccuugggaggcugagguggguagaucacaaggucaggaguuugcaaccagccuggccaauaugaugaaaccccaucucuacuaaaaauacaaaaauuagccgggccugguggcgggugccuguagucccagcuacucgggaggcuaaggcaagagaauuacuugaacccgcgaggcagagguugcagugagccgagauugcaccacugcacuccaacuucggcgacaauagagcaagacuccgucuaaaaaaauaaaaaaaaauuggucgggcgcgguggcucacgccuguaaucccaucacuuugggaggcugaggcaggcguaucacaaggucaggaguccaagaccaucauggccaagaugguggaacccugucucuacuaaaaauacaaaaauuauccaggcauaguggcgggcgccuguaaucccagcuacucaggaggcugaggcaggagaacugcuugaaucuggcagggggagguugcagugagccaagauugcaugacugcacuccagccugggcaacagcagagcaagacuccgucucaagaaacaaaacaaaacgaaaaauuacugaagucggguggagcucagacaucgguaguuuuccaaagcucccagacauucuaauagugccacuacaguugagaauucaguguuggagaacuaacuuucuuauguacugaauuguguucauacuuuccauaagugaggcugaagaugcaaaaauucaauuugacaaaccucuuuugagcguguccugcaguggugcuaauugcuagagagagaaaugggcagauuacagccuuguugugaggacaguguaagaguuaagaaggaagacuuuuagaagagaaagugggacuugaacuaagccuagaugaauaaaaaauuuuuaauuaucauuugcaugaaaacguuuaucuuuugucauuacagauuauaacaacauaggaaaauucuuaaauagaauuuuaggcauggaggugcaucagcagaaugcguuauuucaguauuuugcggacacacuuacugcaguuguucaaaaugccaaaaaaaauggaagauaugauaugggaaucuuagguaaguagggaaaauuucccccccacaauguccccagggaaaauguggaguggagaaauucuuuaaacguguguaccugauaaaaauguucuuuuuacauuuacauguuucuuuuucuuguucaagaucuugguucuggagaugaaaaagugcggaaaagugauguuaaaaaguuucugacuccaggauauucaaccucuggccacguagaauuauacacaguaaguuuagaaaauguugugaaguaucgucuucccaugagaugcauuuacagaaaugaguuuaaauuucguuguuucucuuacagauuaguguagagaggggaaugucaugggaggaagcuaccaagauuugggcugagcugacaggaccagacgauggcuuuuacuugucauugcaaguacgacuuuuccuuuaaauucuauucagauauauaauacuuuuuaauggccagcauuguaauugucucuucacuuuguaccuguuucccaguuguguuuagcuuugucuauuuugguaauuuaucauuguaauuguguguuuguccauuuguguuauguuuuuacuuaaugcauuuuaaaggauguuauuagguguggguuuagaauuguuacauuuucuucuuuuuuuuucuuucugagacagaguuucgcucuuuguugcccaggcuggagugcaauggcacgaucucagcucaccucauccucugccucccgaguagcugagauuacaagcaugugccacuaggccuggcugacauguauuuuuaguagagacgggguuucuucacuuuggucaggcuguucucaaacucccgaccucaggugaccugccugccucggccuuccaaagugcugggauuagaggcgugagccacugugcccagccuaauuuuuuuauuuuuaguagaggugaaguuucaccauguuggccaggcuggucucgaacuccugaccucaggugaucugccugccuuguccucccaaaggaauuauagaugugagccaccacaccuggcugaauuaacuuuuuuuugagauugagucuugcuguguuacccaggcuggagugcaguggugcgaucucggcucacugcaagcuccaccucccggguucaugccauucucuuugccucagccucccgagaguagcagggacuacaggcgccugccaccacgccuggcuaauuuuuuuuguauuuuuaguagagacaggguuucaccguguuagccaagauggucucgaucuccugaccucgugaucugcccgccuuggccucccaaagugcugggauuacaggcuugagccacugcaccuggccaacauuuucuuaaauuaagcauuuuucauaagacagagacuuacuuuagucuuaauaaugcuuuauaucuuuaagacucauuuuucaguuaguaaaauagcuacauucuuucaguuaugauuugucucuguggacagaacuaaggggugugugugcgcacacaucuauacauguauguguagauacucaacaguauguagauauucagcaguaucuugaguuucauauuuacuuacucagauccaagacaacagaaauuuuauuucgccaguucucuaagauauuugggguuguguuguuucguuuuguuuuguuuuuugaggcaguuucaaucugucgcccaggcuggagugcaguggcacgaucuuggcuuacugcaaccuccgccucccagguucaagcgauucuccugccacagccucccgaguagcugggacuacaggcacgcaccaccacgccuggcuaaauuucuuauuuuuaguagagacaggguuucacuguguuagccaggauggccucgaucuccugaccucaggugauccgccugccuuggccucccaaagugcugggauuacaggcaugagccaccgcgccuggcauguggcuaauuuuuuaauuuuucuuuuguagagauggugucucacuauguugaccaggcugguuugaaacucuuggccucaagugauccucccaccucugccucccaaagugcugggauuacaggugugaaccacgcugccuggccccuucguucuuuuuuacaaggcugaguaauauuucauugguuguauauaacauauuuugcuuucuguuuacaaauauuuauggagugacugcaaguaagaccugguucuugcucauaugaaguaccuacauguaugaugauggcacaggcaggaugaagucauaaaugaucuagggcaggaguugcuaaacuuuuucuaugaaggucugauauguaugguuuuguaggccauauguggucuauauugcauguccucuguguuuuccuuccuuccuuucucuuuuuuuucccaccuuccuucauuccuucuuaaucuuacuucaguuuaggagugccaagcuagauuuauuccacaggccuaagcugcugauccuugaccuagagaaaagcucucaaaggaucuggcuccuaguugaguugggguuuuuugguuugguuuuguuuuuuguaaugggaucucgcucgcucugucacccaggcugauaagcaguggcgugcgugaucauggcucacugcagcuucaaccuccugggcucagacaauccucccaccucagccucuuaaguagcugggaccacagguacacuccaccacauuuggcuuuuuuuuuuuuuuuuuuuuuuaaugcaguugaugucucacuguguuguccaggcuggucucaaacuccuaggcuuaaaugauccucccaccucggccucccaaagugcuggauuacaguugugagcuacugugccuugcugguuuugggguuuuugaaauacugauugaacuguagguugauuugcaugucauuauaagaaacaguacagauaaacaucuugcauacuuuuaucaguuaccccagugguaauauuuuuuaaaacuguaguguaauaucacaaccaagauguugauauugguagaauucaaguauuuuacucggcuaucccccauagaugcaauuuugauugguccacauaagguguugguuauuuucaggacagucucgaacuccuccugggcuugauccauccucucaccuuguccaccugaauagcugggauuacaggcaugcaccacugcaccuggcucuugguuauuauuuuuaaauugaaauuauugccagaauaucaccguugguagauugugaugaaaguccugauccccagcuucucuuagguugaaggaugugauaauacugguccuucauucucuguguggcaacagguggcugggcgugaggaguggugguccuagagaccucauuccuggucuucguuugccuuugaaccuccacugcauuaggccaccauacuuuucaguguguguagccugugcugccauugggaaaacaaugucagaaucacuuuccacuguucugugaugauguauaauuaaccugacacugucaagacagagcccauuguuaagugucuuaaacacuauccucuaaguauagguuuggauauuuccugucagcugauaaauaauuuuaaauauaaucuucaccuuaaccauuguuuuaugacuuuacaguaauuauauaaacaauguuucaauucguuggaaaaaguaagagaccaagggucuuuaauauccaugaagaggaaaguaaaauauuguguuuuucauuauaagaaugaauauaaaaaguuaauagccccgcaaacaaugauuuauuguguagagggcugggaaaaugguuuuacuuugaaacuuuucuuuuuccuuccguuuugcuccagaaaugauuguuuagaagcuguucagucuuuauaaagaagaaaugaauuuuccaguuguuuuuccuugaguuaaauggaguuuuaagaguaacuccuuccucuuaaaguuuuucucauaaauccaacuuuaaaaaguuaaaaauaggccaggcgugguggcucacgucuguaauccuagcacuuugggaggccggggcggguggaucaccugaggucaggaguuugagaccagccuggccaacauggagaaaccccaucucuacuaaaaauacaaaauuagccaggcaugguggugaguaccuguagucccagcuacucgggaggcugaggcaggagaaucgccuugaaccugggaggcggagcuugcagugagccgagaucgcgcccuugugcuccaggcuggugacagagcaagacugucucaaaaacaaaaaaaaaaguuaaaaauacauaccuaaauuccaacauuucucuaaugcuucccuuucuuccauuuuuaccuccauauguguggacaauuuguucaacauuuuugcuuucugcugccauagcagcuuugauguuuacagaacacuuuaucaugugaucucucacuuugcccuucaaaacccugugacaucgggaaaggcaguacugacggaguagacaagugcagaggacuggggccauccaaggccuuaucuuggaggggcuugaauucuauuguuaacuugaaaggagaguaacauuucuuuuuccauuuuacugagaaauguuuaaaaacauacagcagagcuuaaagaauuuucucugaagaccccuaaugccuacugccuggauuccacuguuaacauuuuauuacacuugguuuuucuuaccucucugaggcugcuugacugggauuccagguacaggaaauaaaagaagcaaaaugaucuguguuggacauuugugcauuaaagcuaauuccacguaguuuucugaagauaacuuuggucuuuaaccuucaucuuuagccagaauuaagguccaauaacugccucuugggugugacuguguuagucuuuuaaacaagcauuuucgguccuuuuugaaguuaccguguacuuacuuaguguuauagucucaaaugauuauguuugcugacgugaugguacagaaacaugucuuaaaguguguauuauaaaaucuuuauauuuugucauuuucuuuaaacagauaaggaacaacaagaaaacugccaucuuaguuaaagaagugaauccuaaaaagaaacuuuucuuaguuuaucgaccaaauacugggaagcagcucaaauuagaaauuuaugcugaucuaaaaaagaaauauaagaagguauuuuuucauuuguacauuauauuauauaggaauacuuacuuugggccaggcaauguggcucacaccuguaaucucagcacuuugggaggccgaggugggcagaucaccugaggucaggaguucgagaccagccugaccaacauggagaaaccccgucucuacuaaaaaugcaaaauauuaucccaggauggugaugcauaccuguaauuccagccacuugggaggccgagguaggagaaucacuugaacccgggaggcggagguugcagugagccaagaucacgcuauugcucuccagcccgggcaacaagcgcgaaacuucgucucaaaaaaaagaauacuuacuuuagcugggcacaguggcucacgccuguaaucuuaguacuuugggaggccaaggcgguuggaucaccugaggucaggaguuugagaccagccuggcccauauggcgaaaccucaucucuacuaaagauagaaaagauagccaggcguaguguugcaugccuguaaucccaguuacucaggaggcugaggcaggagaaucacuuuaaccugugaaguggaggaggcuugcaguaagccgagauugcaccacugcacuccagccagggagacagagcaagacuccgucucaaaaaaaaaaaaaaaaaaaaaagaauacuuauuuuauaauauauugaaauuguuuaagauagcuuuucuagguaugaaauuauauuuucuuuuucuuucuuucuuuuuuuuuaaaugaggucucacuguguugcagaggcugagcuggucuggaacucaugggcucaagugauuguccacuucugccucccaaagugcuagaauuaacaggugucagccaccgcacccagccugguuuaaggaaagugucaacuuuuguuaugcuaauaucacagucuuaauguuaccagccuuaagaaacuucuaagguucuguuacccaggcugggaguguaguggcgcgaucuuggcucacuguaaccuccgccucccggguucaagugauucucaugccucagcuucccaaguagcugggauuauaggcaugugccacacaccuggcuaguuuuuuuuuguauguuuaguagagacggaauuucaccauguuagccaggcuggucuugaacuccuggccuuaagugauccacccgccucagccucccaaagugcugggauuauaggcaugagccaccgugcccagccuaaaaugauuauuugaaacagcuuaucucuucaguaaaggaagcuuccagugcuaaucacaaaaguuagaauguuuaaagcccuucucacuaccucuuaguuuuauugugaggaugccucuauguuuauauuuugcaaugauuuauagaaaauguuaagcgaccacuuuuccuaacauuuacuauuagguuuuauuuuauuaauauuaccuuauauuauuauuuguagccauucugauuugaaaacaauuauaguuaaguaguuauuugaaaaauguauuacauaagaggaaccagcaugacagagcuuuucaaauggcguucagauucaguuaauagcaaggguuaggcuuuuuguguagagauuauuuuaaauuggcuaccucuagaauuacagaccagacuagguaaccaguuuauuuaaagcaauacuguuuucaaugaaauucuucucauuuuuacaggucgucucagaugaugcccugaugcacugguuagaucaguauaauucaucugcagauacuuguacucaugcuuauugguuaguauuuucguguuuccuaccaaauuuuccaaaauuuaauugagauuuaaauacaccuucacucuuuaucaguauguccucaugaauuaacuaacagauuaaguauugucaggcgugguguguuccaucaggaauauuuacuggacaguuguagacuagaaacuguuuaguuuauguaccuccuuacucuucacugaugcuuucuuauuuccagccaacuguugucuggcagcaugaccuuaacaguuauccuucauauuagaacuugcuuuuucacggcugggugugguggcucacgccuguaaucccagcacuuugggaggcugaggugggcggaucaccugaggucaggaguucaagaccauccuggccaacauggugaaaccccaucucuacuaaaaauacaaaacaauuagccggugugauggcaggcaccuguaaucccagcuacuugggaggcugaggcaggagaaucgcuugaacccggaagguggaaguugcagugagucaaaauugcgccauugcacuccagccugggggacagagcgagacuccauuaaaaaaaaaaaacaaaaaaaaaaacaauaaggccaggugugguggcuuacgccuguaaucccagcacuuugggaggccaaggcagguggauaaucuaaggucgggaguucgagaccagccugaccaacauggagaaacccucucuacuaaaaaaaaaauuagcugggugugguggcgcaugccuguaaucucagcuauucaggaggccgaggcagaauuguuugaacccgggaggcggagguuguggugagccgagauugcaccacugcacuccagccugggcaacaagagcaaaaacugucucuuaaaaaaaaaaacaaaccacuuuuucgcccuccuucugucacucucccuucauguuuuuuuguuugguugguuauuuuaaagagacagucucccuauaucaccuaggcuggaguacagugcagcaaucauagcucacugcagccucaaacuccucccaucucagccuccugaguagcugggcucuuuucuuucuuccucucuuuuuuaaaaaagcuuuacuggugucccagaucuagggaaugucuaagaaaccagggagauucccaaaguuaauagcacagcacaugcaaacuuuuguuguugagucuuggagcucuuccugcugugcccccucaccccuuggcuuacaguguucacuuugugaccucguauacucuuauacucugcaaaucauaguuuucuucucauuguucucucccucauuaaguaguuaaugcucuuacaguaucuggcccacuucaugaaaaggaauaugagauguaaaugaauuuuagcuugaggggcuuuuuguuuguuuugauuguuugggcuguucugcagguagauaaguuggcuuugaugugaguagugcuuuugguuuucauuaugagaguaaauuagugccacugaaaauuagaaaaaaucuguaagauaaaauguuuuaaaagguaggcuggcuaggcaccauuggcuugcugguaguaccagcacuuugagaggucgagauggaucacaugaguccaggaauucaagaccagccuggccaacauggugaaaccacgucucuacuaaaaauaaaaaaauuagcagggcaugguggcagacgccuguaaucccagcuacuugggaggcugaggcaugagaaucgcuugagccugugaggcaaaaguugcggugagcugagaucguggcacugcaccccugucuggaugacagcaagacguggucuaaaaaaaaaaguuuuaaaaguuaaccuacuaacuuggguuuuuuuuuuguuuuuuuuuguuuuuuuuuugagaugguguccuugcucugucacccaggcuggagugcaguggcacgaucucagcucacugcaaccuccaucucccagguucaagcaguucuccugccucagccucccgaguagcuaggacuacagugccugccaccaugcgcagcuaauuuuuguauuuuuaguagagacaggguuuuaccauguuggccaagcuggucucgaacuccugacuuugugaucugcccaccacggccucccaaagugcugggauuacaggcauaagccaccgcgccuugccccuacaaacauuucuuuuuuuugagauggagucucgcucugucacccaggcuggagugcaguggugugaucucggcucacugcaagcuccaccucccagguucacggcauucuucugccucagccuccugaguagcugggacuacaggcacccgccaaccacgcccggcuaauuuuuuguauuuuuaguagagacgggguuucaccguguuagccaugauggucuugaucuccugaccucgugauccgccugccucugccucccagagugcugggauuacaggcuugagccacugcgccuggccuaaacauuuucuaaaacauuuccucuggggacagugcaguggcuccuagcacuuugggagaucaagaugagaggauugcuugaggccgggaguuugagaccaaccuccucaacacagcaagacuccaucucuacaaaaaauuaacuuaaaaaacaacaaacauuugcuuugaguuauagcaagaaaaguguccuauauaccuacauuuaacacuguauuagauucgucuugaguuaguacuaaccagaagggcaucuuuauugaugaauauucugaagauaauuuuaaccagaaaacauugaugguauuucuccuuuuucucauuucuucuuaaauuuacauguagccucucgcuccccucccaccccuuuccaucucucuagauugcugaguccuucccacuaaugugauuuagaaccaguguaucaguaguuucauaauauagaaauaacuggcaggaucuuccccccuccuucuuuucuuuucacagguauugcuuguuuuuucauggcaggaucucucaggaucuuuuuucuuuuuuaaacagagggcuugagugcaauggcaccaucuuggcucacugcaccuucugccucccagguucaagcgauucucgugccucaaccaccugaguagcugggauuacaggcaugcgccaacacacuuggcuuuuuuguuuuuuuuuuuuuuuuuugaagacagagucuugcugugucgcccaugccagaguguaguggccugaucuuggcucacugcaagcuccgccucugagguuuacgccauucuucugccucagccucccgaguagcugggacuacaggugcccgccaccacacccugcaaauuuuuuguauuuuuaguagagacgggguuucaccauguuagccaggaugcucuggaucuccugaccucaugaucugccugcuucggccucccaaagugcugagauuacaggcgugagccaucgugcccagccaguuuuuuguuuuguuuuguuucguuuuuuuugagacagagucucacucuguugcccaggcuggagugcaguggcacgaucucggcucacugcaagcuccgccuccuggguucacgccauucuccugccucagcuucccgaguagcugggacuacaggugccugccaccacuccuggcuaauuuuuuguauuuuuaauagagacaggguuucaccguguuagccaggauggucucagucuccugacuuugugaucagccggccuuguccucccaaagugcugggauuacaggcgugagccaccgcacccagcccauaccuggcuaauuuuuguauuuucaguagaaaugagguuucuccacguuggccaggcugaucucaaacuccuggucucaagcugucugcaugccucagccucccaaagugcugggguuacaggcaugagccaccauaccuaauuauuuuaaacuuuuuguagagauagagccucgccauguugcacaggcuggucucaaacuccugaacucgaacaauacucccuccucagccucccaaagagcugugauuacaggcaugagccacccugcccggcuagcaagaucauuuuauaaaguagcaauauugcaguaaaauaauggauauuaaaaugacuaaaaugcuucaacagauagcaaacacaauaaauucaacccuuuuuauugggaggcaggccccugaaaaaaucgugguuuuaaaaaucagccugauaccuuaaauuggaaaugcuaacccaaugggccaacagaauuauaaucuaagaaauaguaaaggcaaauacugcugaaacauuguuuauuugaaauuugaggccaagagcgguggcucacgccuguaaucccggcccuuugggaagccaaggguggaucaccugaggucaggaguuuaagaccagccugcccaacauggcaaaacaccgucucuacuaaaaauacaaaacaacaacaacaacaaaaaaaagucccaguuacucgggaggcugaggcaggagaaucacuugacccugggaggcagagguugcaaugagccgagaucgcaccacugcgcuccagucugggcaacaagagcaaaacuccaucucaacaaaaaaaaaagaaaagaaaagaaauuugaguugaccuuguaaaucuuuuagaaacgugucugugugcauauauagacacucauauguauuucuuucccauuuuucuuaggcgcggcaauugcaaaaaagcaagcuuggggcuaguuugugaaauaggucuucguugccguacauauuauguauuaugugguucagugcugagugucuggacaaaaguugaggguguucuagcaucugucaguggcacaaacgugaagaugcagaucgugcggcuaagaacggaagaugggcaacggauuguaggugagucuaauuuuuguuuugguuugaguugcaggaaaaaaucggauccgacuuuuuucucauugcuaauaucuuagcuuuauuccacaugcaucuaacaucucuuccaguaguggguaugggacccguuuuauauuucuuacaagguugaacagaaguuaagccuucaaacagacauuguugguucugguugaaguuaugauguggucaucucuuugaugcugcucucagcugcucuugcucuccuucucuacucuugguggcugugcaggcucccugguguguagacaguucagccucuugcccaggaguucuccauugagcuaacuuaagacucuggaauucaaaagccacugugcacagagaauggcuugguguccugcagggagcaaggguagacuaggccagcuauucucaccgugugcucaacuacagguguccaggaagcagggcagcaacuggacucuguuugcuuaucuugguuucgcuuacagcagccuuccucuaccacggauugcauaucgggaguucaugggccaaagucagucuauggaauuuuuuuuuuuuuuuuuuuuuuggacaccaguauuuugggauguuguagguuuucauuugaauuaaugaauuuuuuuuuuuuuuuuuuuuuuugagacugagucucacugugucgcccaggcuggagugcaguggcgugcucccggcucacugcaaccuccgccucccgaguagcugggauuacaggcaugcaccaccacaccuggcuaauuuuuauauuuuuuuaguggagauggguuuucaccauguuggccaggcuagucucaaacuccugaccucaagugauccgcccaccucagcuucccaaagugcugggauuauaggcgugagccaccgagcccagccucauuugaauuaauugccaacauuuaaaaaucaagagguuucauauaaaagucuagauuuccaguuucaaaagcagcccaucagcugggcaugguaguucaccuuguaaucccagcauuuugggaggcugaggcaggaggauugcuggaguccaggaguuugagaccagccuaggcaacacagugagaccuugucucuauuuaaaaaaaaaacaaauagggccgggcacgguggcucacaccuauaaucccagcacuuugggaggccgaggcagguggaucaugaagucaagagaucgagaucauccuggccaacaucgugaaacccugucucuacuaaaaauacaaaaauuaaccaggcgugguggcaggugccuguagucucagcuacuugggaggcugaggcaggagaaucacuucaacccgggaggcggagguugcaaugagccaagauugugccacugcacuccagccuggcgacagagcaauacuccaucucagaaaaaaaaaacaaaaaaaaaaacacauauauauaugcaugcaauuuaucuggaacauugagccuucaauccuacaugcaggacuuaaaguucccuuaaccagcacccagagaguauccuuuccaguuugcuaguaucugcucuucuaaguuaaccuguuucgguuagcauuugaauuugcaacuucuguucuguagucuuuuggugcauuaaaagauaauacauagaauaauagauauucuuaaccuccuguuaaaaagagaauaauagauauucuugacuuccuauuccuccaacaagauagcauuacacuaaacacaugcauaugcuuggguauuugugggaaaugcuguggaagaaucagacuacaucucaauggccauuucauuuauuagguagucguuuaauuuuugugugaacuucuuguccauuacgcuuaauauuaugccucauuuggaaucugcugugaagcuguacagugugguuucuucuggacacaacuugauaaauucuuguuacuaauuacagguuugaucauuccggcaaauugugugucuccucuuguaaaucuccuaucaacuucagaccagucucaacagcuugcgguccaacagaaacagcuauggcaacagcaucacccucagagcaucaccaacuugagcaacgcaugaagaacagacagguuucaacauggauggaucugaaaugcuguugaagcauaucauuugcauaaaaaucagggacaguuuccaaagaauuauauauuuuuuucaguugugcucucuaguuaguuuuuuugggaguaaggacaaaccuggaauagauagcaaaacugaaaaucagcagugcugauggugguacauaugucuuuccuuuagcuucuccccugauaauucccaucugcuuuuacuucgggugagcagagggggaugugugugugcgugugugucagucuguuugugaguguguuaaaggcuacagaccacaguugguuuaaaaugcuuggaacuucccaaacuggcuuuacuuuauguuuauacagugcucaggguuaacgcaguacauccaugccauugcugugggagguauccccggaugcauguguuuugagucuauaaauauagaaaauauauauugguuucuuuuuccaacuuaauagguuuauuaaagcaugaaaugaaagguugcauaucaugcauucagguuauuuucuaauuuuuguucugacagugcaugucuuuggaagcaugcugaaacaagauuaacacaggagucgaguaacagagagaaacauuuguuagauguacagcauugguuauugcauuuuuauaguguuuauaccuggguauugcuucaaacccugcagaccccuccuuccccuucucccugcccuggguuucuggucaagguaaugaauacauacauuuuucugugauaaaacucuuaaaaguuaauuuuaauguauuaauaguauuccuaaugugugcugcagaaauggcuaugagccucuuaaauuuacauuugcaacuuaaagguaguuuuagaaggaaguacaaauuggcuuucaucuugcaaacaaucguuuuuuacuucauuaucuuaauuugcuuugucacucauaaaaaggaaaccauaccugaguuguagacaaugaggaaacacuugaggcuucugcuguguguucuuuuguuauuguuguuauuguuguuacucaguaacuugaauauuguuuaauguguuguaagacguagaguuuaucucaagcuguuaaaaaugguaauguacaaaugugaauagacacuuaucuauauaauauggguaaguuuuguuucgccuauaauagauguuuauaaaaacaagugaggggacaguuggucuuuuuaucuuuucuuucuuuuucuuucuuuucuuuuuuucuuuuuuuuuuuuuuuuuuuuuuuuuuugcuuccacagguugcacuauugaaaaaucgagauuguauaaaccugguaaaaagcugcaagaugccaaaaucuuguagaugucaaauaaaaaguuauuauacuaacaagaaguggacucuuguuuaggcccucacuggugaccuucagaaguagucugugacggggacucagcagaauuuguguguugucucagcauuccagguagccuuauaguuuggcuuaaaacuuaucccuaaaauguaagauggcauugagggaaaggguauaaugauaguacuucugaauguuuuuuaaguugaauuguuuguaaacuucuugcagaauugggugagauguguguuaaaacugacaaaccuggcugaaagcuuagggcguucauccucuugugucuccuuuagccugaguuugguuaugucaagcuuaccguaaguuuucuuaggauuuauuuauucuuggugccuaaaagaauaaauugaaaguacuuucuguucuuuggcacauuuugcccagcggaugcaacuucuauccucaguccaguucauauaucucaggcagugauccauuuuguaucagccaguuucccuuguuagggccgcuagacccggcuggcagccaagagcagcacucuccccaccuucagcagaacuucucagcucauguguguguuuuuaaaagcaguaggcagcuuccaucagcaauggaagugucccccacuccagugguggaggugcagucgcuggaccugaggaaguggggaagcauuacaaacccuccugcaguaagaauggcagaguugggaaggaucuucucucgcaggcuguuggcccaacuccucuuuucuguguaugagggcaucuuaguuuuuuauggcguuuucaaagcagcauaugaggauucuuagcaugcagcuaagugacaacccccauggccuaugauguaauguuugcucuggacuagccaucuugauaaauaggaguguauguaucuuagguucuuuguagaacagcuauuuuuuuuucucauuaaaaaggccucugaaagcccucucaaaauggaccucacaaaggcaaccagugugaauggaugggagcuggggugcugcaugcccaggcuggucauggugugugcagcacccagagaguugcacccaccccuucuucagguggacauccgaccuuuacacuguggucuugcaaaaaucagcgaguuaguuuggccgcccugugaagcuucagcauucaagguccucuucuguuaaaacccaacucguagccgggcgugguggcucacuccuauaaucccagcacuucgggaggccaaggcaggugcaucacuugaggccaggaguucgagaccagccugguccacauggcaaaaccccaucuguaccaaaaaauacaaaaaauuugccgcugacuucuguaaaauagguccauucauugcaggaucuaaaugccacaccugaauucagaggccuuguuuaauuaaccccauguccacuuugccucugcaaugccuuuuucuuuuuagcaauauggcucugagcacaaagauuugguuggaaaucauguucguguuuucagaguuuacagcgucaauuguacugaaaaccacuuccagagucuaaagcagcucagauguuaucucugggggaauuaguguuccccucauuuagcaaccuccauaccacaaggucucugucuguaguuacugggauuauccagauacacuaucaaugauacaaauucauaggaguauuaaugcauuucuuuaaacacaacuugauuaagaagcaaauauguuaagcaguuuucuuuuucugcugcuaaauuacaguuagacacuucaguaucuucucuuuacauguguauauaaauuaguaagaaccugcauccaaagcaauguaguguguguauguaucuauauauauuuauucuaacucagcacuucagaagccuuuuugaguuacaacaauauuuuaguuugccucaucuguagagguaaaauuucuauauuaccaagcuccagaggaauaugauauuuuacaggcacaauuuucuggcuguagucccuggggcauucauuugcuggccuccaugggaugcuguuagaacaauuguuagccggcaagagaagaaaggcuaccaggacagcauuuauaauuguagaaugggagccuucuucccucuccccuccacuuucauuuuagcaugagauaaaaaaauagauuggaaaugauuguugcaucucacuucauggaaguaggggcagaaguucccucuggauccuuuucuugacaagcagucaagaggaagguccccauacacauguaccugugugauacuugguaguuucuaagaauggugcuacauaagcguugcuguuaggcugggauccuauuaaugaacguuugauuaguucaggccucccaauggcaaaggcagacaccguggagauggacauuuacugacuccccuucuguguggcuucggucucccuggcuaacaccacaccugugcguacugcgcucggcccacuuugcugcagaaacguagcaagcguuucaugucagggcuacagcugagagcaaaaacugcaaaaaaaaaaaaaaaugucucauugaaugccaguugucugauacaaaugcagugucuuuuaagugacagaaacacaccuaaauaccugcaacucaagcucgcuagcauuuuuuuuuugaguacuugagauaaaauccaaaacccacccucuaauuuugugcuguauuuauauauauguacauaaauguauauauagagaaauguugaguucuucuggauucugaauguaaauaauucuuguaaauugggacucugcccaccuguuucucccuuuucccucuucccuucagcucuauuuauucuuuucuugacuuucccauauggggcaucuuaugacuuuuuuuuuuuuuuuuuuuuaagaaaaguauggaaaacuuuucauuuagaaaaguauuuguuccuguauuuuagaauucaguuuugcaucuuugcuguagaauuccuguuuuguguuaauguuuuuuacuaugucuuauuguguugugugcaaugcauuguacuggggggaugcacuugagugccauuucugauacugucauuguaugacugcugaugcucguuuauguuguucuuuggaagcuauagugagccugauguuuucacauuuuaaaaaaugcuuccugagacuucuuuaagcuccucuaacuucuucagugcauuugggaucaaacuuagcucuuagaucagcaaaccugacuugcuucuacuuuugcaauuuuucaggccuuaccauauuucuuaucucugucuucccaccugauaggaaaaucuugcagauuugaaacagugguuucuggccugcugcugcagcaaauucccuauguuuauuuaagaagucgggccuaugcuuuuaaccuacaaaugaugaguaauuuacuugcaaugaacacagguagccugcugcuguuuauaaccuguugaggauauuuauagcaggcaggaggcaggccuaguguguuauugacaggugacuuuagagaauguacauuggccgggugcgguggcucacgccuguaaucccagcacuuugggaggccgaggcgggcggaucaugaggucaggagauugagaccaucuccuggcuaacacggugaaaccccgucucuacuaaaaauacaaaaaaaaaaaaaacuuagccaggcgugguggcgggugccuguagucccagcuacucaggaggcugaggcaggagaauggcaugaaccugggaggcagagcuugcagugagcccagaucgcgccacugcacuccagccugggcaacagaccgagacuccgucucgaaaaaaaaaaaagagagagaauguacauuaaggaacaauuguccuccaaaagagagccaagcaacugcucuggagccuccuaggcugacucugcuggagggugagacaagcagauucccauugcagcacuggucccugggguacccugaacggcugugcucuccacccuuguaucggugaguggaucuugucuacaucagccguaagccuagaagcagagcgggaucgaggcguuuuuaauaauucgaguugggaagacccggaugguucaucaaaaugaugguguugagcacccgggaggcagacauuggguauuuguucacaauuuugcaccuguaagaaaauguuccuuuauaacuuucaaggauugccgugagcgucuuuggggccuuuucauucauguacaaguuucauucauuacuauucaacuugguagacuuggugaaaaauguaaaagcauucuguauuuggaucagucuugggaacuaaauuugucgugaauuggggccugucacagauugccuccagugugcauccuccacgcagacccuccuugcucagucucccucuggcgcccauggggaagccgugcugugguuggcagugcggccaucugggcugccgcaacguggcagggcaccguccagcaagacugccccuuagugcagggcuaagcaaggaaaagaagaagcccaaaaaggcggguucuuuuugauacuuguaauucaggcguccuccagagugaaggccacucugcaggccccuggugagaaccugucuggcuuuuccacugcgggccccuaaccaguacccugcccuuguggcccauuugugccugggcagauguuucuggccagcagacacugaaggccuuuuugcugugacaguauuuauggcacugaagaggauaaagaagcuugagcccucuuucugacucccacuuuauggggcagagagagcuuuuuuucuacauagcacauugcagucucaccgcuaucagaaaaauauccuguucaugguuuauacugaauuugcaaacuacugauaugauuuuucaauaaccacuuguaucuuccaucauccaugagaggugggaagagguacacuguaucucugcaauaaaacuuuggccagguucuaccuccucugagcaaaggauacuuuucuauguagguguagaugguucuccuuuacuaaucugacauggugcaucuggagacaacaucugaugggauccaaagacaacuugaaacaaagguggaugucagcucuugguguguuuucauuugguucucuuuuuuaaaucucccuuuuguuaucgcuccuguuguagcguguccaucagugugugaagggugcgcccuguuccaaugauacugcauugcugcauccagccuuucgugggagcacgguaccaagcguccggaauugauuaucccaaucauuuuugauauguaacugaaaaauuuggucucaugcaauaaaaauguacuggcugcauuuuagcaagguuuauuuacucuugcaaguaaaaacgaucaaccgugaagcguaacaaauucuguauuuaguuuuuuuuucuguuguggugguuuuuguuuuguuuuuuguuuuuguaagauucuaaauaaauuaaauacgaguca

SEQ ID NO: 191527 - RNA, 8287 nt, Homo sapiens
ggcgaaucugcugcuaccaauguaaaggucaggccgaggccggcgcggagaaucugcugucgccugcagcugcucgccugucuccgucggaagggagcccaagcuuugcagaggugaguggaagcggcuuggaaggagcgggccccacgccggagagaaggaagagggagugcggcccagacgcugugcccgcgcuuguguggggcgccauguugaaaccuggcaaaggggacgacauucuggguugcguugcggggaguggggacgagagcuggauuggaaggauggcgccuuacucccugcggcccccagagaaggagaggggcgggggagcggccucgaggguuggcggccaggcugcaggcuggaugggaaggauaggcuuuuccacagaaacuuagguguuugccuccgaggcccacugcgcaugcccuggagggcucuguggguuccgccuucaguuuugcuuuucacaggaggggcaaagucuuuuuuuuuuuuuuuuccuuuuugagacagucuugcucugucgcccgggcuggagugcaguggugcgaucucgguucacugcaaccuccgccuccuggguucaagcgauuccacugccucagcuucccgaguagcugagacuacaggcgcccgccaccacgcccugcuaauuuuuuguauuuuacuggagacgggguuucaccauguuagccaggauggucucgaucuccuguccucgugauccacccgccucggccucccaaagugcugggauuacagccgucagccaccgugcccggccaggaggggcagagucuuaccccgaagacccaggaaggagaggcuucauuuauuuuuuuguuuuuccccagagacagggagucgcccaggcuggagagcgguggcgcgaucucggcucacugcagcgucgacauuucgggucaagcaguccucccgccucagccucucaaguaucugggaccacaggcgcgaccccacgcccggagaauugauuauugauugauugauugaaacggggucucacuuuguugcccaggcuggucucgaauuucugggcucaagcgauccuccagccucggccucucaaagugcugguauuacaggcgugagccagcgcgugccuggccaaaaauuuucuaaauuuguauaauaauuuauaauuguaaugcauuuuuauagacaccauaugaucuaaucuucacaaaaaccuagugaagugacauuuagcuacauuucacaauaagaauccugaagcucaaaauuuacugaccucaaauaauccacccgccuuggccucccaaagugcugggauuacaggcaugagccaccgcgcccuggcccccaccauucauuucggcucucauccccuguugaugaguaaaaugagaaugaggcccaggcgcggugguucacgccuguaaucccagcacuuugggaggcugaggcaggcgggucaucugacaucaggaguuugagaccagcuuggccaacauggugaaauccugucuguacuaaaaaugcaaaaauuagcugggcgugguggugugugucuguaaucccagcuacucgggaggcugaggcaggagaaucacuugaaccugggaggcagagguugcagugagccgagauuggccauugcacuccagccugggugacagagugagacuuugucucgaguaaaaaaagagaauguaaaaaucgaaagagauuguuguaggaaaucucaaccuaaugcugccggggaggaagugcaccuagaaagauuaaugagaaacaaugaaaccagcuguuaguaucuauagaagcaugcagaugagagagagaacaaaauccaugcuuauccguuuguaauucuccuccauuuuaauuugaagaagucuuaaaguuuugaacaggagcucuguguacaauaauaucaguuuuauuugguagauccuugugacuccugacuucaaaugauccgcucaucuuggccuccucaagugcuaggauugcuggcgugagccacugcaccgggccccuugugacuuuuuaacguugaauggggagggguucuuuuccuucaggagaggaggggugggucucagccucagacacccagaauacugguuuguguguuuucuuuuuccuaucuuuaucuccaaaaccuuauauuuuaugaaaagcaucagaggaaacgauuaagagcuuuagcucuggaguccacacugccccugguucuaacuccuccacugggcuacuucuuagcuuuaggauuuggggcacaggcugccuuuuugugucugaccuuuuucaucugaaaaggcaauaauaauauaguaccuaaguccugguauuguugagaagugagaggaguuaagagguuaguacaggcuggguucgcuggcucacauguguaaucccagcacuuugggaggcugaggcagaaggauagcucaugcccaggaguucaagaucagccuaugcaauauagugagaccccaucucuacaaaaaaaaaaaaaaaaaaaaaagcuggguaugguggcgcauagugaguaauuccagguacucaggaggcuagggugggagaggcugcagugagccaugacugugccacuguacuccagucugggcaacagagcaagacccugucucaaaaaaaauucaagcgauucuccugccucagccuucuguagcugggauuacaggcaugcaccaccaugccuggguaauuuuguauuuucaauagagacgggguuacuccauguuggucaggcuagucucgaacucccgacuucaggcaaucugcccacuuuugccucccaaagugcugggauucaggcgugagcuacugcgccuggccuuuuuuuuuuuuuuuuuuuuuuuuuuaaaaacagagacagggucucaccauguuucccauguugcccaggcuagucucgaacuccugggcucaagggauccucccauuuuggccucucaaagugcugggauuacaggcgugagccaccacgcccagccucuucuuucuuuuuuuuuugagacggagucucgcucugucgcccaggcuggagugcaauggcgggaucucagcucacugcaagcucugccucccggguucacgccauucuccugccucagccucccgaguagcugggacuacaggcgcccaccacuacgccuggcuaauuuuuuuuuuuuuuuuuguauuuuuaguagagacgggguuucacuguguuagccaggauggucucaaucuccugaccucgugaucugcccgccucggccucccaaagugcugggauuacaggcaugagccaccgcgcccggcugccucuucuuuuuuucacguggagaaauuccagccacgagagaagacacaaauugaguuagagccagagcccagaccaggacugaaauugucucccucucauccugugcuccuucugucacuccaucuguuuuucauucuuuuacugacagcagagaggcagccucugcaaaguugcuuguugaugaugacagacauauugcccuccuuuuaccauguggugguaaacagugucauguccuguucuuguuucucaaugaucagguuugccugauuuggacuaaaaaaaguucuaugauuuuuuuuuuuuuuuuugagacagaguauugcuguguugaugaggcuggagugcaguggcgcaauuucagcucacugcaaccuccgacuccugguuucaagcgauucuccugcugcagccucccaaguagcugggacugcaggcgcccgccaccacacccagcuaauuuuuguauguuuaguagagaugggguuucgcuauguugcugaggcuggucuugagcugcugaccucgugauccgccugccucggccucccaagaugcugggauuacuggcgugagccacugcgccgggccaguucugugauuuuugaucagaguugguucaguuccucaguauuuaucagaaagcauccuaggaucuggagccaccagacugaagaguguuuacuguguguugggcaaaacaugaucaggacuuuagaaguuucaaugagcugugagaaagacacaguugcuucaugguggagggagcuaaaucuggacuugacaggcccaguagaauuuccgcaaguggauaugagggagauagacagggagagcauauucccaagagaagaaaucauccugagauguuugcacaaaugguuuaggccaaaaagaaagaaaaauuguacuaggaaagacauggggcuggagaauuagggcauauucaaggaaggaggagcaagccuggguaguuuacaaacaggcuuuguuccuguugaaaggaucaggagaaaaauagaauagguuuuaugaugggacauggugagaggcuaagugagggucagaggucuuuuuuuuuuuuuuuuuuucuucugagauggagucucgcucuguugcccaggcuggagggcaguggcauguucucggcucacugcaaccuucgccuccuggguucagccucccaaguagcugagacuacagggugugcaccaccuugcccagcuaauuuuuuguauuuuuaguagauaugggguuucaccauguuggccaggcuggucuugaacuccugaccucaagugauccucccgucuuggccuccuaaagugcugggauuacaggugugagaucgugcccggccuagugucagaggucuugagugcagugucauugauuuuggauuuuauucuguagguguuuggcuuuuuuacugaggaaagaaaaauucacagugcaccucuaaguaaucacucccccuauauaacccaucaacugagggagaaauaaagcagaaagauccuugaggaaaauuugaguaagaggaaaaaaguuauagauauuuuaagaaauauuauggaaaaaugcuguuaggaaugagaacuacuguauauauuucacagaaaccugguuuuuuguuuuuguuuuuguuuugagacagggucucacucuguuacccacacugaaguacaguggcaugaucaaggcucacugcagucucaaguuccaaggcucaagccauccuccugucuuagccccccuaguagcugggacuacaggcgugcaccaccaugccuggcuaauauuuuugaauuuuaguagagaugaggucuugauauguugcccaggcuggucuccaacuccugagcucaagugaucgucccaccuuggccuucuaaaguacugggauuacaggugugagccacugcaacaggucaaguuuuuuuuuuuucuuucuucuuucuuuuuuugagacagacucucgcucugucacccaggcuggagugcggugaugcgaccucggcucacugcaaccuccgccuccuggguucaagcaauucuccugccucaaccucccgaguagcugcgacuacaggcgugugcaacugugcccagcugauuuuuguauuuuuaguagagacgggguuucaccauauuggccagacuggucucaaacuccuuggccagacuggucuugaacuccugaccucgugaucugcccaccuuggccucccaaagugcugagauuacaggcgugagcuaccgcgcucgccaguuuuguuuuguuuuuuuucuuaacuuuugggacuucuuccaggaaagaccugguuugguuuuuauuuuuuauuuuuuuuuuugagacagagccucgcuuuguugcccaggcuggagugcagugguguaaucucggcucacugcaaccucgccuccuggguucaagccacucuccugccucaaccuccugaguagcugggauuaaggcgcccaccuaccucgccuggcuaauuuuuuuuuuuuuuuuuuuggagacggaauuuugcucuuauugcucaggcuggagugcaauggcguggucucggcucaccgcaaccuccaccaaccuaguucaagugauucuccugccucagccucuugaguaccugggauuacaggcgccuacaaccacgccccgcuaauuuuguauuuuuaguugagaugggguuucucuauguuggucaggcuggucucgaacuccugaccucaggugauccaccugccucagccuccuaaagugcugggauuauaggcguuagucacugcacccagccagccaagguuuuuuuuuuuuuuuuugagauggagucuugcucugucgcccaggcuggagugcaguggcgcgaacucugcucacugcaagcuccgccucccggguucaagucauucuccugccucagccuccugaguagcugggacuacaggcgcccgccaucaugcccggcuaauuuuuuuuguauuuuuuaguagagagagcguuucaccguguuagccaggauggucucgaucuccugaucucaugauccgcccgccucggccucccaaagugcugggauuacaggcgugagccaccgcgucuggccucagccaagguuuuuaaguaacauauuucagcauuggcucuacagcguugcagguuggucacauaagcauuagcugggucugaaauauuaguaagcauuuuauuauuccagcaaagauucacaugaauuaacuauguaucagaaggcaugacaacugcagugugcuugcuggacaaaaaauuaccauugcaguaaauucucaugcucccagucuaaacggauuaucagcuagggaucugagaagaaaucccauguuccuuuugagacaaauaacccgcucccgcugcugggucacuguagccuuagcuuuguugucuguuuacuacagaauggugcauccaaaucccuguuuucucuuguaguuuuaaaaaagucuauaucuuuuaaugaugcauaguaaaaaaauuuccacacgaaugaugugauaucuagaauuuguuucagaauuaucugggggcagauuauucuggccacaugugcauggugguucuaguugagccgggugagaaguuuguggaggguuauuauaugauucucuauguugguauuugauauucuugguaguagaguuuuuaaauugccauuuuccaccagcaguuccugggcuaguuuuccuaugaucauuuuaaagguucugaaagagaagucugguuuugauccacguugccacauuguaauguguucauaguugguaagugcccuuccguggcugagccagaugcugcauauaugggugaaacccgagcacgcugcccucugcuuccugagagggcauuuguaggaguggguaagggcuucucuggagcacaacugccuggcuuuggugcugucucccccacuuacuagcagggaggacuuagccucuguggguguucccuuccuuuccuguuuuuaagaagaggugaaugauaguauccuuuucauggcauuguuguaaggguugaaugaguggcucagaguagaggcuccauccacgcuugcucuuaucauucauagaacaugaacgauuggaugcccaucgccaaggaguaugauccacucaaagcgggcagcauugauggcaccgaugaagacccacacgaccgcgcggucuggagggcaaugcuggcacgauauguccccaacaaaggugucauaggagauccccuccucacccuguuuguggccagacuaaacuugcagaccaaggaggacaaauuaaaggaagucuuuucccgcuauggugacauccggcggcuucggcuggucagggacuuggucacagguuuuucaaagggcuacgccuucaucgaauacaaggaggagcgugccgugaucaaagcuuaccgagaugcugauggccugguuauugaccagcaugagauauuuguggacuacgagcuggaaaggacucucaaaggguggaucccucggcgacuuggaggcggucuugggggaaaaaaggagucugggcaacugagauuugggggacgggaccggccuuuucgaaaaccuauuaacuugccaguuguuaaaaacgaccucuauagagagggaaaacgggaaaggcgggagcgaucucgaucccgagaaagacacugggacucgaggacaagggaucgagaccaugacaggggccgggagaagagauggcaagaaagagagccgaccaggguguggcccgacaaugacugggagagagagagggacuucagagaugacaggaucaaggggagggagaagaaggaaagaggcaaguagaggcccaacagcagaaccccaaagugaaguuacaguggaaaugaguggagggggauugucuuucaacgcagcgugagucuaaugguugaauaaaacuuacugaugauca

SEQ ID NO: 191528 - RNA, 49437 nt, Homo sapiens
gggggcggaaccggaaccggcaguggcuugggggcgggaccucgcggacugcuguggcggcagcuggagcggcggccgcgguggcagaaccgggggcggccgcugcagucuggagccccauagugcggggccgcggccaggccacaggaagagcucgaggcccgggccgcaccggcugagugugcgggcccgcgcggcucggagccgccgccgcccaucgagccccuccgggcgcgggucggcccgccauggggucccuguuccggagcgagaccaugugccuggcgcagcucuuccugcagucgggcacggccuacgagugccucagcgcccugggcgagaaaggccugguccaguuccgagacgugagugucgcccgggagacgcgggccgcaccugcucuccuggcgcccccaaucccgcgcaucgcuggggcccucccgcggggagcaccgaggaagggcgcgccccguccccauuguccagacggggaagaugacaccccagcucagcggccaaagcuucccggagcgcggggcugacuccagggucgccggccgucuguguggucggcggcugcucugccccaguuaguuaggaucgcccguguggucuucaucagcuccgggcaccgagcucagcgggagaacaaaucccacaaaggccucuuggaguccuuuuggaacuuuacggggguuaggggggcgcauuaaccaaauaaauaggucaaccagaaaagguuugccauaaagaagaaacggggugaugugaaggugauucgggcgggaggugagugugaagggauugucgaggaagccucccggagaaggugauauuucagcugagacccaaauagaaaggagccagccguggggaagaucuggggagaggguccuuguuggagggaacaggaggagcccagacagagccagaaaugggaaggagcuggaugucaucugcuugaggagagggauuuuuguguuuuggucacugaugcuuaaugcuguacauaccauuguguguaaggacuuaagaacucagucauuguuugucgaguggaagcugucuccccaacaaguaauaauaaacauuuguuuguccauuuacuuguuuauuguuugucuccaccaaggacugucaaccucugagaguaaguaccuuaacgcaguccuuggcagucauuggcaucgauaggcauuuguugaaugaacagacaagcuuuucuugacugcccgcuauguucaggcacuguuuuuggugcuggagacucgguggugagcaaggcagacacagucccuguguuccuggagcuuccagugugggaggagacagauuaaacacacucugauuaugagcugugauaagugcuaagaaggcaaagaacaggguguggaagggagaccgugaagcaaguacuuacugacugaauugaaauccacucaggcgaacauuuuauuuccuggccaccacuuucaucuccugacuguuucccuuaaucuuccuaagguguccuuaauuucaaaagggaucagcccuacccgagaucugauauccauugauaucagauaucuaauaccagaucagccccauaaggcaguugcaaagucauggagagacuccugagugacaggcgagggugcagguaagaugcagggcgguuccugguuccuggagccacuucugcaguuguacccauucaccugauggaugcugcgcugagcugugaauagcacccaaaacauucaggcaacagcugcaggugcagcaggcuccuacauuuguaacagguagauguuuuccuuccgguuaguacucaagccaagacacuuaucacacuucagucuuacagguuugagcaaacguacuaaucacuaugaagguuccaguuucaauaagcgccacuaccuccagucauagaguguaccugggauccuuuucaacugaaugucagugaaaggagaagaaagugcuguucaucuuuuuccagaaggaaguaaaacuaagguugcugcgaugagcucuuguguggugcuagguuuucagugugucuucagccugaguuuccuacugacuuuguggugaccagaugggaucacuguuaguaacccuugcaagggaaaggggggcagguggugacuuccguggugacagcuagugggaaguaccuggaaaagaaaggucauucagcugauggggaggacucccugaagggaaaguucgcacuuuuguuacaguucucagucuaagaacagguuuccucuuuaguccuucagcugaagugggaguaucaauggcugugaauaucaaaacaaacagcaccagaucuccucugccgguuuuacuagguuaaaugugccuugaauugaaucuacauuaaaauguaccuuauuccauuagccuugaauuagggugcugcccuaaaagggaaaaaaaacccaaaauuuauaaaagaaaccacacaauagaaaaaaaaaguuaauaugucugggcacggugguucacgucuguaaucccagcacuuucggaggccaaggcgggcagaucacaaggccaagaguucgagaccauccuggccaacauggugaaacccugucucuacuaaaaauacaaaaauuagcugggcauggcggggugugccuguaguccuagcuacucucagaaggcugaggcaggagaaucacuugaacccaggaggcagagguugcagugagcugagaucgcgccacugcacuccagccuggcaacagagcgagacuccgucucaaaaaaaaguuaauauauguaagcuggugauggugguguauguaugugaaauccauguuuguauuauugccacagaaauuuaccucuuuauaaauaaagauucuacuauuuguagaaacaucaugcccauuuagaguuaaguacuauuugauauugaaggaagaaaaugaaagcugagaaguaguauccugugacagcuuuagacacagaacuuccuuuccaacaaguuccauagaacuagauugugucugaaucauuaguaacuuggaagugguuacuuuuaguucgaccuccagaaaugaaugagaaggugacaaacagaagugaaaugagaauuuuuaccuuuuuucugguucuuuuaaaaaaaaaguccccaaaaaaugaacaagaacugagucagacacugaguagacacuuaccagguugagcaguuucaugucaaguuguaucuuaacuguuucuugagagugcccaguacaaauccuggauggaauaaagauaaauuucgugucuuaaauggcuuucaacaugaaugauauacuguaaauuguugaaguaugaaagugauagaugaccauugugagaaauguggaaaacauaagaauaguaacauaccuugcaugaucccaacgccuagaaauuaacuuuaacuuuuuggcuaauacuggacaaucagcauuucucuaauaauguuuaaaaauguccauauauauguauuuuuauauaauuugaaccacacugaaaacauccuaaucugcuuuacacagaaaucaugacuaacuuccuaauuuuauuaaauauucuuuuacaacuuuuuaaaauuguuuuaaacuuuauauuauaaguagagggaagaguacaguguacccccauguacccauaaauguaaacuuaguuuuuucucacuucccagacuagaucauuuugaagcaaauccaagauauauaauuuaacuuuucaacaaguaccucuaaaagaugaauuuuuuuucuuuuuuuuuuuugagauggagucucaauucugucgcccaggauggagugcaguggcgcgaucucagcucauugcaaccucugccucccagguucaagugauucucaugccucagccuccugagcagcugagaucacaggcgcgcgccaccacgccuggcuaauuuuuguauuuuuaguagagacgggguuucaccauguuggccaggcuggucuccaacuccugaccucaagucauccccccaccuuggccccccagagugcugggauuacaagcaugagccaccaggccuggccuagaagauaaaaaauuauuaccaacauuguaccugaaaauuuaaauaacauuucuuaauauaaucaaauaccuggucauuuuuacacaacuuuauugagguguaugguagaguuuacccaugauuuuuagaaaguuuauggaggccgggugcaguggcucacaccuguaaucccggcacuuugggaggcugaggcagccacaucacuugagcccaccaguuugagaccagccugaacaacauggcgaaaccccaucucuacccaaaauacaaaaauuagccgggugugguggcacgugccuuuaaucccagcuacucaggaggcugaggcaggaggaucgcuugaaccugggaggcagagguugcagugagcugagauugcgccacuggacuucagccuaggcgacagugagauccugucucaaaaaaaaaaaaaaagaguuuauagagucaugcauccauugccacaauuguuuuagaacauuccaucaccccagaagauucuuaaugcucauuuacaguuaauccuuauuccuacccccacccccccagcacccacuaaucugcuugcugccucuaggguugucuggacauuccauguaaguggaaucgcacaguauguggcuucuugugucuggcugcuuucacuuaguaugaaagucauccagggugggcgugguggcucacgccuguaauccuagcauuuugggaggccgaggugggcgaaucaucugaggucaggaguuugagaccagccuggccaacauggugaaaccccaucucuacuaaaaauacaaaaauuagccgggggugguggcacuuggcuguaaucccagcuacucgggaggcugaggcaggagaaucgcuugaaccuggaaggcgaagguugcagugagccaagauacugccaguacguuccagccugggcaacagagcgaaacucugucucaaaaaaaaaaaaaaaaaaaaaagagaaagucaucccuguuguugcaugggucaguaguucauuccuuuuuauugcuaaguagcauuccauuguguggauauagacuguaauuucuuuucuuuucuuucuuucuuuuuuuuuuuuuuuugagacaggcucuugcuuugucacccaggcuagagugcaguggugugaucacugcucacugcaaucucgaucuccugggcucaagcaauccuccugccacagccuucugagcaacugggaccacaggcgugcaccaccaggccuggcuaauuuuuuauuuuuuggagagauggugucuuaccauguugcccaggcuggccucaaacuacuggccucagguaguccucccaccucagccucccaaauugcugggauuaucaacacgagcugcugugccuggcuauaauuucuuuaacuacgcuacuguaauuucuugaacuaguuuucuauuguuggauuuuuggguuaucauuuuuucuuuuucccugagauugauguugucauagauuuucaucuguuuccauagcuuuuuccuuagguuaaauuuucuucaugggguauugcugggcaaauaaucauuuucaggauuuuuucuuuuuuugacccagggucucacugugucaccugggcuggauugcaguggugugaucucagcuccauccaaccucugccucucgggcucaagcaauucucgugccucagccuuccaaguagcuggaauuacuuaggugcgccaccaugccuggcuaauuuuuuuuuuuuuuuugagauagugucuugcccuguugcccagguuggagugcaaauggcacgaucuuggcucacugcaaccuccgccuccuggguucaagcaauuuuuccaccucagccucccgaguagcugggauuacagguacuugccaucaugcuuggcuaauuuuuguguuuucguagaggugggauuucaccauguuggccaggcuggucuugaacucccgaccucaagugaucugcccgccucauccucccaaagugcugggauuacaggcgugagcuaccgccccggccuaauuuuuguauuuuuagcaggguugggguuucaccguguuggcccggcuggauuuucaggcuuuuuugguaacaguugacaaauugcucucaagaaaaguugugucaguuuauaguuucauucaauaguauacaagaguguacaucccccaaacuuuggugauguuuuauuuuuuacauaaaaguauuuuuaaauuuuagaaauuuaaaccauauuuuucauccuuuucucagcucaaccagaacguaaguucuuuccaaagaaaauuuguuggugaggugaagaggugugaagagcuagagcgaauauuggguaaguuuauuuucugauuuaacaacuuaaauaauuaccuuuauauaggcaaaccuuguucgguuuaaaaauauuggaaaauauagacaagcagaaaggaaaaaaagaaauuguauucucauucagaaguaaucacaguuauguaggcauguauuauuuuucuguauuuuuuuauucaucuauaaaaguaaaaauuuacaaacauaauggccugguuauuuuguuguuacccuuguuuuuuacuuaacagugcuuacuauaacaucuuuucgugucaguagacauagauauuuacccaucaucguuuuugauggcagcauacuauuugauuguauuaauauuaaugugcuguggcuuauuuaaccgaucccuuguaguuuauuauaacuuaaaaacauuguacuuguuaauaaguuacuuaauuuaaaauuuuuucaaggaacaagggaggcgggaaauggaagauagagugauugacaauaauuuccuuuuucucagggcuuccuuugccaguguguuagaucagugcugauuguuaaccauuucaacuaagcagcccagggccacuucuuuuaucucuaaagucuuuaccaucuuagucugguacuagucauuaucaaaucaagccuugacauucucacugaaguggagggaaaaugacagacagucaacugaaggacaaagcuuguuuuuuuuuuuuuuugagauggagucuugcuuugucaccuaggcuggagugcaguggcaugaucuuggcucacugcagacuccgccuccuggguuccagcgauucuccugcuucagccgcccuaguagcugggacuauaggugcgugccaccacaccuggcuaauuuuuguacuuuuaguagagaugggguuuuaccauguuggccaggcuggucuugaacuccuuguuagggacaaaccgccccaaaaaagcuucuugguacugccaacacuucccccaaagcucuccgugcugccuaccccucccccugagccccuuuaacauuucuaagcccuuaucuaggugccccagugaagccagcaaacuucacuuaucaggccuuccugcgauaagcaaaacacaauuauaaaccauccggaccacacagggggagguugugggaagccuaaacaaacuuugccuacggccuccuguaaguuccuucauuuagcugcuacuguaaaggucacaaggugauacauggcaaaguuaaccaacaaacgaccccagggucucucucccccguauaaaccccucauuuuguaaguucagggcugccuccucugucguggagcagccggcagguucaauaaacuuacucaccugacuuugggucuauucuuccuuucucucggcugaccuuacacuccugaccucaggugauccacuggcuucggccucccaaaggucugggauuacagaugugagccaccacacccggccuauuuuuuuuaaauuggggauuuuuaaguguaacaggaaauuuuagucauuugaaaucuaguccuauucauauugcuugagguccuaguuauuugugugguucauguacguuaguggcaccauauuccugucuuugcaaccugggugagucauuggauagaugguguauucagaauaagguuuuuaaaggcagggcaaaugugauaacacauuagguauauccaggacuuccuguagcuuaaacuguuucaaaagaaugcagggcugggcacgauggcucacgccuauaauuccagcacuuugggaggccaaggugggaggaucacuugaguccaggaguuugagagcagucugggcaacauacugagacccugucuccacaaaaaauaaaauuagccaggcauggugacaugugccuguagucuuagcuacucaggaggcugaggugggagaauugcuugagcccaggaguuugagguuauugugggccaggaugacacaccacuguacuccagccugggcagcaggguaugaccccauaagaaugcagacuuaaaacagugaaaaaggaccucucaaggaaauuuagguguacgccaggcaugguggugcacauaccuauagucucaguuacucugaagguagaggcaggaggcuuucuugagcccaggaguucaaggcuagcgugggcaacauagugagaccccugucucuuaaaaaaaaaaagaauaaauugaaguauaaauugguuaaaacaauuugcguucauuucuagaaaccucuuagacccagugcuuccuuugcuaucuugguaagacaguuucuuuucuuuuucuuuuuguuuuuccuccuuacuucuuuaccugccucucucccucuguaaaccaguuaguaacacuucuaaauauuaggccugauaaugacuaacagauauugugacuuuuagccuaaggaaagggaugcuucauggaaucgaaaacauaaaccaaauaaaguaguuaguuuuggcugguguacuauuaguuucaugaaucuagguguuuuguuuuguuuuguuuuguuuuguuuuaaugacugaaacaaaaaacaucuaaaaccacagcuucuggaagaaccacuuguucuugccagucuuguuccacucuuugaacuugaucuuggccucccacugggccuugcauuuaagagcagggucucugaaaaccuggugguuuugucuaaggggauggucacaggguacucugugggcaugaggucauuauaguuauaaaccuucacaaaagacuugaccuuugaccucuuggcaaucuucuugcccauggcagcugucacugugggaauaauggucuuuuuuagccaccagaggguggcugcagguguggucugaggugccaucaucaguuuucuucaugaggauuggcuuuguguccagaguaguguccggccacgacuggcaccauuuucccagguuucaugaacuugcccauuucuagggcugcccugacacuugccccccaggcugccgagggcagcaauugcaagacccagccaggcuucugaaucuaguuuuuaacuucaguggugaaacagugcagguuguccucagccacagccucagggcugacugggagcugcaagagagccuggcucuuggugcuggguggguuuccugguagugguugugauuuucuuguuggacugauggaugcccuuuucuuucugagggcaucugcgagaaaucauguugccagcucccauaggggcuauuguaggucuaucacuuggguaauuccugcacuuccaagugcgccccuaaccucugcuucauucugccccuguagauggcugcgacucaaaaguucuuucacuagaauauuagaaaugaaaaaaauggguggaauuucagaaaagguuuauccagguuguuguucauucuauuuauuuauuuuuuaagucacuaagaaauagaagagguuguuguuuauuuugucacugcaugcagaucucucuaggcagcauuauuuuuggaaacaagguugcaaaaagugaccaguaagucaguugggacaagcaagauuuuugugcauuuagacauugauuuuuagauggcuugggaaacauugggcuuuaaaauguuucugacugaaauguauuauaguacauuuuaguaucuaauuguuuaacuuuuauuuucacaguguauuugguacaggaaauuaauagagcugauauuccccuuccugaaggagaggccagcccuccugcgccaccccugaaacagguucuagaaaugcagguaacuugcuucugacgaagcugguugcagccauugaucuugggggcugcuuacuuacuuauuucauguugucuaaugcuuuucugccuuucuucucaaaacuauggaagauggugaucucucuaggcagagagauuaaagaccgcuauuaugauuaacccucaguaauagauuaucuguguuaaauuuuaacaguaauucaguuuucuuuuacaguguaaggcauaugcuuccuuuccaggugguggugaacagaggcaacaagaaucaggccaucaagccugauugauggaucagaacaguucaugauccuguacuguuucagaaagcucaucccagggucacccaugccuuagcugccucuucuugugcaaggaauugaggcuucgguguugugccuucacaguccucccacauuuacccuggcccuuccccucuaaauuuuggaagcugguaugcaguccauggguugucucgggugggcagcaagcagcguucugucacccugaguucccuggcuggugugcuggggauacauguguccccggugagaacacucaccugugcugcuuauuagcauccucggugaauucguuccucacccugugaaguaggcuggagcucuugauaacucuucuaaaacaauuaucguuguguaacugaagccauucaguugcgggcuccucuguuuguuuauucgggaggaagucuuucauuacuuggugcaggagacuccagagagaacucuccaaccagaugaguaacagcagucaucuggauuggccuguucgaugggucgcuugugauguaauuacaaacauagugaugacuguguacagugcuuguaaggcaaagcagaaguaaugaauauaguauauuaagugauuuguuugaauacaaguuuucauugacucaaugauuugccuuacggauuuuugcuucuguuauuuuaauacuuaaguauuuuuaaggauguuuaguauguaacuaauuauuaaagauucucaugaauuuuuuuuuuuuuuugagacagagucuugcucugucgcccaggcuagagugcauguaguggugcgaucucggcucacugcagccugugccucccggguucaagcaauucuccugccucagccucccaaguagcugggauuauaggcacgugccaccaugccuggcuaauuuuuguauuuuuaguagagaugggguuuuaccaucuuggccaggcuggucucgaacuccugaccucgugauccacccaccuuggcuucccaaagugcugggauuacaggcgugagccaccacgccuggccaauugucaugaauuuuuauccucaauuaauuguguaaaugugagugcauaguaacucauaugcuagagacuaggaaaauaaguuagaaaagauuaucuaaauauauucuguguugcaaaaaaaggaaauguagacuuaaagaggaagagucuuugaugugugauaugaauaagcagacaaaggaaauccgagaaaugacagcaccugugguuagagacgagggccagucuugggggucucacgcucaucacagccuucggaauguuuuagcuaauauguggugugaacuucacagaaauuaccugaauuaauaugaaacaauaaaugagccuauuuauuuauuuacuuugagaaggagucuugcucugucacccaagcuggagugcagugacacgaucuuggcucacugcaaccuccaucuccuggguucacgugauucuucugccucagccuccugaguagcugggauuacaggcacaugccaccaugcccagcuaauuuuuuuguauucuuaguagagacagggaggccgaggcggguggauuaccugaggucaagaguucaagaccagccuggccaacauggugaaaccucgucucuacuaacaauacaaaaaaaaauuagcugggcguggugaugcgcaccuguagucccagcuacucggggaggcugaggcaagagaaucgcuugaacccaggagguggagguugcagugagccgagaucaugccacugcacuccagccugggcgacagagggagacuccaucucaaaaaaaaaaaaaagaaaaaaacaaaacaaaaaaacccacuguuuuugguauacugcaugaagauuauuggaauuacacuuggaacuaauuacuacccucuuaaguaaccauuguuuuguuuuaggagcaguugcagaagcucgagguugaacugagagaagucacuaagaacaaggagaaacugaggaaaaacuugcuggaacugauagaguacacucacaugcugagagugacaaagaccuuugugaaacgcaauguugagguacugaacagcucgugaggaaauacagcuguuuuuauaaacagcuuuuuauaaaaaucucauucccauaggcuguguauuuugcuauuaguucauauagauauguugcuucuuuuaagagauuaaauuuauuuauuuauuuaauuuuauauuuuguuuuugagacggaauuuugcucuuguugcccaggcuagagugcaguggcacaaucucggcucacugcacccuccgccuuccggguucaagagauuguccugccucagccucucgaauagcugggauuacaggcgcccgccaccacgccuguaauuuuuuguauuuuuaguagagaugggguuucaccauguuggccaggcugguaucaaacuccagacccaguugauccaccuuccucggccuuccaaagugcugggauuacaggagugagcuaccgcgcccagauuuaagagauuaaauuuaaaccuugguuuuauuuuucaguuggauuauaugacuuuaaauaaaguuuuaagagccauuuccuguguugguuguuuucagcaauuacaauacuaaauauuuauaagaugguuuaguuugugguugaaaaaaauuuuuaugagcaugagaaaaaaauugaaugaaggauguugaacucuaaaauuuacuuuuuccaaauugcuaaguaaaggaaguaaaagaauaaucuauaauuucuaagacuaggucagacacaguggcuuacaccuguaaucccagcacuuugggaggccaaagcuggaggauggcuugagcccaggaguucaagaccagccugaacauagugagaauuaauaugagaccuugucuauacaaaaaauaaaaaauuagcugagcgugguggugcauacuuguagucccagcuaccaaggaggcugaggugagaggaucauuugagcccagaaguuugaggcugcagugagcuaugauugcgccacugcacuccagccugggcgacagagugagacccuguacccuguaucuaaaaaaaaaaaaaaagaaaaaaaauuauaagaauaaagaauaguccauguaguagcaccuuauggagcuaaguauagaagagacaagugcaucuguuccaaacuuaguuucacuugauaugauagugaccuuugauaaaguuacucuaucuuggaugaaggcaaugaacuaaauuauaacugucuuuuauguaaaugucuucaauuggcuuacaaauaaaggauggggaaguuaucuuuucauuuaugaggauugaguuauaaaucuaaguuaccucagaagucuuugcacccagaucuaaguaguuaguuaggaugcccuauaaacuuguuugaaaauuugacaugagaaauaaagugucacuuuuaaugagacacacuugguuucauauguuuauuucuaguuugaacccacuuaugaagaauucccuuccuuagagagugauucuuuguuggauuacagcuguaugcagaggcugggagcaaaacugggguaggugacaaggccuggggugucaggcuucauacugcccuucuuguaaaaggcagaugagcuccauagaagggaugaauggagaccauuuuaaagccuaggguugaaugaaacauagugaauauuuguuuaagaaacacuguauuccuguacuuguugagcugaauuacucagcuguauugacuuuuuuacucaacacaauggaaauuucuuuugguauaaugagcuagaaagaaacaacauuuacgugauucaguguuacuucuauaagccuaaaacaauuggucauucaggcaucaaauccugucuaguagaaacuugguggcuaaaccgaguugguuaguuuuuuuauuaaucauauuuuaaagaucuccugcugcuguuuauucuugcugccuacugaaacuagugguaauuuguuuccucgugcgauuugugauuuuuaaaauuauuaugaacucauauuucacaguuccugaucugaaggaauucagugauauuuaguuugaggauguuuuccuccagagagaauuuguuuugacauuugucagguaccugggagugcucugucaaccuggaaucauuuauauuuuucucagcauugagauuuuuuuguugauuuguuuuuugacugugccaggaaugugaauuuaagccucaaaccugagugaauuuuaaccugugguuauaaauucuuagggaagacuucucccuccaucuagaaccaaaauagaaauaaacaaguuuacaugcaggcuccaggcuccuuugcaagguagauuuuuuuucugguccaucccuucacugaggguguagcucuuugugcauggagcagucccagcuggagaggugagucaguuguaucugcucaccuuaucuagacccagugccuggcuccugcaucccaugcuggccuuaaacucaaguucuuaagauacgggguucaguguaauaaucaggacagcugugagguccuguuuucccuuuggauuccaagaauuucucucuuuuuuuuuuuuuugaggcagagucuuguucugucgcccaggcuagagugcaguggcccucuagcaaccuccgccucccagguucaagcgauucuccugccucagccucccgaguagcugggauuaugggugccugccaccacgccuggcuaauuuuuguauuuuuaguagagacaggguuucagcaucuuggacaggcugguuuugaacuccugaccuugugauccacccgccucggccucccaaagugcugggauuacaggcaugagccacugugcccagccaagaauuucucuuuauuacaagcucaucucuaccuuuaaaaagaaguuucaaaaauauucugaccagcaccugagauguuuugcaguuggagggcucucaggaugucuucaccacuugguagaaaugaagucuucaucauucuuaauguaguuugauaacauuuauugcuuucaguugacuacagguugacuuuacugucucacagauuugugucuggccuaauuaaccaaggaaaaguggaagcauuugaaaaaauguuguggagagucugcaaaggguacaccaucguguccuaugcagaacuggaugaaucccuugaagacccugaaacagugaguaaaugucaccaucaccuuuuagcaaugacggacuaacagcagaguuggagauaugguagaaagaauguuuuucuccugaaccauuugauaauaaguuguuaaccugaugccuuaucucuucaaccacguguaguguguauaguuccugaaaucagggacauugucuuauauugccaucacaugaccaucagucaggaaaugaauguagauacauuacuauguccugagccuugaaucucauucagguuucaccaguuguccuaguauggucaaagcaaagaauguaauuuagcauugcguguuggauuuaguugucaugucucucucuuuuuuuaaacuuucuuuuuuucuuaaggagauggggucuugcuguguugcccaggcuggucucaaacuccuggccucaagcaauccucccacguaggccucucaaagccucccaaaguguugggauuacaggugugagccuccucaccuggcuuuuuuuuuuuuuuuuuuaacuuuuuauuuuugguagagauggggaucuuaacuaugcugcccagacuggucuugagccauccuccugccuuggccucccaaaguguugggguuacaggcaugagccacugugccaggccuguccugucucucugaucuccuucauucugggacaguuucucagacuucccuuggcuuuugugaccuugacauuuuaaaauacugcaaguuuuuuugguagcgugucucuggguuuggguuucucagguaucuucucaugaguugacucaggucacgugucucuggcaggagcguugcugaagugaggcugcauucuucucauugcaccgucaggugccacauguuucuguuugcuccauuacuggucguggucccucugaucacuugauuaguuccauuacuggucauggucccucugaucacuugauuaguuccauuacuggucauggucacucugaucacuugauuaguuccauuacuggucguggucgcucugaucacuugauuaguuccauuacuggucguggucccucugaucacuugauuaguuccauuacuggucguggucacucugaucacuugauuaaggcacuucucuuuagacuucgcugugaaguuacucuuuuuuuuguguuugaaacuguaaauauccuauucuucaucagguuuucagcuuccucauuuauuuccuauuuuauuugauggguuccuguuccuuuaauuauuuauuuugauauucacauucuccuagauuuggccaguuggaauccauucaggcuggcuuuuauauccauuuuacauguucccaucacuuuuugagcacuuguuuguacaacaggauguccagaugcauguugcaauuccucucacacggcucuggaaucaacuguuucuucaaggaggcuguuuuuuuuuuugagugcaaaucuugguauuuugaagccaagauguggcuucugggugugcacauuguuacugagggguugcuuuuccuuggcugugucagaguagcuuggggacacacacaaaagcacaugcacauauacauuuacagcugugggccaguuacucucccccaaccccauccauccccauguacauaccuaacagcuguggggccgaaugguucagaagggaggguggaggcagcggggagagacagagucauaaucacccuuaggauaucuguuuuuuaaacuucaaaguaaaaauaacuguuguuuuaaaugaggaugaacugcugaucuacuaaagguggaaaaggaacuugguuuucuuaauuuugaggaaagguuguuuuuuuucuagguuggccucaggaauuuuggcuguaagauuaauauacaucucauaguaguuuugacgcauaaagagaaauuuggcugugauugauugauugauugauuuuuacuuuuuuagauggagucucacccugucgcccaggcuggagugcaguggcaugaucucagcuuacugcaaucucugccuccaggguucaagcaauucuccugucucagccucccgaguagcugggacuauauaggcguggaccaccacaucugcugaauuuuuuuauuuuuaguagagaugggguuucaccauauugaaacaccaucaggaguuaggucuuuuuuuuuuuuuuuuuuuuuuuuuuuugagacagcgucuggcucugucgcccaggcuggagugcaguggcgcgaucucggcucacugcaagcuccgccuccuggguucacgccauucuccugccucagccucucaaguagcugggacuacaggaggccgccaccgcucccggcuaauuuuuuguauuuuuuaguagagacgggguuucacuguguuagccaggauggucucgaucuccugaccucaugauccacccgccucggccucccaaagugcugggauuacaggcgugagccaccacacccggccaggaguuaggucuugaacuccugaccucaggugauccacccaccucggccucucaaagugcugugauuacaggcaggagccaccgcgcccagccugugauuuauuuuugguuuucugaaauaaaaaucuaauccguuugaaaucuaaucaguuaagcccuucauuaaccacucacuuguaauauuuucuacuuuuuuguggcuuuuguaacugccagugaccaucguuaauuauccuucaguugugaccuugaugacuuuucuauuucaagcugaugauuaaaacuaagaucaaaacuguucugaaguagcauuuacauauuuuuugaguuuuuucuuuauuaagagaaaauaucaguaauucucaugcgagcauuuacucaaguuaaaauuguuuuuuaauagaauuugaaaguucucuugugccucugcaaccuccaccucccggguucaagugauucuccuaccucagccucccaaguagcugggacuacaggugcacaccaccacuccuggcuaauuuuuguauuuuuaauggagacgggauuuuaccauguuggcuaggcuggccuugaacuccugaccucaagcgauugccugccuuggucucucaaagugcugggauuauaggcaugagccaccaugccuggccucuuaugccaaauuuuuauggaauauguuaaagggcaguaaacaucugugaaggaauacagagaauggauagauguauaucuugaaaauacaaucccuguccccacgguuauaaagaaaaugcauguccauuauagaaaauugggaacaauguagaaaacaagaagaaaaagaagucccucgcagucuccuauucugagccacuguuuacaugccaaguguguucucucagucuuucucuggguaagauagggguauuuuaucugguaacuuuuacucagguucuaggauuuguuuauagugucagguuuacugucuuuuggguucaaugucugacccucuugaaguuauuacagaccuuagagacuauuuuuagccauuuucccccauugguguuucuaagugcugaccauucucucugcaucaaagcuagacaugggcgcuuucuucgguuguauagauuguguuuuucuguuguguguggcauuucuucugccuugugccuuaagugguuguguuccuugacacacuacuauguugcccaggcuggucuugaacuccugggcucaaacgauccuccugccucugcccagcaaaguguugggauuacaggccugggcucaaacgauccuccugccuuggcccccugaaguguugggauuaccauucccagccucuuuuuccugguucuaacucuuuucugacagugugaagucagcuuccauuauccucagugugucuaguggguugcucaguuaacugacuuauucauucauuguauucauucucccagccacauccucccucuccuccuccugccauccccucccucccaccaccgccugccugugcuaugcuguagcuccccagucugugcuccuguucccugggcccagggcucaauuuuuggacagcuucucucuucuuucugccuuuagagaucucacauaauuuuaugauuuuaaguaccaugccccaaauguguauaucccuagcuuggaccuguccccagaauacuagacuuuuaugucugucuacuccauaucuccuuuuaaguaucuggaagaccguuucugcuuuugccuaaaacugaacaucugaucuuucuucccagaccugcccuuccagacccauugaucucacugcgcaggcugaaagcccugggcuucuccccacucuucucuguuucuugcgucucacuuaaaucccucagcagaucugguggccaugucugcuaaauagagagucccgccgccucuccucgcucuuccucccuccugguccaggucucgucccacacuugccucgccuggcugggccccugcuccugccucugccuuagccuggucucuucuccuggcauccagaaugauccacaggaaaccacagucagaucauuucauuccuguacucaagacccuccaggggcuuccuguuuuccucagcaacagcccuguggagccgcacaaugggccuguggcccucgucauuccucagagcuguguuacuacaucccuccccggcggugcuggccuccucgagucuccugacugugcuucuguguguacuccucugcuuggaagucucuucucccaguggccauggggcucgcguccucaccuccugcauuuuuuuuuuuccauuuacccugacuugaagcucaccugcacgucuuuaugcucagaugucacccucucggggagaucuuccuugcccauccuaugugagaucacagugcccaagcccacccucccucccucccgucuccucauccugcgucuguucuuuauagcacuuaccucuaccuggcguacuuucuuuguuucuuuugcugucaaguugaauauaaguuuaaguucccuuccccucccaggucagggauuuuugucaguuuucuucacugcuguaucccuagcaccuauaauagugccuauucaguuuuuauagaauucuguuuuguuggauacuuguaaauacagggugauucuuauuauuuacaguaguuaugcuucauaaagucacugagggcugagcacgguggcucaugccuguaaucucagcauuuucggaggccgaggcagguggaucaccugaggucaggagaucgagaccagccugaccaacaaggagaaacccccgucucuacuaaaaauacaaaauuagcugagugugguggugcaugccuguaaucccaacuacucgggaggcggaggcaugagaauugcuugaacccaggagguggagguugcggugggccgagauugugccauugcauuccggccugggcaccaagagagagacucugucucaaaaaaaaaaaaaaaaaaagucacugaaaucucugaauuaccaacuguggaaaaacucacugcuccuaggggaaguacgggaguugagucauuuacauugagcucccagccagcagcucugugacucgagcccgaacgaagugucccuaacacacgccacaucucugucagggacaucacagcugucuugugcucaggacaccagacugcaccucagcccuacacucggggcuguuuauaccgugaaaucaccaaaaaaagcacagaagugugaaaaacaugauaccaaacagacucugaaaaggacacuuggugauagucugagagcagagaugggaagggagagcgucaccuuguuggacuuuaccugggaacgcgggugucgggugccuaaaaguuuuggcugcucugcacaugacuggaagcgcuccguggauugguuuggggcuguuacuacaaguaggugaauucguaauuacagaauccucaaauaaggaguauugacuguauugaaugagugaaugaaugaacgcuuugacaguguuugagcugccgaaguucuagaaguuuauacacgcagaaauaacacuuauccuuauucauucuuuguagggggaagucauaaaaugguaugucuuuuuaauauccuuuuggggagagcagauuggccacaagguuaagaagauaugugauugguaagaaaaagaaacauuucauuucauuuaugucuuuauauucagucaccucuaguuuuccuucaacaucccucuggagucagaaauagaguggcugcuaguuuuuguuauaugauucuuugcugcacugccaaguucuuaaacauuuaauuugucaucucucuuaccaaugcauuacuuaaaauaauuuaaaaguagagacuguguuaauaauauucccagaauugacuuuuuuccuuggagaucagggcuucagauugguugaaaaaggaauaaaguuuuuauauguugugacuucauguugcuuugagcuaccagucgggcuuaccugucaucacugagcaugugcaucucuucuguccuggguacccuggggcagggguguggcguguggugaggaggaggcgcucaggggccugucuggaugcagagccucccugugucgcugucucacuggacucacuuggacaagugaccaagccucaguuucuucaucuguaaaaggggagagugauugcuuucuuauaggucuuuuaggacuaaaugaaaugaucagguaaaagacaucaguucggcauaagccaucaguaauuuugaguugugguacaacaauaaucugugacuuaacuccugucagcaaaugggaacauaagcaaaagccaaacaaagucagaaaacuccuuugcuuucuuccccccauggacaacucagcuugccuuguuucuugcaggguggagggggguuugggcauuuucuguuuacuagaauuugguucucaauugguggaauagaaaguaauuucaggugucaccuggauaaaccuuuuauuuucauagauagauauuuguuuuacugcagauuaaaaaacuauacccagcucagcaaacccaugauuucacagauauuguugcuuaggauaaggcuagaauagguauuuaauuuuucaaaggcagaacuuaaagaaaaauaaagguaugguguuaacauaugaaggugguccgggaauggcugcaguuuggggacacagcucgucauucccucgugcagucugggugccgaguggcugaguggcccugagaggaccugucaaaggcaacugcuaggaagccagagcucuuuucuccuuuuguuuucgugugugugugugugugugugugucugugugugucuguugugugucugugugugucuuuguguuuguguuuaaaccuguucagugauucccagcccaaggacauuguugaauuuuaggaagcuggaauugggaaugagcuuccaggaaucauugagggcaggaguggaauuuggaucccagagggaguuugcuaaauuuaucucacucagcaggugcuuguugagcaucuguaugcacagcccgaccaagggcagaugacugcaucugcacccgugucucccaaacggcugcuuucauuccguuuugccagaagaugugccggggaggugaacguguuuaguucuagugcugacagaugugagacuguguucaacucuugucuuccagcuaccacugccacguguaccccuauccaaacacagccgaggagcggagggagauccaggaggggcugaacacccgcauccaggaucucuacacugugaguaagcuggaaguggauugccucuuuaucugagggcugccaaacauuuacacguauauuuucucucuuuuuuaacauagauaauauuggucguagacaaaucaagauguucuagugagauuggaauguugcuucccucccuccuccccauggaaguuuuauuuuagcaacuuguuaggaaccugaguaguaaugacaaggcuuuaaaaaaagauucuguggucaccuuugauauguuggaugguaauucauuuuucuuuuucagacaggcucucgcucugucgcccaggcuuggagugcaguggcauaaucucagcucacugcaaccucugccuccuggguucaagcgauucuccugccucagccucccaaguagccggaauuacagucacgcaccaccaugcccggccaauuuuuguauuuuuaguagagacagaguuucgccauguugcccaggcuggucuaaaauuccugaccucaaaugauccgcccaccucagccuccuaaagugcugggauuacaggugugagccaccaugcucagccuggauugugauucuuuuuuuuuuuuuuuuuuuuuugagguggaaucaugcucuguugccaggcuggagugcaguggugcgaucaucucagcucacugcaaucucugcuucccagguucaagcaauucuccugccucagccucccaaguagcugggauuauaggcaugcgccaccacacccugcuaauuuuuuuguauuuuuaguagagacgggguuucaccauguuggccagguuggucucgaucuccugaccucgugauccacccgccucggccucccagagugcugggauuacaggugugagcuaccgcccccggucuggauuguaauucuugaucacaaaagacaagccagcuccaguuaacauggugagggcauuauuuuaccaguaggauuuaaauucauuuuucucuugaugacagugaggguucuuguuggcaugaaguguccuucugacucaguuaagcgagaggauuucuugguaggaugggaugggcguugguggcucacaggguugacaggggugaggccaagcuugggaauggguaggaacccagggagcuugcuggauccugguaggccaucacgcugccgcagugacaaugacgucuaaccauuuccugugcccuagggucauguucuccagaggcaaccucccaaaagagggcaucugauugauugggcuuagauuuuucugcccaccuccgagugguacuaggggcagggagaaggaaggaauggcucccuuagcugccaccaggauaggcaggugccuggaaugauccucugucaauggggagaaaguccucuaagggaagucgggugccagguggacagaaacaaaaacaugcccacuccacugaaagccccuguuguucuuccccagguacugcacaaaaccgaggacuauuugaggcaagugcuauguaaagccgccgagucugucuacagccgugugauccaggugaagaaaaugaaggccaucuaucacaugcugaacaugugcagcuuugacgugaccaacaagugccucauugcugaggucuggugucccgaggcggaucugcaggaccugcgccgggcacuggaggagggcucgguaaggcugccuuccucuccucugccaggaacagaagagagacugauggaacugauaaauucagagaaaaaaaggaagugagaauuucauagaguaaugagaaugcaguguguugacucuucuuuuguuuuuuuaaaauauuaauuaacaaaauuaaaauagagaugggguuuugcuguguugcccaggcuggucucaaacuccuggccccgagcgauccuccugccucagccucccaaagugcugggauuacaggugugagccacugugcccagccuuggcucuguuuuugaacugaaauuauggugagcuggucauucaaagcuguaugugaguacauguguuuuuaaauugcucuuuugaguaauucauucacaugguguaaaagugaaaagaaauaaaagaguaugaaagacacagugcaguggcuuccucccaccccauagccuuacuuguccacuuccuccacucaaagauaaccauuacuucaguucuguuauuucuuugaguuucuuaacuguagauaagcagauaggaguagauauuauuuuucuuucuuuuucuucacaaaauggcacuauucauacuauucuuuucacuuaauaaaacuucucuauuuuucuuauaacuauuuaauauucuguugugugcauaccaugguuuauuuaacuaguuuucuggucauuuagguaguuuccgcuuuuacaaauagcacuaugaugucaaaucuauuuguaggguaaauucccagaaauggaauuacuggacugauuuugauagauguugucagcuauuguauuucucucauugugagugaaggggaauaccuuuuuuuuguuuaagagccuuuuggcugggcacgguggcucacgccuguaaccccagcacuuugggaggccgaggcggguggaucacgaggucaggaguuugagaccagccugaccaacauggugaaaccccauuucuacuaaaaauacaaaauuagcugggcgggguggcacaugccuguaaucccagcuacuugggaggcugaggcaggagaauugcuugaggcggagguuguggugagccaagauggcgccauugcacugcagccugggcaacaagagcaaaacuuugucucaaaaaaaaaaaaaagagcguuuucaauuuucuuuuuuuugugaacuaucuguucauauucugcagccauuuuccaucguauguuggccuuuuucuuaccaauuucuguuggcuccuggucugugacaccaguaagaauauuuuccccaguuugucccucgucuuuugacuuaggauguuucuguuuguuuauuuguuuguuuguuuuggccaugcagaaguuuuuuguuaaauauaguugaacuuauccaucuuugcucuuacaccuuccagauuuugaaucacaggcuuuucccacugcaagguuauaguguaauucuuccauguuccugugagguuuuucuucuacauuaaacucagauuuuggucauggaaagaacagguuuacauauuucaagugacaguuaagggaacaccuuuuucaugaguuuuuugguuauguaaccuugucucauuacauaauucugugaugauacaaauguaaaauauaauguccauuaugacauaaacaugaaauacccagugcugagaaagacagcaacacauaaauaguauuuuguuauuuagaguaggaaccaccuauuugagagauaaacacagaugauucuucuuuuacugaggugacaucaguuugagggacaugacuaguacuccuguuauagguggugugugugcugcuuugugacuuucaagguggcugcauucgauucagaucgagcccauggugcugcuucugccaucuccugcgugcacaugcacuggggucucuugagagcugcguauuaaggucucagugaccacauguccaccuccggcugcauagcuguucuuugcuccgcucgugggcaccgacucuucguuucccgucaaggguacugagcucucagcccaccucuuacugcuuauagucccugucucuucgcuuuccucaucuguccuguccuguguuauuuuucuccauaaguaggugacugagacguucuccaguguugaugaaagcuggcucaucaccugcauucccacaccucaugaaucuggcucuucacaguugccuugguagucagcuugugucuacaggaugccuuuuuuuucugucgccaagauugaauuugaucagguacacaggggucucacaugcagaacuccuaacaggcugugccaggcggaagcggggaaucucagccuccagccugcagaucccaguucuuggguucacuuggcugccugaagcucucuagucacuuggcugccugaagcucauucccuagagaagccucagagaggcuugcaagaaucauauucucugaauucucauguugaucacaguggcugucugcugcuuuuuauaauuaggagugaguuuuucuggaaauaaaauucugggcucauuuuuuucccccuugaguaucuuacacauguuccuccaucuuguucuggcaccuugcucccaacagaaagccugauguuaaucuaauuuucuuuuccuuguaauucaugugguuuuuuaguuuaguuuuuuguuuuguuuugucuagaaaaauaucuuuucuuuuucuuuaaagaccagugauuuucagccugggcaacaugguuaaaccgcaucucuacaaaaaacucaaaagucagccggauguggugaugcaccuguaaucucagcuacucuggaggccggggugggaggaucgcuugagccugggagguugaggcugcauugcacuccagccugagcaacagagccagaccuugucucaaaaacaaacaaacaaacaaacaaacaaacagugauuuuacagaaugucucucucucucucuuuuuuuuuuuuuuuggagauagagucuggcucuuucgcccacgcuggaguacaguggcaugauacuggcucacugugcaaccucugccucccagguucaagugauucucaugccucagccucccaaguagcugggacuagaggucugcacuaccaugccuggcuaauuuuuguguguguauuuuuaguagcgaugggguuucauaauguuggccaggcuggucuggaacuccugaccucaagugauccaccugccuuuaccucccaaaaugcugggauuacaggcgugagccaucgcgccuggcccagaaugugucucuuaacguggucuuucuguauguucuuucaauauauagucuuugguggugguuuuguuaauuucauaaacguucuccugaauuauaguuuuugguauuugcucuacugucuugcuuugguuuucuucuuuuaggaccuccugucaucuuucaguggaaccuucuuugcuuaucuucaguaucugucacuuuccuuugaauccuuuuugucuuucguuacuucuuuuugauuuguaagauuucuccucuucgcgccuucuguuucucuuacggcaguaugaggaaggguucuucacuuuuguguuccuucuaguuuugucuuacuucugaaauaauuucuuucuuuuuuuccuaauuccuucuugaguucuguuaccucauuucugagucuuuuaaaaucugauuccuggugcuuuuuccuguccuguauuuuuuuuuuaauucuuuuaacuccuuuugaaacaguaaguuacaaugguuuuauuuguuuuguggacauucuuucuggcaucuucucacugucuguggggaugguauucuacuccuuggcuuuuuucuucuuaugaccuuauguaagauugggcuucucccuccucuugcucacuuuuaaaugaaauuagacuuuugaggcuggaugcgguaacucacgcugguaaucccagcacucuggaggcugaggcgggcggaucacuugaguccaggaguuugagacuagccuggccaacauggcgagacccugucucuacuaaaaaauacaaaaaauacacaauagaaaaaaaauuagccaggcaugguggcacgugccuguuaucccaguuacuuggaaggcugagucacgggacucccuugaaccccagaggcggagguuuaaaaaaaaaaagauuuauggaacauggugaagaugcuuagcugcucaaggaaauucauuuuuuagacaaggucucacucuguuucccaggcuggagaacagugguaauggucguagcucacugcaaucucaaacuccuggguucaagcaauccucccgucucgucucagccuccugaguagcuggaacuacaggcaugcacuacuaugccuggcuaauuuauuuauuuauuuaguuaguuauuuauauuuuuuuguagagauggggucucuacaaaagacggugucuggucuugaacuccugggcuuaagugacccuccugucucagccucccaaagugcugggaugacaagcaugagccaccaugccuguccugcucaaggagauucuauauuauuacacaagcaauauaaauguauauuuacaugaaaauaguuuucuggcagauguuuaugguacucaaggaacuuuuagaagauggcagguucaggauagcgauccuaaccucacugaugguuuuuucuuuuuuuuauuuuuuguguacugaaugcaaacacgucggguccuggaucugagauguccucugugucucucuugugaacuccucugucuuuucucuuucguuccuguccugcucaguuuugaucucacucccagcaguuucuccucagcguguggccgcucaacaggggaggaccuggcaggucagugccgugaguuuagggacugggcugcccugccccaaccccugcagacuucacugcccauggccccugugccgucgccuacucuuggacuggacagaacucuucccaguuccagcugcuuuuugugguuuggccuccucugcuuucccagggagguucuuucuggccauuuuugguguuguuggcccaggccccuuggaggccacauugcuuacuugcauccucugcucuggaggcugcuggguaggucuuguagcuguuggugguuuccucacccauuuguauuuuggggacuguggggacgugguuuggcuguaaaugccauccguaggcuuuaggucuugcuagcugguugcacuuucuguucugaaggggacuuggggacguucaaagcugugccacccucgagaauuuccccagaaccccauuacaugcauacguuuuaagagacacauuuuggccgggugcaguggcucacuccuauaaucccagcacuuugggaggccgaggugggcagaucaccugagguuaggaguucgagaccagccuggcuaacauggugaaacuccgucucuacuaaaaauacaaaaacuaaccaggcgugguggugugcaauguaaucccaacuacuugggaggcugaggcacgagaaucgcuugaaccuggaaggcagagguugcagugagccgagaucacaccacugcacuccagccugggugacagagcgagacuccuucuuuaaaaaaaaaaaaagacuuauuuugaccagaaaaucuacuauucugucaauaaccuguuuaccuuauuuuaaaaguguuuucauuauaaaucaauauaaugcauuucagaagaauugcaaacacugauggauaaaguuauauuuaugauucugccauaauagaauucauguugacauuuugguuuauucuugccuuucucauuuuuuuauuaaguauauugcaguugucucaaacuuccucuuucuucaccguuuuuaagagauaaaguacucagugucgguuuucugucagugacugagccgacuccauacccacgugccccgcauuccccagcccccauucacuuccggcgcauucaguccugcucucacccuuccuucuuggaggccacaggccccaagugccgcccuugccacccccugauuccucacagauggacuuuuccuccaggcccucuggcugcucuugacccuguugaguggagauuaauccugcaccaaagccacacacacagcguugccaaagcaguaacacaaggcugggcacggugcucacaccuguaaucccagcacauugggaggcugagacagguggaucaccugaggucgggaguucgagaccagccugaccuacauggagaaaccccgucucuacuaaaaauacaaaauuagacgggcaugguugcauaugccuguaaucccagcuacuagggaggcugaggcaggggaaucgcuugagccugggaggcagagguugcggugagccgagaucacaccauugcacuccagccugggcaacaagagugaaacuccgucucaaaaaaaaacaaaacaaaacaacaccaccaaaaaaaaccaaaaaacaaagcaguaacccagauucguugaauauggauaguuauuuucuucuuggauaguaauuuuuuaucuuuccuuguuuauguggaagagagagaguggugcuacaauccccucauucaugaauauaauccccacaaaagaaacaccccccacucggauccgcaccaacaaauucaccgagggauuucagaacaucguggaugcuuauggagucggaagcuacagagaagucaauccagguuggaagucugauuuguaaauacccguauuuccaauggcauuguugcauucuugcucuaagaauggaauagauauuuggaaagagaggcugaccauuacuuuuuugcuaucuuauuuaaaaguauaagguuuuaaauguaaccacacaauccuaucuugugaauucuggagaaagucaagauuguuauguaucauuguguuugaaugaacucagguuuuccauauuugcugugaaucagaaaucucuuucccuuuuuucugcagcucucuuuaccaucaucaccuucccguuuuuauuugcugugauguuuggagacuucggacauggcuuugugauguuuuuauuugcccucuuguugguguuaaaugaaaaucaucccagacuaaaucagucacaagagguaaaaauauaaacacuccagcucauauaucugguuagguggcauuagcagugaccgaaagagagacaccucuuagauguuugcuguaggcugcggcugugcugggcagguguguggccugucagcugcggcugacagggaugucugcggggcgaggcuguuuucugagaagugaguggugagggucgugcccacaccgacagcugucacauggacacccuccaguaaccauauucugcccccgccuugcccuucacagaucaugaggauguuuuuuaauggccgguacauccuccugcugauggggcuguucucaguguacacuggccucaucuacaacgacugcuuuucaaagucagucaaccuguucggcucuggguggaacgugucggccauguacagcuccagccacccacccgcagagcauaagaagauggugcuuuggaaguaagugucccauagcuggugaugcucuggguggaaagcauguuuccuagaccuuccuccucccaggucagccuccucacucugcuuuuuguuacagugacagcgucguuagacacaacagcauuuugcagcuggauccaagcauuccuggaguguuccgaggcccuuauccccuuggcauugauccugugagugcaccacgcucugucguugucucuggaugcucuguggugccaccuagcuucgggcgccacgaguuucucuagacuguugagcaggguucacgcugcccugagcgggaggugcucauuagccccugugcaucccagucccggacacugggaggggaggccaggagcuggggggcccuccguuugggaaggugaggucagaggaaguccucagagagccagggcuguguucugucauguguccuaccuauuuuccucuggcugaaaauggcacuucaguagcccugaaaugugugccauuuccuacauuucuuccucguauaugugaacuuuuaaaaacccuugaucucgaaagaaaugguauggaguguuagagcugaaaggaagcgugagguuauuauggugcuuauugggguaguuguuuggaaugggaaaaguguuaauagaaagaaaauggggaaguacucacgccuguaauuccagcacuuugggaggccgaggcgggcagaucaugaggucaggagauugagaccauccuggcuaacacggugaaaccccaucucuacuaaaaauacaaaaaauuagcugggugugguggcuggcgccuguagucccagcuacucaggaggcugaggcaggagaauggcgugaacccaggaggcgaagcuugcagugagccgagauggugccauugcacuccagccugggcaacggagcgagagacucugucucaaaaaaaaaaaaaaaagaaaauggagaaguagccccagggugccaggacccccaaccccuucgagggcucagcaggcgguggcugaggcaguggacugcaggguugggugggguuuuccugagcugucaggagucuuucuggagaaucaaaagaaugacugagaaacaaucucaaaguugguuuguggauguaauuguguacagucguuaaacugagcaaaaaaagucuagcauuccuuaaccugggcucuccaaggaggaaguaucucuuaguguguucuguuuauucuuaucucuaaucaugauugguauaauuucauguuguagcauuaagucuuaauguaauugaaaacuuggaaacacggcuacaacaauuucuuuaagauacagcauuuuggagccaaauucaguaauaacuuguagcuuuguguuaaggaaagaaauauuucugaauaagggaaccaaggaagaaaguuugagugaguuuuuuuuuugggaggcauaggggaaaauugggguaugguuuugucuucuuucuguuuuaacuuaauuuuaaacuaggcauuacauuaauuugguucaaaaguaaaccaauguguguacguuauacauauaaaauacguauuuuaaaauaauauauaaaaguauguauaauauaaauauaucagcgaaguugacuggccuccaacuucucagcccugaauaccucauucuaaaaucuuauuuuugcaagggcaaaaugagauaguucagggcuaggaacugggaggcuagaaauuuuaaaauuagcugggagugguggugcgugccuguggucccagcuucucggaaggcugaggugggaagauugcuugagccaggucaaggcugcagugagcccugauugcuccacuguacucuagccccugggcagcagugagaccccuuaccuuaaaaaaaaaaaaaaaaaaaaaaaaagguugggcgcgguggcucacaccuauaaucucagcacuuugggaggccgaggcaggcggaucaccugaggucaggaguuugagaccaguuuggccaacauggcgaaacccuuucucuacuaaaaauacaaaaaucagccaggcaugcugguccagcuacucaggaggcugaggcaggagaaucgcuugaacccaggagguggagguugcagugaaccaagauugcgccacugcacuccagccugguugacagagcgagacuccucaaaaaaaaaaaaauuaucuuaauagacccuguuucccuuuuccuaacccaccugaagggcaggcuguaggaauuaauuuucagacaguaagagaagcagucaaugaguggggaaguuacggggacucagacuggccggggcaccguggggaggucagccauggucuggagucccucuuggcacaucuuggguuggccacuugcaccauuucugauuucauuguauucacagcuaaacuuuaugacaaaauagacauacaggagcauguauggcacauguauguaaaugugugauaacacauguaugucuccugcccagguagaggggacauaacccaggaccuugagagcauccugacccuuccagucucugagcugugugugacucucccuugccuugccuuuugucaagacuuccuaggcacaucucccuaaacgcuaugugguuccaucuggcacccuuugacguuaacaccgauaaaauuguuuuguaauugucuguggcccugguuuaaggaaaucaaugguucucagauugaaagcaucaaaagaaaagccugaauauuguuuccuucuuaaacuuagagccaccuuucaaguuaagacaggaacuuucuugagugucaccuguugaaggaaguuaaagauucuguuuugucuuguuugguuugguuuuagauuuggaacuuggccacaaaucgccucacuuuucuaaacucuuucaaaaugaaaauguccgugauuuuaggaaucauucauaugacuuuuggagucauucugggaauauuuaaccacuuguaaguacagauuuuuuuuuaagcaauauuuauaaaccaaacuuggcauuucuucaauuuugcuucuuguuggugacuguauuuauuggguaaggggcagccaauaugauguuguauuuacaugauucuguugaaguuauuuagauuuucugugguuucagcaauucauucagcaaauauguauuuaucgagcgcauaguagugccaagugcuguucuaggcacuaggaguucagcagugaggagggcagaaaaaaguuguugccccaguggagcuuccauucaagugagggagacaugugacaugugcauucaugucgauuuccagaaggggugcuugccauauuccuuuuuuauuuuacaaauaaaaaaucuuuuuguuuuuacuuuauuagagcuaguauaugaagaguaagagauggugucauuuuucucuaacuagaccuguucauucugaucucuaaacauaauuuguauaauuugaugcuguagcuugaagucacuauaacaggagucuugaaaaacuuguaacaauguaagacacagcauuuuggagccagauucacuaauauuguguagccuuacuuuaaggaaggaaauguuucugaauaagggaacuaaggaagaaaguuugagugagauuugaccgcaaaaacuguaguaguuuuggccgaccucacgucucuuccucguagauguaucuggacacucagauguaucuggauucaucauaugagaaaugauguuauucugaaauucgcuuuauaguuuaguugcagagaguuuaauuuacucuuuuuaacuuaggcugaucuuguucguggguugauugauuccuuuucuuuccuaggcacuucaggaagaaguucaacauuuaccugguuuccaucccggaacuucucuucaugcucuguaucuuuggauaccuuauauuuaugauuuucuacaaguggcugguuuuuucagcagaaaccuccagaguugcucccagcauucugauugaauuuauuaacauguuuuuauucccagccaguaaaacaaguggccuuuacacagggcaggugagucaucuucccacccucaugaacuuaacggaaguauucccaauagucuuuuauucugagcaguagaaguguuggggugaucuccacaggagccugggaaggcugcuucugucucugcaugugucaucacuggaggaugccaguccagcuugaccgcugugugcaggcagcaugaccaaacucgcugccacucaguagccaucaaaacgaguaggaagaggccaggcauaguggcucauuucuguaaucccagcacuuugagagaccaaggcuggcggauugcuugagcccgugaguucgagaccagccugggcaacacagcaagaccucaucucuacaaaaaacacaaaaauuugucaggcaugauggcugcaccuguaguccgagcuacuugggaagcugaggcaggaggaucgcuugagcccaggagguccaggcugcagugagccauaacugcaccacugcacuccagccugggugacagagcaagacccugucucaaaccaaaaccaacaaaacuggugggaagaaaaugcauuaccagagggauccugagggcugcccaguccccccauuuagaagggaccaccuggaucacagcacauggacccuuucaaaaaaugagcuuuccucucacugugcguuugugugcugucacagugggcucuaagggcugacugcucugcuuggaggccccgcucugcuguuuccucaggauggagcuuugagcagaugacuaacuucucucugccucaguuuccucaucuguaaaaugggacuaaaaacaggagcugguucauaguauagcgcacguguccaaagugcguacgaacgugcuugcacaauccagcuacucaguaaaugucagcauuugccauaguucuuacccaccuuacauugagggucuuucugcugugagcgccacggcaucuccugcccacggaugcugguccagacauggcucaccacguuguaaagugucugugaggacaucuggggaaacccucccagucgguaguaucagagccuguguuccuccugagccguguuuugguuuuucaucguguugaccugugaauggagcauuugguuuuguuuuucacauucuauugggugcuggaaaguuuuaagucagauuugaagcucaacuuaacggaacuuuggccucguugacgagaugcauauuugcguucuuuuugaacuuuuuguuucuguuuuuuuuugguuucucuuguuuaugauuuuuaagaauuguauuuuaucauuauuuuauugaagcuuuguacaauggcauagauaccacagauaaaugcaggggcguucagugggcacaggugcuauggacagaaagaucaaggaagggcagcuaccuuucuuuacuaccugccgcauaccugagagugugcuuuccuuacuuaguguuucuuaauucucacaacagccccaggagguaggugugucauccccuguuacuggugauaacugguggcucagggcaguccuggucacucagcggucuguagggccaggcuguuaaccuaggucagccuggcuccagcccaggacuucugauguggcucugccuguggccgccaccuuucucggcauuucaagagguucauccuguugaugguguguagauaauacagcuuugugccugaguagcacacagagcucuaggaaccuguuuuuggugaggggcgaccauacagagugauaagcuuggacagcacagugucccguccaaacccugggaagccaugcagacugccguggcuguguaagccugaguggauuuugcuuuugauuuagcuuuaaguaacuauaaaucuucguuuuucuaaggaaguguuuuugguuuuguucugaauucucuuccacgauuuucuguguguggagguaaauccacuugcugauucacacucauaguccucagacggucuuuauaaucaucaaagaacaggaaaacagaaccaagaauauacaaaauauucugcuugugcuuauacuuucucauuuacaguguuuacagaaaaugauuaguuggaguuugacucucuuuagaauuuuuguaaaguuuccuugcuggucuaaaacaaaauaauacuuuaccacagggucauuaauguuauucaucaguucuagaauucagcuaugaguuuaggaaaagaaaacccgcuggcaaguguagcuggcuggcauuuauugaauguuccucgcguggagacauuguucgaucuuuccugauuucaucgugugcugcugacccugcaggcaggccuucacguuuuaaucggguuucucaccuucugcacuaacaggaguauguccagagagugcugcugguugucacagcauugucugucccuguccucuucuugggaaagccacuguuuuuguuguggcuucacaaugggcguaguugcuucggggugaaccggguaagugcggguuuggaugcauuuacaacugugagcaaagcuugcuuucgguuauacaaggauugguguagaaaacaccuccuggagggucccugucucuugauuuaaaagccaaagcucccuuuauuuaaaacauugauguuggcugggugugguggcucacaccuauaaucccagcacuuugggaggccaaagcgggcagaucacuugagcccaggaguuugagaccagccugggcaacauggcgaaacccugucucuaccaagaauacaaaaauaagccggugugguggugugcaccuuuagucccagguacucgggaggcugagguggaaggauggcuugagccugggaggcagagguugcagugaguugugaucacgccacugcacuccagccugggcaacagagcaagacucugucucaaaauaaauaaguaaaugaaacauugauguugaaagagccugcuguguccagggccuguggagacccgcccugguaugaacuacaagcuuauuagggguuuaacucaguccuucaguucagaugggcacaauuuaaaugccuuuuuccauauucgucuuaauuucuucuuuaagauuuucuuuuuucuuuucuuuucuuucuuucuuucuuuuuuuuuuuuuuugagacuggagucuucgucuguugcccaggcuggagugcaguggcacuaucucagcuuacugcaaccucugcccuccggguucaagcaauucucuugccucagcccucaaauagggggacuacaggcgcccgccaccacgcccugcuaauuuuuguauuuuuuguaaaagacgggguuuugccauguugcacaggcuggucuugaacuccugaccucaggugauucaccugccucggcuucccaaagugcugugauuacaggugugagccacugugccuagccuaaagaacuuuuuuauucucaaagagcugaaucauuaagagaaacaaagaaacuauacaaguuugguuuugucacaaccuugugguuuuacaggcacugacucugugcucuuuugguuguuagaguggcuacacacuuauaaggaaagauagugaggaagaaguuucauugcugggaagccaagauauagaagagggaaaucaccagguggaagauggauguagagaaauggcgugugaagagguaaaucuuuucaacugcuauugauaaacuuagauaaguaaccaagcuuccauagagauaaucauguuaagauaauauuuaaucaucuuaaaaaaugguuaagaaaaugggacuuccagccuccacaacuaugagaaaccagcgcuuuccaaaugcuguuugaugauagaguugguggcauuauaugaguucgggucauuuuguccuuucacuucgccagugggauuucugcuguuauauuaagaguuaugauuggagugacuuaaggugccaugaacauugcuuucagaagcuucuugggucagucagaacuuuuccauaguugcaagaaauagagacccaguuuuuucugauugcgaagggauuuuacuggcucauggcaggacagagguagaguugguuucaggauaauuacaguuuuggggucuccaauuccaagaggccuugguuggcuuuuuuucuuuguaaguuuucuuuauauugugaagucaguuggccccaugaugcuagaaccauggucacaaguugcccugggcuuauuuuuucagucuuuccauuagagagcaaagcgcccuuaccagcuuguuacuauuaggaaagaauccccaaauaccugccaucccuggaccagugacugcugccucaguccccuuuacgagugaccgcugccucaguccccuucaccagugacugcugccugaguccccuggaccggugucugcucagucucccuuaccagugaccacugugucaguccccuuuaccagugacugcugccugaguccccuggaccggugucugcucagucucccuuaccagugaccacugugucaguccccuuuaccagugacugcugccuuaguccccuuuaccaaugacugcguucucaguccccuggaccagugacugcuaucuuaguccgcuggggcugccauaacaaaauaccacggacuggguggcuucaacaagagacuuguuucucacagccccggaggcuggcaggcccggacugagaugcuggcaggcugcuuuccccugaggccucccugcucagcuugcugugucggcacagggccuuuccucugugccugcaccccuguuucuccugcucuucccagaagacaguagucacagugggucagggcccaccuccugaccucacucaaccuugauuaccuccucaaagguucugucuucaaauacagucacauugcgguuagggcuucagcauaagacuuuugggaacauaauucagagccagugugguuggggguacgaggcuggacagggaaguagcggcuccccgcaaagaacagaggugcagucccaggaagacagcagagcauggccuccuuucuuuucauggaaacuuuauuuuggccauuuagugaggaccaaacaaaaugucuuauaaucaacauuuuguaauuauuauguaauuucguguuuuaauucgggacaauuaauaauuaaguucuaggaucauagagaaacaaaagcagagcuggaaagcgcaugagagucaccuugccuggugcuuugcagcccuuucccugucaggggccccuugcauaguuuucccugguuggcucuacuuagaaugcucacaucuagugaaucgcagucuacucuuaggguuggugaauaccuauuuuaucaguagauguuucauaauuacugagaccugccccagaaucccauuaguauagcagcuguggccacggcaguuccucuggucuaccuucuugguuuacacaggggagucugaggcgugcggugggaguggggcugaugaagguggggauuuggggugguaaagucuggucauggagcuggguaguggcagaguggugaacagagugcgucugggguuucuguuccucacacucuagcguguucuuaccagcauccagccggcagcucuuucauuguaauccuugaaguggaacccacuuggcauguagaaguacacauguaacaucaugacucuuaacauauguugugugaucucucucaguuuaauuuuggagaaauauuaaugacccaaguaauccauuccaucgaguacugucugggaugcaucuccaacaccgccuccuaccugaggcucugggcgcuuagccuggcucacgcacguaaguuccugcuuagaccugcaguucccaaugcccuguagugccagcagacucagggggcacugugggauauuuuaacuuuguaacuaauagucauagcaccaucuuucagcugccacgugaacuuacacuauucacuacuuaauacacagcucucuuggcuauuucuuuuggcugaggagugcuguggaaaaaucacagagggagucucucugaggcuggucuggcuucagagccugcccaauuuaaaaaaaaaaucacugagacacaaggggcuuugagaacugagacggcuugggagccucugguguaagcacuugcuacuguugccauuacuguuucuguuaguaguuauuucauucacugcugccuuaccaagugugaauaucuguuuauuucaagcaaguccugccacagcacucauggguagccuugaucacaggaguccucccuuugcacaauuccaguaaugcacacauguuaguuuccacaguguaguuaacaccuguuccccagcagcaugguucccauuucagucaccacaguaccuagccgugcaguuaggugcaggugcauuuaccagccuacgugcggcaggugucgugaugaagaugcugauaacccaccaguggugcucggcaauguuucaggacguugaagguuugugcaaagggugcaauguugcaaguggguucagacguagaaaagaauaggacaggccaggcacaguggcucacaccuguaaucccagcacuuuggggggcccgaggcagguggaucaccugaggucaggaguuugacaccagucugaccagcauggcaaaaccaucucuacuaaaaauacaaaaauuagcugguugugguggcgggcgccuguagucccagcuacucaggaggcugaggcaggagaauugauugaacuuaggaggcggagguugcagugagccaagaucacaucacugcauuccagccugggugacagaccgagacucugucucaaaaaaaaaaaaaagcuaaaaaaaaaaaaaaauaggacaauuuggcaaguauuaggaaagaugcuugcucugcaucaggucacccagcuugccaauuuacacagcaggaaccaagcacuguucaaacuacccuaauaaacuuuuuuuuuuuuuuaaauaacagacaaaagacuuuaauacucagugcuucuaauguuucaaagauagauuuaccauuuuuucauuucccuauauuuuuuguuaaaacauuaauaacucucuuauuagcugggugcuguggcucacgccuguaaucccagcacuuugggaggccuaggcgggcggaucaugaggucaggagaucgagaccauccuggcuaacacgugaaacccugucucuacuaaaaauacaaaaaauuagccgggcgugguggcgggcgccuguagucccagcuacucaggaggcugaggcaggagaauggugugaacccgggagacagagcuugcagugagccgagaucaugccacugcacuccagccugggcgacagagcgagacucugucucaaaaaaaaaaaaaaaaaaaccgaaaaacaacucucuuauuguuggccaacaauauagccaacaauaagagaguuuuuaauguuuuaacaacaauuuuaaaggccacagagcaaaccauuuuucccauggauuaauagggaugcuucggaugguuuugauugcaaggucuuuacugugcaaagcaagcacugccugugcuuguggaaaccaccggacaagagggugucuuuuuuuuuuuuuuuuuuuuaguuaaaaaaaaaugcuuauguuuuuauaagcauagccaaaggucuggaauuuuguggcuggaggggcccugucucguucaucuccauuuugcagagguggugacugaagccacugagugucggugcuuuacucauggucauccaguugaucccucaguggcagaaccaggccugggagccuguuucuggcugccugguccagugcgcuuugggaggucacaacccaaaccuagucuggggcaagaccucccuuugggagauggccucugauauuuuuggagcaccaggucuuccuuaguguuugagaccgucucggagcugacuggcuuucacaugagaaacaguugggucuguguuacaugugugucuauuauuuuaugggauaauaguucagggccgucagggggaaacucaguccagguagcucacagagggacccacuguacauaagcgagcaugaccugugcaggcugcacuccuuugcagaguugucugauguccugugggccaugcugaugcgcgugggccuccgcguugacaccaccuauggcgucuugcuacugcucccgguuaucgcgcucuuugcaguuuugaccauuuucauccuucugaucauggaagggcuuucugcguuucuucacgccauacgccuccacuggugaguuugaaaccuagccuuggagcuguuauuuaaaaaacauacccgcccccccacugccccgcccaaccaaauauacacagccccugcaaaaucuaaugcugaauuuaggccaguucuucccuucccuugggaucuguguucauauccucugaguuaaaauuguauuuugggccgggugcgguggcucaugccgguaauccuggcacuuugggaggccaaggcagguggaucacgugaggucaggaguucaagaccagccuggacaacaugaugaaacccugucucuacuaauaauacaaaaauuagcuggguguggugucgugcgccuauaauaccagcuucuugggagacugaggcaggagaauugcuugaacccagcaggcagagguugcagugagccgagaucaugccauuuuacuccagccugggggacgagcgaaacucugugucaaaaaaaaaaaauguauuuugauucugaacuauuaucacugacaaguaaaaguaaguuuaaguuugcagaauacuaacguauguuucauacuccuaauucacuuugggucugacagguugcucugucuuauugcaagauaaauccuucuuauguauuucuuaauguuuuaugguguaggucagauuacugcucugugccuccagugacucaaguggcaggagagggucucguuacuugugcacgugcuuuuguguguugggcagugagagacagcggaugugucagaguuucuguucacacugggaaagccagcacgggguugggggugcggggcaguguuuagcuaaguaaaaauauaugugccaagaacauauuuuggaaugaagcaauuucagcacaggaauuuuuuuuuuuaacuuauaaauguuguuuuaaggaaugugauuucauaaucuuccauuaauacauggcuuuuuuuuuuuuuaggguagaauuucagaacaaauucuacguuggugcaggcaccaaauuuguuccuuucucauucagucuacuuucaucaaaguucaauaacgacgacaguguggcaugaucauauugcuguaaccaacaagcuuucagauuuauggagaaugaccauguuauagacuuucacuuaugucagauuuaugauaggaaaaauuccaucuucauuacugccuuaugacauagccaaauaauucuguaagauauaccucuuccucauauguuaaauauuuuguaaaguuuaccaauuugagauauaaaaauuucuuuugguuuuuuaugaugagcaaauauaaguuaaugccaaacguuauguuaaaguuauuuuuucaaauacaggauuuggggagagaagccaauuuugcauggcuaguugaaaaugguauuagauacuuauuuccuuuaaacuuuauuuaaaacaaacaacagaguuaaucugucaccugaaguugccagauaauauuuuccaacagcugaaguagggauaguuuuuuaaaaaauuuaaugauggguaaucaaaacauucacauuuauucugcuggauuuaaaaauauguacuuuuuuuuuuuuuuugagaugaagucuugcugugucacguaggcuggagugcaauggcacgaucgugucucauugcaacuuccgccuccuggauucaggugauucuccugucucagccucccgaguaacugggauuacaggcaugcgccaccgugaccagcuaauuuuuuuguauuuuuguagagaugggguuucaccauguuggccaggcuggucucgaacuucugaccucaagugauccaccugccucggccucccuaagugcugggauuacaggcgugagccaccaugccuggccaaaauaugcaaauauuuuuuauccugugcuaccuagaauuacaaguagaggauuguuuuuacaauuuugucuuguuuuaguaauuggggacaaugggauaaaaugacauacaacaaaugguuaucccacuuguauauuuuuuuaaagacucuuauccuguuacccuuacauaaaaccaguuaugauaauuguauguuuggaagauaaauuguaugcugagccuuaaaacccagugugacuguagaagauauaaugcggacaugauuugaauuuagugacagcuuggcugaugucacugaaccagaaggguuuauacugagugaaggaaagguaaaaaguaguauuuuguauauuuuuguaacaaaauauaaaugaagauauuuuaccaugaagagauugcacuuauccuugagaacagucuaaauauaaaugaagauauuuuaccaugaagagauugcacuuauccuugagaacagucuaaugauacuuuuuuuacuuucagacuguuucuagcuaaaguucugauaaaaguauugaguuaauuuaaacuuucaaacacuguuuagaucaguugaaaacuaauucuuaauagccauuguuuuauaaucuuuaguuuaaauucaucuguuugacauuugguuuuuugugaacuugagucaguccuauugaacauuuugaccuauauucuugcaaauuauguuaauuuuucauauuuuaguuugauuuuagacaauuauuuucaaaaagaaaccugacuuuuuuucaccuucuugacauugugagugauacacguuaaaaggcuauuugcccgcauccuccucuauccuguuucgagguagagagcuuggcacuucuguuacaagcugagagucuggaggugcugaguuuaacguggcugugcagcugauuucaaggcaugagcugaacagcguugacacagccgugacuuacaauuaaacccuuucaauuacaguacagauucugugugcuacuugaugagauguuacccaaggccaguuuggacuuacugcuuuuugucccucauauuaaauuaucaaaugaugccgaugaaaugcuugaaaaugauucugcucucaaaguuaugcuucccuagaaaggugucaugucgggcacuuguguugggugacuaugacaucccagcagugcuggucaggucucagaguugcuuucaccuagagcugaugcuuccacaaggggacauuuguguuacuuugcuccaggggucugucauaaaaacaaugguaacuacuucaucccuaggaagcccaagacuucagggcacuguuagcugauugguaaauaagggacacgauauucacgggaauuguuuacugcuccccacuaguaauucucauggggccacuuuuuuaacucuuucuaauuaacaccucuucucagcauagagcagaggaugcagucauuucucuguugaaaucuauguaguauuuauguagaaugucauuauaugaaaagcgaauucagaauccuaacucugggaaagcgcucucuggaaauguaguuugauaauagugucuuauaggggccacgggaauuuguuucucuauaaagcgaugggcuccagugucauguuaccagaguuaucgcucaguuuuguuuguuaaggcuuuugcuagaaccuauuauguauccaguuuuuaaaacauacuucauucccuugauagcagagauccagagcacagauggcaaguuguguggaugauacugaauauguuuauuuuccuaaagauaaaugucacgacacgacauuucucaguuuuuauuuagauguuuauuaccauguguuaacagaaucuuaaaacccaagggauuucuucaguaaacuagacuuugauucaaccugcugggcuggagacuguaauugccguggucaguuaaggagugcaaaggguguucugucugauaggaucugggugagcccugcggacuuuccagcagcgaaaggacuuggaacuccucuuucgcugaaugcugcucuguuucuggaauggauauuuuauaacaacauucuggugucagcauccccucagcaguuguuuauuuaaaaauuuuuuuauuuuuuuugagacagugucucacucugucaccuaggcugaagugcaguggugcagucucggcucacugcaaccucugccuccuggguuuaagcaauucuccugcccuagccucccgaguagcugggauuacaggcgccugccacagugcccggcuaauuuuuguauuuuuaguagagacaggguuucaccauguuggccaggcuggucucaaacuccugaccucaggugaucuacccaccuuggccucccaaagugcugggauuacaggcgugagccaccgcgccuggcccucugcaguuguuuaauaaggcacagaauaccuguagcauaggucagccuuacgauguccaugaauuacauauucagacguuuuagagccugauacauuuuggaaaagaaaaacaacuucuacaccuauucuacaguccgcauuuaaaacaauaaauuccucuauuaaaaacguaaagccggguuugcuugcgugccacagggaauauauccaggaagguuauuaugaagcugucaaaucaagaugaugggaauaaggcaguuugaacgaacagucuucccacagucaggccauuuuugcugauuugguuuagaauuuucagaaauacuuaguacacuccaccuguucuuugaugggaauaucuaagaaggcuagguagguucuuaggguuagccugagucaucuaggggcucaacuccuugugaggggaaaugacagugaacaaguuaguacuuugcuccacaaaugcaugaaaggacaaauuugcaucuucuaucaguauuuaacuuccuuuugcuaaugacaaauaaauauaucuauauuuuuaa

SEQ ID NO: 191529 - RNA, 86346 nt, Homo sapiens
ucccauuuuuuuaaacguuuauuacuucaagagugaauuauuuuucaaagaugauaaaacucauuucuauuccaguagaaaagggucacagguuugccccaggguccaggagcgcccggaaggcagggcccccaggccucuucaccucagccugggcaccuauaaucugagggacccugugagggggugggggcagcucgggggcacagccugcggccacuucggccagagaguggccggcucaguccauaggaugaugucaguuuaggcuggaggaaaagggcgccagacaacccgaugcagugccugugaagacuucggggggaucaaaguccggccggggugggcggagacccucgggcagcugcacagggcaucuugugcucacuccauuguuuuccgaggccuguguaaaggcgcuuugccuggccuggcagguagaccaaggccaaagcucguggccagggccugggcacugaguccccacugaauuuggcacaggaaggcggcacucccagccuggcccguccugcauggggagccaccacaccgggacugcaguguuucaccuuggaggggaggaagccugggcccaacggcugaacgggacaggccaggcucacccgaggaaggggacgcaggacccacagccccuguggucaggccugugggccacguggagagaagguuccagaacagugcuuguugacgagccucucccuacaagucccuucagcagcagcuccaucccugagugucugcacaagccugcacgcauguguguaugugugccagggcgugugugcaggugugcaacaggcacauggcagcugggaggcucaggcuguggggcuggggggcuguccgcugggagaguccgggagaagcgggguguaggggcuggggggccggucaggcccagcggccaggccuggcuggcucacgguguccucaggacccuguggagaaaggcaaagcugggugaccacccacgcccugucaccaaaccccacccucauccccgcccaccacagcccuguacccacauccccagcagagacuccacccccgccaccaggcugucagaagugagaagagacuggagucaccuauagacuccuggaaugacuccaagggccucuucaucucacucaacacccgccuggccuccccgaccuccuuuagagauggagaaacugaggcccaaagagacuuaauacagugaggggcagagcaaggggggcggccugugugcagcacagucaacauggaacaaccggggcaagcucugucccucaggaggagaacguauguuuauguguugauuuauuuuuuauuuuuuagagacggucucucucugucgcccaggcuggaguacgguggugccaucauggcucaccacggccuugaacuccugggcucaagugauccucccaccucggccucccaaguggccgggacaaugacacgugccaccaccacgcccggcucauuuuuuaauuuuuuguagagaucaggucuauguugcccaggcuggucucgaacuccugggcucaggcgauccucucaccucagccucccaaagcgcugggauuccaggcgugagacaccaugccuggccuguguuuuuaaacccaugucacaggacgguauucagccugaacaguauuccugaacagaagacagggaggaaagccagccacacagcaauacacgcagcaggaugcagcuucggucacauucaaaaagugaccucaugcucauggcugcgcacaugcagauucagaaaaaacaaacccacgugccaaguuccuggccauggcugcucaggguaugcggggcgcaggacguggggagggggacgagggccacccagggaacgagugaaaccaagggcaugagaugcuggccaucuucaacacugacagcugucagcaauggcugcgucugggugaggggaacuggauacugucauuugucuaguuugacaguuguagaaaauuucucaacuuaaaaauuaaaaauacagauaaugcuaaugauaagaguguggggugagccuucgucccacuaagcccccugccucccuugcccugagcaacagaggccucccugccccgguggcuggggcuggaaaccgcugcccaccuccgcccaccugugcuugcuucaccacgggguaggaaaaucaaacuccugcucagggcagagagcgggcacaggggccagggucugcugcacugagccaggcgcgggggaggucagccccgcccccacaccacccacugaggcagcacaggacacccacagguggcuagaccuuagccaugugggcccaaagagccgugacuugagaaggucucacucagaaguagaaaggggaaaccaccccuaggcuguaaaagaaccccuugucuuucccaaggaagacacguggaacaaaacccgcaggugccagagggugaagcagguuccuccuccuuccccuccuccuccuccucuuugccacuuguuugacugaggaacauggacuuggcguggaagaaagaucggugagaagcuaagaaagguccaggaacauaucccugaagggccaccuggacaguuguccaggcuguucacugcacaaaaggacccagcugaaggguuacagaccaguggacacacaguuuaccaagcccccugcccuacagcaggccucaucugcccagaggggcugucuuuuucuuauuuauauaaaaauaucuguuuuccccccuucucccaagcaaggcagccccucagggccauccccauacccagguacagggcaaagguguggggccuuccccagggacucaggccugagacucagaacaggacccaagagggggcagcaguggccugcagggggaccaccagccaccacccaggugcccaccccaagcugcagccagccacuggaggacacugcauuccccguuucacaugccuaggggauccggggcgcugggcugggcuccagaccuuccaggaggcagggcaggagggucuuuucaagucaaacacuugucucaucaccuaaaaauuggauucuguuggcaaaauaaaggggagaccccaguuuuguuuggggggcagaugacaggacauccugguuauguccagggaggugcagccauggggcccuggccacucuaucuaugcuaaaagugaaaagcucccugcucuacacugaccaggcccugaccagccccugaccagcccccaccccugcacccugggaaucccaggcaaguuucugcagaagggagcaguggcuggaaggagcaggcacaccgauggggccaaaccgugcacagcacuacgguguccuggaggaauccugggagagaggaaaggaaggggguccaggcagaaggccuugcccccaagccuggggacccugucccagggaggauccucuccuaauauuaacacuccaccccaacauggucagacuccacccccuacucccagauggacaggaagggcgccccagagcuugacugggacacagggcuggcagcgccugccaacgccaacaggcuccugccugcccaccccuuggcauuuucuuuuucaucuccuuguccagcccuggcaagugagaugaguuagagacagccaaguggccccaaagaguggggcugcugccucacguccccacaauguggcucccuggaaagcuauuuucacccaaguaggccuagccucagaagcucuugagggcagcacauuuuucagaaacuaaaauaacagcuauuaucagaggcaccacgguagagcgacucaucccugcccaaccccaaguuguagggccugcagcucugcccgucaccuccccuggcaaggacaccaucccuggccacggcucccccaugaccucagcccuacaggaaccuggccaaggaaacgcagaacccccaggggcaucagccuauguucccagcagauagggcggccacauaaaaucagaacgccuaguuaaaugugaauuucaggugaacuacagacagguuuucaggauacgugcguccuaucauugcacaggaacacaauaaaaauuacuuauugcuuaccagaaauucauauuuaacaggcacccuucuguuguuucuuguguuucguuuguuuguuugugcucaaucuggcaauccuacccucagauccagucccagguauacaguugguguucaguugaugccuacauucuuuguucuuggucagucaucccagauguauuuauuuauuuauuuauuuuaguuuuauuuuuuugagacggagucucacucugucacccaggcuggagugcaguggcacgaucuuggcucacugcaaccuccaucucccggguucaagcgauucuccugccucagccuccugaguagcugggauuacaagcgugugccaccacacccagcuaauuuuuuuuguauuuuuaguagagacagguuuucaccauguuggccaggcuggucuugaacuccugaccucaaaugauccaccugcuucggccucccaaagugcuggauuacaggugugagccaccgcaccuggccagucaucccagauuuagaucaaugccucucaaacauguuucuacaucagaaucucauuaggguccauuaaaauacagauuccagggucccaccaugauccuauuccagaaggcuagaaggcugcccagggaucugcauuucuagcagacuuccccaggggagucuauugcacaagagauuccagaagcagcaggccuaagccuugcuccugucuuucuaaugugaccuugcaaauaggcaccagcccacagaauacaaguugcccucugggaucaaaaaaacugcuauucacucagaacauaggaagggcaguuucuccaaaagcaaaauacacaaauaugcaucuucagucuguagacacuccaggugaaguugaggcugaaggaaugagcaggaccccaaauguuuuaagccgccagcauucuacuugauaugggagggggcggggaggcgcacggcauuaccugguacccaccuacaguuuugcuuccugcagcacagagcccuugggagcugaugucaucagggauucagaauaggccugaauggccuccuuauccuuugagcccuuuuuacuacuacuccaaaauaaauagcauuucuccuagaagauaaccaagcuaauuuauaguugacguugaagccacauaaaaaugguuuuacacgguucuucaauuugcaaaaggcaaagaggaaacaggaaaggcacauaaguuuagaguccaacaacccucaacgauugcagguggcugagauguggggagcugccgcucuuagacauaaguacaagcaucuucaggaaacacaccugggagguggacaagccaagcugaaaagggcucguccacuugaaaauuuaagccagcgaggaagcaagguggggagaugggccauggagaccgacaaccaguggacuuagcuggggggcuguuuaaaaucaacgaggaacagauuguucuguuaaaauacuuuugauuuauuuuaaaagaaugacuugagaagaaaaaauuacugcuuuuuuuaauuuuugagacaggaucucacucuguuguccaggcuggagugcaauggugcgaucauggcucacugcagccuccaacuccugggcucaagugauccucccaccucaaccucccgaguagcucagauuacaggcaagagccaccauaccuggcucaaguggaaaauuucucuaaagagaaauuaaaauauguugaguuuacccgcaugugauuuuuuuuuuuuaaaucaggacaaauuacauaaaaacugauaaggccggccaggcacaguggcucacaccuguaaucccagaacuuugggaggccaaggcggcagaucaugaggucaggaguucaagaccagccuggccaacauggugaaaccccgccucuacucaauauacaaaaauuagccaggcaugguggcaggugccuguaaucccaacugcucgggaggcugaggcugaggcugaggcugaggcucccacuugaacccgggagguggagguugcagugagccaagauugugccacugcacuccagccugggcaacacagcaagacuccaucucaaaaaagaaaccaaaaaaaauaaaaauaaaaaaacaaaaaaaacugguaagguccugcuacaucaaaacacacauaaugggauaaauuucacuuacguggccuccagugaaaccugcagggagggagccacacugccgaucguagcauucuuacuggauuugagggugggaugcugauuugggggcugcggcagggaaagggacccuagccacagccuagaccuucugugcuuccugacccuccuucccuguccccauucugguggacaauuuggagacagacagaaggagacagagggaugaggcugucauggccuccucuggcccagucccucagccaguccccagggacccccucauguggcugugcgucgucacuuguggacaccuauggugaugcucugccacgggaagguauucauggucugggaguguggguucugaguccuucuguccucccuacauaauucagucuagaaacuggagggaguuccauuuugcucgcuggagucacagcccugcuggguucuggcucccccuggggcaguaacagagaagggggcucccaaaagggcugguuggacccaauggucauuguucaucgggagcucaaacgcuagagcagcaacaugaugacagcugguguccaggcuaccaucucacauuguggaaaccuuuuccccccgaggacaggaauuuugaaaggaagucggguuucaggucugaaagccaaggugaagaaccaggaaugcuuuauugucacccagcaugcaagcauggaagcaggcaagccuucccugagacaggggaagaggaagaaucauucaccagugcuaaaggaagcaggugcugcagaggagccaagaccagcagagcagcggggcagccccaaggccccucagaaggccucggccuguggcccuaggaugaugcaggugggggccaccucagagaguggcuuucugguccaugcauccaaaaacagccuuuccugaugaccugccagugggcagcaucccuuccccugccauggcagccacucgcccaucuccacugccccuugagcucugugaucacagcucuccuguccuucgugugacuguaguaacuugccuaaaggccugccuugcccaucuuugcugcagaucuuauguucuggucaucugcauccccugaccugugcaaagggccuugcagugaaugcaugaaugaauaaauaaaugaccccgaagcaaggagggacacuguuaucaccccucuuccugcugcuucuggaggucugaagcccagggcuggagcucuuccccacuuccguucccuccugauagcagcugccccauccuguucaagccaucgacuuccucacgcacuggggccuccccgcugggcccaggcuuccaccccucccagcccggggcccauuccccagccagcagcugaccuagugauuccccucuuuaaaagccuccaaugccucugucacucccagaaucaguuccaaacugcucacugugcaccacgaggcccuggguggcccgcccuguccacucucagacaccaccuccuaccucugucccugcccucacuccccuccagccacccuggcccuaccugaccguccaaugugccuugccugucccugccacagggccuuugcaguggccgcuccaggcagcauuccucauguggcugugugcugagugccucccuggccuccaugucaaagcucacuaucuaccucuucagagaggccuuccugaagcuccaucuguccuuguccccacuugcuccagacaugcacucuccagucuggaagcugcauucaguuggugagcccuugaaacggggccaguccaaaaugagaccugcugcacauguaucguacacacaggauuucaaagacuucaugcaaaaacacugcaaaaauauugaugccguuuauacugauuacauguugaagugauaauacuuugcauauauuuggguuaaauaagauuaaaauuaauuccaccuguuuccuuugacuguuaaguggcuauuagaaaauuuaaacugaaaaccucacacguggcucacgcuguauuucuauuuggcucuaaccccucacagcuccuaucaugagugaaauuaucuuuucugcugauuuacuugguuuucaucugucuccccggcugggaugccagccccccucaaucccccugagcagggaucucagcugucuccucuacugcuguacguccccucgccccuaacagaaccuggcauccccgggugcugacuugaugaauggaugaugcaaguaccaggucucauuacucaaagcccaccugugcccccuccaagggagggucccaggccuuccagaacaggcagaguaguggcaacgcggcaugcaaaagacgcaagcgugcugcgcagcccccagcagugaccgcucccacuccggcagagacgcaggacugcugcuggaggugggcuccaggcugcgguuggccagaggguccgaucugaggccccuuucccccagcaggcaagcgaauggcugucagcccgggcugcccucuggccagcaccuacuuggcuccggauuuggcagaugacagggaccagcagcaggacgcagcccagcgccaggaggacguacugggcauagugcaucaccuugggcaucaacaccagcugaguguagaaugugugaagagucucccccuccauggccccgcucugaggagacagaaugacaaacacaugagcuggggccgcaggcugcgggcuacagcgcagaugccacccaacaccuuccucugugcccgccucagcuuuuccccaccucaagcuucccggcuaaagcauguguuggagccugccagggaccuccucccuccaggacacaaggugagacuacaauuccccgacucccuugcaguugggcagggccauaugaucguguccugaccaaugggagguggaccuggccucacgugacucuccaucucguucccugccacugaauggaggcucuccaggauggcggggccaccggggcccuggaacccuaaaugacugcagggagcagagcucugccuccccaucaacccacuucagauucggcugugaguaggaaguaaacuugacauucggaggcuuguuuguccuggccauuagcuagcccugauuuaaaacgaggugggcaagaaacaauaaauacaguaaauaaaauaaaauaaaauaauaaaauaaaacaagcuaggccagaaggaauucugaaaagcugcgagagaaguaaguuuaagagaaaagcugacaccuuggaaaccaacuuccccacuuucaggagaagaggucauaugccccaacaaaauuauuuuacacccagggccagggacuuuaccucuucaugcagcuucugucuuccccaucucuagggaucccuuucaccuuggugggauaacugacauagggugcuuggacagggugaaguuucugauacgcugguccaugucacaguccgguuacccuggcucagcccucucccuuucuacaagcugcuccccccgccuccugccucaaaugcccacauuggcucuuaacaaaagcccccgacgcugugcccaacgcacccuuaccucugcaaaccagagcagcggcaggaccacaggcucaaucuucccaguuugucuggaaauaagcaagacauagcugugugaaacaaagucuuacacccaaacuugaucuaauucugcuugaauacaacaucuaaacagguuuaguauaauuuugcacacacuaaacccucaccaccaaauauaaacaaugagcugaaacacuuuaggagccauaugacaaaacuguccccaggcugaaggucucagucuacagcccucaauaauacuuguaaauaagacuaacuuuaaaucuuuaaaaggcguuuuguuuuuuuuuuucuuuaguugacaaggugagauguuuucccacagggcuguuugacaucacacagcuuugaaccugugaucauaagcucugaggccaggagggauuugauucugcaaucucagucaucccuccuuauccaugguuuugauuucugccauuucuuacccucaguacaguacaauaagauauuuugagggagagaccauguucacauaacuuuuauuauaguauuuguuauaauuacccuauucuuaguuauuguuaauuguggcuaugccuaauuuauaaauuaacuuuaucauagauguguguguauaggaagaagcauaguauaugcuauacaggguucaguacuauccccagcuucaggcauccacugggggucuuggaauauacccccagggauaagggguccaugguacuugauuggcaugggcugagggaaccaguguuucgaugugcugccagaaggaaucuccccuggcaaagagcuugacaacuugaaaauaaucuuuuuaaacuaaaaacucacaucuccuacagggcagagaccaccagugacccagccaaaauccauuggucccuuuuagaaacaggacccaaauuuuacucaggauggcaaugcacccaguuaaagacuccacuucagccucucuuguggcaagugaggcucugugaccaaguucugguuaaugagauguucgcagaagcguuacgugggauggccgggagggcugcuuaaaaagaagcuuucacagcugggaggugaaccuuuuuucccuccucccuuucagaugccugaaacgcagaugcaagggcuggagcucugcagacacugggaccagaggugaccuugaggauggaagccauguguugggaaaauggaacagaaagaugaguggaacuuggacuaugaaugucucuugccauacuuggacugucugccuccagacauccucuaaaagaagauuuuuaaaauaacaauauaccuuugucccauuugagccacaacuguugaguuuacugaucuauacugccaaaccuaauuccaccaauauaccucacgacccagcaauuacgcucuucagaaacugcccuagagaugcucacacaugcacacagaggcacaaagauguucaguguugcuuggacuagcaaagacaaacagacaaacgacaauauguaucuucucuauggccacauauauaugaauguaaauaaguaggaaaaggccuggaaggaagcacagcaaauugaugaugguggguacggcuggggauggcggggagucacaggaaaccauauucuuccccucaggaagauauguucuuauuaccugugaaguuaaaacuuacacgucaaguuaaaaagauaauaaaauccaaagggagaauaaaaguaaacuugauacugcagaaacgucacaggcaugaccucauccaggcuaucaaggucgacaucaacagugauacaguauguugacggaauguacccaagaugcucugaaacuggaacuuucucucugcgguccuccucccaaaacccaucaccccagucuaaucaugagaaaagcaccagaccaaucccaguagagggucauccuacaaaauaccugaccagugcuucucaaaagugucacugucaucaaaaugaaggagagaugagagacugucacagccaaaaggugccuaaggagaccggaagaccaaugcgacaccugggaaacugugaccugccacgacgaaggggaccgugcagacaugacugcaucaaggcucucagauggggagagcguccuggaauaucuagguggguccaugcagauaugguuacaucaagguucugagaugggaagaguauccuggaauaccuagguaggccccagagaaucacaaaaguccuuaaagagagaagcgggaaguccuagccagagcaaucaggcaagagaaagaaaaacgaaaaaacaaaaacaaauuuuaaaacccuaaaaaaagaaaaauuaauuuuuaaaaagaggggcuggggcgugguggcucacgccuguaaucccagcacuuugggaggccgaggcagguggaucacaaggucaggagauugagaccauccugggcaacauggugaaaccccaucucuacuaaaaauauaaaaauuggccggacgugguggcacaugccuguaaucccagcuacucgggaggcugaggcaggagaaucacuugaaccagggagucagagguugcagugagcggagaucaugccauugcacuccagccuggcgacagagugagacuccgucucaaaaaaaaaaaaaagagggaagcaggagguuagaggcagagagaaauuggacagugcuacacugcuggcuuuaaagagggagaggccaagugcagugguucacgccuguaaucccagcacuuugggaggcugaggugggaggaucacuugcacccuggaguucaagaccagccugggcaacauagugagaccccugucucuacaaaaaaaacacaaaaauuagcaggguaugguggcacaugccuguagucccagcuacucaggaggcucaggugggaggaucgccuaagcccaggaggccaaggcugcagugaacuauagaucaugccacuguacuccagucuagauagcagagcgagacugugucucaacaacaacaacaacaacaacaaaacagggagggcuaggauuaaggucaugagcuaaggaaaguaggcagcuucuagaagcuguaaacggcaaggcacagguucuccccuggagccucuggaaggaacaaggccugcagauaccuugaucuuagccuuguuguguuccuuucagacuucagacucccaacacugcaagauaguuuuuaaaagugagccaugacauuuguggcaaaauugugacagcagcaaaaggaaaugaauacagcaacucacacucaguauggagcagcagggugggcuggcucaccacuugccccacacagacccccccacaacaggugucuagcagaaaaggcaguguggcgaggugguuaauagugcacacucaagcgucgcugccuggauuugaaucccaccugggccgcugugcaggcacgugcucacguggcaggcccgagcccuuccaccccacacaggcugcuggcaaugcuggcccggagcuggcgucugggagccuggauucgggaggccucccauugcucccuaacugacaaggauggcucacugugccugagcaaucuguacaaguaaugugguuuauacugaccaccagcuugccuucuaagggucuggaauuucaguaccugccaggcagaggguggccacaugaccagccccuaguaaaaacccugggcacucagucucucuagcgggcuucccugccagaugacaugucacguggguugucacaacuccuugcagcaagaauugggugacuccccugggagagggcucuggaaacuggcaccugcuuuccucuggacuuggccccguguggcuuuucccuuugcugauuugcuuugaauccuuuuaccguaauaaaucauagccacguguacaaccauaugcuucguccugaggcuucccagcaaaucgucgagccugcgguggccuugggaccccugacacagccacuuacgagcucugugaccuugggcgugcuacugagccugugucccuucuguauaagcgagauauuauaacguaacucuuccuaggacucuagggaggauucaaugcaguaauacauguaaagugcuucgaaaauuacccggcauauaaaagugcuuggcacauuuauuauuguuguuguuauaauuguuaaaucccagcaaagaaauggacacacaaauauucugucacuuugccaugcacagcaguagggaggggagauggaagucacugaggggcggugacgaaagucagcacaaaaggcucaaauaccacaaucagagaccgggcgcaguggcucacgccuguaaucccagcacuuugggaggcugaggcaggugaucaccugaggucaggaguuugagaccagccuggccaacacagugaaaccccgucucuacuaaaaauacaaaaauuugcugggcgugguggcgggcaccuguaaucccagcuacgcgggaggcugaggcaggagaaucgcuugaacccgaggcggagguugcagugagccgaaaucgcgccauuguacuccagccugggcgacaagagcaagauccaucuuaaaaaaaaaaaaaggcugaaaucccccaaucacaauuauuggaggucucucaggccccuuguuaaguaggguauugcacagugaaaugggcucacacuaucacccuacagaggacgaaacacgauggggagacaacagacgguaccauuuacuuuggcugcuuuucucugaaagacuuuguaagaaccaaugggaauuguauucaaguaacaugcaaccccacugccuuuaccuagcgagcaaggagcacagaagcuuccccgacaggucacgagacagcucugcuucccggcagcugugucucuagacuuuucccacggccaucccucguggcccuccacaucugcuguugagaccacuuuccuggagugccuuguucccaguccacagggaggucagcagcugugcggcccagagagguugggugaccgguccacaggucacuggcaggcacaauccagcugcccgcgugaacuguuuguuaagaaugugaauuaggcccagcgcagggcucaugccuauaaucccagcacucugggaggcggaucaccugaggucacaaguucgagaacagccuggccaacauggugaaauccugucuccacuaaaaauacaaaaauuagcuggguguacuagcgagcgccuguaaucccagcuacuugagaggcugaggcaggagaaucgcuggaacccgggaggcagagguugcagugagcugagaucaugccacugcacucuggccugggugacacggcaagacuucgucucaaaaaaaaaaaaaaaaaaaaaaaaagaaugugaauuaccucccaauaaguaaaaauugacagagcuccuguuaaaauucagauuuggaaguccuuuugaaaaaugcagaggauguggccacacugagcccgcauuuccauggggcuacagucagcuggugcugggaaggggcuguauccucggccccaggucgccucuucuaucuggucacccacuuggccccaguugcaucccaguuagcagcccaggugccacgcgguggaaccagagggaggacuugggcugcaaacgccucuuccaugccuggggcuguuuccccacccacaaauccaucaagaacaaauucccuaaguggccucaaaauauaaaaauaaaaugcaagggcgggaugaaggaagagagcucacaguuauuacucgcugccgugcucugacaaaguguuauucuuuccagccgagaggcauuugacaaagcugaauagaugcucacauuccugcaacccagggauuuuucuaagagaauuuuuuuuaacgaaacuauuucagauaugcuaagaaguacagacacugacauagcaacaaaucaguauaaucccucaccaaguucuagcaacguguaauguuauagcaagugcuggugcgcguggggaggaacuggaacccugcugcacugcugcuaagaauggggauggggccgggcgcggugcucacgccuguaaucccagcacuuugggagcccgaggcgggcggaucacgaggucaggagaucgagaccaaccuggcuaacauggugaaacccuguaucuacuaaaaauacaaaaaauuagccgggcacgguggcgggcgccuguagucccagcuacuugggaggcugaggcaggagaauggcgugaacccaggaggcggagcuugcagugagccgagaucgcgccacugcacuccagccugggcgacagagcgagacuccgucucaaaaaaaaaaaaaaaaaaaaaagaauggggauggggggcagaggcugugcaagucugacuguuccucaaacgguuaaacaaagaguuaacauaggacccagcgauuccaccccucgguacauaccuaaggaaaacgagaacagauguccacacugggacugacacaagaacauuuacagcugcauuaugcauaacggcccaggcguggaaacaacucaaacguccaucaaccgauaaauaaauguggucuauccagacaauggaauauuauccagccauaaaauauacugauccaugcuacgacauggaugaaccuugaaaacgugauccuaaaugaaagaagccagucgcaaaagaccacauaguguaugauuccauuuauaugaaaugcccagaauagguaaguccgcagagacaggaaguggaugaacgguugccuggggcugaggggacagggaagugaguguuaaugagugugggguuucuuuuggggaugaugaaaauguuccaaaauugauuguggugauagauacacaauucugugaauauacugcaaaucacugaauugugcauuuuauuagggggguuauuuuuuuuauuuugaauugugcauuuuaaaggggugaguuuuaugguacaugcauuauauuugcauaaagcuguuuuauuuuaaaaaucaaaaagaggaaaucagugcuugaaaaauucuuuuuuuuuuuuuuuuuugagacggagucuugcucugucgcccaggcuggagugcaguggcgcgaucucggcucacugcaagcuccgccucccggguucacgccauucuccugccucagcguuuccauuuucaaacauuugguuuugccaggcuuucauuucugccacucugucguguaggaaacagcuuggauugaagcucuggcuaauuggcagggagggggugaauguuaaaaaagaaaagugaaggccgggcacgguggcucacgccugcaaucccagcaugcugggaggcccagguggguggaucacuugaggccaggaguuugagaccagccugaccaacauggugaaaccccaucucuacuaaaaauaccaaauuagccgggcgugguggcacaugccuguaaucccagcuacucaggaggcugagucaggagaaucgcuugaaccugggaggcggagguuguggugagccaauaucccgcccuugcacuccagccugggcaacaagagcgagacuccaucucaaaaacaaaacaaaacaaaacaaaaaagagaaagaaaagugguguucuggggaaggaauaucaggaugcaggucaggaccuggcucaaaaccaagaccccucagggagaagaucagcagggacuggauuccacccccaauaggacccucuccccuccccaugcccugguuccugggguaugucacuggagucugggaccacuggagcacugagcaccuaaucucucaaugagcaaugcagccccagcucccaguccccacucacccaaugccugcgacagauuucauguagaggcucagcugcaguuucacagagcaguucauggggauucccgugaccugcggcaacaaacacagugaggagacuggccacccccaagcuccagggacaccgucaacccuccucucccuggucccagucaagagggugggcgucccagcuaacugcccaguggagcuugcuuguaucuuaccuaaaacaagccacaggcuggggggggucaacaguucuagaaaugcugggcaggugcacugggaucuccucuccugauucuaaccccuuauagggaaacaagugcuucccacacaguuauguucacagccucaaagagguuccuucuauaaagcaaggcugucucaggguggaaaauaccuaaucacuuucaccuguccuccuaagacagcguuucccaaagugcagaauggcaauuuguccaugcucccucucaaccuccacauucaauaaaacagacaaaagucccuucucaauucacucccaacuccuccugaucauuuugaagaguaggucucagccagguguuugcauggucuuuaauaccccucuaauacaccuacacaaaaucuccacuucuaacaauggugcugacagcuggccccagguucacuccugcugacagacaacaauauuuuacauagagccuaauauuuuuuuccuuguucauuuuuaugguugucuucuuuuuuuggagaauuuuguaauuuccuauuugagguaguaagaaaaagcuuccuuugugcagaaauuuauuuuuauuucuuuuugagacagagucuuacucagucaucuaggcuggagugcaggcaaccucugccuccugaguucaagcgauuguccugccucagccuccccaguagcugggacuacaggugugcgccagcacacucggcuaauuuuuguauuuuuaguaaagacaggguuucaccauguugaccaggcuggucucaaacuccuggcagcaagcgaacugcccaccuuggccucccaaagugggauuacaggcgugagccaccacacccagccuauuuaucauuauuauuuuuguagagacagaguuucacuauguugcccaggcuggcgucaaacuccuagccucaagugaucuuccugccucagccucccaaagcaguggaauuacagccaugagccacuauacccagcucuuuuuaacgagacuuuuuuuuuuaaguaaauaaccgaagugacacacaugugucaucaaaaacaacaggaaggugguuccagaaugaagucaggaaaugauaguggaaauaaaacuagauuugaggucagagaacugcaguugguucuucuuaacugagagucgcguccucaucuguaaaacagagagaacucucccgaccugacagaauuuuugcaagagcaaaaguaagguaugcaagauagccacacgcagggccauaaaugccuagguuauuaucacguacacuauagggaaaggauguuuucuucauuauggcccagcaugcugaggaccuuccaggccccuguggcaaagaagagcucauuaaaggccucacuuacgcccacgacuggggagugcuugcccucgagagccuggugggaugggcaugagaucacccgugaguagaacagaguucacgccacaggccugaagcugcucuccuuaggaauucugcuggcaucugggaacccagauuucaggaggguccccaccauccccuaacugaugagaguaguucacugggccgaaauuauuuguacaaacaauaugguucuugcucagcaccugcuuuccuucccagagccuagaauuuugguaccugccaggcagaggugcccacaugacuggccccuagcaaaacaccaugggcacugaauuucuaaugagcuucccugcuagacaacaucuccuacauguugucacaacucauugcuaaagacauuaagugcauccuguaggaacccccuggaagaggacucuggaagcuccagccuggccucccccgacuucacccaaggugcuuuuucccuuugcuaauuuugcuuugaauucugucauuacaauaagucuuagcugugauaccaccauaagcagcguccuguugagucccccguccccaugcccucccccaguuucaggagcagaaaaguggccacacggaagcagcuuccaacacacguucguuuuucaaggcuaaaggccaacaggcagcaagcugaucuccugaucccccuccccaacgugcccagcucaaaaaacaaagaaauaaaggccacuuccucuccccgucggccucaagcucaucuggagguagaauuggacgcagcagcuaaaguggcugcggcaaaacagcuguuugccucucucugggcucccaaacuuaaccccuucuuucuugaugugaggggaagaaagaaaauccgugcccugaaaggaaagcgaucacugagagcgcacaggagacuguguucaugguggaauucuccggaagccagcagagcaagagaggcuggaggaggaauuaacuaaaagagggaaggcagagaccagggcuggggccggggccgagagggccuagucagcggcuaaggaggccugggaggacaaagaaaaauggugcagaacagcauccgccauggagcuucgggaagggccuaaggugcacagcauuguggcaaacguguggagcuuccucagacaacgaaaaccagaacuaccaucggaucagugaucccacugccgggcauccccccagaggaaaugaaaucagugugucaaagggacaggggcacucccauguacgcuguggccaagauacggaaucaagcgaaguguccgucagugaaugaaugggcagcagaaacguggugcacacacagugggauacuguucagcguuuaaaaagagggaaauccagcugggcgcggcggcucacgccuggaaucccagcacuuugggaggccgagguggacggaucacuugaggccaggaguuccagaccagcuuggucaggauggugaaaucccgucuccacuaaaaauacaaaaauuagccaggugugguggugugugccuuuaaucccagcuacucuggaggccgaggcaggagaauugcuugaacccaggaggcagagguugcagggagccacgaucaugccacugcacuccagccugggugacgcagcaagacucugucucaaaaaauaaauaaauaaaaacagggaaauccuguuauuugugacaacaugacggaccuggggacacuaugcgaaguaaaauaggccaggcacaggaaagcaaacccugcaugaccucaccuguauguggaaucuaaaagaguugaauucaggccaggcguaguggcucacgccuauaaucccagcaaccugggaguccgaggcggguggaucaccugaggucacgaguucgagaccagcauggccaacguggcaaaacccugugucuacuaaaaauacaaaaauuagccgggugugguggugugugccuguaaucccagcuacuugagaggcugaggcagggagaauugcuugaacccgggaggcggagguugcagugagccgagaucgugccacugcacuccagccuggguaaccagagugaaacuccaucucagaaaaaaaaaagaaaaaaaguugaauucauggaagcagaggguagaauacuggcuaccaggggcagggauggggaaguccgucaaaggauacaaaauuucaguuagacagggggaguaaguuuaggagaccuacugggaaauagagcaacagucacuguauuguacuauacaauacaacacagugacuagagugaauagcaauguauuguaagcuugaaaguugcugacaguagauuuuaaauguucucagcaccaauacaucaucaguaugugagguaaugcauauguuaauuggcuugauuuagguauuccacaaguuauauacauacaucauaacaucauguuguacacucaaaaauagacagcuuuucuucuucaauuuagagaauuaauuuuggcugggcacggcgguucaugccuguaaucccgguacuuugggaggccaagacaggaggaucgcuugagcccaagaguucgagaccagacugggcaacauggcaaaaccgcgucucuacaaaaaauauaaaaauuagccaggcauggugguacaugucuguaguccuggcuacuuagggaggcugaggugggaggaucaccugaacccagggaggucgaagcugcagugagccaugaucaugccacugcaccccagccugggcaaccgagugagacccugucucaaaaauaauaauaauuuuguuaaaggcccaugggauagaccacaagugcccacccaggaaacagaaaaccacagauuucugaaucaaugguagcagccaccaagaccaacugggcauauuuuacagagaacggaggugccaagagaagaggccacaagcugaaggaguguccuugggagggccacauguccagcucccugcuuguagacagaacuucacacgggacaaauucccugugugauuuaucugcaaaauaccccaggcucuucuugguaccuaaagaucuuuaugguaucuugacacauccagagggcugccuccagcucacauguaggagacaucccagcugauaaguucuaauuaauuuacugucuuagagcccauuuauagaaaccaguacagggaucauaaaacccuugaacuaccuugaacuauggagucggggugaaguaaggaacuuugguggcucgagauucuagaagccaggcuucccaccaccccagcccacagcagcucucugccuggggagagaggaggcagccaggugugcuccaaccaggaaucacccaccccccacagaggauggcaggggcucaccggguggauguccaggaacaaggagugugccuccugguuagggugcaggccagucaccgcuucugccagaaccgggucagcguugaggaagugaggaugggagagaaacaagggggcaccuagaagaggggcagggaggggacaucagacaaggacaguauauuggcagguccugccaggccggaggucugcacagagcuguggucugcagggcacccccguggcgaugacaagauaaccagacagagaggaucccuuccuccauucuguaaaaagccccaggcccugugaugagggacaagcucugcgccagagaaggggugaggcaggagccgcugauucugacaggagagaccaaaagaaggaagaggccucuucacaggagccaggugaaggaugcccgggaagcgcauuccagguggaagggaaggcagaagcaagcguggggagggggaaaugcauggugcacaagggugcuagggaggcacggauggaaaaggcaacgccagauuugaacuuggguguggggaggggagucucaagcgcaagccaagcagcccacacuguccccugcaggacacgcagcaaugaucggagcucaggugugugcaccuguggccagaucucccugcauccacaggagugugucccuguagacacaccugcuacaaaugugagcucaaccucgccacugaccaaccaaaccaggcaaacaccagcucacccucgggacaauggacaacaggccugaaggacaaguuaacaaggaacagcgagcgggccucucucaaaagcucacgagggccaggcgccauggcuuacaccuguaaucccaacacuuugggaggccucagcaggcagaugacuugcacccaggaauuggagaccaggcuggacaauauggcaagauccuaucucuacaaaaauuagccgggcaugguggcaccugcauguaguuccagcuacucaggaggcugaggcaggaaaaucgcuugagccucagagguugaggcuacagugagccgugaccgugccacugcacuccagccuggguaacagagcaagauccugucucaaaagaaaaacaauuuuuuuuuaaaaagcucacaaggauccagacagugcuaauccacagacagagccaacggguggugaccaggggcugggggagggggcggggagugacuucugaugagucugggucuccuuuuggggugacagaaauguucuggaacgagauacaagugauggcugcacaaccuugugacccugcuaaaugccacugaaucauucacuuuaaaaugguuaauuuuauguuacaagaauuuugccucaguaaggaaaacaaaacaaaacaaaacaaaaacuugaaucagaggccaggcacgguggcucaugccuguaaucccaacucuuugggaggccaaggcggguggaucacuugaggucagaaguucaagaccagccugggcaacauggugagaccccgucucuacuaaaaauacaaaaauuagcugagcaugguaugugccuguaaucccagcuacucgggaggcugaggcaggagaauugcuugaaccugggcggcagagguugcggaggcugcagggagcugaaaucgcaucacugcacuccagccuggacaauaguuuucggagguugcaguaagccaagauugcaccaaugcacuccagccucggcaaaagagcaagacugugucucaaaaaaaauaaaauaaaauaaagggccgggcgcgguggcucacgccuguaaucccagcacuuuaggaggccgaggcggguggaccaguugagguugggaguucacgaccagccugaccgauauggagaaaccccgucucuacuaaaaauacaaaauuagccgggccugguggugcacaccuguaaucccagcuacucaggaggcugaggcaggagaaucgcuugaacccaagaggcagaaguuguggugagccaagauugcaccauugcacuccagccuuggcaacagagcaagacugugucucaaaaaaaaaaaaaaaagacauaguuaaaaaauaccguggaaaauaaugauguuguaaguucuaacuagaaccuguuacugcaugaggcuuuaacugggagcccugcucuuuuucuguuaaaagaaaaaacaaaacaaaaaaggcugaugaguguggaaggcucuucaaguccucucaacaccaagagaccuucuccugcaggugauggcaaggaggaaaagagcauggacccagaagcucacucucaccuccuuggaccuucugaagccaucccaagcacccgcagggacaguguccuccacaaucuggaaaacgcugccucucgugccuccuccguggaggaggcagccacggagccgaacucuggaggaaucucaaacaagcccuggccugcccacagccccagguggagaccgaggugggauggaacaacuugccagcccccgcccuugcuucagaggccgagccugcauggacccacgcacguguuucuuccaauguuauuaccaagcacgccgagagagaucuucccagcuguaagugguaauuaauuuguagcuuuauggcauaucuagccagacauaauugcccaggauugccaccgaugauaauuaguuggcucugugaggcaagucggaugcccucacgcaacagggagguuugagaugagggaguugucugaguccaacagauuucaaggcccagaaaggcaaaggcaugguaccuuuacucuuuagauaacaugccacagaaacacagacauaggugcaccaaacgacacgugugcaccacggucacggucgaaaaacaggaacuuggaugccuaggagcaauggaaggagaagauggagguggcacccacgauggaacaccacacagcaacggagaggaggggcugcuaccacccacaacgucacggacgaauugcaccagggugcuaaggggugcacggaccagaaaaggaggaaaaggagucuagcauuauggguccauucacaugaagaugcaaaccagcugagcuccggggcuggaugucagggcggugggaggaccgcgaguggcauccagggccuguccugucuguuucucagucagggugcuggccacggggugcguugacuuugugaaguuucaaacugcaggugucagccaggcgcagcgguucaugccuguaaucccagcacuuugggcgggaggaucacuugagcccaggacuucaagacuagccugggcaauauggugagaccccgucucuuaaaaaaaauuuaagaauuagcugggcaugguagcaaccgcuuguagucccagcuacucaggaggcugggguaagaggaucaauugagugauggaggucagacugcugugagccaugauggcaccacugcacuccagccugggcgacagugauacccugucucaaaaaacaaagcaaaaaaccccaaaaacugcaugagucaucugggaacuucuuuguaucuauguauauuuuauuuagaagcaaaaacuaagcccgggcaagacggcacaaccccaccucuacaaaaaaaaaaaaaaaaaaaaaaaaaauugaaauaagauaaaauaaauuagccagguauggugguguguaccugugcucccagcuaccugggaggcugaggugggagaaucauuugugcccaggaggucaaggcugcugugagcugugauugcaccacugcacuugagccugggcaacagagaaacccugucucaaaaauauaaauaaauauaagaaaaaacucuauuuaaauaaagauuuuaaaauuccuuugcgcuuuugaaauucuuuuggcagaugugcuaagagaaggcgggacacaccucgucccacgcccuuggaggggaugggcaugucguuucucccccuucuccugguaccuacacccccacuuuaagccuucccuacuuucagccuugugcuuggaguggggccggcccacccaggagccaucugagcaugugacacaagccuggccaaucagcauaguccaccucggcuacugugauugguuuacagcugggcaugggagccaggcagaccaauuagagcaaacccuggaacuucugcuggagugaaggaaacacagguggcccccuuucugcaggacucggagcugggcggaggugagccuggagccuccacaggcagccaggagggagagccugcuuggcagcaaagccaguccagcagaaaacugagcugggacuuggcagaggcagcuuccagacaacaucuaaguucuggauuugugccuaaugcagagaucugcccuggaauuuuucauuacgcaaaccaagaagugcccuuuuggccuaaaucagguggaguccagcaucugccacuugcgacaguugcuguagcacaccuauuggguguguaacauccucaaccuuaggagcagaaauccccgccgauaccagcaaagaaugaagcaagcagaggccaaugcccagacgggccagacaggaccaggagacagcagcgggcgucccaggccccagcuccaaaccauucauucacagguuguuccauucugccugaaauaggggaaagcauccaaucuguugacagccccuccuccugaccccuguugcagaccaguccuuuagagucgccauugccagcuggaggacggggcuucaaccaaaaaggcucccagaaggcaagacacagucaaauagagggccgcuuccgguccuaccaacccugugaccuuggucgcauccagcaucaggccucaauuuccuaaguacagaacgcacucaccaucccuauauucaaauacuguaugaguacccauuacaugcggggcacaguucuagaagcuaagaauaaaaccaacaagaggagcuuggggcccugccuacagggaugacagugaauggaaggggcaaugaauaaaauccacaguccaugaguucagggagcaaugagcaccaagacaagaagaggaagacaagaagaccaagacaagaagacaagaagaggaagccauagggagcagcaggugggagagggggcaacuuuagaacaggaaaucagaggaggccucccggaggagguggcauuugcaugcaggccaaaagaaggugagggaugauccacucagaaauccagacaaagagcucuccaagcaggggaagcaacccaugcaaaccacagugcaaggcacugaccuugguauacuuuagaaaaagggcgaaggcaucagggcuggagaauaaugaacaggggacguguagggagaaauggagucagagaggcugguggggcuggauccuucagagaggccgguaggggcuggauccugcagggcccagggccauggugggaguuuggacuucacuaugaaugcagacagagcugccagacauuuuaagaggacggcggccaucugcauauuuuucgagaugggucuuccucuguugcccaggcuggagugcaguggggugaucacagcucacugcagccuugaccucugggcuuaggccauccuuccaccccagcuuuccacguagcuaggacuacaggcaugcaccaccaugccuagcuaauuuuuuuuuuuuuuuuuuuuuuuuggccagagagaggucuugcuauauugcccaggcuggucucgaacucuuggccugaagugauccucccaccucggccuccuacaggguugugauuacaggcgugaaccaccacacucggccugcauuguuaaaagaucccuccgcugcugucgggagugcuacagaacuuccuaugaugauggaaauguucucuaucugugcuauccaagacaguagcugcuagacacacauggcuuaugagcauuuaacuuccggccggugcaaccaaggaacugccuuuuaauuugauuucguuuaaaucaauuucaauuuaaacagccgcaagaggccagcagugaccgcacuggauggucuaggggauggaugguaaggcggcaacacugcauugagggaugggcuacugaaagggcuggaucaccaggaaggacguguccguggccuggacaaugaggcggggguugggguggggagcaagagagaggaaggagugaggacucaaccuggagguaaagccaucugggcuuguugacgcacuggaagagcugggugaggacagggaaacaaacugacgcccgaggguccaaacugagcaacuugaggugggggugucucagggacuggcacacaauugagacacaccaacaaugucaggggaccgacgccaacagcagucaucacaucugccuagccacccacacugcggaacgagaagauguuacguaacacacagacccucgccagccucauuucaugucauuuaggacacguacaugcccuaagccccagaacccaugacuaugucaggucacaggguaaacgggcgcugggccugcucagcagcugccuugaagguccagaaauugggccgggcacaguggcucacaccuguaaucccauugcuuuaacacgcagaggcagguggaucacuugaggccagguguuugagaccagccugggcaacauggugaaacaacaucucuauaaaaacuuuacaaaaauaaaauuagcuagguaucauggcccacaccugcggucccagcuacucaggaggcugaggcaggaagaucgcuugagcccaugaggucgaggcugcagugagcuauaaucgcaccacuauacuccagcuccaggcuacagagugauaccuugucucaaaauauaaaaauaggcugggcgcgguggcucacaccuauaaucccagcacuuugggaggccgaggcaggcagaucacuugaggucaggaguucaagaccagccugggcaacauggugaaacccccaucucuaccaaaaauacaaaaaauuagccaggugugguggugcacgccuguggucccaacuacucgggaggcugaggugggaggaucacuugaaccugggaggcggagguugcagugagcugaaauggcgccacugcacuccaaccuggguaacagagugagagucugucucaaaaaaaauaauaauaaacaagauggggagauuguccugggguauccaggagagcacgauguggucuuaaggguccuuagaacuggaagagggggcagaagagggaggagaggaagagauaugaggacagaguggaucagaaggaugccauguugcuggccucaaagguggaggaagggcccgggagccaagaaacacagaggggccucuggaagccagaaaaggcagacgcagcuucuccuagagccuccagaaggaacacagccgccuuguucugagcgcggugagacccacgcagacuucugacuacagaacugcaagauaaccaguguguguuguucuaagcccugaaguucauggcaauauauugugacagcaacuaauagaccuggcauuucuuccuuuucagauuaucuuccugcggccucauuaucuucgccuaaugggauuaucaagaguacagaggccagagauuaagcagacagcacugggcagauaaacccucagcuggccccacccucacacccucccgccaucccagcacaggggacggcacguacugaaccugcaggugcugacguucugaauuccagacuccaggcacgggcagaagccuucguuggguggguagauggacccguuggcaaacaggguuuugggagccacgaagcgauagguggggaugccuucaaacaccccugacuccuuguacauuagcuucauggaucugcaggggacagacaggaugagaggggacacccagacccggcggccagagccaggcccugccaaaggcugcccagauccagccacuucuccccacgggcgcuaccaccucccggguccaaaccgcccccaucucucacccgcggagcugcagcgaccuccuaacaggccucuccgcuccgacucugccuccccacccacaucaauguauuagccguggccagauggaguuuuacaaaagaacagaggccaggcauuauggcucacaccuguaaucccagcacuuugggaggccgaggugggaggaucacuugagcccaggagugugagaccagccuggggaacauagugagacccagucucuaaaaauaaaauuguuuuugaaaguuaugaaauuaaaaaaagaacagaauauaucaugccccugcugaaaaucugugacccuuucuagucuaaccuaccauuaggauucauugaccuuaucuagccccugcauaagcucugcucagcccugccccaacuuccugugcccagggccucccugcaguuccuaagcacacucacuccugccccaggcccuuugcaucacugcucccucugccuaagaacagucuccucuggcaucuucauccaccagacuucagcccuucagucagaucucaguucagcugucacuuccucggguggcagcaccgucccccacacccaccccauccacccuccauccauucaugcuccuguacuuucucaaaagcacuucugaacuugaacaugcacugugcuacccacucuguccacggcagccacucagcacgcauggcuguccaucccgcccuugacauggggugaguccaaauugggaugcaaguauaaaauacauuccagauuucuaauacuugcuagcaaaaaaaacaaaaaaaaaaccucaucaauaacacuugaaaugaucccauuuuugauauaugaggucaaauaaaauacauuauuaaaaauaauuucaccaauuucuuguuacuuguauuaaugcagccacuaaaaaauuuuaaauugcaugugugccuugcauauuuugauuuauaggaaagugccagcuuagauaacaguauuaugucaaugccaaauuuucucauuuugauaacagcauuaugguuauguaagaaaauguccucguuucugaaaaacacccacugaguauuuggagguaagggggcauacagccuccaaccuacucuccgaugguucuggaaaaagacacucggcgagaagaggggguggggggcuuaacacggcuagugaaccugggugaaggggagacgggggccacuuguauuucucaugcaacuuuucuuuaaguuuaaaauucagcuuuuaaagucagcuggguacaguagcucacaccugcaaucccagcacuuugggaggcugaagcaggaagaucccuugaggcuaggaguucaagacuagccugggcaacauagcgagauccccaucucuaaaaaauuaaauaaauaaauaaguaaaaacuuaaaauaguaaaaaguggccacacagagcaaaagcacugucacucucugacacucuaguguuugugcauuugccugaguugcccugauaggacacagccuccuggggaacggagacuuggcccacccucucacuaccgggcaccuggcacacaguagggcuucacaggguuugcugggagggcagauaagucaagguccacaugagugaauuccuaaguaaaggacuuuuccagagugaccagaauggaacacgacacagcaaggccuccagaaaagggcuguaggagccacccacugucuacucuuaccccacaacugggaccaugggacacagagcugagccugaaggggccaagcagagccagcugaugucucagcacccagauggucaugggggccaccagccagacgccagagggagcccaccucucgccuccauuuuauggcccccugugacuugacauguccugcccccuccucccagcccagcaccaccuggcugcaaaccaccaccagcagccucucuuugggcuguguagaggcauuggcagcuggaguuuggcuuuugguggugugaccaaagagaauucaagcuggugccaagggcuacugagucaaauccacgaugagucaaaaugcuuuccaagugcacagccaacaccacagaauuuggccaugagcuacccaggaaacccaggaggccccgagucccagugauuaccggcaggccuccgggcuguagaacuccagcgaggacucaggagucaugaagggcggccacauuugcccagaaguuccauugaucauguugcacugaucggaaugccagaagucaaccuggggggaagcauccagacuagaccccucaguagggccaaggccccuuaauaagcccucucaggugcugcacaccuaacucacccuggugcacgcacggccacucaauucccaauacuggcacggugggaagagggcaggcuauguagacacacagagagaaugccuaccacagcuucccccucccagaccccugaauguguaacuucgcuagggacucaguucuuucaucugcaaaauaggccuaucacccacauuuccagccugaaucuggaaaagaaguguggugagcaggugaggugagagguggggcgcggcugugcucagcccucagagcggaagucaacaggcaccuccugaaaacaaucggcacacaggcaaacuacuuaaaaucauaaugguggccaccaccgggcaaccccaaaacagaaccugucagguuaacugacucuggggagcgagacccagacucgacaaaaccaacugcucacuuuccaaucuucuguaugaugaggauguuuaaaaucacgugcacauguacaguauauuggaauauacaagccacaaugaaugugaacuccaucuaucgugaauggcuacugccaguugcagauggugauuuuugccacucugggcaccgguugggguacgauuugucccuagcccucagggucuuugcaguaacuaccacggggaguggggagugggaagucacacagucauuuucacacauauugagaaaaggucacgaaggugaaaaaagccaguugcaaaacaaugcacguaguaugauuucaugauguucaaagaagaaacaauuccguauuucucugcguacauauaggugugcacauggguaaaaauggaugggaagaauauaucccaaacugauaauuguggguuuccucuggggcaagggguaggggugggaggugauacuaagggcacuuaucucccucucuuguuuuauuuuguaaugugaaucucuucucuuuuuuuuggagaccgaguuucacucuucucacccaggcugaagugaaauugcgugaucucagcucacugcaaccuucaccuccuguguucaagcgauucuccugccucagcucaugaguagcugggauuacaggcaugcaacaccacacccagcuaauuuuuuguauuuuaguagagacaggguuuugccauguuggccuggcuggucucgaacuccugaccucaggugaucccccccaccucggccucccaaagugcugggauuacaggcaugaacuaccacgcccggccuucaaaacauuuuuguaaguaaagaaucgaaaggaagaaagcacucaguucccagcagaugccaggugcucaguaagcucaguaagcaaucacuaaccccaccugccccucuggguggucaagcuuuaaccagagguaaaaucccuccuccaacuucaagaguguucauccucccagcacccucuucacgacaaaggaagaaggagcucucuggucccugccacucccgagcagccauggccgggcccacccuccccucucccuggcgacaggggcccucgccucucgccccucaccuugcucagcccguuccacuuguccacgagguggauccugcugauguucuggacccccgugaacaccgugaagagcccagagucggaguuguugagcuacagacacagcagggaacagcaucguaaggcuuaggccugccauugagccggccuggucugaacauucugggcugagcccuccucccccuccaccagaaggacagggcccccagcaucugguucacugccaaaugcccagugucuggggaccgagaggaggcuugggagcuuucuaggaggaauggucccggguucuguggcugcaguguuccacccucccuuccuaacuccaggagagucuggcuuuccucccagguaaauggcagaucacccccaccacacccuacuccagcauaaaauaaagcauggccaggucagcucccugagcaaugaaaaaggagaaguggcaugucacuuggggggaugcuuuaaggacugugcacacgccuuucaccgggcucucugccgcugcuauagcagccaaggagguaugugucaagacagagccucccucagccuggauccccaagugaccaccacaagcgcgggugccccagucacccacacuggacguggagugcaagcaaaggaauaagucuugguuguucuaagccauggagauuccggggcugcuugucacagcagcaaaaccuggccuguccuaacccaucgagguucuugauaguggggcccaggcuuuggugcuccgagagcauuucccagaagcugguuucuaaucccaaagacaugcaaagcacaaagugguaugagugacugaaggaaauaucuagaagugcuuugcaggguggagcacacugaggagcuccaagguugcccggcugagugacugcacccaucacagaccuccagagcaggacccagcacaaggccccagcccagcaucccgggugugucugucacgugcccauguggagccaagaauaaccagagccacuacaaaggggagcauuaaagggacucaugugcaaaaacggccagguacagugcaccggacacaguaagagcucaaaaugauagucuuuauuuucauuauuauuguuauuauuaauaaaugcucacccaauaggauacuuaaaugaucauuauaauggacggagagcaucagaaacugccaguuacuacccaaagcccaaucucuccuuacucuuucauacaaaacccaaaccauacucagagcaucagcacacccagcuaaaaggcuaccuuuccagcuuccccuggagcuagguguggccaugugacucaguucuggccaauagaaaggaaguggacauugguuuucuuccucccuaagagggaggaaacuggaacacgcuguuuuacccccaguuccuccaucugcuccccaaagccccaccauuuuuuccuucuugcugugcugccuggaaugugaugugauugcugacacucuagcagccaacuuggacaaugagguuaucuugaggaugaaaaccacaugccaaggauggcagagcacaguaguagaaggcuuccagaucacuuaagaccaugaagccaccacaccaacacugaacagccuaccgcuagacuuuucuugugagguuuucauuauaugcagucaaacguagauuauacuaaacuagggacuuuguaauaacuuucauuugcaaagcacuucaggauuuacaagaugccuuuacagcaucaugccacuuagcccaaacuugcucauuuacccacacgacaggagcccgucacccuugacaaaaacguacugaguaucuaucacacgcagcaccacgauaucccccccagcacucuacccugaucagcagagaccaaagagauggcugaggcuggagcagucccaaggacucagugaaaccugcggugagggagccaaggucagggucagacccuccauggacgagauguuggcuccgaagcccagucagugacccuaccagguugccaagagucaagauuaagagucagcuugugauauuacuccccagcagccaugcccccuuccuccagcaaagccuccaauuugcuaagcuaaggcccagucacaucauuugagccuggaucaagcuguaccugaauccaacccuagcauuuucaguucuaugagccccaacauuccccauuucacucaagccgguuugagucagguucucagucacuuacaacccacagccacuagauccccagccagcuacaaagcaagcuggugaccaguguccaggcugugugaggggaagacaggacacaggccugaaucuuuggcuucucaccaggccacacguaccucagcaaauaauccgaacuuguccuugaaggggaacaugccuggaaaguacuuguugaugagauucacaaggggguccuuguagccccacaugaucucacccacagugcgguucaugaaggcacguucgccgaggguggugaaugccaaggucaugaugagcuucagggucaugggcuuauucuccaucaucaccgccgcacccugcaaggcgaagggacacuagugucagaggcuggacguggcuggcccauccucccuuggccccagcugggccucacagcaaagagcccaugaagggaaaugcuggggugcaggaggccccuggaguggccacguggggcaucugggacaccagaaccacccucugcuccuccagugccaaggccacaugugcucccgagaaccccuucucccccuugcaccccacuggacucaggcuaagugaacuccagccccagucccagaggcgggccuguggcucagcccucaacaagacagccccuuuuggagaucucagaaauguaaauugaaaagggaaaaaaaaguacuuuggccaggacuuccaaaccaagacagguggacccaccugggaaacucagaacccacugggggugguggagacagcacagggccgaaagccacccaccaggcgugaguccccacgcuccgaccaccucagggacugcucucugcacaaggggcaggcgggaggagagacaggggacgaggucagggugcgaggcggcgugggccacagggcagccucaccaagaccaggauguugggcaugacgauguagucgcucuccgagccgugggacuuggagggcuggaacuggaaggugcgguacucgaggaaggacacggugucguuguuguugaaggugauguugcuuuugugccugaacucccugugggggaagccagugggucagacgccccgccccgcugcaugggacguuucccuucuacucgccugcaaugccugccugggaaccaggggcccuggacgucugugcacaccuccggccccacagccaaagcugagcucggccccuucgccaagucugucccucccgccgccugcccacugcaggacauggugucgccgcccacccggccucguucugcucucccccacccaacacggccaucgucucuccaucuacaaaaggaaguaaucacaagcccuacuucacagggcagcuguggggauuaagcaaucagauacccagaaagcaaucaacacagccgccgggugcagagaaagcacgagguaaacaucagcugcugugacuguugcugcugcuguccuuaugaucucucaucucuccaagccacucuccaccauccagaagaaucuuugaaaaguggaaaucaggucgggagcaguggcucaugccuguaaacccagcacuuugggaggcugaggugggcagaucaccugaugucaggaguucaagaccauccugcccaacauggcgaaaccacgucucuacuaaaaauacaaaaauuagcugggcaugguggcagaugccuguaaucccagcuacucgggaggcugaggcaggagaaucgcuugaaccuggggggcggacguugcagugagccgagaucgcgccaccgcacuccaaccugggugaaagagagacuccgucucaaaaaaaaaaguagaaaucagaucgugccaugcucuggaccacaaccccacuuugcaugcagguuaaaaucaggcuccuaacgugaccucugaggcccucagcaaggcucaggccucgucucuccacugucucccucccucguaaccccagccgcacaggccucugucccagccuucagaccuuugcacaugcucugcccgggacucugucuccccagggccucuucccaccaugcggguccagugagugucccuuugcagaugugcucccgacccuccagucagaccgagccccaaggccacccucccuccugcacuccggcuucacacuguuuugucugcacaauacugauggcugccugauuuccccuuauuuguccacuucuuuacucucuccccaucagaacaucagcuuggugaggcagggccuuggucugccugcgcccccagcacacaggaggugcucagucagugcucacagaaugaaggaguauagagagcuuuggcauuuuugcccauucuguccacugcuggguccccuguacuuagaacggcagccaacaccuagcaggugcucaguaaacauuuguuaaaugaacgagcgaaugagugaaugagugaacggaaugcagcagcugauucauguuucccauucccaaaccucaggcacauuugcuggguuuucaucuuggcuuucccagaaccagacugugggucuccaacagcgggaacacccucugcccgccccaucccuggaacaccgugugccgggggcaagucagcuccccugucugugaacugggaaguggggguguggaggaggggaggugcugugaaaacgccaggagguaagggaguuguaacaggcacauccgccagccgucucagagcuccgagugcauccugagugucccggugaccccaugaaggggcucuugugucucuccagucugcagacgggcaaacugaggcucagaggaaugaagucacuuccccuaggccacagccagguacaggacaagcagaaagcaaaggcacaacucugugguccuugggccagcauguuccacaaacagcugaccccuucccgugcugacccacccgguccucuggcccagauagggucuggggggucggucccugcuccuggucaugcauguguguguguguguguguguguguguguauguguguaugcauguguagguacauguguguguauguauguguguguguauguguauguacguguguauguauguauguguguauguguauguguauguguguguauguauguguguaacucacacaugcacccuccacccagacgcacaccauuggucccucccugcuccauaaagaaccucucuaggcaacgucuggugauucgcaccuguaaucccagcacuuugagaggcugaggcggaggaucgcuugagcccaggacuucaaaaccagccugggcaacauagcaagaucccaucucuaaaaaaaaaaaaaaaaaaaaaaaaaacccuaaaacaaaaacuucucugggacuagcacuuaccccgacuaugacuugccugcuuccggaacaaucucuggggcucagucagcagccuccccaucccguccacucugagaccccuccccugcccagccucagccggccccuccacccucaccuggacacagccucaccuguacacguagggcccgcgcucccgcaccugcggcuucucgcccuucaggaucucgcugggguucaugacgucaaagaaguagacggagagauagaaggggauagggaucuccuuccacauguugaaggacaggcuacuggggucgaugcgcacguucugcaggggaagggacaaguacgcuugugaggagagugaugagggccccacgccccaccacaaggcuccggaacagcugcccgagcccggccagggaaggggcuccucggcgggagcuugggauaggagguggugggaaagcccuucgcacaugaggcugucgcaccuggagcuuauggaauuaaacaggcaaccuauccaugcugucauaaugcaucuuaaaauauguccuaacagcaacaggugacaccagucaagggacugugguaaacaggggcccaugcaccaccuaaagggagcgccggagcucaggguagcggaugggcucagggcagggauagccucaugcaggaacaugggcuccguguggccagggggaucauucauucauuccacaagcaagcacugagcacuaccaccugccaggcggguucuaagagcuggggaugggagaaugaccaggacagaccaaaagcccagcuauguggggcuuuaccauagcggaggaaaggcaggcaccaaacaacucagguaaaacgcaugccacgugacagagcacagagaaaacacagcagggauuggggagagacugggauuugagacagucaucacguaagugaaauauaggccaggcaccauggcucaugccuguaaucccagaacuuugggaggccgagguaggaggaucaccagagcccaagaguuugagaccagccugggcaacauagcaagacccugucucuauaaagaauaauuuuauuuauuuauuuauuuuuugagauggagucucacucuguugcccaggcuggagugcaguggcaugaucuuggcuaacugcaaccucugcuucuguguucaagcgauucuccugccuuagccuccugaguagcugggacuacaggcccccaccaucacgccuggcuaauuuuuguauuuuuauuuuauuuuauuuuuuugagagggagucuugcucuguggcccagguuggacugcaguggcgcgaucucggcucaccgaaaccuccauauuccggguucaagcaguucuccucccucagccucccgaguagcugggacuacaggcacccaccaccauaccugguuaauuuuuguuuuaguuuuuguuuuuguuuuaguagaagugggguuucaccacguuggccaggcuggucuccugaccucaagugauccgucugccuuggccucccaaagugccaggauuacaggcaugagccacugugccuggccuauaaaaaauaauuuuuuaaaaaguagcugggcauggugcugcacaccuguagucccagcuacuugggaggcugagaugggagggucacuugagccaaggaggucgaggcugcagugagcuguaauggcgccauuuguacuccagccuggguguccaagcaacacccugucucauaaaaaaaaaaaaaagaaaagaaagaaagaaaaagaacacacacaaacacaaccuagacccaaaaucaaaacagaaggcagugaggaagggagcucacaaaucuagaaggugaggcgcaggggacauuccacagcaaccacagccugugcaaaggcccugugguagggagacgcugggagagagccucccuguguggcugagugagccagucggaagaugagaacacagaaguuuuccaugaaaaccagaaauaaagaaauguauaugaaaucuccugauuuaaaaauguugcaaaaacaugguuuucuuaaagggacuauaggaaacacgccugggguccacuuggacuccucugccagcuuuccuccucuagaucuauaauucgcugccccagugucacagggagguccccccuaguccaccugacccccacccucaacccagccgggacauaucucgggccccucagugcccacaccacgucagagcccggcaggagugacccagcccauuagacuagagcugaugucgcaaagccaggcagcugcgucaccuuccacccucuuuugaacauggccuucuaagacaaggacagccagaaccaacaggcagaggcucuacaggaggcagacagcugagcuggccagucagggccagccccaugucccccggaaggagcagauuuggaggcagccagacccugggucgcacuccacggggccacuugggcaagucagccccugugaaccucaaguuucucaucuguacgaaggagcuagugacacuguagcuacaacugugucuaguuugaccuacguggcgugucaaugaagaagcugaauucuuugucaagaaacuggaagauguaauguaaaaucuggauuucagaguucucuuggaaaaaucaggagaucagagacuggccuucaagugccauaauuguuuauugauaaacgugucuuccuacccagcugccagcaccagaaggaucaccuuauggucugagcagcccauaggugcaaacgaaggcgcauaaacugaauauuaaugagguaacagaagcgagcauuuccggggugcgccaugagccuggugaugcuguucacuguguucucauccucugaacagcaccauuacucuuugaggcagccaccuccacuauuauuacccccauguuacagauuaggaaacugaggcacaacuaaggcuggagagagauucaaccaauaguuggagggcacugaggaguccgggaggucuuccugggggaggugguaugugagcuggaucaaagagcaguccugcccccucgguaacgcccuccccaccccauggcggcucccaccaccccaugcgaccacagcccacaggcaccagcuccagccccucccagcucucaggccccgaucgcccagcccuuccuucaguccuggccuucacccagccucaaagcccaugcacugcaggucccucugucugggacagacccugcagcccuggggacccugcucaccacaggccagaccccuucaccagccugggggacacauccagcugcuggugcuccccccauagaaaacacagcaucaaaacccagaacccuggaaaauguguucggggaguagagcacgaacuauauguucucaccacagaaaacaguggggggcaggagggaaccguagaggugacagguauguucagcaccuggaucucaggggcggguuucccggugugcacacaccagcccaucaaacugcauauauuaaauaugugccauuguuuuauaucaaucacaccuuaauaaagcugcuuuuuuaaaaaagcaaaacaaggcccagugcgguggcucacaccuguaaucccagcacuuugaggggccgaggcaggcagaucacuugagcacaggaguucaagaccagccugagcauggagacuccaucucuacaaaaaauagaaaaaucagccauccgugguggcaggugccuauagucccagccgcuugggaggcugaggugggaggaugacuugagcccaggaagcagagguugcagcaaucugugaucacaccacugcacuccagccugggcaacagaacgagacuccaucucacacacacacacacacacacacgcacacacacgcgcacacacacacacgcagccucaauuucccuuugcagccucccucucccaccugguuucucagcagaggcugcugggcuggagauaccuuucuccuuuggaaucucaccaugcuuuccuccuccccuggccgcuuggccugguucugaagaugaaucagggcuaaaccaagaagucaugggauccggccgcguguccaugucucaaucucucucucucucucucucuccccaaagaagaggcuuucaggcccuggguuucagcccauucauucagcacugcccaaagggaaucuucagagacccagcgcagcccuguccaacugggugaucagggaugggucacugaccuucuccgagucucaguuuccucaaccauacaaugggcguaaggagagugucgccucaugggcugcugugagguuugaaugaguccauggagguaaagugcuuagaacaaggucugaagaccccgggcaccagagggucagcccugcagucauuaagugacccuuccuccucugccccaccuccacccggguuaagggauggacuuugcccugcuuuugaucagcaggaugacuuuuuuccaccacacuagaccaggcagcugauuagauaacagugguggggacacuguggccuuuugccuaacauggcugauucuaugauucuguccccaccacccccaaggucaaagaccauggcccuggaacacagaguugggauagaaugccaaggugagcccuuguuggacgccacucccucccaucuggcgaaauagacccuuugagcccaggaaggcugccuggaggaggggacaucugagcugggaauuuuaaaauaagcugggcuuugcuaggaaaagaagaugguggaggagugccuggcagaggacacagccugugcaaaggcugggaagccuuuaagagcgugacuugccugaauguucaccaaaaacaaauauggaaugauauauccauauuugauaguuggaaacaacucaaauauccaucaacagauaaaugaauugccacauauccacacaauggaaugcuaccuggcaaucaaaaagaaccaaccauggaugaacaccacaacacaggugagccucagaagcacuaccccaagcaaaaaaaagaaaagaagaaucauacuacacaacaccauuuccgcgacaucggggaaagggaauacucuagagagagaagccagaccaguggcugccggggaccgggauggagggaggggacuaacgugaacuggcccagcuaucuugauuuugguugccauauaggugaaguguauacaucugaugcaacucaucaaauuaggccaggcaugguggcucacgccuguaauccaaggacuuugggaggccaagccaggagaauuucuugaagccaggaguucaagaccagccugggcaacauggugaaaccgugucucuacuaaaaauacaaaaaauauuagccgggcaugguggcgcacaccuguggucccagcuacucaggagacugagcugggaggaucacuugagcccaggaguucaaggcugcagugagccgugaucaugugccugcacuccagucugggccacaaagcaagacccugucugaaaaaaacaacagcaacaccaccacccaugacaugcuauauuuaccgcuauggaacaaucuccagaauauuuuaaguaaaaaaaaauuuaaaaaugaauacuauuacuaccuuuaaaauauaaugcaaucauguugaucaaaaggcagauaugugcauacacauauaaucccauuuaugugacguucuaaaacaggcaagacuaacauaucaauagaaaccagaacaggggucaccugggagguugggggauaagcgggugaaaauucuguuuccugaucugguugcugguuacccgggacuauguucacugaaaaauguaugguguuauucccuuuauaugugggcuuuucuauacgugugcuacacuucacuaaaacccuuuugaaacuauaaugugaaauuuuaaaaauaaaagauuaacugcaaaugggcaaacgacuugaaaagaccuugcuccaaagaaaauacacaaauagccaacaagcucaugaaaaggugcuugacaucaucagggaaaugcaaaucaaagucacaaugggccaccacuucucacccaccaggauggcuagaauuuuuuuucauggaaaauagcaaguguuggcaagggugugggaacuggaaccuuuaugcauugccggcagaaguguaacguggaacagccacuguggaaaccagucugaccguuccucaaacgaucaaacgcaaaguuaccguaugacccugcaacuccacuccccagaacagacccaagaagaacugaaaauggguguaaaaaacaacacguacaagaaugugcacagcagcacuguucgcaaugggcgaaaacgacccaagaguccgucaacagaugaauggcugaacgcaguguggucuguccagacagcggcaucugacucacuuagaaaaaggaaugcauggguuggcucuuuacuacugcguaaaaaagaaauguauuuaaagagccaaaaaaaauaauuuuaaagaaaggaaugcggccaggugugguggcucacaucuguaaucccagcacuuugggaggcugaggcaaguggaucaccugaggucaggaguucaagaccagccuggccaacauggugaaaccccgccucuauuaaaaaaaaaauauauacaaaaauuagcugggcaugguggcagccaacuguauucccagcuacucgggaggcugaggcaggagaaucgcuugaacccgggaggcggagguugcagugagagccgagaucgcgccgcugcacuccagccuggguaacagaccgagauuucaucucaaaaaaaaaaaaaaaagagaaagaaagaaagaaaaagaaaggaaugcaacacugacacaugccaccacauggacaaaccucaaaaaccugacauggagugaaagaagccagucaaaaggccacacuuagugucugaccacacuuacgaaaugcccagaauaggcaaauccagagacagcagauuggugguugccaggggcuggggcagaaaggaauggugggugacugcuuaauggguacacgguaaugagaaugcuuuggaacuagaucgugguaacgauugcgcaaccuugcgaacgcacuaaaugccacuaaacuguacauuuguaaaugguuuuggugaauuuuacguuaacuggaucuuaaucacaauuucaaaaagaaagauuaacuccaaauuaaaaugagauaucauuucccaguagaugagcaaaaauuaggacauccaagaaaacaacuacaggcaaagauguuuggaaacaggaccgcugugcacagcgggggucaggccacuggggagucgggacaguuucuaaucgggucaggugugagcaaagccccauggucuguggguucccuguucagacauggugcagagcaccagcuucccagcuccugccaggcuagggccacgaccugcacacccaccagaagccucaugagggaauacgcaccuucccagcaugaugcaacuuacguuaugacuccauuauucgccccucugguauucuauccuauuccauucuguuuuuaaaaugcugaucccaggccaggugcaguggcucacgccuguaaucccagcacuuugggaggcuggggcgggcaaaucaugaggucaggagaucgagaucauccuggccaacacagugaaacccugucucuacuaacaauacaaaaaaauuagccaggcgugguggcagaugccuguagucccagcuacucggguggcugaggcaggagaaucgcuugaauccaggaggcggagguugcagcgagccaaaauugcgccacugcacuccagccugggcaacagagcgagacuccaucucaaaaaaaaaaaaaaaaaaaaaaagcugauccccacccaccccacuuauuucacaacccacaaucugaucacaucugacaguuugaaaacucugcccuagaaagauucuccuaagugugcaagaaagcgccagaagaauugucagaccucaaaaaaagaacagagggccaggcacgggggcucacgccugugaucccaacacuuugggaggccgaggcggguggaucacuugaggucaggaguuccagaccagccgggccaacauggugcaaccccgucucuacuaaaacuacaaaaauuacccaagcacggugacaugcaccuguagucccagcuacucgggaggcugaggugggagaaucgcuugagcccaggaggcggagguugcagugagccgagaucacaccauugcacuccaaccugggugacagagcgagacccugccuugaaaaacaacagagagcccagccagguucucagucaaagauaagcugggcuucugcacacgguggcugcacagugaguaaacgccaucgacuugcagauaucucaaaggcagaaucuugacagaaggacaaauacugcaggacaaauacuuccagauuugucuuuuagaggugaggaaucugaagacauugaauacacagagaguugaauggugcuuacggggcggaggcuggggagguggggagaugcaggucacagggcgcaaagcugcagucaugugggauggguggucuggagguugcaugcacaacacgaggacugugauuaauacuguacuguauacuggaagcagauuucaggugcucucaccacuaaaaacaaagagguggccgggacucaugccuguaaucccagcacuuugggaggccgaggugggaggaucgcuugaggucaggaguuugagaacaaccugggcaacauagggagcccaucucuauaaaaaauacaaaaauuagccaggcacaguggcgcgcaccuauggucccagcuacucaggaggcuuaagugggaggaucacuugagccugagaguucaaggcugcagugaaccgugaucaccccacugcacucuagccugggugacagagcgagacccugucucaaaaaaaaaaaaaaaaaaagaggugacuauaugaggagauacauauguuaaucugcuuaacuguaguaaucauuucacuauguguguguauauagcaaaacagcauuuggaugccuuaaauauacauaauuuuuauuauuuauuuauuuugaaacagagucucgcucaguugcccaggcuggaaagccuugacuucccgaucuccccagaucaagcaauccucucaccucagccuccugaguagcugggacuacaaggcacauaccaccacgcccggcuauuuuuuuauuuuuuuauuuuuuugcuuuuaguagagacaaggucucacuauguugcccaggcuggucuugaacuccugagcucaagagauccacucgcuucagccucccaaagugcugggauuauaggugucagccacugcaccuggccucaauuuuuauuuuuaaagaaaaaaaaaucuugagugaagaaaaggcuaaagaaagaaacaauugacaugggccucuugaugugaauuuuccaaacacaugaaauaauacucuauauucuuucugaagacaaacccauguggaaauguagaaaaacauucagggaaaugauaccugcaaacaaucucaggagagggcugggggcuggggauguggggaaagcuuuaacugucauugugaacauguuauuucuugaaaauaacauacgagccaccguccgaacauuggccuacaagccccucugccuggucuggccccuguguucucucuggccccacauccaacuguagcaggacaagucacagacaaaacuccucagacaccggauuaaagaaggaagagguuuuuauucggccgggagcaucggcagacucgcgucuuaagagccgagcuccccgaaaaagaaauuccuagcccuuuuaagggcuuacaacucuaagggguccaugugaaagggucauaauagaucgaguaagugugaggaacgugacugggggcuacauacaucagcuaacagaacaaaaaguuuuacagugcuuucucauacaacgucuggaauuuacagauaacaccaguaguuuuggucagggguuaauauuauuauuauuauuauuauuuuaaccaccagggccaggugguggcgccaaggucgucuagcuauuuaucuuacuucuguuucuuuccaucuuuuugcuuucucccuuuucuccugucuuauaaacuagggaaaaggggaggcuggggagaagcugggaaggacaacagcagaagcgguggucucauuccacaaccacugucuguuacucagcccagccccacagccuccuugcuauccuguccaagaggccacgcuccugccccagggccuuugcacccacugcuuccuccuaaacacguggucaaaucccucaccccuucgaaucucugcuuacaugcccccuucucagaaggcucauccaaccugccccuaaaacuccugaccucccgaccugccguguuguuuccaugcugcuuguggccuucgagcacacgguauaauuagcuuaucagguuuauugcuguccaucuguaucaccugccuggccauaaacccacaagggcaagauccucagcugcuuuguuuggcgaugugucuguccucagggccugggacagcucuuggcaccuugcaggagcucuguaaauauuuucugggugaaugagcaaaagugagaccugaaaccauauaaucaacguggaaaugucuagcgggugguaacgcuaguccuccuuuguguguuuuaaacagcucauacuuaagaagggauuuuuuuuuuuuuaaauacacagagaguaccgccuguuuaggccggggcaacaacucgguaaaugugugauggaugagaugaagauuucauagacauuaauuuuuagcauucucuuccuaccacccacagcacucuccccugcaccuggagaggccccugaccuccaaaccuaacaccccgcucgcccaggugccaccuccuccaugaagcccacuggaacgaccucggccuacagugaggcugcucugaccucauugggauugcaguucaugcccuguacaaucauccgccccaugcuagaugcuaugcuaggaauuuaaagacacagggaugaacacgauggggccccugcccugagacgccccugcccucagacaccaggggagcagaaucgucuggacgaucugcccggcccuguucagguagcgaaacacuuccaccuacuucaccucuuaaauucucaauggcucaucucaucgaagcagacacugaggcuccaaagccaaaugccugaccaaggucacaggagcagggagagacagagccccaggcuccguauccacgucuaggccugugcccucacgcuucucuccuaggccauccccgcugggcuccuugcacgggagcuucacaaaugaaucauuaacuugaccuggccacugaauugcaaggucuaauuccuccuccuaugagaagagaaaacaggcuuccaagaaacacaccucugaccaaaugagccaagaagccaauuugcccagacgaagccuaguucugggacaaggccaggcccugcccacucuggaccagcagucaguggcugacuacacucucaaucccagggcuccaggcauccccagcuccauggggccuuaagaugcaggaacaacuacgacacaggcuaauccaaucugggacuugggaacaccacacccuuggcucauguuccaacuucuuuugauuuuuaaaggacuaagguaagaagacuaaaauaaaagguuuuuacaagaaacccacgcuuguaaguugcuuaagcgaagagguugagucauuccugaguccuccauuuuccucccaccuagcacccuccaucagcaaggcugggcugcucucgcuuuaaagcaugccucaaauccauccacuucucuccaacaccauccuggcccccauccuggcuuguauggaugggugccguaguuuccccgcuguuuuccugccucugcucuugccccccgccccguucuccccacagaauccaaguuauccuuuuaagauuaaagucagagcaugucauucugcucaaaccucccccaugccucccuauuuaucucagaauagaaucuaaauuccugacagugaccuaugaggucuugcacaacccagcucccuauagucacuccagucuccucccccauuccuaucugccucgcucacucugcuccagccacacuggccuugcugugcuccugagccaccaggcaaguuucugccacagggccuuugcacugacucuuugcuccuccaggggcaaucuuuccccugaugcccacaaaagugagccccucacuucucaagucuaaagucacuuucuccgugagaccuucccugagcaauuuucaaucccuuaaccaucucuauugagccccacuguauggcaggcucugcucuaggccugggcacuucaauagugaacaaaauggaugaaaauaccauucuuccuaaagcagcccuucccccaucacauuauauucaucacccuguuuuaucucccugacauuaucaauaucugaaauuucuauguaguuguugauaagucccccuuccugcugcccggaauucagucacaauggauggagcuagagcagccaucuuggaucaugaggcacccuuaagaaugaaagccacacaugaagaagggcggagcagaauaggagauaggagaaaggauuccugugacuuccuggagccacccaccagcccuggguggcuuagucaucagagaaauguccacuggacucacagugagaucccaugccauacaccagaauggcuacaaugaaaaagacugacaauaacaagugcuggugaggauguggagcagccagagugcucacacauugcugguggaagugcauuagugcagucacuguggaauauacuuuuucuaccaaagcuggacguucacccuacaauauagcaaucccacccccaguauuugucccagaaaaaugaaagcaugcacccacacaaagauuauccacaaaugcucauagcagccguacccauaacagcccaaaacuggaaacaacacaaaugucuacaagcaagugaaugcaugacaaauggggacacacucauaccauggaaugcuacccagagacaaaagggaaugaccaauugagacacacaaugacaggguaaaucacacacagggaccacgugcaugaguccauauaagugacgucccggggaauggcaaaaccaauccauggggauagaggugggggcagcaggaccucagggguggauacugacagggaggggugcgggggaggcguuuacacuugguauagggggucauuacaagcgugcauaccuaggugaaaauccaucaaccucuaaccgaaauugugcacuuuucuuaaugcauuugauacuucaauuuuuaaaaagaaaaaaauuaaagcaaaaaaaauuuuuucuuuuuucagacagagucucacucugucgcccaggcuggagugcaguggugugaucucagcucacugcaaccuccaccucccagguucaagcaauucuccugccucagccuccagaauagcugggacuacaggcauacgccaccaugcccagcugauuuuuuuuuuuuuuuagacggaguuuugcucugucacccaggcuggagugcaguggcgcgaucucggcucacugcaaccucugccucccggguucaagcaauucuccugccucagccccccaaguagcugggauuacagaugcccgccaccacaccuggcuaauuuuuguauuuuuuuaaguagagacgggguuuugccaaauuggccaggcuggucucaaacuccugaccucaggugaucugccugccucggccucccaaagugcuaggauuacaggcaugagccaccgcgccuggacugauuuuuguauuuuugacagaaaugggguuuuaccaugucggccaggcugaggucuccaacuccugaccucaggugaucggcccaccuuggccucccaaagugcugggauuacagacgugagccacugcgccuggccuaaagcaaaaaauuauugauccaggguuggguacucuucagauguucaauacacccucaaguggugucgcuaauaagagagcaccuacagccaccaaggcccaaucagggucccagugccccgucaaaucugauuucugaagcagagcagcgaggccagccaggagaccaccaggggcccuggagagacgugagaggucugggguccccucuuuaccagcaaaggggcucuguccacucccuguccccucaacccccugcccauccuccaccuaccagcaggcgccugauacaacuuccugugccuguuucuuuaccuguaacaaggaauaaagaauaggacccaugcagcagggacaggucauguugacauaaugugcugggaacagcccuucgucacugcgaucuuccuuccaaaacccggaacuagggccuaaucaauagaagaacaacagacaaaucccagcagaggggcguccugcaaaauuccuagccggugcucaggaacgcaauccaggucauccaaagccaggaaagucugagaacccacagagaccagaggauccuaaggcaacgugagggacaaacgcaauguggggcccuggauuggguccugggacagaaaaugauacgaaggagaaacgaaggaaacgugaauccugucuggauguuaguuauuacugauguaucaacacugguucauucauagcaacaaauguaucccauuccuuuaagauguuaauagcaggggacacuggcugugggauaugugggaacucagcacuaucuucccaauuuuucugaaaguugaacuguucuaggccgggcgcgguggcucacaccuguggaauccuagcacuuugggaggccaaggcagguggaucacuugaggucaggaguuggagacuagccuggccaacauagugaaaucccgacucuacuaaaaguacaaaaauuagccagguguggugucaggcaccuguggucccagcuacuugggaggcugaggaaggagaaucacuugaaccuggaaggcagagguucuagugagccgagauugugccacugcacuccagccugggcgacagagugagacuuggucucaaaaaaaaaaaaacuguucuaaaacagaaaguuauuuuaaaacaagcaggcucugucgcggcaauacagggagggccaaaucagugccucaccgaaucauauuacagcuucaagcaaaaggaaaaaaugugcaccccauauuuauacuuuuuccagaacauuaaggucuuuuuguaaaaacacugacaauuucaaaaguucacauauuaacacaacauuauuuuaaguuuaaauauuuuauuuaagcccacccaaaccagauuauacuaucauguuaaugaccuggcuuuaauggaagcauuuucauuguauuagcuucccacugcugcuguaagaauuaacaauuaacacuggcucagaucaauacaaaguuauuaucuuacaguucucggggggagaaguccaaacugggacugccccugagaugggaugaaagucacggugcaggcagggugcuuccuucuggagcucagggggaauccauugccuuccguuucccagcuucuaagaggccuccgcauuccuuggcuccuguccccuuaucacuccaaccccugcuucugaggucacaucuccuacucugacccuccugccucccucugucaaagauccuugugaaagcauuguggccccugggacaauccaaguucaucucccaucucaagauccuuaacuuuuuuuuuuuuuuugagacagggucucacucuguugccaggcuggaaugcaguggugugaucacggcuuacugcagccucgaacucccgggcugaagcaauccuccuuccucagccucccacauaacugggaccacaagcauacaccaccacgccuggcuaauuuuuaaauuuuuuauagagauggggucucacuauguugcccaagcuggucuucaacuccugggcucaaaaaucucccaccuuggccucccaaagugcugggauuacaggugugagccaucaugccugguguaagauccuuaacuuaaucacgccuacaaagccacuuuugcugaggaaggucacauauucacagguccuggggaucaggacgccagcaccuuuuggggacauuguucagccugccacacccacccagagaccccagagcauccucccacacagcccccuccaccccagggaacaccccugcaccagggagugugacauuugccccgugcaccccuuccucuccccacagcccuaucuuggccagaaggcaggcuucgcuagaaacaagguggacccggcaggaagcccaguguccucuuuaaugggaagcuccacgcccaggaugcucacacgucccccgcuuuugaacccugcuguguuuuggccugagcuguccuaagagaaacccgggccggggaaugaucugcggagcaggacacucucccgcagcugcuuucaagcagcucagcgggggcacuuuguucuugcagcugggaucugaaaagcaagcccucugggcugcggacgugcccgugcugccugcacugccuccucgugacucccgagaccuccugccagugacacgaggguguccagaaacacaaaccgaggcccgcccugaaaagggcuaagccagcuucauccucagccacaugggaggaagaaugcaggcaacagccagcaggggccugaggggcccugcaaggccagagccaggggucuugucaaaagcaggccucccaagccagugagcucccacgggacacacggggggacagggaggcagccagaggucagaaccacuccaggguccucagguucccagaaacuuccaggcugggccgggaccagaaacagacgucaccggugccagucccuugugcuggucccugagccacagccccugaggcccccaaaaggggcccaaccaacaaggggcugaggguccgggcagagccucccacuccaggcaugaggucucgggcaauuucugaacacuggagcagguccaccuuucaaaccucauuacugcccuacagaacgacuuuuggugugagcauaguacuguggucaugcuuggggauuuucuuuugcuuuaucauuguggugguguuuacuagguaccuguucgggcagugguucuugaaguguggucccuggcugagcgugguggcucacgccuguaaucccagcacuuuggaaggcaaagauaggaggaucacuugagcccaggaguucaacagucugggcaacauagcaagaucucaucucuagaacaaaauuuuuuuacaauagccaggcaugguggcauguacuuguagucccagcuacuugggaggcugaggcaggaggauugcuugggcccagaaggucgaggcugcagugagcugugauugcaccacuacacuccaggcugcacaacagagcaagacccuguccacccccccaaaaaaaaggcggucuccaaaccagcaacaucagcaucacuugggaacucgauaaaaaagcagauucccaggcuccaugccaggucugccgacucagacacucaggggcuggggccuggugauccguguuuuagugagcccuccagcguccagacuccaaugcaccaugaagugccguggcuauacuagagacacugacggaugaggcaaugucugacaugagccccagaacaauguggaaaaggggaaaguguauggaggcacgugcagaaggcaagacuugguaucuccucagcaaguuacagggcccgugaccaucgcaccggucuauuuuuauguauguuugaauuuuuuuuuuuuaagagacagggucuugcucugucacccuggcuggagugcacuggugcaguccgagcucacuguagccuugaacuccugggcucaaaccaucuuccugccucagccuccuuguagcugggaccacagcagcuucugucaccauacucagcuaauuuuuucauuuuuuguagauuuuauuuuuuguaggggucucgcuauguugcccaggcuggucugaaacuccuggccuaaaccaauucucccgcuucaaccucccaaagagcuggauuacgaacgugagacacugcacccagcccuugaaauuuuucauaaauuuuuuuuaauucacucaaaauuucuuauacaccgcauccuccccgcccccacuaaaaaaaacacaaacuaggucuugucucuuccugaaacagaugccacaaacugggcccaugggccagauuuugccaguagauggguuuugaaucacauauuucaaaauauuugaaucuguugacaguaucuuaaaccagcagguaaauuccugccuucuggcuucuuuugggaaccugggugauguccagcucugggccugcaugccacguggcccagcccgcuggagcaaagcaggagccgcuucacaguuggggugugcccuccagcuugcaacgggccccaccacucccuaucaccucaugccagggcccuucccccauguauguuccugcacaguuugcaaucccuguccuauaguaacacacgaugagaacguggcauucauucauucauucauucacucagucauucauucauuucaacccugccugagcauccaaagcgggcgaucagugcuacagggguaaaguuaauccaacaggauuccugcccucguggacugagcaggaaguggggaagaggacacgcaauucacaagugacucagguacccaguaggaagagcucagggacaucacacguauucacuggcacgcacuggcaagcaccagaggucucgcgcaugugucacuggccagaauguccaucaguacagccaccucggagagccacugggcaaaaucuacugaggcagagcacgauguucugaacugcugaacgcaucuggaaaccaccaccucccaucucucaggaagcacaacaguaaacaucugcauuacagaagccacuggaggcaaguuuuauguuguuuccagcucaaagcaucccauuuaaagcaaugcuuucauuuauuuaaaccuaacaauuaggcugggugugguggcucacaccuguaaucccagcacuuugggaggcuggggcaggaggaucacuggagcccaggaguucgagaccagccugcgcaacacagugagccccaucucuacaaaaaauguuuaaaaauuugccaaaugugguaguguaugccuguagacccagguacguggaaggcugaggcaggaggaucccuugagcccaggagauagaggcugcagugagccaugaucgugccacuguacuccagccugggugacagagcaagacccugucucaaaauaaaaugaaauaaaauaaaauagaauaaagcuaauaauuugucuccauuuuacugaugaagaaagugaaguacagggagauuaaaccacucgcuugcccaagagcacaaacccaauguuggcacagagucuugaccuugggucugaccaaaggcugggcacugccuugguaaaggcccagcacaggcguggcaaguaaggagcucagaccagcgaagagaaugcuggaaggugcauacaguccugguccccgggcacagagaugaaucaagcacaaccucuccuuccccgccaaaucagggccucauccugcuccccaguugcaccugcaugacgggaacuccaggcagcccaccucuacuugcuuuuuuggacaaaaacaauuucuaccagggcugaucccagccccacuguuuccacacaagucagacagugaauaugccuucuuucaaacaccccaaccucaauaaagcuggcuguuuucaagcaaaaacauuauucuucucuguucuuagaaagguuucaacaagcuacagccuguggaccaaauccagccugaugccuauuucuacucaccccacaagcuaacaaucauuuugcauuuucaaauggaaagaagggaaagaggggaagaaagggaagaaagaaaagaaagaaagaaggaaagaaagaaagaaaggaaggaaggaaggaaggaaggaaggaagggagaaaaaagaaaagaaaggaaagaaaaagaaagaaaagaaaagaaaagaaaagaaaagaaaagaaaagaaaagaaaagaaaagaaaagaaaagucagccagcugggugcagugcugcacgccuguaaucccaacacuuugggagaccaaggugggagggucacuugaggccaggaguucaagacgagccugggcaacauagugaggacccccccuacacacccacccaccaaccuauaaaaaaaaaaaaugagccaggcgugguggcacaugccuguugucccagcuacucaggagaguaaggugggaggauaacgagcccaggaggucuaggcugcagugagccaugauggugccccugccccccagccugggugacacagugagacccugucuccaaaaaauauguuaaaaauaaauaaacaaacaauugaaagaaaaaugccauuucaugacaugugaaaguuauaugaaauucacauuuugguguucauaaaugcaguggcacuggcccacagcggccaccucgacuuauuucugugucgucaauggcagccucagcaucacagcagcagggcugaguagcugagacacaacccgugcagccugcagagcugagcauauugacuaucugucucuguacagaaaagcaugccaaccccagccuagaccacacagaaauucaggaagggccauccccugccaggccagcuucacgggugaggccggaucuggccauuagggagagggccagggcgcagaccuaguucuggccucggcucagucagccccucccaccccgguccccugauaugccacauggagacgugacugccuccccauccuccccguggcagugcagagagaaugagaugacccaggacaugugucuguugugaagagggcacccggcuauaaacaugccucagggaacuauuguuacaggagccucccugagcucaccacuggcuccaguucaagaacacgucaugaagccagccaaggucuuguaaaauagggcaacggugguuugggccuggaggaaucagaagcucagggcugccugcuucaaaggcuaagucuucugcaacaggcucagcauguuggaauuugacccuggccaacaggcugggccgucuggucuaccaucuacaaaccaacagcccaacccauucaagcaggaggggccgguaccauuucucccuucagguuaaacccugccacaguuuuuaauuuuaauugggguaaacauaaaauuuaccaacuuagccuuuuuuuuuuuuuuuuuugagauggagucucggucugucacccaggcuggagugcaguggugugaucucagcucacugcaaccucugccucccagguucaagaaauucucugccucagccuccuaaguagcugggauuacaggcgccugccaccaugccaggcuaauuuuuguauuuuuaguagagacgggguuucaccaucuuggccaggcuggucuugaacuccugaccucgugauccacccaccuugggcuccaaaaguacugggauuacaggcaugagccacuacacgcccagcccaacuuagccauuuuuaaguguacaguucaguggcauuaaggacauuugcaauguugugcaauuaucagcaacauccaucuaaagaacucuuucaucuugcaaaagugaaacccuguacccacugaaaaagagcucugcacccccucucccccagccccuggcacccaccauucucuuuucugucucuguggaucuggcuacucuagggagcucaugcaaauggaaucguacgguauuuguccuguuguggcuuauuucacucgcauaacuuccucaaggcccgugcaugucgcagcgugcguccaaacguccuuccuuuuccaggcugaauccuauuccaacguguggaugggccccagcuucuuacccaccacccaucagcggacacucggguugcucccaccguugggccaucgugaacagcgcugcaaugaacgcgguggccagauuccucuucaaguucccacuuccauuucuuugauacccagaagugggguugccccaccauaugguaauucuauguuaaauuuugggggggccuccacacagcagcugcaccauccuacauucccaacggcacacaugggccccgauuucuccgcacccucaccccaacggcacacaugggccccgauuucuccgcacccucaccccaacggcacacaugggccccgauuucuccgcacccucaccccaacggcacacaugggccccgauuucuccgcacccucaccccaacggcacacaugggccccgauuucuccgcacccucaccccaacggcacacaugggccccgauuucuccgcacccucaccccaacggcacacaugggccccgauuucuccgcacccucaccccaacggcacacaugggccccgauuucuccgcacccucaccccaacggcacacaugggccccgauuucuccgcacccucaccccaacggcacacaugggccccgauuucuccgcauccucaccaauauuugagauuuucuguuuucucaagugaccauccuaauggguaugagugugucucacugauucucauuucccuaacgaugagcgagugucgcugagcacacuuccauguccccguuggcuaucugcauuuuuuuuuuuuuuaagacagagucuugcucuguugcccaggcuggaguacagucuuggcucacugcaaccucuaccucccagguucaaacgauucuccugccucagccuccugaguagcugggauuacauacaggcgccugccaccacacccggcuaauuuuuguauuuuuaguagagacgggguuucgccaucuuggccaggcuggccucgaacuccugaccuugugauccgcccaccuuggccucccaaagugcugggauuacaggcgugagccaccgcgccuggcugccugcaugucuucuuugcaggugcuugguccguguuuuaaugggguugucugacucuuguuguugaguuguccucgcuugauuuuaggaccagaguuaaggcccacacuccaucugcucucaaccucccucccccgaucuucucgucucggaaaauggcuccaccaucuaccaaacuccucaaaccuugaggaaccacccuugauuccucuccuucccucgcaccccaguccacugaccuaucuuguugacucucccugaaaaaaaacucgaauauguucccuucuuuccauuuagaaaacuacccccaccuggcucaaaucaccaucuucucugccuccccgcuuccagccuggcccccgacacucccuucuccagacagcagccagagagcucuucaagacugagucaggcugggcgugguggcucacaccuguaaucccagcccuuugggaggccaaggcagguggaucaccugaggucagggguucaagaccagccugcccaacauggugaaacaccaucuuuacgaaaaauacaaaaauuagccgaguguaguggcacgcacguguaaucccagcuacucagaaggcugaggcaagaaaauugcuugaggcugggcgcgguggcucacgccuguaaucccagcacuuugggaggccgaggugggcggaucacgaggucaggagauugagaccaugcuggcuaacacggugaaaccccguaucuacuaaaaauacaaaaaaauuagccgggcgugguggcgggcgccuguagucccagcuacgcgggaggcugaggcaggagaauggcaugaaccagggaggcggagcuugcagugagcggagauugcgccacugcacucccccgccugggcaacagagcaagacuccgucucaaaaaaaaaaaaaaaagagaauugcuugaacucgggaggcggagguugcagugagcugauaccaugccacugcacuccagccugggcgacagagaaagacucugucucaaaaaaaaaaaaaaaaaauacugagucagaucauggcucuucccugcucagaacccuccauggaauugaaaaccaaaucugaacuccuccagguguccugcaaggcccccacaugccuguccccuuucacccccuccagucacuucucccaaccccacuggccugcucccucuuccuccaacacagcaggcuccuucgcaccuccggccuuugaaccugcugugcucuuugccagcugcuccccagcucauagagccccuccucugagaggcccuccugacucccacaucagaaggaguccccuucccagcaguggcuccaugucagcucaccugccucguccccuuccuagcucuucucgccaccccaccucuuccaugugcuucuccauggcccaucccuccugcuaaagcguagcugccgugagcaggaccaggucucuuuuguccacggcuguagcuccaacacuuggcacgagaccuggcccacaauuugugagcaguaaacaugggccgaaaggaugaguagcuuucccugccacuucagcccugggggucccuccuccuccucccacaguccugugugccccauucaggugguucauaaacagcugcccggagcagauucuccacugggguuugucccaucuguaaaaugaggguuguaaaugugcccaaacagcuggggaugaaugcaaagcgccccacgccccgugucacucccagccaggagcaagagggcaccaugccagugcugccucuggcccaggcagucaccuguccaggggaaacaggccucuaaggcuccaauggccucacgcacuggaguucaucaauaacacaagccgagaaagccccaggaaagcuggagacgcugccggaaaugcaaagcugcucauucuuccauccgucccagcuaaagggguucgaggaagcuccuccccacacaccucccaggguggaaggggaccucauaucucagcggggcucuggcccuggccccagcaucccagucccugucucuucucccugcccccaccaaggacacagaugcccaggccugcuggcagcuucaucacacuuaucugcacucccaagccacagauuacagcugucaggcccagaggaaacguggcggucacaucaacccugacucugaaaacagcccugaaagacacagggguguuuccagcacagcaaggucuuacuggaaaggaccccuggaccccaauguccuagaggugugccccacgaccccacaugccccucuucacugcucuggccuuugggaaacacagcccuguccuuuacaagguccuauuugcaaagccugcugggagacagaggcccagggcucggaugaggauggguucugugcgggaacaagagaugccaagauccaccuaggugccccagccaagaggcagaaaagcaugggaaccgugugcccuugugggacgugugccacggacgggaaggauacgggugugggucccccucuguggacgcaaacauguuuauugcaggaaggaaaaacaaggaacuauuaacccaagucaccucuggagcaaagaccagcuggggccaggggagcagugucgugcugugaucuuuccagaaggcugacucuuuuuccguacacuuuuaauuuguuugaucauaucccuauuuuaccuuccuuauuuuuaaugccagccagggcuuucuggguaagagcugggcacacccagggagaggcacgugaccauccgcagcugcucuccuuggccuccaguuuguuuuguuuuuguuucuuacuuucuguggagaugggggggggggucuuacuauguuacccaggcuggucuugaacuccuggccucaggcgauccucccaccucugccucgcuaagugcugggauuacaggcaugagccacugcgccuggccuugacuucugguuugugagauggaagaacauuggccccaugugcagagguggaaaucggcuuuuaggaaaaaagugaguuuccacaggacccaaguaaugggaccuggauuugaacccagagcucugcagaucugaggauugggcaccugcacacauagugcuggucugaagcauguccccugccaaauucaugcccaccuagaaccucagaauguggccuuauuuaaaaauagggucucuacagauguuaccaaguuaaggaucccaagaugagaucauccuggauuuaugaagggcccuacauccaagcuggaggcccuccaagcccaagcugguggggucuagccccaguuugcucugugacccuccaacauggcccucaaaaucucugagccucagacccccaccugaggacuuaugaaaggaagaagacucaaauucacaccucagaaaagcacaugagaacaaugcugcaccacguacccucacugagaccccagacauucucgaagacuaaaucgucucaggugcuggagaggaugugagagcugggagggugaacagcaguggcccuucuggaaggcauguugggugaaaauggcucccccucugcccuacagcaauuccacuccugcgcauccccaggaaauuguggagaaguacaaggcagcaggguccagcauauuugcuguuuguggaggcaggagucagacauaaccaagguacccccgucgcuaagggaauaaauacaacaggaugaacaugaauuaggggguccaggcagcagaaggaagcaauaagccugauacacacauaggaacacggauagauuuuaaacagggcagcacgaggaauguugacacgaguuaccgugcauggcauggaaaagccgcccucuccucagacgugacaggccacaugaagggggccucccugugccacccccagcucaaagcacuuccaccucuagcucccucgguccucacugaauccuauaggaaggcaugguuuuagcccauuuuauaggcacccuacuauuaugagcugaacaguguccccccaaaauucccauguugcagcccuaacccucggugcaucagaaugugacuguauuggcgcggggggcagggccuuuaaaucggugauuacguuuaaaugaggucaguggggugagcccuaauccaaucugacugacgcccuuaaaagaggagauuaggacccgcagagagucaccggggaugugcgcacacagggagaagguggcgucuaugaggccgggagaggggucuccggagaagccagcccugccaacauccugaucucagacuuccggccuccagaacuguacgggaauacauggucuuuggcccaugcaccuguuauggacauuuuuuucuuucuuucuuucuuuuuuuuuuuuuuuugagacagaguccugcucuguugcccagacuggagugcaguggcacgaucucggcucacugcaaccucugccucccaugcagacucagacacccaccagagaccagagacucgaagagccuguccauggucacacagcagcaggaggcagggccgggaucuggacccacaccugcaggcuccggaaucuaggacugcacaagguccaaggacacacucagguuuacagacgcagccacacagaggaugggcgcaggggcagggcgggcugaagagcgagaggggugaggggaaggagggcauaaaaggagaccacugaaagcagaagccaagcgaguucccgaacaugcgcgcucccagcagcaccgcucccggcagccaccagcccagacgcccauccacagaggcgcggaaaaacagcaugcagugcacccgcaccguggaggccugcucagcuacaaaaaggaaagcagcacuccacaugccacaccacggaugaaccccaaaacaugacgcuaagcggaagcagccaggcacuuaaggccacacauugcaugauuucauuuauaagaaaugugcagggccgggcacgguggcucaggccuguaaucccaacacuuugggaccgaggcagguguuugaccugaggucaggaguuugagaccagccuggccaacaugugaaaccccgucuauauuaaaaauacaaaaaaaaaaaaaaaaaauuagccgggcgugguggcgggcgccuguagucccagcuacuggggaggcugaggcaggagaaucgcuugaacccaggaggcggagguugcagugagccgagaucacgccacugcauuccagccugggugacacagcaagacucugccucaaaaaaaaaagaaauguccagggccgggcacgguggcucaggccuguaaucccaacacuuugggaccaaggcagguggaugaccugaggucaggaguuugagacuagccuggccaacauggugaaacccgucucuacuaaaaauacaaaaaaaaaaaauuagccggguguggugacaggcgccuguagucccagcuacucgggaggcugaggcagaagaaucgcuugaacccgggaggcggagguugcagugagccaagauugcaccacugcacuccagccugggcgacagagcaagacucugucucaaaaaaaaagaaagaaagaaagaaagaaauguccguaacaggugcaucuguagagacagaaagaaaaugagugauugccaggggcuggggagcugcaaagaguggagaaugggcaauucuacuugggagggauggaaauguuuugaaacuagguagaaguggugguaucacugaauuauucgauuuacaaggauuaauuauauguuaugugaauuugaacucaauaaauuauuaaaugaaaaacaaaugauaggauuggaaacgcugcaaccacuuuggacaagagcuuggcccuucuccaugcaggugaagacacgcacgccaugaccagacccccuacucugacugucgggcccuagagggauucaggcacaugucccuugcaggcagggacacgagugugucauaacccagaagugaacacagucaccggcaucaggguuaaaacagaugaacuggccgggcgugguggcucacgccuguaaucucagcacuuugggaggccgaggcaggcggaucaugaggucaagaggucgagaccauccuggccaacauagugaaaccccaucucuacuaaaaauacaaaaauuagcugggcaugguggugcacuugggaggcugaggcaggagaauugcuugaacccggggggcagaaguugcagugagcugagaucgcgccacugcacucuagccuggccacacagcaagacuccaucucaaaaaaaaaaaaaaaaaaaaaaaaaaaaagacagaugaacugugauacucagcuucuuccgauuagcaucaugaacugugauaugacauggccaugaaaauagagugcagcuuaucgcagcaauguggguggaucccacaaauaccauaugaaguaacaccagcaagaccaaaccaaacaaaaauacugagaguaugccugcauccaaguuaaguccaaaaccggaccaaacuaaucccgguguuuagggauggcuaugagggagugauacuauaaaaagcaaagcaagcugggaccaaacacagugucuucugcaggggcuucggggcagaugagcuuucccucuucuucacguggggugauugcaugcauguucaucuuaguuacauauuugauugcauaugucuuacacuuuccucaaagugagcaaauuucacaaaaaacagaaauccaagacucuggguggaaagugcaaagcgagggguugcagcagguggaguccaggagccugggaacagacaguggaaggaaaucccaaggacaggggagacuuggcuguucccagagcugccaagggauccuggcugcaaugggcucucggccaaguaaggccaguuugaccuccaccugccugccaggaggccagacagggccaagaugaucuggcacaagaauuuccacaaggcucugaggccugggcaucugggcuaguggcugccgggaggcccaguuagggagaggcaaaacaggaaaagcccccaccugccacuccauccagccucccguuuccacccgaccagcccugagaccccaggguuuccacaaucuuccuggcccaggggaugagucagggaucagauccgccaucucuucccaugugauggcacuggggugggcagaggcuggccgagggccgcugaaggauggacacaucaccgcucaaaggcaaggaaugagagccagaaauuuuagaaagcagguggaggaagggaccaggaggaauugcaggcuucuucaacccaagagguucagacuugcacugugacugccaggcugggagcugggggaggauccaggcacccaaccccggcucaucagaaacacucugcuccaaucugauucacacaaugaggcuuuugugugggagucugugggaagaccacgugcacuccugagaaagcaaucagacaaauccaaaucaagggccauccugccaaaagcacccgccuggccccuuuacagaugccaguguccugaaagacccagcaaagagaaaagggcuggagaacaggucuggauuaaagaggaaaaacacaugaggcaaccagacacagcaugcaaccuuggauucaaaaaaaaauuuucuuuuucugagacggagacucacucugucgcccaggcuggagugcaguggcacgaucucggcucacugcaaccuccgccuccuggguucaagcgauucuccugccucagccucccgaguagcugggacuacaggugugcgccaccaugccuggcuaauuuuuuuacuuuuaguagagacaggguuucaccaugcugcccaggauggucucaaucucuugaccuugugauccacccgccucggccucccacagugcugggauuacaagcgugagccaccacgcccggccaauucaaaauuuuuuaaugaacaacuaugacaaaaaguguuauuggggccguaagggaaucugaacacagacugucagauuaaagguguggauccucguggccuucuugaguggggccgugguccacggccauggagaaggacguccuuguccuuaggaugcacccaaaaggcucagcaacgagagagagaggaugcacaugcagcaacuuguacuuuucuucccguuuuuacaaaauaaaaucuuugaaaauagaaccuugggugauguggugguggaagaacacacugggcugcuuuauuuuacaagcuggaugccucccucgugagaacggcagaacgagccgugguacauccgcaccguggagcguuuccaggcaucuagagaaucagagcgugaucaucaccagaaaaucccagcugacugaggacgacauggacaagcgaugacagcgugagaaacccacggugcagcaaagcgugcauaguauggucccauuucagcaaacugcugacagauggaucccucucuaugucugugucuauccgguuaagauguuggaaacagccagcccuuacuugacacuugccgagcugcuauuugaagugugacaugugccaauucugccaccuuaaaagcccuauguaggagacacuuuuauuaacuucauuuuacagaaaaguaaaaaaggcacagagaggguaagucacuugccugaaggcacccaacugggaaguggccaagccaggauuugaaccugggcugccugccuucaaaguccauaugcugggguccaccugagcugcuggaagcuaaagcccugccaaaggcuggagagaagccugggaugcugcugggacacacugcaggguaaacccaguggcuaggauuccagaucaacuccuccacgggugcaucugggcagcucaucccucccaccccuaccucauccccucucugcccacggcacaccccugcagccucucaccuuggguggacaaagccugaacuuuggcacaccagcccugauaucuccccaacuuuuuaaaaaaugccucaucccaguccugccgccaggaugugaacaggcagggguaucaaugggacccugggaacuuucugccugaagaacauucguuagugacuuccuccggcacccacccaggccccuuccacccuugcugcccgggcccuccuggccuccauccagcuagccugggacagucggccccacccagcacuggcugcuaacuaucuccguggccuugaguaaaccucugcuaccuacagaauuugguuuccaaaggaaaaauaaaagauagaacugagcuucggaacccaagucaguccagaucuaacaaucugacagcugaugaaacuuuccccguuagagcaauuaggccagguacagugauucaugaauguaaucccagcacuuuggaagaccaaggugggaggauugcuugaggccaggaguucaagaccagccugggcaacauagcaagaccccugucucuacaaaaaaucuaaaaauuagcugggcaugguggugcacaccuguagucccaguuauucaggaggccaagguaggaggaucgauugagccugagugguugaagcugcagugagccguaaucaugccacugcacuccagcuugggugacagagugagacccugucucaaaaaaucuaaauaaauaaauaauaaagggugggcacuguggcauaugcuuauaaucccagcacuuugggaggccaagguggguggaucauuugaggucaggaguuccagaccagccuggccaaccuggugaaaccucgccucuacuaaaaauacaaaaauuagccggguguaguggugggcaccuguaaucccaacuacucaggaggcugaggcaggagaaucacuugaacccgggaggcggagguugcagugagccaagaucaugccacugcacuccagcccgggcgacagacugagaccaugucucaaaaaaauaaauaaauaggccgggcuucguggcucacaccuguaaucccagcacuuugggaggucgaggugggcggaucaccugaggucaggaguucgagaccagccuggccaacauggagaaacccugucucuacuaaaaauacaaaauuagcugggcacaguggcgcagccuguaaucccagcuacuugggaggcugaggugagagaaucgcuugaaccugggaggcaaagguugcggugagccgagaucacaccauugcacuccagccugggcaacaagagagaaacuccgucucaaaauaaauagguaaguaaauauaaguaaauacauacauaauaaacagcugguaagcuacuaccuccucaagaggccuugguaaacagaauagucagccaaacaaaauaaucucuaauacuguaacagccagagacagugaaaggcaauguggggaugaagugggaagcuaccugggggcaaaggggcucagccccauuuuugcugccuauggccgccucuucccccgacaacagccccuccuuuuugccuuuugggaaccacccuacuccuaccugagucucugugggcaagaacuacuucccucccuggcuccaaaugggcaggcgacccaaggcugaccaaucacagcaguccauuacucgagccacagcaauugguccaaggaugcacaugugaucccagcucagccaaucacagccaaugagcauugacuccauaaguugugccagccacugagaaaauucuuuaauucuccuucaauaucccucaggaagguucccuuccaagagcuucugggaauuccaaagcagucaguuucucccugacguggugcagaugccauuuauuuucuaagcgucagaggaagccacuggcaagugagacuggggcguacauauaaaaacauaggaaucuaauucuagaaucgcauucagccuguccagaugcccugucacgggacccaggaagaacagcagggucacaagaaacucacucccuacauugacacuaaccaagucuacuuaugagggucacugcuguuuuccuuuuuuuuucuaauugaaugcauguagaugauuuugcaugaaugacaugcuuaugggccacaccuccacauuccugcacggagcaaaaucacaagcagaauggaccucggucuccugacucagccucgcacaguccugcuaaugagaacaaagugaaacauaaaggauuccauuuuuuuuuuuuuuuuuuugagauggagucucacugucaccuaggcugaagugcaguggcgcgaucucagcucacugcaaccuccaccucccgaguucaagcaguccuccgccucagccuuccaaguagcugggacuacaggugugugccaccaugcccagcuaauuuuuguguuuuuaguagagaugggguuucaccauguuggccaggcuggucucgaacuccugacuucaagugauccacccaccucagccuccuaaagugccgggauuacaggcaugacaccuguaauccuaacacuuuaggaauaauguaauaauggcgcccggccuauaaaugguuccauucuaaauaaugaaccuuggcuuaaaugcucagggagagaaacacucccagccccagccccauccaagacaccugaugggaccaagaugccaacaggaggaucccugcuuccuccuggaggcaggagguggccccagaaacagccuccacgcuuccuguggcccuuccaccaugacaggugcugucucuuuacccaccauccacagacagccccgaugacaucuuuauacacccgcaucccuuccuucuggcuacuccaccuucaugcuggggcaggaaaggggucaaucaaaagccaccaaagcucagacagggaaacagcccagcacuggaaccaggcagaagucauugaaauccagauggaguguguuaagacucaggccuacaaucuguggaugcaucccagggacccaggcuuugggguguuccccagggcguaugaccucccuuaccccucgcuacagcccgaggagggaggcccggagaaacacgcccggcaggguuaugcaacucacccacagccacagagacaggaagugcaagagccacugcugaacucagggagucugguuccaaaguccacgcugcggaggacccccacuggggccucucugccuuagcccaagguccuacgcuaggugguucucugcccuggacaagggucuccaacuauggaaugcagccaugaacgagacagauaaagucucuguccucauggaacucacacaaguggaugagauaauuucagagacuauuaagggcucagaagggaauagcauggugugguuauaacacagauggcgcaagccaggcgcgguggcucaugccuguaauccaagcacuuugggaagcuaagacagguggaucaccugaggucaggaguucgagaccagccuggcuaacauggugagaccccaucucuacuaaaaauaccaaauuagcugggcauaguggugcacgccuguaaucccagcuacucaagaggcaaggcuggagagucguuugaaccggggaggaggagguugcagugagccgagauggggccauugcccuccagcugaaaaaccacacagauggcacagacaguggacguggggggcaacuguccauuggguggggugggcaaucacggggugucuucuucaaaagguuacauuuaagcuucaaaagguuacauuuaaacauaaaagaggaaccaagcauaagagccagggagacaaaaagacgguccaggcagaaagaaaagcacuuccaaaggcccugaggcaggacagcaugugacacguuggaggaaaaggaaggccugugagguugcaguggggugagaaugcugaguugagaugggcagggcccacgaaaaugaggcucacagcuuugauaccaaaugcaggaagauuuuauucagcuucuugaaaugauccaguuugcauaguuuuguuuuuuuuuuuuuuuuuuuugggagacggagucucgcucugucacccaggcuggagugcaauggugcaaucucggcucacugcaaccuccaccucccggguucaaacaauucuccugccucaaccucccgaguagcuggaauuacaggcacaugccaccacgccuggcuaauuuuuguauuuuuaguagagaugagguuucaccauguuggccaggcuggucuugaacuccugaccucaggugacccacccacuucggccucccaaagugcugggauuacaggcaugagccacugugcccggcccaauuugcauguuuuaaagagcauccuggcuuugauggggagaagugacaacagugugguauaaaucagcagagcaaacagccccaugaugacacuccagcauccacugggaaacaacgguggcagcucggucuggggcgacggccacggcagguggaggaguaggccccauugcccugcacaggaccacaaccugccacuggucacgaaccauccugugaaacaacccuugucuuuuaaacauccuuucaauaaauauuugagaaccugcgauuaugugcuaggcaucguuccaggggcuugggucacggcaacgaauaacacaaaggucccugcccucacaguccgacauucucauggggagaaauagacaauaaacaaucaacaugauacccagggaaguuccaggguaucuacaguggcugacaggucuaagcagagcggguaaggagggcuggcagcacagggggacaagggggaaccugcaugaugcacaaacggaaucaggggagggucuccgugagcaagugagagcugaacagagaccuacgggagaugagagggcuugugucaggagagcuaaggcgauugggcccauggggcugaggaauggccaggaggccauugugcaagggaaaagggaaugcggacgucgccagaaaaguggcagggguggauggcacaggcccugggccagguuaggaccuggcugugacuccuaggggacgggucuggccaugucagggcuuugaggggaggaggugcuaagugcaaucuugaugggcucccauggcugcuuauugagaaaccccacuggggagcaaggaugagcacagggaggccagugaggaggcggaugcaggaaucugggggagaggugauggugccuuggaccagaggugauggcgccucgggcguggugagaaguaguuggaaucuggguauauuuagaugaugaagcuagaaaacuuucugacggguucucugagggaaguggagagaacagagucaaggcugagugcaagauguuggcccgggcaacuggaagaugggggggcuaugauggagugggaagcuggugggagccacagguguggccgagggugaugaggagccagccggggcgagcgugagcugccuuugaccccgaguugagauacggacucugcuguuggacacucgggggugggguucaggggaaaggucugggcccagggauaccaauuugggaguggucaggacagagaugccauucaggcgcaaggcuggaggagcccaccccagggaugagggaugaggacacacagaaaggaugccuggagcuccaccagcaggaggcaggaggccagggagaugaggaggcaucagcaggcaagaagacagagcagccaggaaggugggaggaaaacccagagaauggagauuuaaagcgccucaaggguccuucuagaagcuuccagagaagguguaaggaacuucacccaaaaugccaggaagugaacaaggucaggccccucccguuccuucccccuccccagcacaggcaaucagugaacaggaagaaacaguggaguggagggaaagaaaacaagaaaauuaagacggccaggccuugggccaugaggcuuccuggaacccgggaccuggggagcuucugagcaggcggagugucuccauaucucacgcaggcuuugggaggaaaaucgcccccaacacccacagggagccagccccugggcccuuuaaggcuucaaagucaagaacgcagcuuuuuguguuguuuuuguuucucuuugcaagacagcuccagccuggccacuugugggccagcagagcucaaggucauguccaaacagggggagggagacgagguaaauaaaagggauucucuuuuuguuuugcguuuuugauuuuugacugagcccuagcguugaauucuccgcacaauuaaugugucuguggugucggagcugccagcgccuccuggagcagaaggccuggaccgaacucuccuccacagaauccuccaggcccaagauuuaaaccacaaacucucuggguucagccuugggggguguggcuuauggccccaggggccucucuuuugcugaccacagacauggaaucacccucuggacacuaaggaaccuccaugcaggacccacgaaugacagugccaacaagccugcagcaaaucgccacuggggccaagacucauccaggaaaaacaccuucauggagcaagcccuccauggggacucacuuccaucccauuugcuagaaaccaaaggccaggguaaggcgauuccagguggcugagcuucgccacguucuaguuaaucagggugcaucucccggcggaggcacagcaaguaccggccauuccgggaagggacagggaauguuuccuggaaaccccaggugcugggccuggccccagaaaggccaaccacagcgggacacaucaacauguaugugcagacacaucaacacacaaggacaugcauaaacacguguguucauguguguccauuugcauguacagacacaccaugugugccugugucaacauauguaggcacacaucaacacaggugucugcauacacaucaucacgucgucacacaucaaggcaggugugugcaugccuacacaggugugugugucacuguuuucaccaucagcacuuguguacacacaccaacacacgugugugcaaacacacacacacucacgaagacagggagaggcaaaucuaccaggagcaaauaaacuagacucacacaaacuaaaaauagcccauguuuuucagccgucgccagggaguaaguugaagcugucucucacaugcuagaaggaguaggaaguucaauggcaggaaagaggaagaaaaacaaaacagaauuggcacacaccugugauccaagcuguccucgaggagcccccuccccaccugugcccagugaucaguucuagggcuuugccccacauguccaaacaaggggguccuacaggaaacgcccgguagguggagacacugggccucccccccagguuccgcaggggggcugauaaaggcgcagagcgggcggccccugcaggaugggugggaguccagcccccggggucacugggagcccugggcuaggaacagguggccuccccgggagccucacuuggugccuuugauuggagaacaugucccuggucucagacuacccccggaagggagaggccagggugcacucugcaccagcaaaguuuggcggggugaugauuaggacaaagccucgaagggacccugcuguucccuggugaugcacagaaaaggaaggggcagcccaggaagagaauauaagaagggcaccccccgccgcccgccuuaagcaugcagucgaccugcucagacacacggagaaccgggaggacgcagugcgcagaggccaccgggaccagcuguggagucggcccccagacuugaaauccugauucaaccgcuuggagcuaugugacauggggcaaguuacuuuccgccucugugcauccauuucccucaauaaaauaagacacaauaguaccuauuuuagauacuaaaaugaauaaugcacauaaacacuuggaacaguauccggccacaacgagugcccauugacuguuaucucccaucaacccccaucuuuuaacugauugacaaagauuucccaaaaggcacaaacucagggacagccggugacaucccuggcuggcccuggugccggggcuccccaaggcucacuguguggcucuggcugagggaggcaggggugagcuaaagagccugaggccagggcugggggucgcgcccgccucauucauucuguaaccugacugguguugaagggguggcaaggagcucaggcgcugcuauggcccucggggacgcugcagugacagugaugggaaagccccugccucagcagauacagggguaucaggaaaaaagcaugcaggcaaagaugaccgaagguuuuugccucuaccccaggggaaacaaaaggaggugccguuuauugagacagggaucauaggugggggaagcccagcagcaggacaaggcaaccgagguugaguccaucuagaaaaccaacuuaaagacagcagaggggacccagguucucuccuggacauggaagaaggccaugaggccuaucauugaagaugguggucuuggaagaugaccccuucccugcagcccagcaguagugaggggccucuccccacguccaccagcugggccuuccuuggaggaccagagacauacgggaacuuggaugugugccccccaggaccugaaccaggccuucguuacucacccacauaccugagcacagcugcaugccaggcucagauccagggaaugggagcaagaguccccauucucauggcaucugccucugggacagacagacaccuucacacacacacacacgugcacacaugcacgcacacacauacacuagcgaggucacuuggggcaaauuacucucuucagcuugucuccuuaacggacacugaagacaauaaaucauaugucacggcccucugcagggacuaaaugagacaauuuucacaaaggugcuuugaacccugccuggugcacaguaagcugcccaugaauggaugccaugaaguucacaaucgcggcccuuagugugccuguccaaacaccucucuccaauccuacccacuggcagaagggaaaagaaaugaguugcgcuuccccaaagccucuccaagcaaccucgaccacagggccccuuugcagugugccucaucggucuguguggcgcauucaucuggccagucuuugaggaaaacuauguaucuguucauucguaauuuuuuuuuuaagagaugggauuuuggccgggcgcgguggcucacaccuguaaucccagcacuuugggaggccgagacgggcggaucacgaggucaggagauugagaccauccuggcuaaaacagugaaaccccgucuccacuaaaaauacaaaaaacuaggugggugcgguggcgggcgccuguagucccagcuacucaggaggcugaggcaggagaauggcgugaacccggaagguggagcuugcagugagccgagaucgcaccacugcacuccagccugggcgacagagccagacuccgucucaaaaaaaaaaaaaagagaugggauuucacuuuguugcccagguuggaguacaguggcacaaacacagcucacugcagccucgagcuccugggcucaagauauccucccaccucagccucucaaguagcuaggacuauaggugcaugccaccaugcaccagcuuaguuuuguuguuguuuuguuuuguagagaugggggucucacuauguugcccacgcuagucuuaaacucagggcuucaagugacccucccaccucagccccauaaagugcugggaucgcaaguuugagccaccaugcuuggccuuguaauuuuuaaucaaacacguagcauguggauacauuuucucuguuaaaacaaaaauaauggccgggcaugguggcucacgccuguaauuccagcacuuugggaggccgagaggggaagaucacaaggucaggagaucaagaccaucccggcuaacacggugaaaccccaucucuacuaaaaauacaaaaaaaaaauuagcugggugugguggcaggcaccugcagucccagcuccucaggaggcugaggcaggagaauggugugaacccaggaggcagaggcugcagugagccgagaucgugccacugcacuccagccugggcgacagagcgagacuccaucucaaaaaagaaaaaaaaaaauagcauuacagauaaaguauuagguuuccuuuggccacacccccaguguccugccuucucucauuagaguagccacuucuguuagucucaccuuuucccaaacuuuaacauauucuaauauuaagccauugaaaauaauggcagggcgcggugguucacaccuaucaucccaguguuuuggaaggccaaggcagaaggaucacuuaaggccaggaguucgagaccagccuggguaacauagugagaccuugucucuacgaaaauaaaaauaaaaauggaaagaaaauauagaauauuguuugguggguuuuuuuuaaacauaaauagcaccagagcuuuuuucaauuaguaauguguuuuuauggccuacccaugcugagacauauuucuaaguuccuucauuuuuuuuuuuuuuuuuuugagauggagucucacucuauuacgcaggcuggagggcaguggcgugaucucaguucacugcaaccucagccuuccagguucaagcuauucuccugcuucagcgucccgaauagcugggauuacaggcgugcaccaccauguccagcuaguuuuuguauuuuuuaguagagacaggguuuagccauguuggccaggcuggucucaaacuccugaccucaggugauccggugaauaaugaagacaugguucagaucccugggggcacacauccaaguucugugaaaaggacauagacaugaaauguggacaagaagccauucuuaagaaauucagucuaaagaagcaggccaaagggaaaaagaugucaacuagugugacaauauccacaucuucaccccagcucaucauugaagacagcagccucggaagaugagcaucccuuuuuugcagcccagcugcagugaggggccucucccccauguccaccagcugggccuuccuuggaggaccagagacacacgggaacuuggcuaccaaaaaaugguaaugauaaaucaguaauuaccagugauggcagagauaggggaaguagcacagucccauaccuuguggguggaugcagcaacagagcugugcagaagggcaauuuggccguaaucaucaaaacucaaacugagcacaccugcucccaaggccccacuucuagaaauccacccuauggaaauguucaugaaccacacgaagagggaugugucgggauaucgcugucauuugugacagagaaaaugaucagucaauggagaaacagguaaacaagucuauaaccauucaaaggaauaccagcagugaugaaggaaaacgcgggguagacuuauugcugagacauggaaaauuuuucagcugguaucuuugaauugaaaaacaaauugcaagauaauuauacauguucaaguucaccuacacuuaguucaaguuauguaaaauauauauuaauauguauacauacaggcuccugguacacagaaaagggucuagaaagauccacaucaaugauggugauaauagcucaggaggggaauaaaaugggggaaacuuucucucuuuuccuccauuugaacuuuuuuuuacgagcaaguauucauauauuuuauauaaagucgucccucaaugucagaggggaauugguuucaggacccccauagauaccaagaucugcagaugcucaaguccccgacauaaaaugcugugguauuugcauaucaccuaugcgcauccucccguauucuuuaaaucaucucuagguuacuuauaauaccuaauacgauguaaaugcuaugucaauaguuguuauacaguauuguuuuuaugucuuuuuuuaguuguauuguuauuuuggggggauuuuuucugaaaacuuuucaucugcaguugauugaauccacggaugcagaaccugcagacacagagggccaacuguagggacuucuguuguuaaccaaaaagcacauuaaaaaaaaaaaauaaaagcacaaggccucccauucaaguugcacacagacucauguagccaaagaaaacaccagcgggcagucccugcuuaugcgugugucucacccgccugguccccugaacacaggcucucuucuuccaugcuaaggcacuuggccgcugcuccagccugggcgguuccagaaguggccgucuugggcugggcgugucuuccugccuucacaccacucggccccaaaccaaucgccuuugggauauccacagaaggaugcugggaggcuccuguucaacuuuaagccagaugcuccuagcuccaggacaauugaggacaaugugguuuuccucuuuagaagcccaggagaggaguggggaaauuugguggugcaugcauguguggugcacacacacacacacacauccuacugacauacuuaaccugaugacauccugagaaagaaaacaccuugaaauaagcccccgaauaacugaguuggcaagacucuuuaccuggcauaaguccccacacucccauagcaagagaccaggugcucacucacagcacagggucacaugcuugaacugccugagugauagccccucuagggacccugcauacacacagugggguccuggcacugcagcagccacaaggcugucacugacacacacguuucaguaugaguaggccacagaaaaauaaagcucccucaguguaacagagaaagccucugagcugucaugggggagaagaggccauucugcugauuuuccugccauccccagagacagugucaccauccaccgggaccucuuugcagucagauuacaggcuuuggcgggacaagauuugaaaaaucaaaaauagacacaacguggcuaagaugcccuagacaacugcucacccagagaccuugagagagaccauauguugcuccaucuuuaaggccagcuagcugggucccaagaaguguggcagccagaucuaagcagauccuucauucauucacucauucauucgcucugugaaugagggaacagacaugaaauguggacaaggaaccauucuuaagaaacccaguccaaagaggcaggccaaggggaaaagacguccauuagagugacaauguccacaucuucaccccagcucugcaucuggcuagaacuuugauaagagugagccccaguuuccccuccccgccacugcauguguggguucccagggcuucaaaacucuaaauggcuuuuaguucaaaugugauacucugcaaucucccagcccuucccuaacuccaggcucauucaaacaggccacccaggcacccagggcagagucuguccgucugcagaccagcugaccgccuaaucugucucccugguugaaagggcaaugguaugcaaaguuaggaucagaggaaagaccuaaggcugcgugcacucagaggaccuugggcugcugccugccucugcaugaaucuggggagaaaagcggcuuauaguuuccagacugaaucauggaggcagugagcagggagaacagagucgcgcauucugccucugggagaggguuccuauggggagauucugggcaguggaggaugcucagcugagcaccuaccaugugagcugggcacccacgugggucucacagaagguuccuguccuccugggcucacaggauacaagcaaagugcagcucuaauuuuaccggacccugcuaccggcugcugugaaagcagacguucacacacucuugggcuccuucgggcggcaccacggaagcaaccuguccacacuccugauccgucgugggcgcccagacccuuuagggcgggucaggcgcccggguggucucccguccaggccuccccaacccuggccugcgccuccagcaaagccccuggguuccccccuagccucagucuggggcggugagggugguggggaggcgggcagcagccccucccgaagcgccuggccucccucgugcucugcggcgccaggcccgggcgccgauuccgcugcggucgcccacccaccgcaacgcgcggguccucccggcgcccagcgcccaacagcccggguccgugcgcggacccccuggggucucccucacccaccuuaaggaccugcugcuugaugagcgacggcaccaucacgaucaugacagcgcccagcacagcgcacaguagccccgcgacgcccagcgccccggcagcccagcgcgcuuuggcggagcagcccaugucugcgcgccuggggcccacccgcggcucgcagggcuccgcgccuggcaggagacggggacggcgacagagacgacacaggcggggacuccgggcacgcaggccgcagaggcacgguggauccgggacggcagcgcacgcaggagcagcccggcagguggccagugguuuuaugccccaucgccggcgccgccggaccgcccccgggcagccuugggcuucaggauuccggcggcaggggcggggccugagc

SEQ ID NO: 191530 - RNA, 42298 nt, Homo sapiens
ucucacggccggaguugguggucugggaacccacgugggcuggguuucggauugcucugcugguccggccgcuggagcgcccacccuggccuagucgccauggggaagcugcgccggcgcuacaacaucaaggggcgccagcaggcgggccccggacccucgaagggcccccccgagccgccccccgugcagcuggaacuggaggguaagacauccccggaccggggcuggauuucggagauuucccagggcggccugugcccugccuucaggacucucggguggggaucccagaggggugggauggaucaucuggaaugggggaauggguccccccauuccagaugauccaaaggagaggggcuuagugacagccuaguuuuaacaguguauauggaauacccgggauuucucucgcccucaaauaguaacauggagaauuuggcaaaaaaaacaggaguaguuccaucccuucccaugacuucgauuauaaucucuuuauaaucuccagcgacccccaaauguguauuuucagcccagucuugucugcucagcuccaggcuggcugacauuucucucagaccccuuuuuaggaguagcccuuauuacaugccaggcacuauucuaggcacuggagacauagcagaaagggagauuuuuagaaaaucccugaguuuaccugcuguauaggaggagacaggcaaagaauaaacauauagaaauuuaugcggcuauagugagcagauaaaacagaagaggccauuggguggguugcagcaucccauagaguugcuggagaagacaucacucuguuagagucaagaucugaaggagaccugaguggcugccuggagaugagagaaaaaacagggggccagggcaggucgggccuggacugcagucuuggcgaggacuggggcuuuuucucuacgggagagggcagccaugggagcauuuagagcagaggaggcgugguggugggcaccuguagucccagcuacuugggaggcugaggcaggagaauggcuugaacccaggauacggagguugcagugagccaagaucgcaccacuguacucuagccugggugagagagcgagacuccaucucaaaaaaaaaaaaaaaaaaaaaaaaguuccacagacaggcugggaguugaggcagauccccuaacaucucugugccuucguuuucacaucugcagaaugggaccaguagcacacguugagcagccuuaauccaaaauacuccaaaauucaaaaguuuuugagugucaacaugacacuuaaggaaaugcucauuggagcauuccagauuucaaauuuuuagauuagggaugcucaaccagugaauagaauacagauguuccuaaagcuaaaacaggucugguuccuagcauuucuggaaagggauauuuaaccuguaguagccgucuuaccuccuaucagaguuuuggagaugguaauuugggaaaauauguugcuuugaaaaguaaagaaagguuacagagguggggugugucccaggacaggugacaaccguuaugauggcagugacaauucaggauggcaccucaaagacagccguagacacugggcugacacuuggaacuggaccaccugagcagaggggcugaggucucucagacccagagauuuggggaaaguuguuucucacaucagaacaggacauuuccauguaucccugccuuucucaggggccagaggaaucucauaagaacaugacucagauuaccuucuuuuauuuauuuauuuauuugagauggagccuugcucugucgccuaggcuggagugcaguggcgugaucucugcucacugcaaccuccaccucccggguucaagcaguucucgugccucagccuccuguguagcugggauuauaggugcaugccaucacaccuggcuaguuuuuguauuuuuuguagagacgggauuuugccauguuggccaggcugguccccaacuccuggccucaggugauuuucccaaagugcugggauugcaggcgugcgccaccgcgcccggccccaccguacacucuuaggagaacaucaggcugggugcaguggcucacgccuguaaucccaacacuuugggaggcugaggcggguggcucacuugggggucaggaguucgagaccgccuggcuaagaugguaaaaccccgucucuacuaaaaauacaaaaauuagcuggggcguggugguacaugccuguaaucccagcuacuugggaggcugaggcgggagaauugcuggaaccugggaggcggagguugaagugagcugagauugcgccacugcacucuagucugggggacaaagugagacaccgucucaaaaaaacaaaaagagaaaaucauaguauuuuuugggggguuuucuuuuuuuugagauggagucucacccugucgcccaggcuggagugcaguggcaagaucucggcucacugcaaccuccaccucccaguuucaagagauucuccugucucagccucccaaauagcugggauugcaggcacccaccaccacaccuggcuaauuuuuguauuuuuaguagagacaggguuucgccacauaggccaggcuggucucgaacuccugaccucaagugagccaccugccucagccucccaaagugcugggauuacaggcaugagccccugcgccaagccuugagaacaucauaguauuguuaugaaaauagauuugagcucacagaucccccuguuccugugugcagacucaggaggcccccaugcaagucagggggcuugugggaggcgggaccagagcuaccucaaggagaauggggacuuaauaacugugcucucucagacaaggacacguugaagggaguugaugcaagcaacgcgcucguucuaccggggaagaagaaaaagaagaccaaagccccuccccugucgaagaaggagaagaagccucugaccaagaaggagaagaaagugcugcagaaaaucuuagaacagaaggagaaaaagagccagguacaccccacucgggcagggucugcaaguggcucuccagcauagagagagauggggggucucucuccuccugagggugucucuguggugcaacuaauagaacuuucuggaaugaggaaaauuccagugcaugguccagugcgguagccacuaaccacauauugcuguugagcacuugaaaugcagcuacuauggcagaggaacugaacugaacuguuccggagaaugucaaacuuuuuuccuuguuuuuucuucuuuuuuuuuuuuuaauuuaaauuuaauuuuuuuuucuuuuuuguuuuguucccccacccccgacaucuuuucuggcucuaccaaaccuuaaaaaaauuuuuuuuuuuugagauggagucuugcucuguugcccaggcuggagugcagugaaaugaucuuggguucuccugguaucaagugauucuccugccucagccuccuguguagcugggauuacaggcgcgugccaccacgucaggcuauuuuuuuuuuuuuuuuuuguauuuuuaguagaggcgggguuucaucauguuagccaggaugaucuugauauccugaccucgugauccgcccgccucggccucccaaagugcugggauuacaggcgugaaccaccaugcccagccaaccuuaauuuuuucauagaggaaaaaaguuugucaugggaaauucaaacauuugcaagggaaauucaaacauuugcaagaguaaagagaacaguaugaugaacucccaugugcccaucgccagcuccaacauugaucagccccuggucaaucuuggauuaucuccacugcuggucacuuucccaccucugggucauuuugaagcaaaucccacauacagugaaucuguacuaguuuccuggggaugucauacaaaugaccacaaacugaggggcuuaggacaauagaaauuuguuccuucccagcuuaggaggccagaaguccgagaucaagguauuggcagggcggugcuccucacugggcucaggggagggucauuccuggccucuuccugcuccuggcggcuccaggcguucccuuggcuuguggcugcgucacuccaaucucugccucccucuucccucggccuuuccuccgugugucucuucgaagggcgcuucucauuggauuuaggucgcgcucagauacucaggaucaucucaucuugagauccuucacguaauuacguaauuacaucuacaaaaccuuuuuccaaauagggucacguucgcaaguucugggauacgaacacgucuuugagggaggcugccauuuaacccacuauacauagcauuauauccauaaauauuucaauuuguaucucuauaaguagagacuuuuaaaaaugaccagaauaccauuagcacaccuaaucuuuuauuuuaauaucaaacaucuagcaagugguuaaauuuccuguuguuucauggauacuccucacccuuuucuuguuuuuuuuucccauuguaguuuauuuguuguuugucuuacaguuuccuaccuucuggauuuuuaaauuuuuauuuuauuuuauuauuuuuugagauggaguuuugcucuuguugcccaggcuggagugcaauggcaugaucucggcgcaccgcaaccuccaccucccggguucaagugauucuccugccucagccucccgaguagcugggauuacaggcaugcaccaccacguccggcuaacuuuguuauuuuuaauagagacaggguuucuccauguuggucaggcuggucuugaacucccaaccugaagugacccaccugccucggccuccccgagugcagggauuauaggcgugagccacugcgcccagccuuaaaauuuuauuuuaaacaugcuccucugccaucugagcuuuuuguacauuaguauuuggaucuguagcagugacugucauccggaacaguuuugcgcgccgccccccgcugccccagggacauuuggcagugucuugagacauuuugggcugugacaacuugggagugcugcuggcaucuggcggguggagccaugggaugcuguuaacagccuauaaugcacagaaaaacaaaaacuuauuuggcccuaaaugucaauagugcugagauugaggaacccugaccuggagccuucaugagaaucaaguuugacuuuuggugaggccacugcacgugggagcugugucuucacaucaggaggcuugagggucucucuccagcagccguggaugggcaguccccagagccuugguagggggaagacuuacucaccugugagcguguucuuuuuuuuuuuuuuuuuggagacaaggucuugcucuguugcccaggcuggagugcagugguaugaucucagcucacugcaaccucugccucccagguucaagccauuguccugccucagccucccggguagcugguaccacaagcaugcgccaccaugcccggcuaauuuuuguauuuuuaguagagacaugguuucaccauguugguuagguuggucuugaacuccugaccucaggugauccacccgccucggccuccuaaagugcugagauugcaggcgugagccacugugccuggucaguguguccuuuuuaaauccuauuuagggugcuuucccgcugugcuauaccuuguucuguguguguguguguguguguguguguaauacacacauagaaguguguaggcugggcgcgguggcucacgcuuguaaucccagaacuuugggaggccgaggcgggcagaucaugaggucaggagaucgagaccacggugaaaccccgucucuacuaaaaauacaaaaaauuagccaggcaugguggcgggcgccuguagucccagcuacuuggagaggcugaggcaggagaauggcgugaacccaggaggcagagcuugcagugagccaagaucgcaccacugcacuccagccugggugacagagcgacacucugucucaaaagaaguguguauaaaaccuauauguacaguuacaagaacaauaaaguaaaaacucacgaaacccucacccaacuaaaagaagccaacuggguacacccccugcacacagcauugcucaggguagcucggggaccaauucacaucagacacacaaagccgccuccuuccucagagcagcuagggagcacugcuguacaugacugaacugugcuuuauucaucuccuguugauggacaucuggugggccauaaucuucuacugugauacccugcugcagagaaccucauuuauacaaccccagauucuguaaaagggguuaaaaaagccagcuugcugugucuguugauggaagaacaccaugcaccaguagaauugcaauuugaccgccgauuuuaaagacuccagguguuaaugaugcugaaauuuuauuacagucucacuucccuucuuaagagagggucgugauggcaaaugcauaauacacucguuuccuuucccagcgagcagagaugcuacagaagcugagugaaguccaggcuuccgaagcugagaugagacucuuuuauaccacuuccaagcuaggcacugggaaccgcauguaucacaccaaagagugaguuggccaguccuuugcuaacccugcccucccuccagggcccccuagggagggcgcacagguuaugggguccucuggggguggaacauuugagaaaauaccuuuaugguggccugaguggcugaaaauucauugucauccuaaaugccucuaguggguaaaggccacagaugcugcugaaccuucugcgacacacaggacagcaaaguuucucgcuccagugaugucgguguuuuccugugguguagagucccuuguuacagcucuuccagcuuuugugcagcugauuaggccagaaauugccauuagguggucaagggcuggauuuggcccaucagcggguuugguuugguuugugucguguuuuuuuuuguuuuuuuuuuuugagacagagucuugcuuugucacccaggcuggagugcaauggcgugaucucagcuuaccgcaaccuccaccucccagguucaagcgauucuccugccucagccucccaaguagcugggauuacaggcaugcaccaccaagcccggcuaauuuuguauuuuuaguagagacgggguuucuccauguuggucaggcuggucucgaacucccaaccuugggugaucugcccgccucggccucccaaagugcugggauuacaggcgugagccaccgcgcccgacugguuugugucguuuuuuaaggcaugagugcuguuugccaauauguuagcuuccuggcgcugccauaacaaauuacugcaaacagcgguggcuuagaacaaccaagccagaagggugccguggcucauaccuguaauccuagcacuuugggaggccgaggcggguggaucaccugaggucaggaguuugagacuagcauggccaacauggugaaacccugucuccacuaaaaauacaaaaauuagcugggcaugguggcucaugccuguggucucagcuacucuggcggcugaggugggaggaucaccugagccugggagguugaagcuacagugagccgugauugcaccacugcacuccguccugggcgacaaggugaauucauguucccaccuagucucgacuaguuggacgauccggccacaccagcaguguccccaccaagcugcugacccuuaaauggccugugugccccucccacccagucccaccccacucuguggucuccucagccugugcugcucauuuacaugaggccugacuggugccugugagcacugucaguuagugacuguuuaucgagugcagagacugucccaggcucucugcuaggcccuggggauagagcagugcacagaaauaaaguccuuucucuuaaggagcuucccagugucauggcgggagauguaaucgugggaagucaucaggcgagugcaucugugucccacgcugggaagcacugagcagaaaaugaagcagggaagagcgagguggagggagaagggugagauguggggucuguguguggucagggagucucccugacagcuagugcuuaagcagaggcuuaaguggagugagaggagguaucugcaggaagggcauuucagggaguggaacagcaggugcaaagucccugaggcagaaagggguauggccuuggaguccugaccucugggauugagguggggccucugugccugaagucucugcuaucucaacaggaaggcugacgaggugguagccccgggccaggagaagaucaguagccucagcggugcccaccggaagcgucgccgcuggcccucagcugaggaggaggaggaggaggaggaggagucggaaucggagcuggaggaggagucggagcuggacgaggacccagcugcugagccggcugaggcugguguggggaccaccguggcaccucugccgccagcuccagcacccagcagucagcccgugccggcugggaugacuguuccuccuccuccagcugcagccccaccacugcccagggcccuggcuaagcccgccgucuucauccccgugaaccgcuccccggaaaugcagguucgccaccccguguuugugauuaagaaucuagguuagcgggcaaggggcgcacagagggcguccuggugaaguggggcaagggcaucccuucucugugccuccauguccccaucugggaaaggggagagugacugcgccucccuugaggcuguggcagggauuggugcgcgaggaggaucacagugcagggcgggugucuggcggcacgccuggcaggcucggggcccuggaggucggcggcaguagcuucaucgccacugcccucugaccagcgggccuggccugggcugccccgauccagacaagaguuugggcugugaaucaguugacccgaaaucaagugcugauuccccugcucuccagcucacuucccgcgcaucuguaaaaugggaauauuccggcuacugaaggggcucccccucucugugccuguuuccuuccugguacaaugagugucucacuggguugugaugacaaugaaaggauuuggggcauggaaagcccacagcccacguaggaacucuggaucccuagaggaguaauguuggccguugaauggaauugggauccugcuucuaaguacauuuuucugcuuuuauaagucuucaucaggguaagcugaccgcucuagcaaaugaccccaaagugccaguggcuucacaccacaaacguuugcuucuaggugaugucaucacccagugccaucugguggcaaggagggugugggguucugcuccgcgcggucacucaggggcuuggccuccuccaucccgugucccugccaucccuugggacuucaguuccugcuuuucuuugugaauuuuucccuauucguauccuguccauauuccuaagcaauacauaccguagguuugccuguauuuaaaaguggcaucauguccuuuacguuauuccaguuugcuuuuuuguuacucagcauuauaucuugggauacauccauguugaugcaggcagcugaggcucauuuacuuuuuccccacugcuaucgaguauucacggugugaauauagcgcaggaugaguauucuguugcuggauaguugguuguuuuagcuuuuugcuguuaucuucacugcuguuuuuguuguuuguucguuugaaacagggucucacucugucacccaggcuaaagugcagagguuugaucucagcugacugcaaccuccgccuccgaggcucaagugacccuccugccucacccucccaaagagccugggacugugggcacacgcuacuacgcuuggcuaacuuuguauuuuuuuuguagagacgggguuuugccauguugcccaggcuggucuugaacucccaagcucaggcaacucccaaacucaggcaaucugcccacuuuggccuccuaaagugcugggauuacaggcaugagcacaugacuagccuucacugcuuuuuuaaacguucuugucccucuccuaugagcgcaugugcagaaguuucucuugggcaguguuugcaaaugacgugauagccaucuuugggucaugaauugaguagcuuuuaaucuuuuuuuuuuuuuugagacagugucuuguucuguuacccaggcuggagugcaguggugugaucacaguucacugcagccucuaccuccugggcucaagcgguccucccaccucagccuccugaguagcuggcacuacagauaugugccaccaugccuggcuaacuuuuuuauuuuuauuuuuuuguagagacagagucuggcuauguugcccaggcuggucuugaauuccugaccucaagcaguccucugccuuggccucucaagucgcugggauuacaggcgugagccaucaugccuggccucauauuuuuaaaaaaaacaaauggaggccaggcacgauggcucacgccuguaaucccaacacuuugggaggccgaggcggguggaucaccugaggucaggaguuugacaccagccuggccaacguggugaaaccccgucucuacugaaaauacaaaaauuagccaggcaugguggugggugccuguaaucccagcuacucaggaggcugaggcaggagaaucacuugaacccaggagguggagguugcagugagccaagaucacacuauugcacuccagccuggacaacaagagugaaacucugucucaaaaaguaaauaaauacaacaaguggaauagaauagaauagaaauagaacaaaaauuaagaauaugagcuuguuggccaggcaugguggcucaugccuguaaucccagcacuuugggaggccgaggugggcagaucaccugaggucaggaguucaagaccagccuggccaaccuggugaaaccacauuuccacuaaaaauacaaaaauuagcugggcgugguggcaugugccuguaaucccagcuacucaggaggcugaggcgggagaaucgcuugaacccgggaggcagagguugcagugagccgagaucgcgccauugcauacaccuuagggugagccauguuucacagaacuguuccuuccauauacgauacauauaugugccuguguguguacugagucaugauauaaaauguguuucuuuccaugagucacaggaaaaaauguagaaagccccugcucuggaauauguaccuaggagaggaacugcagggccacacaucuuaacuuugagaaaauuugcaccagauuauuuaucgaaguggcugggccguuaauugagacuccugccagcaacagccgaggguucccguaucucugagagacugcucugccccaaccaagcugugccuggggaugucaguccugguguccugaaggaugugaucccugucucugucucuccuggaccauggcuccugguccccuccccagcugucagggccucuguuccccagcaggcacaucuguucagcacccaugugucagcugccaccuuccuggaggucccaucacugucuauagucuugcugcucccuaagugcugacuuccucuccuuccaggaggaacggcugaagcucccaauucucuccgaagaacaaguaaucauggaggcuguggccgagcaccccaucgucaucguguguggugagaccggcagcgggaagaccacacaggugccucaguuucucuaugaagcaggcuucagcagguaggggcuggacacaggguucucucugggucccucagugacacuggagaugcccugaaaggucgauaagagccugggcuccccaggauccaauccuggaucugcccugugcaugcugugugacuucagacaagcuacuuaaccucucugggccccagcugugagaugggaauaauagcgccuacuucacaagguugucguguggauuaagugagugaacuugcguagcacacuuaauuccuggcacguagagcuaugugcuuacuauuuucuuuuuuccuuuuuuuuuuuuuuuugagacagcgucucgcugugucaccccggcuggaguacaguggugugauauuggcucacugcaacuccgccucccggguucaagugauucuccugccucagccuccucaacagcugggauuacaggcgcccgccaccacacccagcuaauuuuuguauuuuuaguagagacaggguuucuuuuuuuuuucuuuuuucuuuuuauuauuauuauuuuugagacggagccucacucuguugcccaggcuggaguguaguggcgcgaucucggcucacugcaagcugcgccucccggguucacgccauucuccugccucagccucccaaguagcugggacuacaggcgcccaccaccacgcccagcuaauuuuuuuguauuuuuaguagagacgggguuucaccauguuagccgggauggucucgaucuccugaccucgugauccgccugccucggccucccaaagugcugggauuacaggcaugagccacugcacccggccaagagacagaguuucaccguguuggucaggcuggucuugaacuccugaccucaugugauccacccaccucgaccucccaaagugcugggauuacaggcgugagccaccccgcccagccugcgcuuaccauuuucacuguguagccugcuauuggcacuuuugacccauguguguugggguccccaagaccaugcucagguucggugauugaccggggacucccaggacucagcauguuauccugcacauggcuaugguauauuacagcgaaggacgcgaucagcagagggcagugguaccugggguguucuggggaaacccagcuccagcuuccagaguccccucccgguggacucacacaggacgcacuggauucuccaguagccaccuguggccacacaggaacuauccuccaccagggaagcuaguuagagauucaggguccacggcuguuacuggggucgccuaagcccacccugccuggcaggaacgaaauccuagacgccuaaaaggaaagcagguguccggcauaaaccacccuguuugcacaaacaggcugggcacagugggccccgcacuuacagggaauggaaggagcucuccuguuguacagguucaggcacccagcgagggccagccccgucagcagccuuucgagggagagcagcugcaggucugugguguuaauguucccacagagcugggaccagccacccaucggcuuggcggguuccugugucuggaggagcuugugcuugacuggggcaaacagagcucccagccugguucccccaggccccguuccuucuagcggcugccugguguccgcugcauggugaaugucgaaccguuuucuauguguuggccuuugggcuguuccguuugcuguuaaaaguagugcaaccuggcacuguuucccaccgccccugggugagcgccaggucaguauggcaaaucuugcuguggaacugcaugaggcuuuggcaugaacagguggggccgcgcacuguugauggccauguucuuccucccccagugaagacagcaucaucggugucacggagccccgccgaguggccgccguggccaugucccagcgaguggccaaggagaugaaucugucccagcggugagggcucuacuucccuggggcggacuauggggugguccuguggccuugcccagaugugggaagcccaggaggaggugagcagcaucugugccgagggugcuggguggagugucaccucugcauguagcacugggaaucauugugugagagaacuuuccaggaccugcccaagcagggggccuccaagcaagcuuacguccugcacagugugccgaggggacagaguggcccauccaggggcucgagaacagagcagggggccagaugcaggcagucacggagcuaguaccuagcauugccggguuaaucuaaaacucaagguucuaaaguacaaaaucuuggccgggugugguggcucacgccuguaauuccagcgcuuugggaggccaaggcgggcagaucaccugaggucuggaauucgagaccaaccugaccaacauggagaaacccugucucuacuaaaaauacaagaugagccaggugugguggcacaugccuguaaucccagcuacucgggagguuaaggcaggagaaucacuugaacccgggaggcagagguugccguaagccaagaucgcaccauugcacuccagcaugggcaacaagagugaaacucugucucaaaaaaaaaaaaaaaucuucaggcgguaagucuguaggacuugcuuuggaaagcagccuugaacaggcagauauagcacuugcuuuacaauggcugggagcauauguuuauaaugcagaggccugugucuaacauguccagcauggucuaaaauccagaaggcacaaaagagcacagagugagagccugccucaucugcccacucagcagauguuacuaggcagcaucuagugugccaggcccauccugggcucucaggacguggugguggaccagacagagccaccggcccccgggucagcaugccaguugggggacuuguugucuuuguacguuaggcucggaggacgcuaaggcagggauggaguacugggggccccuucucacccaaugcccugccuccucuccaggagcagccaccacugaccaucuccugcacguccuccuggacaauucugugcauaguuggcaugcgucuaggaaaagcugccucauucucuuuuuaacuuguuaaauauuauaaaaauuuggggacuggguggccgggugcgguggcucacgccuguaaucccagcacuuugggaggccgaggcagguggaucaugaggucaggagaucgagaccauccuggcuaacacggugaaaccccaucucuugaaaaaaauacaaaaaauuagccgugcgcaguggcgggugccuguaaugccagcuacucgggaggcugaggcaggagaauggcgugaacccaggaggcagagcuugcagugagccgagauugagauagcaccacugcagucuggccugggcgaaagagcgagacuccgucucagaaaaaaaaaaaaaaauuuggggacugggcacggcggcucacgccuguaaucccaggacuuugggaggccgaggcagguggaucaccagagguugggaguuugugacuagccugacaaacaugaagaaaacccaucucuacuaaaaauacaaaaaaauuagcugggugugguggcacaugccuguaauccagcuauucaggaggcugaggcagaagaaucccuugaacccgagaggcggagguugccaugagccgagaucacgccauugcacuucagccugggcaacaagagugagacuccaucucaaaaaaaaaaaaaaaaaaaagcguuggggggggcgcauauacauaaguagaaaggauaguauaaugagcccccagguacccaagacccaguuguaauaauugucaacucuugcccuagccuguuggaucuguacucuccuccuggccccccucccccccacuguuuagaagcaaaucuuagguaucuuauuuuauccucaauauuuugcuguacagaucugagagauaagaacuaauuuuuuuuuuuucuuuuuugagacggaguuucacuuugucacccaggcuggaguucaguggugcgaucuuggcucacugcaaccuuugccuccuggguucaaacgauucuccugccucagccucccgaauagcuggaauugcaggugcccggcuaauuuuuguauuuaguagagaugggguuucaccauguuggccaggcuggucuugaacuccucaccucaggugauccacccaccucggccucccaaaguguugggauuacaggcgugagccauuuuuuguuuuuugagauggcucuauugcccaggcuggagugcaguggugccaucuuugcucagugcagccucaaccucuugggcacaaguaauucucccaccucagccuccugaguagcugggacuacaggugcacaccaccacaccagauuaauuuuugaauuaagauaaggacuuuuugugaaacacauacagcugcaguaccccgaugauaguugccaagucugugaagucucuggaacacacuccagcccaugugcaggucuccccggugucuccuggcauagucaccauccgaggagggcucuggccgagguguucagggccuggcuccucaguugcccuuaacagcuccuucccuucccuucagaaaccaggauuuuggagggggagaguggacuggggagaugucugggacuuguuucagguugccagcgggcccugcccucaagccgccugccugcuccacggccugccuuguaguggccccguggcgacagccccagccaggcacggcucugcccuaacccgaacucugcccauacagggucgucuccuaccagauccgguaugaaggaaacgugacagaggagaccagaaucaaguucaugacggauggugugcugcuuaaagaaauccagaagguugguuguggauccuggcucacagagcaaggccagugggcaugggggcgggaugcuaggaugucaccugggauaugagcagccggcaagccaccuguugauccagcacucccacggugcugcugugugacuuugggugaguuacuuaaccucuccaagcucaguuucuugaugaguauguuggugcauuccuuagagaaucauuuugaagcggaaguuguagagugcaugcugacagcuuagcacaguggcccguaccuagaaggugcucgugaaaugugaacuuguauuuuuauugugacugacucacagaguucacgccuugccggggguguacugaaagccuguggugugcaggcucugcccugcggcggguccagacacagcccccucuugggagcuucgaguccaguugcguuuggugaggggcagcaccagacucggagugggguaccagccucaggcugagggaaaggggaggggccgcuggggcuugcccuugagcgucuucacggucccuggccucagaagcugcgucccaaggacuuuccauuuguaaaucggaaccccagcugcugccucccuagucagcccacuugggccuuggggaagcaccccaugcuuccuagggagccggccauucggucaaguggguggcacgcguguccagagagcaugcagggcccgggugggggacugcugucuggugaagaagcugugcuccgugcuggcugugacguccccuugggcagggccaaucucccagggggauggcaaaggugauuccagcccuccuggcuuugaagccacugggacuccuggggguggcaguggaugcaguuugggucuggguggccccugucuguguggcaccugcuguccaacugcccacggccccaccccacaucucauguccauuucccaccugcccucccacucugcgggcaucugaguugagcagcucaccucugaugaagagcagcugcccuuccucuaacacugucuccucaagugggaguucugggacgugaagcggcccuuggggcuuaggcuggaagggugggccucaccccggaccuccccccaggacuuccugcugcugcgguacaagguggugaucaucgacgaggcccacgagaggagcguguacacggacauccucaucggccuccugucccgcauugugacucuccgggcuaagguagcgcaggaggcgggugcuggggagccccgagcccuaggccccccccagcucugucagaggcuugggcuuccuucaccuguuccccguuguacccugggcugcugccaugagcagguaccccgagcacaaggucucccugggccuaggucuaggccuagugccagggcugugaaucuuggaacagccccugugugauccccuccccaccgccccggugccagccucauaaacugguguccuucuccccauccaaagcaagaggcucaggagaaguguugaugccuugccaggcgcaauggggcugguugaugaggccucugggccucugggaucagcagagcaggugggccugcccagccaagggccaggcucccggagcucugagaggggcuccccagggccucuuucuccaucucccugccccagccugacacaggggccugcugaguuggugggugccacccuggggcgcggcuucaugcaguaggccugucucacccucccggcggggagaggggccugcgcuccacaugugccaugagccuggccacauucaaggcccugaaaaucaacagugaacaagacgcugucuuguucuaacaguuccugcccuccuggggccuccacuucagcaaggguggcaggcaggacgcagacucagaguaugugagccagugacagacaaagccgggggcaguggagggaggacacagggcuagugagggcuucacccgaaaagugaccucugagcucaaguggaaggcugaaugagggagggagugagcggcgugcauugcagagcgaggagaagucugacuggaggagagcaaugcaaagguccugaggcgggcgucugccuggugccuuuuuucuuuugguaacaagcuuuauugggcugugauucacauuucauaucauucaucuguucaaauguacaauucagugguuuuuaguccguucacagagugugcagccaucaccacaguuuuauauuuugucacucaucaauccaacaagaaacccuaggccgggcacgguggcucacgccuguaaucccagcacugugggaugcugaggcggguggaucacuugaggucaggaguucaagaccagccuggccaacauggugaaacccugucucuacuaaaaaaacgaaaaauuagccaggccugguggcgcacaccuguaaucucaacuacucgggaggcugaggcaggagaaucacuugaacccagcggguggagcuugcagugagccgcgaucgcgccacugcacuccagccugggugagaaagcgagacuucaucugaaaaacaaaaacaaaaagaaacgcugugccuuuuaugguuuuuugugguggugguuuuuguuuuuuuuuuucgaggcagggucucauugucacugaggcuggagugcagcggugcaaucacagcucacugcaaccccgaccuucugggcuuaaggaauccuuuugccucagccucccaagaagcuggaccauggucacucuguguguaaccauuugcaaaugauuucccccagcggcugcagaauuccaugguacuuccgcaccagcagugucagagcuuccaguuucuccacauccugccagcacuugucguuuuccauuucuguuauucuagacaucccuguggguggacagugacaccucacuguggccuugguuuaugucuuugggggccaucaggaagucuagaguggccaagcagagagggugaggugggguccggaaggcacgggggugaggcagacagggacggucacuguggggcaagagaggggccugugcuggguguccugccucccacagaggugcuuuggccacuccuuagcuucuggguuugggguuucguagcagcaaaggcagcaagagcuugaagcagagcucaccaugaggccauuaggcauugcugagcggccuggggaccagggagcucccgggagcucucucccaccccccacagaccccagagaaucaggcagcucuucccugagcccccggcacagacacucagucaaucuuggugucaggugggagcuggguugggugggccccagucucagcccaccugccucauauucuaccaucaaagccugacucugaaagacccccuggaacaagccaccgcccugggagcggcaggucccacuauugacucacuuucuccaaggagccuuuggcauccagaaaggggcagagggugggggcuggaaacggggugggcagcagggcacccccaugccgauuucccaggcuucagacccaccugcgguccuggggccacggucacugagccuguccuuuugcagaggaaccugccacucaagcugcucaucaugucggccacgcugcggguggaggacuucacccagaacccacggcucuucgccaagccgccgccggucaucaagguaacacagggucccauguccucugugagcuuggauggcacaaggacgcccuggugucgggagcccccugagagaccucacuuggucacaggggggauugacagcagcuuggaggggguguuagaaaccuugauucggaauaauggggaaagggaaggcagcccugggccgaagcucgugucccccccacuccccaugccuuccugggcgucccacagguggaauccaggcaguucccagugacugugcauuucaacaagcggacaccgcuggaagacuacaguggcgagugcuuccggaaggucugcaagauccaccggaugcugcccgcaggugaggcccuggccaggucaggggaaagaagccucccuuccuaaacccucgcugaaagcacgagugugggagggcccaucuccgaguggcucagaaaagucccuugacccugccaggccucggcuuccucacuuauuccagaguguucaugacaccugucuggccuuauuccacuccaaauacuaugaggcuucagcagcuaccagaugguggagcuugccaucuguccccaucugauaagcagaaaaacccacagggcccaggccagugcuggcaggugaccauagacacuguaggggaacgggcacauccccccaagagucacggauacccuucacaguucugccuuguccccaucauaccugcuccguuacccaccucauguuacugaaauggaugugaccuuucugugugaauagauugugaucgcuuccagccagacuuuuuuuuuuugagacggaguuuuacucuuguugcccaggcuggagugcaguggcagaucuuggcucacugcaaccuccaccucccggguucaagugauucuccugccucagccucccaaguagcugggauuacaggucccacacuggucgcacacugccacgccuggcuaauuuuuuguauuuuaguagagaugggguuucaucauguuggccgggcuggucucgaacuccugaccucaggugagcugccugccucagccucccaaagugcuggaauuacaagugugagccacugcacccagccuagccagagacucuugugugccgaauuugggcccaaggcuggcuuucuucauguuagggaggcaaggagccaugggggugcuucccaacaagcuugaccucguccuucaaggaagccgagguugcugcuucgugaugcucuguccuugcucugcuuauggccuuucggggcucccauccauucucugggagacuggggcuggcaggaggugaggcuggagcuugggcagugagccuuccugcagccucaggucucagggcagccgcggcgcugucacugucgugaguguggugugcaggguuccgugugagcacgcuucucagggcuuuugggucuguuccugggagugaugcugcugggcugugcagucgccguguuuguugaacucccuggcggcagcugcuucagucugggcgugcugcccccugcucaucuaugucuguguacuccuguccucccccauuaucccuggaaccuugccucucagagcauggcuuggcaggugcuuuugcuaagcaaauguuugugagugacugauggauaacagaggggcccauucuuuccacagguggcauccugguguuccugacggggcaggcugaggugcaugcgcugugccgcaggcucaggaaggcuuucccacccuccagagcccggccacaagguaaagaggacgccccgaccagcacucugcccugagcagcugggcuuggccucgcgcucccuggcuggggugcagcuccugccucugagcuucucucuggaagcaucagcaccuuugccaucccccaccucacccccgaauaaauggccaccacugaguggccaugccuugaacaacaaagggcagugugcuggcgaccacgccggccacagacgccuuucuccccaaccugccccucucccagaaaaggacgacgaucagaaagacucgguggaggaaaugcggaaguuuaagaagucaagggccagggccaagaaggcgcgggcugagguacguggggggcuggcagggacuccuggagaguaaggcugcguuguccaggauggcagcuaccagccccauguggcugcuuagguuuaaguguaauuggaauaaaaugaaguuaaaaauccaguuccuggucaggcacaguggcucaugccuguaauuccagcacuuugggaggccaaggugggaggaucgcuugaggccuagaguuugagaccagcuugggcaacauggugagaccaugucucuacaaaaaauuuuuuagauuaauccagugcaguggcgcaugccuguggucccagcugcucagaggcugaggugggagaaccaucugagcccaggaggucaaggcugcaaugagcugugauggucccacugcacucuagccugggcaacagagugagacucugucucagaaauggaaaagaaggccaggcgugguggcuacgccuguaaucccagcacuuugggagacugaggcagguggaucaccugaggucaggaguucaaguccaaccugaccaacauggcgaaacccugucucuacuaaaaauacaaaauuagccaggcaugguggugugcaccuguacucccagcuacucugggauggcugggcuggcaggggcuuuccucuagccucugcgugaaggcaccgugggucuugugcuccgugacgguagcguaagcacucagccgucucugacuugccuguugcacuaccgaugugucaggcagcgauccagguuccucacguguguucacacaacccucccaccagccugggagacaaggucuaugauaguccccaauguuuagguggggaaauucuggcaggaagagagaauuauguggccugccccggguugcauggcccauggguguggaccggggcuuccaugcgagggcaccugucuuccugcacgugccacguccucacacccaggaucccugcagcccaggugucuaugucuuguucgccguaggugcugccccagaucaacuuggaucauuacucgguguuaccggcaggcgaaggcgaugaggacagggaggcagaaguggaugaggaagagggggcccuggacuccgaccucgaucuggaccugggggauggcgggcaagauggagguguggcccgagcaccgauuccugcucauguucauuaucucugcccugaggaugugcccagagcccuugugggccccccgggggccgggguucuagcagcuuuguccccgaugcuuccugaguucuugaaacugccuggcacgaggaggccucaaacauuugccauguugaauguaaugggggcugccaaccccuugcugagggacgcaggccuucagagccuggggguguugcccagcuccgugugcucgcaggggcccccugaaugcaggcagacccagugcccugcugugcccagccaggggcugaguggggcagcagagaguaccccaguacgggcucagccugaccccaccacaaugcugccaggacacgaggaguggagucaggcucccgggauccaugccagggguuuggaggaggagauugugcagcacagggguucagauccgguucagggcagcagagacaagagagccccugggaaccucucagcaguucccccaggcuuggccuggcuggucccaaggggagccucugcagcagggcaaagaaaggagcucugguggagcagccugggggugcagggccgcuguggccagcuccugccugugggcaucugucccggccugggugccagugaccucugcuuucccuccaggugagcagccggaugccucccucccgcuccacgugcucccgcuguacucucugcuggccccagagaagcaagcacagguaaccgugcugggccggugcccagcuuuuggggcacuuuuaagggcauuacagugggguuggucaagcccuuggugguccucuccaucugcuguuugaucagcauccccagaguuuugaggaauauugggguaguuuuggagaauagggaacccucccccaaggcacugggccccagaugggauggcuuguccuugcuacgucuccagcacaccagccuggcuggcuuuguccuugagccuccauuccacgauuucuuuucugauucugguguuuuccugccaucccuuccccgaauccuaggucuuuaagccuccaccggaggggacucgguuguguguuguggccaccaauguggccgagacgucgcuuaccaucccuggcaucaaguacgugguggacugugggaaggucaagaaacgcuacuacgaccgcgucacuggcguauccuccuuccgugucaccugggucucccaggcaucagcugaccagcgagcgggcagagcaggacggacggagcccggccacugcuacaggugggucacccaggcuccuccucagggacguuggugccgccuugcaauagccacugaggaacaagggaaggaugcugacccccaccuccaucuguaguauguuccguguccugccgggccccugugacuuuggggugcuccccagcccuuuugcuggcuuucagauacucacacuauuuuuuuuuuuuuuuuuuuuuugagauggaguuucacucuugucacccaggcuggaaugcaauggcgugaucucgacucacugcaaccuccaccuccuacguugaagcaauucuccugccuuagccucccaaauagcugggauuacuggugugcgccaccacgcccagcuaauuuguguauuuuuauuauauguauuuauuuauuuuaauuuuuguauuuuuaguagagacgggguuucagcauguuggccagacuggucucgaacuccugaguucaggugagccaccaugccuggccuacucgcacuguuucuuuuuuuuuuuuuuuuuuuuuuuuuugagacgagucucacucugucgcccaggcuggagugccguggcgugaucuuggcucacuggaagcuccaccucccggguucacgccauucucuugccucagccucccgaguagcugggacuacaggcaccugccaccacgcccggcuaauuuuuuuuuuuuuuuuuguauuuuuaguagagauggguuuucaccguguuagccaggauggucucgaucuccugaccucgugauccacccgccucggccucccaaaguguugggaucacaggcgugagccaccgugcccggccacuguuucuuuauucugcuacugaggucaggggcagcucuugagugcuguuuguuaacagcuugaucaggauauaauucacauaccauaaaguacauaauuuuaaagcauacaauccaggaguuuuuaggacagucacagaguugugcaaccaucaccacaaucaaugucagaacuucccaucaacccaaaaagaaaccccgugaccacugcagucaccccccuucuuccccgccccagccuguggcaagcaucaguccacuaguuuuugucuauagggaugugccuguugugggcaauucagauaaaugcaauaaagucauacaagguguggccccucgugucuggccucugccgcucagcacggugaguuuucaaggcucaccccggguggcaggugucagcaccccguuccuggccguggcugaaugauaucacaccauauggaugugccgaguuuuguuugucuguucaucagcugguggacguuugguuguuuucaccucuuggcuauuguggauagugcugcucugaacacucaggugcaaggauuugucuggcuccgguuucauugcucuugcaguggaaccuaagagaaccgcugggccguaugguaacucuggguuuaacuuaccgaggagccaccaaacuguuuuccacagcagcugccccauuugacaugccuaccaacagugaaugaggguuucaguuucuucacguccucaccagcacuuuuuaauuuuuuuuuuuuugagauggagucucgcuaugucacccaggcuggagugcaguggugcaaucucagcucacugcaaccucugccuccuggguucaagcaguucuccugccucagccucccgaguagcuggaaugauaggcaugcaccaccaugugcauauaauuuguuuguuuguuuguuuguuuuguuuuugagacugagucucacuguugucggccugggcuagaaugcaaugguucaaucucagcucacugcaaccuccgcuuccaggauuccagcaauucuccugccucagccucccaaguagcugagauuacaggugcccaccaccacgcccagcuaauuuuuguauuuuuaguagagauggggguucaccauguugaccgggcuggucuugaacuccugaccucaggugauccaccugccucagccucccaaagugcugggauugcaggcauuagccacggcgcccggccaauucuuagauuuuuaguagagacgggguuucaccauguuggccaggcuggucuugaacaccugccucagccucccaaagugcugggauuauaggcaugaaccaccacgccuggccagcaccaacacuuauuuuuaauauuuuuguuuugcugggguuuuuuuugagagacaaagucucacucuguugcucaggcuggaguucaguggcccaaguauagcucacugcagccuccgccuccugggcucaagcagucuucgugccucagccucccaaguagcugggaguagaggcacguggcacugugccuggcuucagguguuuuuuuuguuuuguuuuaaugugugacuauuuccugucacacacagcccugcccugguccugagaacaggugcccuuaccucacccacccccacuuuuuuuuuaauaugaaagcuucaguauuuuugagccuagcucuccuaguggaugugaagugguaucauauuguggauucgguuuauguuucccuaaugacuaaugaaggccucuuuucauguacuuauuggcccuuuaugcaucuuucuagggaacugccuauucagaucuuuugcucauuuuuuaauuagguuauuuguccuuuuauuauugaucuguaagaguucuuuaggccaggcgccauggcucacgccuguaaucccagcacuuugggaggaugaggcgggcagaucacaaggucaggaguucaagaccagccuggccaacauagugaaacccugucucuacuaaaaauacaaaaauuagcugggcaugguggcaugcacuuguaaucccagcuacuugggaggcugaggcaggagaaucacuugaaccugggaggcagagguugcagugagccaagaucaugccccugcacuccagcuugggcgacagagcgagacuucaucucaaaaacaaaaaaaguucuuuauauaauauaaucuggauauuagauccuaaucaaaugugucauugacaaauauuuucuccuaauccgugugcuguaauugugugugugugugcgugcacguguguauguaagugugugugcgugcgugcacgcguguaagugugugugcgugcacgcguguaugugugugcgugcgugcacgcguguaugugugugugcgugcgugugcgugcgugcacacguguaugugugugugugcgugcgcgcaugcgcgcguguauguaagugugugugcgugcgugcacgcguguauguaauaaauagcuuuauugcuguuccuuuugucagggcuacauguuaguuaaaaaguagaaaauuuagaaaauuuacaaagaaaaccaguaagaaguaacuguaguuaaaguguagagugcuaugcaccauccccuguuuuaaguacucuacauggaauaauaccuuuucuuuugguuuugagacggagucucgcucugucgcccaggcuggaguacaguggcaccaucuggcucaccccaaccuuugccuccuggguucaagugauucuccugccucagccucccgaguagcugggacuacagaugcacgucaccgugccuggcuaauuuuuguauuuuuaguagagauggggguuuccccauguuggccaggcuggucuugaacuccugaccucaagugauccacccaccccagccuuccaaagugcugagauuacaggugugugccgccacacccagccaguggaauaauagcuaauuaauuuucaccaauuccuuacgaggcagcugcaauuugagcugcauuucacaggugaggagaaugaggcaggaagcgguaaagcaccgugccugcugucaggugaagauccagucccaguggcaugacugaguuuuguuuguugucccgguuucugucugcccaggcuguauucaucugugguuuuuggugugaguuuuguguuuguugucccgguuucucuccauccaggcuguauucaucugcgguuuuuggugacuucgagcaguuuccuccuccagaaaucacccggaggccuguugaagacuuaauccuucaaaugaaggcgcucaacguugaaaaggucaguugcugcccccagccccgcucucagccaccccaguggaccaccucccuuucccugaggcagggagcccagagcugggucugcuggugccuggccugcggcagcugcuuacacaacagugcaucagcaggugcucccagggcuucugggcuccugugaccgcugccuccccagugcugcaucgcccguggacacccaggggauggcugucuggaauagaggcagcaggguccugcacgcuguucauguacuauccguccguggggcgugcagaacgugcugccggcucuuccuggcugcagccuucuccgacccaguccuccaguggagggggggaucccucuagggucacccucccucccccugcuccagggcaggcuaagccaggcagugccccgugccacgcugcgugcuguccugugggcguucagauccccauuuaacugaugaggaaacggaggcagggaagugaagguuuuuguccagggacacacaucuaguaagugacagaacccacauggucuccuagugccuuuuaaacaucugugcucacugauuuuucuggauguuaauauguucaaaaucauaaaaacuucagauacuugagaucaucagggagaaggugaagcccgucccacuguccgccauuugugaccugugucccaguuacguuuccaaacacauaacauccuguacuuuauuccugugguuuugugaauauugucugauauguuacacgcugcuuugggggcuugauuuuuucaccuaauaaaaaucaugggugcuggccgggccugguggcucacaccuguaauccuagcacuuugggaggcugagacauguggauuaguugaggucaggaauuugagaccagccuggcuaacauggcaaaaccccgucucuacuaaaaauacaaaaaaaaaaauuagccagggaggcugggcgugguggcucacgccuguaaucucagcacuuuggaaggccgaggcagguggaucacaaagucaggaguucaagaccagcuuggccaacaaggugaaaccccgucucuaguaaagauacaaaaaauuagcugagugugguggcacacgccuguaaucccagcuacucaggaggcugaggcaggauaaucacuugaacccgggaggcggagguugcaaugggccgagauugugccauugcacuccagccugggugacagggcgagacuccgucuccaaaaaaaaaaaaaaaaagccagguguggugacaggugccuauaaucccagcuacuugggaggcugaggcaggagaaucacuggaaccugggaggcagagguugcagugagccaagaucaugccguugcacuccagacugggagacagagcaagacuccgucccaaaaaaaaaaaaaaaaagcugggugcauuggcucacagcacuuugggaggccgaggcggguggaucacaacaucaggagcucgagaccagccuggccaauauggugaaacuccgucucuacuaaaaauauaaaaauuagccaggcgugauggugggcaccuguaguuccagcuacucgggaggcugaggcaggagaauucuugaacccaagaggcagagguugcagugagccgagaucacgccguugcacucuagccugggcgauauagcaagacuccaucucacaaaaaaaaagaaaaaaaagaaucauggaugccaaguaugugcugggcguucagcacgugugaccucagguuauccucccagccacucuaggagggaguuacuaguguuaucaccccauuuuccagaugaggagccugagacacugagacaggccugacugugggucacguggauaaaaagugucagggcugggcugggagcucaguguggcugggagcacugucgggagugccucccacaagugacaucaaguccacucuguagaaacuccgcaguggcuuccccuggcucuugagucagcuccagagcaggcccccuccugccuucccccagaccuggguuccuagcauugccuccuuaccugcgugccugcugcaggcucaccaccccgccucuagcuuuauugagauagaguucaggcaccacacagucacccauugaaagugugugggucaguaguuuccaguguguucacaaaguugugcggacaucaccaccguggccauuuucaucaccccagaaaggaagcauguacccuuuaucugucaccaccucccagcucccuggccccugugcccacuccucuccauggauuugccaguuugggacauuucaugcagauggaauccuacaaugcguggccuuugugcccggcgucuuucccugaguaugauguucucaagcuccauccgugguguagcgcgugucgcugcuucacuccuauucgcggcugaaucauuguccauuuuauggguggcccacguuuuguucaugcacuccuccauucagagacgcacagguugcuuccaucuuuuggcuauugugauaaauuuauucacguuauuauuacuauuuugagauggggucucacucugucacccaggcuggaguacaguggugugaucucggcucacugaaacccccaccucccagguucaaaugauucuccugucucagccucccaaguagcugggacuacaggcgagcgccaccacacccggcuaauuuuuguauuuuuaguagagauggggguuucaccauauuggucaggcuggucucgaacuccugaccucaggugaucuacccgccucagccucccaaagugcugggauuacaggcgugagccaccgcaccaggccaauuuauucguauuaugccucacugacuaccuguggccccuccuggucaaaugacgcucaguccucaugaguauaauagucuguuaaaaaccgaaaaaagcacccagcgggggcaaagcacagcccucagugccuagccagugcuugggacguguuuuugagugaauggaugaggugagugaguaaaggaggccuugggguuccauugggaccuggccuuugagagugccccaggccccuguguccccacuggcaugagcugagcccggagagagggguuggagggagugccugccacagacggagcaggagcaccggacuuguucuuggcauucacccugucccugccacgucuccuugugucccaggucaucaacuuccccuucccgacgccccccuccguggaagcccuucuugccgccgaggagcuguugaucgcacugggugcccugcaaccgccccagaaagcagaaagguaaggccaagagaugcagagcccaguuccugccccguucagggcccucucucccuuuugcugggccugagcugccucaagcguggggccucccagcuguggcuccagagcuccucucagagcacugccaccaccaccuccaucuccagggugaagcaacugcaggagaaccggcugagcugccccaucacugcgcugggccggacaauggccacauuccccguggcaccccgcuacgcuaagaugcuggcacugagccgacaacacggcugccugcccuaugccaucaccaucguggccagcaugacggugcgggagcuguuugaggagcuggacaggugcgagguuggcggcugggcacucagggccaagcucaguuccgacgggggcucugggcugagagucccagcuacucaggaggcugagguagaagaaucauuugaacccaggagguagagguugcagugagcugagauugugcaacugcacucuagccugggcaacagagugagacccuucucuaaaaaaagaaaaagaaaagugacacuaagacugugaaaguauguugaaaguauguuuagugcauuguguauuuaacaaaauuuacuuauagauuaugacuacaugcuaauucuuagaaugaacaauuauuuaauaauuuccuggcauccuauugcguagaucugccuuuggcagcuuaaugauaaaaggggucauuucugcagagauuucuggaagcaacuugaguuucucaagggcuugguaagucuucagcguucacaucauuccuccugaaaccgccuuucacgccaucaguuuugaccaucucucccucagcugugagccaggcuucugcugccaccaucucucguccacugugaaugguacaggcaggcccacaaugucacuucaucgacucugugagccucugcaucuugugcaaagccugcugcuucccuuagggucaaucugccuguguuuggaccaucuugucagaugacagagcagacacuaguugggaaggcaguuagguggacacuggggaaucuguugagaucuggaugguuuuucuuuguuuauccuccaccaccuccccuccccggucccacccacccuaaccaggaacuuugcuuuaggccacaucacugcaugggccauuccauaccgcagccacuaaccacacguggccucagccugugaaauguggcaguuacggcaacaaacugacuuaaaaccuuacuuauuuuuaauaguuuaaauuuaaacagccacauguggcuaguggccacuguauuggccagugcaguuccagacguuucccugugcucugcacggacagaguuuuaauuugaggaaaugagaucagaugguccuguaucuuuucagggucagugcaucugaacuucaaaagcagcuuuagccgggcaugguggcucacgccuguaaucccagcacuugggaggccgaggcaggcagaucacuugagaggucaggaauuugagaccagccuggccaacauggugaaacccugucucuacuaaaaaucaaaaagcgggcauggugauggacaccuguaaucccagcuauucgucagaaucccuugggggagaauaauaggguucucuggagaaacagaaaguggugucaguuucaguuggggucugaaggcccaagaaccaggagcaucgagggcagggaagacccagcucacgcagucagcagagcccgaagucacaccuccucugccuacuugggcccucaguggaucagauguggcccacacccacauugggggagggcaguagcuuuaugccagucaccaauucaaagaaacacccagaaauaaggcuuaauuagcuaucugggcaucccuuugcccagucaaguggacacauaauuaaccauuacauguaaggucuugaaaaccaggugucuuggccucugcccagaucuccuggucccagcaucucuaagacucccacgugaugcuagugucaaggcucuguagcguggugacugagagcucagguaugguucgaaucucucucugccauucugagcugugugaccuuaggcaagugacuguaccacucugagcuucauuuucuccaucuggaaaauggggaugaugauaaugauaauaauuggauuguugguagaauuaaaugaguuaacacaagcaaagugcuuugagccgugccugacacauauguuaaguguuaguauuauuuucagguuuggaagccacuggcaucauucauuuauucaguccacccuuggcagcuauuuaagcaguuugcagaguuuuuuauuaccuaaaaauggugcaguggccgggcacgguggcucaugccuguaaucccagcacuuugggaggccgagacgggcggaucacgaagucaggagaucgagaccauucuggcuaacacggugaaacucugucucuacuaaacaaaaaaugcaaaaacuuagccgggccugguggugggcaccuguagucccagcuacucgggaggcugagucaggagaauggugugaacccggaaggcggaacuugcagugaaccgagaucacaccacaccacugcacugggcgacagagcgagacucugucucaaaaaaaagaaaaaaaaaagaacaacagugcagcgguggcugccaauggugaauuuugagcuggaccuuaauaccuuaauuacauucaucagugaccccacaaggccucugagccugucccgaugaauaaaggaguuccccccgcugaggcccugagcgcagccgaggccccagcccagacaguauguauguguguuugcagaccagcggccagugacgaggagcucaccaggcugaagagcaagcgggcccggguggcccagaugaagaggaccugggcagggcagggggcuucucugaagcucggcgaccucauggugcugcuggguuugugcccugcccguuggaggguggcgggagggucacccaggucugggaugggucagagagagagcaugcccccucuucguuccccaggcgccgugggagccugugaguaugccagcugcacaccccaguuuugcgaagccaacgggcugcgguacaaagccaugauggagauccggcgccugcggggccagcugaccaccgcagguacggccccgugccggcacgccgcugcacccggcgggcaaccugaccugggcacuugaaauguuuaaaaaagugauccauagaguccacguuugcaaacuugcuacgcaccaaaauguauuuauaacccuaaaucaauacuuggggagcuuuuccaggaacaagggaaugugcacaugagcagggcacuaacagauucgagcugccagccugcacccucccccaccaggucgucgcucgguuucaccuuuucccuggcgauacccccugccauuuuccaucaccgcuguggccuggaccccucuucccucccacaugucccccagacccuucucaugcagaaggaugaggccuugcccuggacucuaccucagcucagcagcacaaauacuuccugccaccaacacccagggaagcuugagaggaaggaaauguccuccaacauauggcaagaggacgaugcguagagagggcagcguggacacugggucucuucugggcaggccacguucuugcacccaaggcuaguggagaauuugccuuccauuuaagcagaucccaagguuugaugccagaauugauggcucucuuccggccgauccuucucccagcgccaggugcauggugguggcccugucaccaugcucuguguccuucuggcuguggcuuuccagagcagccccauuccaggugcagcagcuuagaauugcagucagccuccagacagugcugguuacaguggcuuggugacauuagaccuuuauuguugcaaggaagagaagucacuugagucagcagcccagggcguuucucugcugccauccuccugccauucgcugugccuuccauccuaaggucaccucuugggcugaggagguaguuggaggcuuagucaccucugccuuccaggcaagagaagggaaggaugaggccagggcacccgccggcuguccuguucccguauugaacguucccaggaauuccagccgcaacuuccuucuucacaucauggaccagaacugagucugaggccaccuggguguuaggggagggcugucuccucgaagaaugcucugcugcccaggcaggauguggggcuuugucccaagggagaaggagggaaugggggggcggcugcaauccugccugcugggggcuuuggguccugcugguggccucuggggagggguugagacaagcagguggcugaggcuagagcacugagcaugguugggacuuucuaggaggucagggcagagcuggcuccgggccuugccaccaccgaccucacucuugguucuccccucagucaaugccgugugccccgaggcugagcucuucguggaucccaagaugcagccgcccaccgagagccaggugaccuaccugcgacagaucgugacggcaggccugggggaccacuuggcccgcaggguccagagcgaggagaugcuggaggacaaguggaggaacgccuacaaggugcggcccccaccgccucccugcccggguagcuuggggcaccuggugaggggcaggcgggcugggcccucagggucuggggaggcuuguucccucucagcuguggguccccacugaggaacaaguggggcuugcaguagaaucacaucuuccuugguuaguuucucccaacuuuuuuuuuuuaauaacaguuuaguggagauaaaauucacacagcauuuaaacucuuuugggguuuuuuguguuuucuagaaacaaggucucgcucuguugcccaggauagagugcaguggcacaaucauagcucacugcagccucgaauucccaggcacaaauaaccuucucgccacagccuccugaguaguugggacugcagggggcacaccaccaccuccgacuaauuuuguuguuguuguuuucuuuuuugagacagagccucacucuguugcccagauuagaguauaguggugcgaacucagcucacugcaaccuccaccuccuggguuccagcaauuuuccugccucagccucccaaauagcuaggauuacaggugugugccaccaugcccagcuaauuuuuguauuuuuaguagagaagggguuucaccauuuuggccaggcuggucuugaacuccuggccucaagugaucugcccaccucggccucccaaaacgcugggcuuacaagcaguguuacccaggcuagucuugaacuccuggccucuaggaauccuuccaccuuggccucccaaaguguuaggaugacaagugugacccacugcaucuggccugcauuuaaacccauuuaaaguguucaauucaguggguuuuaguauuuucacagaguuuugcaaccauuaucauaguuaacuuuagaacauuuuuauuacccaacaaagaaaccccacauauguaagcugugaguccccaguuccccgucacccccguuuucaugauccugcuuuccaucuguggaucugccuguucuggacauuuggcaugaguggaaucuuaacauacauggcuuuucaugucuggccucuugcacuuagugugaugcuuucaagccccauccacgccauggcaggugucggugcuuccuuuuuuuuuuuuuuuugagaaggaguuuugcucuuauugcccaagccggagugcaauggcgugaucucagcucacugcaaccuccaccucccggguucaagcaauucuccugccucagccucccaaguagcugggauuacaggugugugccaccaugcccaguuaauuuuuuguauuuuuaguagaaaugggguuucaccaacauggugaaaccagccaggcuggucucgaacucuugaccucagaugauccacccuccucggccucccagaguguugggauuacaggcgugagccauugcacccggcacuuccuuccuuuucacggcuggaucagacuccagcguguggaugggccgcauuucccggcagauggagcacucucccacuuuugcggcuggaguggauaaucagauucuucuccuggguugaaaguaugcggagccccugggcauggguucuucccugaccacaucacucuccauucucugcagaccccucuccucgacgacccugucuucauccaccccagcuccguccuuuucaaagagcuccccgaguuuguggucuaccaggaaaucguggagaccacuaagauguacaugaaaggugccgaggccugcggacagccccuugucccccgauggugacgcuaauggggguguggcugggacccuggggcagaggcauggcagccccucccacggagggugccgcuguaaccccagcuuccucccccggcccccaggcgucucuagcguggagguccaguggaucccggcccugcugcccucuuacugccaguuugacaagccccuggaggaaccagccccuacauacugccccgagcgggggcgggugcugugucaccgggccagcguguucugugaguuggggcaguguccugggcaaccugagccuccugcagccgugggcuucucggacacacgguccuguccccugcccccggacgugugugucucggguggggcagggaugggacucgggagggcagcugcaggagggucccugucucacuggcucccaccuucuagaucgcgugggcuggccgcuccccgccaucgagguggauuuuccagaggggauugaccgcuacaagcacuuugcccgguuccugcuggaagggcagguagguggcacagcggcuccagacccucaucucggguaccgugggcagcagcagcccgggccucaccccuuccuguggucucucaucaggucuuccgcaagcuggccucauaccggagcugucugcuguccagccccggcaccaugcugaagacgugggccagguacugccuucggugggagccucgcagugggcaggagggguccgaggccugaaugaccuccccggggcugccaggacaaagcaccacacacagggaggcuuaaaacaucagaagucugugcucaggucugaaggcucugcagagccacggucugugcagcggcucucggggaggguccgucuugccucugucggccuccugggcuuguggccacaucacuccagucucugccuccaucuucacguggccaucucucugugugucuuuagucucccucccuguguucuccuuauaaggacaccagucauuguauucagggcccacccuacuccaggaugaccucuccuuaacucaugacauuugcagugacccucuuuccauauaaggucacacgcugauguucuggguggacaugaauaugggauaggggagacacugggcagcucccacagagccgccaggugucagugggaggcauccugcccuccuggcccuggggacuuccucccagcuaagcagaccccugccccaucccgcccaccaccucugcuucagggcucacccuugcccucugccuccugcuucugcucuccuccugccugugguccagacccacagacaccucccccuuccuggggcugguggggccuauggugcaggggcuuggggcacuggaggcaggccugaaggugcaggcaggugccagggacucgagauggggcguggggcacagcacccgcugcugggcugucaggagccgugucagucacucagcucacguuuuccaguguggcccugucccaggcauguucucggggcugggauacagacacgaucucugucccacagcagcguugcucggccccagagggacagagcaggacaugagugaggccucggugggcaggggguggagugcgacugggcuggucggggagagccucacugggcagauucaaaggagccagggcugcagcugggcacaaaucuggaggaagguucuagaugagacaaguugcaugcacagagcagccuuggugggcaaggaauguggaccagaggcagccaggguggaugggaggaggugggaucuagagccuucugucccgggaugauuaggggaaggggacccuuugccuucucuuuuauuuuauuauuauuauuuauuuuuuagaaggccugucuagagaauuauguuuuuuugcuuuugaguuuuguuuguuugcuuguuuguuugagacagaguuuuguucuuguugcccaggcuggagugcaauggcgugaucuuggcucacugcagccucugccuccuggguucaagugauucuccugccucagccuccugaguagcugggauuacaggugaccgccaccaugcccggcaaauauuuuuggauuuuuaguagagcuaggguuucaccauguuagccaggcuggucucgaacuccuggccucaggugauccaccugccucagcuucccaaagugcugggauuacaggcgugagccaccacgcucagccaguuuguuuguuuuugagacaaguucuugcccuguugcccaggcuggagugcaguggugcagucaugguucacugcagccuccaacucccaggcucaagggauccuccuacuucagcccccugaguaacuggggcuacaggugcaugucaccaugcccagccagcucuucacccuccuggguggggcuggugggguggugaugccugcccugcuuucgggcccccagcagcagccggucugugcccuggcugccugccaccaacgugcauuccugccccacaggcugcagccccguacggagagccuucugcgagcccugguugcagagaaggcugacugccaugaagccuugcuggcugcuuggaagaaaaaccccaaaugugaguuugaccagggccagggggugggaguagacaggauggggucacugaggcaggggcuuugugcuuugugcacggucagcccuggcuuggcagaaggaucuggccccacggcugcuggccagcuuuuugccaccugaggagagucccugggcccagggucacccugacacuguccuccuucccuccccugcagaccugcuggcugaguacugugaguggcuuccacaggccaugcaccccgauaucgagaaagccuggccccccaccacuguccacugaccagaaaccuggcugcagggccgaggacugguuuggggacuggagggcuggcagcagccugucaccgugcgaccgugaccaccuggcaugggcuucguggccugcucucaggaagugggucaagcccugggaacccucauccaugagagcucgaucccguaugaagggugcugccgcccgugccaucuggcccgggggugacuuuuugaacuguuuauuauaugguggaugaugauuucaucucacgugcuggacgcuguucuguucagugugcucuuuggacuacauuaguccccuguggagcagcagggcuggagaucucugcagucccuuccccgcccgcccugccagaaggccgaggaggcacguggagggccuccuuccugcaauucuucccucuccagagucagggagggcugcccagcccuggccucacagccgucccagauguuaggugagccacugagcucuguguugaccuugaggggccuggcugggggcccccaggcuccaugccuucuugggaggguggccgccaacgccuuuccuguguuauggcaacagggagugggcaucucaucugccuguggucagcucucagacggcagggagcggagcugacguuggcugugcuuggucaccgcugccaugccgcagaggaugcgccuagcugggcuggggccacacgacuauuauguuggccuugaacggggacugcagagcccucaguuugucucccuuguuccucuguggcugaggugggagggggagggugggguaggucccccagcaagaaagagggacaggagcaccccaggcaggaccaaggagucgggaggccccugccuucuguccuccauggugagggcacagaugucuccccagagcccagcgcuggcagaauggauucugcuccuggcuuugcuucugcggcuucgguggagacaguuauggaauaaaauguuccuugcacccaga

SEQ ID NO: 191531 - RNA, 32156 nt, Homo sapiens
ggcgcagcagcggcggcggcggcuguggguaaaggcgcggcgcgcggcccccgagcgcgccaaccuugcccuagccggagcccgcugcggcccagcgcacggcccucaccccgcaucgcgaccccgcgccccgccggccgagcaugggcgcgcgcgccucaggcgggccccuggcccgggccgggcuccugcugcugcugcugcugcugcugcugcucgggcugcuggccccgggcgcgcagggggcgcggggccgcggcggcgcggagaagaacagcuaccgccgcacggucaacaccuucucccagagcgucagcagccuguucggcgaggacaacgugcgcgccgcucagaaggugggcgccgggcccgcgcccgcggucaccuugccccggucgccacgcaccuggcuaccggggccgaccugggaggagcgcggccuccggggcugcccgcccggccagcgcgcgggaagaggggguccggccugcgccucggggccugccgccugcggcccccgccgggccugaccagugcgggucugggcggccgggccucggggcgcccucuccucugcgccgcgcuucuccuuggaccuugccuccgcggucggcgcagccagagucucucccggcugcgcugacgccugccgcgcgucucauucauucauucaccgcguuugaauggcuccuacugugagccaggcagcacacuggcgcucucgguccccacgcggcugcgcccuccccagcuaccccggguuuguccuagccucgcaucccgacccacuuccccugggaccuucugccccacuccuccuccugcuuugaagauacuuggaguuguuuuuacuuuacaggaaaagaagggagcaaugcgauuugcucgguggcuuugggaaaccgagcaccuacugugugcggggccuuucgcguggagccuuuuguuuaguuuggggaggucccggauccugcagccuccugggaaggguguugagucccaggaggaucgcaggggguuuuccccaauuccugcucucuggagcuaggugcgauaggggugccauuccgggccgaaguccgccgacuagcucuugagaaggaggaaguuacuggggacaguugugugugguauugcgguuccuuugcuguucccuggggaggagggggcucuugcuugccgccagccuuccugggguuuuggagucagagaaguuuggguucaaguuggagcucuaccaguuggaugacuuuggggaagugacuucacuucuuugagcuuguuucuuuauuuguuaaauggggauaguaaucauuccccuucauugcgagguuguaauuaugacuaguugguaccuuccuggcccagaaucauggcuaaaaaguuaaaguuuucugcucauugagagggaguggggaauagaagggaauaugaaggccgaaaucagauugacugcauguucuuacuggauaacaugaaagguuaauuuguuaggaaaacaguaaguuuugaccucccucuccugugggcaggggcaccucuugcacaggugggucugugucuucauacauguaggggagagaacgcuuuguagguggccaaagaggggcaaggaagcagggcugaacgccugaaugugaaaagguugcccuggagucuggcgcgggaaaggaucaggggugugagugcagggagucucacuuacuuccucuugaugccguuucggagcuauuugaaggcagaaaucauuuguuuuagagcaaaaauaagccugucuuuuucacgcagggugaccacaggauccccaugucucaacugacggugguuccaugugacaaucuaaggccaacaaacaugaaauacgagugguuauuuaagacuuuuacuuaaauaagacaaucuguauucuggcagagcaucuccgaaucugggggucagagcucuuccugggcuaaaccgggguuugugccuuuaauagagauacuaaugauuacuaagugcuuuuguagauagaauaaucuuauguaauccuuagaaugacccugugcaguagguacuguuacuguucccauuugacagaugaggaaacugagacacagagcagugaaguggcugguuucaggucagaugaguggcagagccaggaugugaaccuaggcagaguggacauggagcccacauuaguaucucucgccuguuuuccugcuucaugaccccuucccuguuccccgagucaguacagcauccagaggcugaccugacuucuuuccuuuuuguuuuuuugagacggaggucuggcucuguugcucaggcuggagugcaguggagugaucucgucucacuacaaccuccaccucccagguucaagcgaucuuccccacucacccucccaaguaguugggauuacagguguccaccagcaugccuggcuaaguuuuguauuuuuaguagaaaagagguuucaccauguugaccagucuggucucaaacuccugaccucaagugauccucccgccucggccuuccaaagugcugggauuacaggugugagccauugcaccuggccugacuuauuuuauuuccugcugaguguagcccacacuggccaggcuuggggauauuguuuuguuaauuuuauggguuuuuuuuuaaauuuaauuaauuaauuuauuuuuugagacagacucuuacucugucacccaggcuggagugcguuggcacgaucuuggcucacggcaacgucugccuccugggcaagcaauucuccugccucagccuccugaguagccgggauuacaagugaguagccgggauuacaagugagcaccaccacauccggcuaauuuuuuauguuuuugguagagaugagguuucaucauguuggccaggcuggucucaaacuccugaccucaagugaucugccgaccucagccuuccaaaagugcugggauuacaggcguaagccaccgugcccagccuguuuugugaauuuuaaauaaaggaaaacugggucugccagcaacuguaguuuucagcaugccuggguuuacgaauuagagccaaaccugcuuugugaaguuuaaugguauuuaaaaaaacaccccauagucuuuuuuuuuuuuuuuuuccgagauggaguauugcuuugucgcccaggcuggaaugcagugguucagucuuggcucauggcaaccucugccgcccagguucaaacaauucuccugccucagcccccugaguagcugggauuacaggcgugugugccaccaugccuggcuaauuuuuguauuuuuaguagagaugggguuucaccauguuggccaggcugguuucgaacuccugaccucguaauccgcccuccucagccucccaaagugcuaugauuagaggcuugagccaccgugcccggccucccauauucuaaucuaggacuugucugaaauacaccuaugaccauccuguuuggagcaugggaacagacaugaguuugaauccuagcuguuucucacucgcucugugacccugagccaguugcuuuacuucucuuuuuuuuuugcuuuacuucucuuuuuuuuuuuuuuuuuuugagaugcagucucgcuucuucucccaggcuggagugcaauggcgagcucucggcuuacugcaaccuccgccucccggauucacgaaauucuccugcuucagccucccuaguagcugggguuacaggcagaugccaccacgaccagcuaauuuuuguauuuuuaguagagacaggguuucacuguguuggccaggcuggucucgaucucaugacuucaggugaucugccugccucggccucccaaagugccggauuuacagacgugaaccaccgugcaccacccaguugcuuuacuuaucugugucccauuuguucagaggagauaaauuggggaauuaaaggagauugguugggcugcacaaugccagggacugaauaagcauuuaguaaaugguagaauauuucuauaugaagggaauuugucugguaggagguaauagacuuguuaauuccuuuaaaaauuauuaagugaugcccuggcaugguggcucacaccuguaaucccagcacuuagggaggccaaggugggcagcucaucugaagucaggagcucgagaccagccuggucaacauggcgaaacccugucucuacuaaaaauacaaaaauuaggccaggugugguggcucacgccuguaauccuagcacuuugggaggccaagguggauggaucaccugaggucaggaguucaagaccagccugaccaacauggugaaacccugucucuaccaaauacaaaaaauuagccaggcguggugaugcaugccuguaaucccagcuacuugggagccugaggcaggagaaucgcuugaacccgggaggcggccguugcagugagccaagauugcaccguugcgcgcgccagccugggcaacgagugaaacuccgucucaaaaaaaaaaaaaaaaaauuagcugggcgugguggugcacgacuguaaucccagcuacuugggaggcugaggcaggagaauagauugagcccgggaggcugacguugcggugagguugagucgccccacugcacucaagccgggggaacagagacuccgucucaaaaaaaauuauuaagcaacuuauacacauguguucauagcaacacuuuuuacaauagcuaaaaaguggaaaugucccaaaugucuuaucagcugaugaagggauaaaaugugaugugucuguauaaugaaauaugauucagccauaaaaaggaaugaaguauugcuauaugcuacaacuuggacgaaccuugaauaaaugagagaagccagucacgaaagggcacacauuauaugauuccauuuacagcauaugaaauaucuggaauaggaagauccguagagacagaaagcagaugggugguugccaggggcugggggagggagcaaugggggaauuacugcuuaauugaucuaggguuuccuuuuggggugaugacagauuguggaacuagauaauaaugguugcaugauauugugaacgugcucaugccacugaauuguacacuuuaaaaugguuaaaauggccaacuuuauguguauaugacuacaguuuuuuaaaaaaauuggccuggugcaguggcucacaucuguaaucccaccacuuugggaggccuaggugggaggauugcuugagcccaggaguuugagaccagccugggcaacauagugagaccccaucucuacgaaaaaccaaaaccuuuggcuaggcaugguggcgcacaccuguggucccagcuacuugggagguugcauagggaggaucgcuugauccugggagguugagacuacagugagcugugaucacaccacuguacuccagccucagggacagcacaaaacucuuugucuccaaaaaaaacaaacaaaugaaaaauuucaagcaccuacuguauguggagaaaaugauuccucucaggcagaauauagcuggacugaugugguggaaacauccugaaugccaggucgagaaacuaguacuuuuuucccuugcuccuuggucguaguugcauggaauacaauuucauguaguucugaagguuaagaaacuaacuccacuucccacuaccgacccgucuaccacccccuuccccgaagcagccagauauucugaacauguauaaauauauggaucuauagaucugcucccuauuguugguuuuuguuuauuuugcacuaugcgcacuguuuuguauuuuuauuuuauuuuucccugaaacagagucucccucugucgcccaggcuggagugcaguagcucaaucuuggcucacugcagucucuaccucccgggcucaaaugauccuccugcaucagccucucaaguagcugggauuacaggucugcaccgccaugcccugcuaaguuuuuuauuuuuuauuuuuauuuauuuauuuauuuauuuuucuugagacggagucucccucugucgcccaggcuggagugcaguggcgcaauuucggcucacugcaagcuccaccuccuggguucaugccauucuucugcuucagccucccaaguggcugggacuacaggcgccugccaccaugcccagcuaauuuuuuuguguguuuuuaguagagacgggguuucacuguguucgccaggauggucucgauuuccugaccucgugauccgcccgccucggccucccaaagugcugggauuacaggugugagacacccgacccagccucauuaaacuuuuuggcuuuauuauguaugagacagauggucuuuucauuuauucagaauccaucgauauguucugggaacugccuuuugguuuuucuuuuuuuuuuuuuuuuuugccguucuauugagcuguuggguucuuuuguuuuugcuuuuuuuuuuuuuuuguaaagagguuugcauuuuuugcuguuugcaagaaaguauuuugagcaaaauaacuuugacacuuuccaguccuuuuuccccuaccaacauuuuaacagcuuuuuugagguguaauugcacuacaccucaauagacugugcguauuuaaaguguacagguugacaccuuuugacauacacacuugugaaaaauuaccacaguuaagauaaaguuucauaugauuuuuuuuuuuuuuuuuuuuuuugagagggagucucgcucugccacccaggcuggagugcaguggcgcaaucucggcucacugcaagcucugccucccggguucacaccuuuccccugccucagccucccgaguagcugggacuacagacgcccaccaccacgcccggcuaauuuuuuguauuuuuaguagagacgggguuucaccauguuagccaggauggucucgaucuccugaccucaugauugccugccucggccucccaaagugcugggauuacaggcgugagccaccacgcccagccuguuuccuauaauuuuuuauguugauaauuuuucaaaguacuaaaaugcugaaagaacagaacaaggaauagcugcaaacaucuccccuaaagucaccaguucuuacauuuccccucaaacuuuuuucucugcaaacacauccgauagacacauacacacaugcacacacauuuauuuuuauuuuuuggcaggaucauuugaaaguuaguugcagacgucuuaauacuuuuuccuacagaaccacaauaccauugucucagccaagaaacuuaaauauaguacaguauuuuguaacagauaguccauauucaaauugucuuuauagcucauaaaaaauccaacacccagucaaggacugcucaugcauuuaguguucaugucucuagucugucagaguuuccucacuuuugguggaggaagggacuuaauuaugaauuuuuuuuuauuuuuauuuuuuuuugagacggagucuugcucugucacccaggcuggagugcaguggcgcgaucucggcccacugcaagcuccaccuccuguguucacgccauucuccugccucagccucccaaauagcugggaccaagggugcccgccaucacgcccggcuaauuuuuuuuguauuuuuaguagagaugggguuucaccguguuagccaggauagucuggaucuccugaccucgugaucugcccggcucggccucccaaagugcugggauuacaggcaugagccaccgcacccggccccaauuaugcauuuuuuucuuuuagacaagcucucacucuguagcccagaauggagugcaguggcgcagucucggcucggugcaaccucugccuccuggguucaagcgauccucccaccuuaaccuccugaguagcugggcuuacaagcaugugccaccaugccuauuuauuuauuuauuguauuuuucguagagacaggauuucuccucgaaaucccuguguugcccaggcuggucucuugacuccugggcucaugcgauccucccgccuuggccucccaaagugcugggauuauaggcgugagccacuucgccuggcccaguaagggacuuuuacagcauugacauuucugaagaucacagacuaaaugucuuuuuuuuuuuugagcuauaauucauauaccauacaguuuauucauugaaagcucagcgguuuguaguauauucacagugcuguacagcugucacuacagucaguuuuagaacauuugcauuaccccaaaaagaaacucuguacccauuagcagucacuacuuuuuuccuuugccccaacucccagccuuaagcaacugccaaucugcuuucugucucuauuucugagccuacugugggcuuuucauaggaguggaguccuguacagucuggccuuuugugucuggcuucuuucacuuagccucauguuuucaagguucauccauacugcaggaucaauacuuuauuccucuuuauggcuuuuuauuuaccugaucaucaacugaugcacauuucgguuuaugucacuuuuugucuauugugaauggaugcugcugugaauauccaugugcaaauauuugugugggcauuguuuccaguauuuugcggugcauaccuaggaguccaguugcugggucauacaggaacuuuuuguuuaacacuuuggggaaccgucacccuuuuccaaggcagauguaccguuuuaccugccuaccagcauguggggccugguuuccccacauccuugucagcacuugcuauggucuaccuuuuuaauucuagccaucuuggcagacgugaaguaguauugcugugguuuugacaguccagaacugguuuuuuuuuuuguuuuguuuuuuuuuuuuuugagacagagucucgcucuguugccaggcuggagugcaguggcacaaucucugcucacugcaaccuccgccuccgggguucacgccauucuccugccucagccucccgaguagcugggacuacaggcacccgccaccacgcccagcuaauuuuuuguauuuuuaguacagacagaguuucacuguguuagccaggauggucucgaucuccugaccucgugauccacucaccuuggccucccaaagugcugggauuacaggcgugagccaccacaccuggcccagaacugucuuuugaaaugucccacaguguguauuguauuauucugauuaucuccuccggguuaggcucagacuuagcuuucauggcaagaauucugcagaaggcaucauguguccuugcugaggcaguaccauaucggggcucguggugucuguuugugccaucgcauucucguugguugacgcugaauuugaucucuggguugaggcugggcaggcccacugcgcugggggugcccuuuccccucugugguucauacguggucuguauguuauguuccagcauuuuccguucaucuggcuuuugcauuucuguguguucuucagaugcuugggaaaccucugaauggcagaaucucccguccccucucccuggcuugcuuaucaagaugccuuugcccucauggccugauuuuccauaggacccguuugcaugugccugagggugauggagguaaagcgagauuaggaugcaggaaggccauugucacccaaccccgguguuggauguccccggguguuggaugucccccgccugacugcugcaagaagagcgcugaugaaaucccaggcuugaagcaaucuuguucccucccauggaggcgauggcugggccuuguuugucugaguccucaggcauccacaguuugcucaccugguccccuuauuucaacuuuccauucugaaaauuguccaacauaaccaaagguagggagaguagagugaacccuuguucacccaggucuucccauguagcaacuuucugccauucugguuacuucuuuccuuccuaaauuuuuuugagggugccuggaauaauauuuuaaagcuaauccaauacauuaguucaccuuugcauauuucaguuagcaucuuuaacaauaaaaauuuugugaaaaucaaaaccacaauaccggccgggcaugguggcucaugccuguaaucccagcacuuugggaggccgaggcgggugggucacuagaggucaggaguuugagacuagccuggccaacauagugaaaccccaucucuacuaaaaauauaaaaauuagcugggcaugguggcgcucaccuauaaucccagcuacucaggaggcugaggcaggagaauugcuugagcccaggaggcggagguugcagugaaccaagauugcaccacugcacuccagcuugggcgacagagcgagacuccaucucaaaaacacacacacacacacacacacacacacacacacacacacacacacaacacacaauaccaucauuacagcuuauaacaauuccuuaacaucuaaugcagguccauuuucugauuucccuggcccaaaaugucuuuacaaaacuuuuuguuugaauuuguaucuaaacaaagucuacacaugaagugucuuuuaagucucuuuuuuaaauuuuuaaauuuuuuuaaaauuuuuuugagacaaggucuugcuuugucacccagacuggagugcaguggcacgaacacagcucacuugcagcuucaaccucccagguucgaugaucccccagccuucucccgaguagcuggaaccacagguacaugccaccaugcccagcuaauuuuuuaauuuuuuguagagacagugucuggccauguugcccaggcuagucucuaacucccagacucaaacgauccucuggccuuggccucccaaaguguugggauuacaggcguuagccaccaugccuggcccuaagccuuuuuuaaaaaaaaauuaacuuuauucuuuuuauaaguagaguuuaaaaaauagucuuuucuuuuagaguuauagaaaaauugugaagauaauacagggagucgccauauaccccucacccuguuucccccauuauuaacguuguauauucauguucuauuaaugaaccaauauugguacaucaauuauucgcugaagucuguacuuuauucagacuucuguaguuuuuccugccacccuuuucugucccaggaucccaucugggaucccacccgauauuugguccucaggucucccgagguccucucggcugggaguuucucaggcucuacuuguuuuugaugaccuugacaguuuucaggagcauugaucaggccuuuuucuuuucuuuucaaaucucccugugucacgcaggcuggagugaaguggugugaucucugcucacugcaaccucugccucccagauucaagcaauucuccugccucagccuccugaguaacugggaccacaguugcaugccaucacacccggcuaaguuuuguguuuuuaguagagucaagagguuucaccauguuggccaggcuggucuugaacuccugaacucaagugaucugccugccauggccucccaaaaugcugggauuacaggugugagccacagcgcccagccggucagggauuuuguaggaugcucccaauuggaauuugucugauguuuuucucauaaugagacugggugauggguuuuggggaggaagacacagaguuaaggaccauuuucaucccaucacauccaggguacagcaaaucaucaugauuuaagucacuuuuaauuuuaaugcccccaccucaugcuuuuucuuggaugccaucuuauucuguggagaaacugggucucaccccauagcaucuccaccaucugcaucuggcugggugcauccucauggugguguuucccugugucccauuucccagauccccaagaaccagugguuagaucuagaggccuggccagggaugguggcucaugccuguaaucccagcacuuugggaggccgaggcgggcagaucacuugaggucaggaauucaagaccaguuuggccaacaugguugaaaccccaucucuacuaaaaauacaaaaaauuagccagacauggugccuuacgccuguaaucccagcuacucgggaggcugaggcaugagaauugcuugaacccgugggguggggagcggagguugcagugagccgagaucgcgccacugcacuucagccugggugacagagcaagacuguuuaaaaaaaaaaaaaagaucuagaggcccgauaagauucaggcuugcauuuucaccggauuucugcuggaacugccuccaggcuuugggcuucgcuguaagcuccuguguuugugugcacugcagcccagucgccuaaacagcagacauacauuuucucccauucuggaggcuggaaaucugagcucgaggugccaggguugcuuucuccugaggccccucgucuuggcuugcagauggccgcccucucccugugucuucgaguggucuuuccucuguuuaucuggguccugcucuccuacuugcauaaggacaccagucgcaucggauuagggcccaccguaaauaucucauuucagcuuaaucaccucuguaaagacccugucuccaaauacagucccauucugagguccuaggguuuagggcuuccacauaagccuuuugggggacagaguucagcccauauuauuccccuuagggcuccugugucuccauccacacaaagugggucagggugucacacaccagagcaggcaggcccagccccacagggaacagcaaauucuccagccaaaugguucaacggcaagagaugggauccuccccgaauucacccucuccugcccggggccaguuuucaggaggggacaggugccguucuuuccaccgugagaaagaaccucugaccuacaccuuucuuagcacugcuaggagcuccucaggcacgccagcuucucaggcauggcaguuuucagagcaccugccugucagcuuguguuacaugggaggugacugcucagcuugcagggaguuccagguugccacccugcaacccaugaaucugacaagaaccaccucagcugcuccgacacgcugggcaccugccgugugcugggcgccacgccgaggucuuuacagguucugcucuugaauccucucuuagucccauuucucccacagcagagaaaacugaggcacagagagguucaacagugugagcaggaaagucucuuccucccagaauaauugcuuccacgcacccuuuccugggcacuugguggcauuuuaaaggccugcuacucuuuucucacaaaaaccuuucuuuuucccuccauuugaacaaauuauagaaauugcuauauauuaucugggcgcggugggucacgccuguaaucccagcacuuugggaggucaagguggguggaucaucugaggucaggaguuugagaucagcuuggccaacaugacaaaacccugucucuacuaaaaauauaaaaauuagccagguaugguggcacaugccuguaaucccagcuacuuaggaggcugaggcaggagaauugcuugaauccacaaggcagagguugcagugagccgaggucgcaccacuguacucuagccugggugacagagugagacucugucuccgccccccccaaauaaauugccauguauugacaaacauguacaagucacacauacuuuaaauaauuguagguugagcacgguggaucacaccuguaaucccagugcuuugggaggcugaggcaggcagaucaccugagguuagaaguucgaaaccagccuagccaacauaggaaaacccugucucuacuauuuuacaaaaacuagccaggcuugguggcaugugucuguaauuccaguuacucaggaggcuaaggcaagagaauugcuuggaccugggauggggagguugcagugagcugagauggcgcuaaugcacuguagcccaggugacaaagcaagacucugucucaggaaaaaaaaauguaacaggaagagcugggcauguagcagcugccuguggucccagcuacgugggaggcugaggugggaggauugcuugaacccaggaguuugagacugcagugagccguaauuacccccacuguacuccaggcugggcaacagagcaagacccugucuccaaaaaaaaaaaaagagcguacauucuguaaucuauuuauuuacucauuauuauuauuuucugcuauuucucgauguugcuggauauguccaucguuguuuuuguugcuguggaauuggacuccauucugugagcagaucaugucuuacuacgcgucucuuccauugugcacguaugucuggccugccugcagcuuuuuagugcaguggcgcucugaaggcacaugugcaacugccucucucagucaagguccucaaccuggagugugccucagcaucaccaggagggcuguggaaacagauugcugggcuccaucccuggagagucugaggcaguggaucuggauggggcccugagagucugcauuucuggcaagcuccugggugaugcugcugcugcuaguccgggcaccaccacacucugagaaccacugagcugggauguguaccgugacauggaaucucuggaagaccucuucaugggugugguucugauucaugcuggucuucugcaggcccuccucccagaucccgccgccuacccccacccaagggaggggcagucacccuccucuucuuucuuuuuuuuuuuuuuuuuuuuuugauuuuuuugagacagagucucgcucugucgcccaggcuggagugcaguggcgcgaucucggcucacugcaagcuccgccucccggguucacaccauucuccuucuucagccuccuguguagcugggacuacaggcgcccaccaccacgcauggcuaauuuuuuguauuuuuaguagagacgggguuucaccguguuagccaggauggucuagaucuccugaccuugugauccgcccgccucggccucccaagugcugggauuacaggcaugagccaccacgccuggccacccuccucuucuuucuaaugcagcgguccucaaccuuuuuggcagcgggaccaguuuuguggaagacaguuuuuccauggacugggucgggggaugguuucgggaugauucaggcgcauuacguuuauuguguacuuuauuucuauuaucauuacauuguaauauagaaugaaauaauuauacaacucaccauaauguagaaucagugggagcacugagcuuguuuuccugcaacuagacaguugcaucuguuccuucugggggugacgcggacaguggcagaucaucaggcauuaggaucucacaaggaacauguaaccuagaucccucgcaugcaguucacaauaggguucacacuccuaugaaaauuuuuuuuuuuuuugagacagagucucgcucuguugcccagguuggagugcaauggcgugaucuugacucaguguaaccuccaccucccagguucaagcgauucuccugccucagucucucccaaguagcuggaauuacaggcgcacaacacuacacucagcuaauuuuuuuuguauuuuuaguagagaugggguuucagcauguuagucaggcuggucucaaacuccugaccucaggugauccaccugccuuggccucccaaagugcugggauuacaggugugggccaccgcacccagccaucuuuuuuuuuuuuuuuuuuuuuuuugagaugcugucucccucuaucacccaggcuggagugcaguggcaugaucucggcucauugcaaccucugccucccagguucaagcaauucuccugccucagccucccaaguagcugggauuacaggcgugcaccaccacgcccagcuaauuuuuguguuuucaguagagacaagguuucgccauguuggccaggcuggucuugaacuccuggccucaggugaucuacucgccucggcuucccaaagugcugagauuacaggcgugagccaccaggcacagccuauaauguuuucuuaagguaaauuagagauggggggggggucucauuuuguugcccaggcuggucucgaacuccugggcuaaagcaguccucccaccucagccucccaaagugcugggauuauaggugugagccaccgugcccagccucuauacuguuuuuuagggcuaaaauguugguguccucacaggacaucguggagucaauacuucuguuagaauauuggacaucggccgggcaugguggcucaugcuuauagucccagcacuuugggacgccuaggcaggcgggucacuugaggucagcaguucgagaccagccuggccagcauggugaaaccccaucucuacuaaaaauacaaaaauuagcuggguaugauggcaggcgccuggaauuccagcuacucaggaggcugaagcaggagaaucucuugaacccaggaggcgaagguugccuugagucgagauugcaccagugcacuccagccugggugacagagugagacccugucucaaaaaaaaaaaagaagaagaauauuggauguggaugucaacaggagucuugaacacuuaccaugugcucaaagcauuucacgugaauaucccauguaaagcucgcaauaaccagaugaaguagguacuguuaucuccauuguuaguggaaacccugcagccccagagagcuuaugaauauauauaauaugcucauggacacccagcuaguaagaggcagagcugggauuugaacccaugcagucgacagccuggcuugugcuuucucagccacagugccaccucugagguuauuggcauuuucuacucuccuggucccugauucagcccugcucuuaucuccucuguccuguaggaaccauccagucaggauauccaguuuaaaaugcuguagccggccaggcaugguggcucaugccuguaaucccagcacuuugggaagcugagauggguggaucacaaggugaagagaucgagaccauccuggccaacauggagaaaccccaucucuacugaaaauacaaaauuagcugggcaugguggcgcaugccuguagucgcagcuacucgagaggcugaggcaggagaaucacuugaaccugggaggaggagguugcagugagccgagaucgugccacuugcacuccagccuggcgacaaagcgagacuccaaauaaaauaaaauuaaauuaaaacauaaaauacuguagcugcccgggugugguggcucacgccuauaaucccagcacuuugggaggccggggugggcagaucaccugaggucaggaguucaagaccagccuggccaacauggugaaaccccgucucuacuaaaaauaugaaaauuaccugagugugauggugcgugccuguaguaccagcuacucgggaggcugaggugggaggauugcuugaacuugggagguggaggcugcagugagccgagaucauaccacugcacuccagccggagugacagagcgagacccugucuuaaaaaaaaaaaaaaaaaaaaaaagcuguagccaauucacggaggcauuuacccuucacacgugagccgaguggcccauguagguggguucuauuauggcagcacucugcgugaugcagcccugcagagucccagcccccauagauaccuuggucagcccuuacaagggaaggggcguguuuuacucaguuuugcucaguuguugggcugucaucaauuaguaucaaguucaaguuaauccccugggccaguagaccacuugguggcauucaucaugggcucgcuguuuuuuccccuguaauagccaaggcuggaaaccauguagguauccaugaguaugggccuggcuccagguguaccauguuuaaaaaggaugaggcagcucuguguggucugagugugaguaucuccaagacagaguguugcaugagcaaagcagcucagcuguacaccugugcugccauugcagaaagaauaugucugugccauuauucaccuggcacgucuaaggaaggguuccuccggagggggauuccaguugccaggaaaugagagggaaggcuuagucuccacugaauaccuguugguaggcuugaguuuuaugcuacauguauacaauaucacuaauuuuuuaaaaaaaaaaguuaaaaugaggcuguaccuuguauucauguuucuuuagcccugugucaccuggagggcaaauaaagaccucagaggcucaggguccuuagaguuggauagagcauggggcuguaucauuaccagcuuccuuggagcagaaacuuccacucuuuaaaaaugagaaacccgcagggugcggugcaguguuucacgccuauaaucccaggacuuugggagggccaggcaggaggacugcuugaggcuuagaguuugagaccagccuggacaacauagcaagagcccaucucuacaaaauaauaauaaagccuggugugguggcugcaccuguagcccuagcuacuugggaagcuaaggcaggauugcuugagcccgggaguuugagggugcagugagcuaucauugcaccacugcacuccagccuggucaacagugagacccugucucuuuagagaaaucaggcagaggaaggcagagauccugacccaagaggaagcaugaaagacagcaggagcaauggcaagcggcguaacgcggcccugcagagagucccagccuccauaggugccuuguucagcccuugcaaggaaggggucguuuucaccaguuuuucucaguuaggcugugaucaguacccaguucaagucaauccccugggccaguaguccacaugugugguauucaucaugggcucacuauuuuucccuucccagguauaaacucccaagcuccccaguucacugcuugacugauggaggaaaacagugauugggugaugaccguuuucuuguuucugcaguucuuggccaggcugacugagagauuugugcugggaguggauauguucguggagacacuguggaaagucuggaccgagcucuuggauguucuuggacuugacgguagguguagggguggcauucacguaaggugucauucuauuuuggugguucucauaguguggaacugguacucacagugaguaauacaugagaagguugcggagggcuggucagugaggauaugagugaacauuuuuuauuuuaauagucucauauauaggccaggcaugguggcucaugccuguaaucccagcacuuugggagaccaaggugggaggguugcuugaacccaagaauucaagaccagccugggcaacauggugagaucccaucucuauaaaaaaaaaguacaaaaaaauugcugggugcagugaugugcaccuguaguccccauccacuugggaggcugaggcaggaggauugccugagaugaggaauucgaggcugcagugagcuaugaucaugccacuguacuccagacuggacgacagagcaagacuccucucaaauaaucauaaaaauaaaaaacaaauggcccaucaaagcugagauuucccagaugccacuuaggauaaggugcgacuggguagugggagugccaauuugugugcaaaacacauggaccagagguauagugcucuggcuuacuggcauccgugcaagaaaugacuaguuauuuaggcagaaggggauuucaugagacagagacacucacagaaccaucagaaaggcugaggaagagaugcauggccucagacacugccgaacuggcuguccaggguugcagcuguugaaaccguugaguucgaagucacacaacuguaguauaauuugaggaccaggaggccacugcugccgccacaacaacuagacuuugcaugugggugcagggacccuugccauuucuggaaccaugcauaucagcugcaacacuucacuuaauuuccaaagucguguguguaugggggaacugccagguggaacuuacuuucuguccagucccuagcugcgagggaggcaggcuaaugcgguucuuagcucuccagcuucugccauccaggaaggcagccugggagcaggugucaccugaugcugcaccagcccauccaccauacccaccgcacagggcaagaauugccaggggagcuggccccugguuuugugggcuaggggaggaggguaguccaguuugauagugcagugcuagucacacguuuauaaucaggaagagaacauuggugaggcacggccccucccuuucuacaugugggagggggcacugauacuggucuuggcggauggcaaggcagcaacggucaugguaacugagcugggcacuccuaguccaguccugcagccugugcuacccccagccuuacacuccccuucccagguggcucugccccaccuccaccugcauuccaucggugggugacaggagcuaacccgggcagagugcccaggguguacagcuuuuauacccagaggagaccuugucccuuaccgccuuaagagcuucagaggcaucccaugcucucaggaugaaguaaccuucccguuuucucuaccgugccccauggugugccagguaaacagggaucuccuagcugcccccgcuccacugcucuccuucuguccacaagguggaggccgcucuuccccugggccuuuccagaggaaauuccccagcugggcucuuuccagccccaccgcccuggucccuggucccagcugccaccugucucacgggaaggucugcaguugcugcauguggcaggguuccuaagaccaucuacaggcucaccgguucccuaggagcacuggcaggacucagcauauaguuguccucacagccgugauuuauugugacggaaggacgcaaacaccaucagcaaagggaaaaggugcgcgaauucccgggcaggccaggcccaagcuucagaguucucucccuguggagucauacgggacacacuuaauucccccagcagagggugcccaccaaggacucccugcccaggcuuuuuacugggggcuggucauguagucacccucugcuugacacgugucaaaauucuagacucccagagggaacgcagguguugucauaaaccacaucauuugugucaacagccuaggccuggcaucuccaggcugcacucuggccccagcucugcaccuggcacaaagaggcccuuuuuguuuguuuuuguuuaggaucucacucuguugcccaggcuggagugcaguggcucaaucacagcucacuacagccucaacuuccugggcucgugauccucccaccucagccucccgaguagcugggaccacaggcccaugccaccacaccuggcuaauuuuugaauuuucuguagagacagggucuuaccauguugcccaggcuggucucaaacucuugggcucaaaccauucuacuguuucagccucccaaagugcugagauuguaggcgugagccaccacacccagcccacccuugguuaauaagagcaggagggcugugggucccacugcuuagccagucaugugggcugaaaugugcuccucaagaauauguguuccaguccuaauccuggaccugugagugagcccuuguuugggaguggggucugcagaugugauaaaguuaaaugagaucgucuuggauuaggguggacccucaguguaaugauugcuguccuuauaagaaguggggaauuuggacacagaaacaccaagaaacauagggagaagacggccaugcgaaaugagaaacagggacuggagggacggagccacaagccaaggaacacugggaccaccagaagcuggaagaggcgaggaaggauccucccuugaacuuucagagggaguguggccccaccaagaccuugauuucagacuuccagccuccagaaccgcaaguggaugaauuucuguuguaaaccacccaguugguagugguuuguugcggcagucacgggaaaccauuauaccauagcccuguuacaugcggaaucucucagcagcgcccauuggugcuugacacccagagaugggggagugggguccacuggccaugaugggcacacugguucauaccuguugacaccccaggccauucagaaaugucuccagccuuaauucauugaguucaaccuuuaagaggccuuaggccaacucagucaccucacugcucagacaaagaaucagaggcgucagcauagccagaggacacugugcaccuggcagcccccuggggccacucauggccccuccagggacuuggcagaguuaacgcacccucccccagaugcagccaccgcgugcaauccucuuagcuuccguauccaccaccugcccggauugucaaacucucuguguuuucgucgccacccauugaacccuggagaaacaaaccugauugcagaaaaucgcacgcagcuuggaaugaaaaacuacagaguaggaacagccuccuaaucauauggaagaagcccagaauagaggcaucggcagcggauccacgagcccugaaugccugcauucaucaggggagcagcuggcgcguucuggaggcgaaacgagcuugcuuccgugucgaagcuuuucuaguucuguuugaugcguaagcuucaaggcauccgaagcccuuuggaauucgugucuuaugcguagaaguuugagugcaaaaugcuuuacaggaagccauacaccaacguuggauauucugguaaaaaagguuucugugagcacaauucuauaauuucuuucuucaguguuuuuuuuuuuuuugagucugguuaaaaugggaacucuguagccccgaauggucuaauagcaaaaaaaugugagcccccuaggugaugugaaguuuucuaguaaccaugucaaaagaguaaaaagaaauggugaaauuaguuuuucuuccuuuuuugggggggaggggguggggagugggggguaggagggacgaagucucacucuauugcccaagcugaagugcaauggcgcuaucucggcucacugcaaccucugccuccuggguucaagugauucuccugccccagccugccaaguagcugggauuacaggcaugcaccaccacacccggcuaauuuuucuguauuuuuaguagagacaggguuucacuauguuggccaggcuggucuugagcuccugaccucgugauccgcccgccucagccucccaaagugcugggauuacgggcaugagccacugcgcccagccuuuuuuuuuuuuuuuuuuuuuuuuuuugagacagagucuugcucuguugcccaggcuggagugcaguggugcaaucccagcucacugcaaccuccaccaacccaggcucaggugauccucccaccucagcuucccaacuagcugggaccacaagugugcaccaccacaucuggcuaacguuuguauuauuauuauuauuuuuuuuuuucugagaccgaguauugcucugucgcccaggcuagaaugcaguggccgaucucaucucaccacugcaaccuccaccucccggguucaagcaauucucgugccucagucucccgaguagcugggauuacaggcaccugccaccaugccuggcuaauuuuuguauuuuuuuuuaguagagaugggguuucaccaucuuggccaggguauucucgaacuccugaccucaugauccaccugccucggccucccaaagugcuaggauuacaggcgugagccaccgugccccccuaauguuuuuuuuuuauagagaugggguuuugccauguugcccaggguggucucgaacuccugagcuccagugaucugccugccuuggccucccagagugcugggauuacaggcaugugccaccaugcccaggugaaauuaauuuuaauaagauauuuuaguuaacccaauauauuaaaaacaacuuauaauuaauagaaaauuaucaggugucucacaguuuuuuggguaacuaaggccuuugagacagucucuauuugacacuuagagcgcacaucaguucugacuugucacauuucaagggcucagcacacgauagauggcacagccuuuguccccauucuagaucugcuggcacagagcacauguccaggaguuggaaggauggcuuagaaggauggauuuaaggcucaugucuucaucguguugcuuaccccucugaagcugcugaggccacuuccaacaaaguuuccaguaaacuggggaaaauaggaaucgugcuucagugaugcgucggcacagggcagggguuguguggcuccggaaacuggauccccugguuccaaaucccagcucugcccuguccuagcugugggacccugggcaaggaguccuuguguggaaaaugcuguuuacccuaucagcgagucaugaggacuggaugacuguguguguaggguggugggauggcgcccagcccauggucgguauucaguaaacacucgggggcuuacaaaggggcccuccuucaaaauguacaucacugugcaguucugggaccugccaaucucacuucuccacacugaggggcggcuggccagcugcacccagagccagcuuccccugcugcagccaucaggacuugacaagugugcagguguaaacccgacccacgcugaggaacaaguuggccaccaaaacauucacuuugcuugaacagugccuguuaggaguugaauuguguguccccguauucaucuguuuuaucuguugaaguccuaacccccagagccucagaaugggaugcuauuuggagauggggucauugugggugucauuuguuaagaugaggucauacuggaguagggugagucccaaauccaaugugaccgguguccuuauacgaaggggaaauuuagacacagacacacguagggagaaggccacgugaaggcagaguaagagagaggagugugucuggcagucacggagugccaaggaucaccagcaauccgcagacacuaggagaggcccgggcagauucacccucgagccucuggagccagcccugcugacacgcuguucacagacuuccagccuccaaacaaacugagagaauaaacuucuguucuuuuuuuuuuuuuuuuuucuuuucuugagauggagucuugcccuguugcccaggcugaagugcaguggcgcuaucucggcucacugcagccuccgccuccugaguucaagcgauucuaguaccucagccucccgaguggcugagauuacaggcacaugccaccaaaucuggcuaauucuguuuuuguuuuuguuuuuguuuuuuugagacagaauguugcucuguugcccagguuggagagcaaugccgcaaucuuggcucacugcaaccuccgccucccggguucaagcgauucuccugccucggccuccugaguagcuggaauuacaggcacccaccaccacgccuggcuaauuuuuauauuucaguagagacgguauuucaccauguuggccaggcuggucucgaacuccugaucucaggugauccaccugcguuggccucccaaaguguugggauuacagacaugagccacugcgcccggccuucuacuccuuuuuagcuacuuggccauggcagcgcuagggaagucagacggugccccuuugcugucagaacgugcagggccacucguguuuucuuuaggauuuucagggccucggagugacguugcuuuggaccacccuuccuugguuuaaaggacagcuuucacugaagucaccgagagguggaaggcagggguggcauucucgucucugggcaucuuuccuggcugaucacuaucuuggccccuugaugacacgaugcuucucaaaguaugcucagaggaaccccaggaggucccugagacccuuuugguuaggaggggugacugugaguuccucucuucucccguaacaugucucugaggucagggauucaguacguacuuuaauacuuccauauauauugaugccacguuaagaugaugacauuuuagauagauuggauuaaacaaaauaucuuauuaacauuaauuccacccuuuuuuuuuuuuuuuuuuuuuugccuuuuuugcugugaguacuugaaaauuuucagugacaaacauggcucacauuuguggcugguguucuguuccucugaauucaaaaccagauuugggggccaggucuccucuaaauagcuagauaggaaagagacuggcaaacauucaaagcacugccacuguucucagagugguuuguucugcuuuagaaacaguugcuuuuugugaaaaauauuuuguguuaaccuauugucuuggucaguucaggcugcuauaacaaaauuccauagacuguguggcuuaucaacaacagacuuuuuuuuuuuuuuuuuuuuuuuugagauggagucucucucuguugcccaggcuggagugcaguggcgcaaccucagccucccggguuccagugauucuccugccucagccuccugaguagcugggauuacaggcaugcaccacuaugcccggcuaauuuuguauuuuuuuuaauagagacaagguuucgccauauuggucaggcuggucucgaacuccugacuucagaugaucugcccaccuuggccucccaaagagcugggauuacaggcaugagccaccgugcccggccuaacagacauuuucauuucuuacaguuuggaggcaggaaguccaaaaugaaggcacuggcagaugcaggcuguggggagagcccuuucuuguagacgaugccucacugugucucacaugaaggaacaaggcgguucucugggaccucuuuauaagggcacuaaacccauucaugggggcuccaccccuacgaccugaucaccuccccaggaccccaccuccuaagaccaucacuuuugggguuaggauuucaacauaggaauuuugugggggacacaaauacucaaagccuagcaucuguaauggguuguuauuugaaaaugaguuaaugauagcaauguuuuuaaauuauuaacaauggcuggacacaguggcucaucugguaaucccagcacuuugggagguugaggcagauggauugcuuaagcccaggaguuugagaccauccuuggcaacacagugagacccuguaucuacaaaaaaucaaaacauuagcuugguggugcaugcuuguagucucagcuacuugggaggcugaggugagaggaucgcuugagcccaggagguagagguugcaaugagcuaagaucaugcuacugaagucuagccugggcuacagagcaagacucugucucaaauaaauaaauaaauaaauaauaaaauuuaaaagauaauuaacaacuaauuaaaaacuaccuaauuuucugcuauggaaaauauaucaguuagguagaacccacauaaacgaaagcucuggggacgcuucaauaauacugaagagugcaaacggucuugagacugagaggucugggaaacacugguuuagccuccagucugcaggggacaggugugaaagucagcucccaagucaaccacauuuagucaaaaugcucacgaugccucaggaaggcacaguguagcaaacacacucuggcuucuggggaguccuggugaccccaagccuuuagucccagagauggcugcuguuuacaguguuggacucuagacacuggccagcugugcggagucugaucauuuuggggaacuaugagauguucacgccguaggugucguuauugaccggaggagcuccaggguugaggcuucccaucucaggccugcucuggauuugcgcuugcccacuccagaucguugugucacacuuugguccucuuuggcugggcguggugccucacaccuauaaucccagcacuuagggaagccaaggcaggcagguugcuugagcucaggaguucgagaccagccugggcaacauagcgagauccuaucuguauuugcugguuuccacacugcuauaaggaacuaccugaggcuguguaauuuauaaauaaaagagauuuaauugacucacaguuccacauggcuggggaggccucaggaaacuuguaaucauggcggaaggcaaaggggaagcaaggcacgucuuacgugguggcaggagagaggaagcaagagcgagggguaaacugccaaacacuuuuaaaccaucagaucucgugagacucacucacuuucaugagaauagcauggaggaaaccaccuccacgauccaaucaccuccuaccaggucccucccuggacacguggggauuacaauuugaaauuagauuugggugagaacacagaaccaaaccacuucacugucucuacaaaaaaauacaaaaauuagccagcugugguggugcaugccuauaguccuagcuacucgggagucugaggugggaggaucgcuugagcccaaaaggucaaggcugcagugagccgagaucacaccaucacacuccagccugggugacagaaaaagacccugucuuaaaaaaaaaaaaaaaaaaaaaagaccacagauucuugggcccacccaggaccuacugaaucagauguccuggggguggggcccagcaaccuguuuuccuaagcccuccaggggauuccuggaggaaucacacaaguuugagaacugcuugugugagaaggcuuaggauauaacucuccuugaacucauuaaacaacacugucaggaaacaaacaauugcagcaugugggaccuccugcaagaaaaccauccuggaaaaauuagacuucagaauuucaguguuucuaaaaugucaugggucucuucucaauuaauggagacuaaagugauggcaaaugcugaacgugaacugucgcuggguccuggugaggguugggaggaaacagcuauuccuggauaacugagaaauucaagugauguuauauggaauuguuaauuuauuauuuauuuauuuauuuauuuauuuuuugagacagagccucacugugucucagguuggagugcaguggcgccauuggcucacugcaaccucugccucccuggguucaagcgauucucgugccucagccucccagguagcuuggauuacaggugugcgccaccacgcccagcuaauuuuuauauuuuuaguagagaugggguuucaccauguuggccaggcuggucucaaacuccugaucucaggugauccacccaccuuggccucccaaaugcuggcaugagccaccgugcccagccuggaauuguuaauauucuuagaaugaugauaguaucaugguuuugaggugaaugaugucuuuauucuuagauguaugaugaaguaugauguguacaucuuucaaauggguuaaucuaaaaaguauguaaauagagaaugcaacauucagaauuuuuaauaauuguucagucuaguugguuucaaaaggaauauucuacuguucuuuuaacuuuuuuguuugaauuucuucaagucaggcacacagaagaugcuacucuuacauuucacugcauucuugagauggaacuucguguguggguaccaguuaggaucagguuuggcugaaacagaaauccaacauaacauuggcuuaaccaagauggacaccuauuucccucuuauaugaaaguucucagggagguggugaggcggguuugauggcucugaugcauguggugcucuggaccaaagcaccuuccauuuuauuguuccuccaugagugccuuccaaaauggcugcuccaguuccagccauuguauccauguuccagcaggcagaagagguaaaggacacauuccugcuacuuuuagggaacacauggccaaagcuuaguuauguagcugcaagagaggcuaggaaaugcuuuaauccuagguaguugugugcccagccugaaggugggcauuuguuacuauggaaauugaaggacaauuugcaggcuaugccccacuuccagagguguuuuaguaaaaggugaaaguugucuuuugagacaaagucuuacucugucacacaggcuggagugcaguggcacauuauggcucacugcagccucuaccucccagccucaagugauccucccaccucagccuccugaguagcugggacuacaggugugugcuaccacaccugucuaauuuuuuuaaaauuuguguucucuagagauugggucuguauuagucuauuuucacacugcuaucaaaacauacccgaggccaggcgcaguggcucacacuuguaaucccagcacuuugggaggcugaggagguggaucacuugaggacacuaguucaagaccagccuggccaacauggugaaaccucaucucuacuaaaaauacaaaaaucagcugggugugguggcaugugccuauaaucccagcuacuugggagacugaggcaggagaauugcuugaaccugggaugcagagguugcaacgagccaagauugugccacugcacuccaaccucaaaaacacaaacaaaaaaaccaaaaaaccugagacuagguaaugcauaaauaaaagagguuuaauugacucacaguucugcguggcucaggaaacuuauaaucauggcagaaggcaaaggagaagcaagcaccuucuucacaaggcagcaggagagaaagagagagcaaagggggcagcugccaaacacuuaaaccaucagaucucaugaaaccccccccccuccacugucacaagaacagcauggggaaaccacccccaugauccaaucaccccccacgagguuccuuccuccacacgugaggauuauaauucaagaugagauuugugugggagcacagagccaguccauaucagggucucacuauguugcccaggcuaaaggugaaagauguauaugauuugaagagaaaccaguauauggagagguuuuuaaaacucaacauggcaggucgucuuaaagggcuucccuggcugggcaugguggcucaugccuguaaucccagcacuuugggaggccgaggcagguggaucaccugaggucaggaguucgagaccagccugauuaacauggagaaaccccgucucuacuaaagauacaaaauuagccgggugugguggcgcaugccuguaaucccagcuaccccggaggcugagacaggagaauugcuugaacccaggaggcggagguuguggugagccgagaucacaccauugcacuccagccugggcaacagagcaagacuccaucucaaaaaaaagaggcuucccuguguguccucauggagcaaagugugacuauucacagaggaacuuccuugaguuccuuugguuguugcaaaggccuuuuaagccccacaggccagcucaacuauccaauucuagcuuguuaagaaaccccuggccccugcguaacgagcccuguuccucuuuucugucccgcagucuccaaccugucccaguauuucagcccagccucgguguccagcagcccggcccgcgcgcuccugcuggucggcgucguccuccuggccuacugguucuugucccugacccugggcuucacuuucagcguccugcacgugguguucggccgcuucuucuggaucgugcgggucguccuguuuuccauguccugcguguacauccugcacaaguacgagggcgagccggagaacgcggugcugccgcugugcuucgugguggccgucuacuucaugaccgggcccaugggcuucuacuggcgaagcagucccagcggccccagcaaccccagcaaccccagcguggaggagaagcuggagcaccuggagaagcaggucagacugcucaacauccgucucaaccgggugcucgagagccuggaccgcuccaaggacaagugaaggucagccggccgggcggguccacaguuaccagcacgcugucucagaaaacgaaaacggaggaaaaaaaccccaaaccccaaacaaucuuaauaaacacgacugagcaagaaaguggcgcuguguagggcuauuuccacccacccggcagcucuuaggacacauucccagaagagcggaaagaucauugacguggaacuacacacgaaguguaauuagugggggaaaaaauauuuuuuaaacaaaggauauaaccauauuuaguuguacaguaagagaaauuuaucugugcauagagcauaaaguuaauuuuuucaagcauuuaaauacaucuuuuguaagguuuuuuaauaaaggcagauugagucaaguu

SEQ ID NO: 191532 - RNA, 131429 nt, Homo sapiens
gucggcggcggcggggccggucgauggcccgggcggcggcggcggcaugcggcuccuguuccuggcggugcugcggccacacaccggcaacgcggucacggcccagcgcguucgguaggugcagggcgccggggccuacgaagccugggccgggggccggggggcggggacgcgggacccggggacgcggggcgcucagccaggcccccuccagccgcgccggggccgucccgagccgcgcgcacaaacggaugggccggugccgccugccgggcgcgcgggggucggugccuucugcguggcgcgcguguccccgggucuccgugcggccggcgcauuggccucgcgcucuccggaggggacugagcaggugaacaggcccggagccugucguggaggggcccgggaaggccucgcugcagaagcaggaugggagcaggauccgcagggaugcgcagcgggguccgcggagcucccggcgggggcgcguuuccaggccggggaccgcggugccagcccugcccucgcggaucgggucucggcugugugccggcguccgggguccuguccccgaagucccuuucccaccuccccucugcccugucuauucucgucuuccuggcugguuagcuccuucacacucaucuuuuucugccuuugucuuauuuguuuacuuguuggucuguguucuggucgcuggaacgcaagcccggcgggggcccggggaggggccgccgcguuaaucccgccgccucccacccgcacagcgggcgcucggccuguauuagccggauaaacauauuccuugaggcgaagccugggaagugccaggauuagagccugcagcuuaacagaagccguguguguguguguguguguguguguguguguguguguguguguaaaagcggacuugcuucaugaaauuucccgauuuacuucccuucugugggccuguuuccccaucaauuuauuuuuuugaaauggagucucgcugugucacccaggcuggagugcaguggcgcaaucugggcucacugcaaccuccgccuccuggauucaagcauucuccugccucagccucccaaguaguugggauuacaggugugcaccaccacgcccggcugauuuuuguauuuuuaauagagacaggguuucaccauguuggccagguuggucucgaacuccugcccucaggugauccgccugccucggccucccacagugcuggguuuacagguaugagccacugugcccggccuccucaucauuaaaaugagcaauugagacuccaccaacacuuucaugucccuuucagcuaauuucuccuaaagaucauaagcagaaaugaccaagagaggauccaucaguuuucugaaauuugcuggaaaauuuacacucagguuucauggugcagguuucuauuaaauaggucagugaugcucugcuuggguuuagcagugaggagcccuuuguguuccuggcucuguuggaugaaccagcaucccaguaugggagaggaaugaaggaggugauuucacauagggauuagugcuauuaagaaagcaaaacuaggaggcugaggcaggagaaucgcuugaaccugggaggcagcuguugcagugagccaauugaucugggaucacgccacugcacucuagccugggugacagagccagacuccaucuaaaaaaaaaaaaaaaaaaaacaacaacaacaacaaaaaaaacaaaaaaccuagggcaggcuuucauggcggcucaagccuguaaucccagcacuuugggaggcugagaugggaggauugcuugagcccaggaguuaaagaccagcaugggcaacauggugaaacccucaucucuacaaaaaaaaauuuaaaaauuagcugauguggugugugcaugccugugguccuagcuacucaggaggcugaggcaggaggaucaguugagcccaggagguugaggcugcagcgaagugacauugcaccacugaacuccagccuggguggcagaucaaaacucuaaaaaauaaaacaaaacuguuaacggaaagagguccugauccagaacccgauagaggguucuuggaucuugcacaagcaagaauucagggcgaguccuuaaagugaaagcaaguuuauuaagaaaguaaaaaaauaaaagacuggcuacuccauagacagagcagccccaagggcugcugguugccuuuuuuuuuuuuuuuuuuuuuuuugagacaaagcuucauucuuucgcccaggcuggagugcaauggcggggucucagcucacugcaaccucugccccccgguuccagcgauucuccugccuuaccuuccggaguagcugggauuacaggcgccugccaccacacccagcugauuuuuguauuuuuaguagagacaggguuucaccauguuggccaggcuggucucgaacuccugaccucacgugauccuuuggucuuggccucccaaagugcuaggauuacaggcaugagcaacuucgccuggccuugguuguccauuuuuaugguuauuucuugaugauaugcuaaacaaggaguggauuauucacaccuccccuuuccagaacauauaggguaacuuccuggcauuuccaugcauuugcaaacugucauggugccgaugggaguguagcagugaggacagccagaggucgcucucguugccaucuugguuuuggucggucuuggcuggcuucuuuacugcauccuguuuuaucagcaaggucuuuaucaccuuguaucuugugccgaccuccuaucucauucugugacuuagaaugccuuaaccaucugugauugcagcccaguaggucuuaaccucauuuuacccagcccuuauucaagacugaguuacucugguucagacgccucugacaaaacuagauaaagugauugagaggcaugaugauggcugagaugcuuuagagaauguggucugggaggcugucuccggagaugacauugaagcuaagaccgaaaagaggcugucacugagaucuggagggauggucccaggaaggaauaauggugagaacacagguccugagcugugugagaagcagaaaggcagccagggucacuggacuauagagaguuuggggccagugcuaggaaaugagucagagagagaggccaaaucuggcuuguacaugugguggggaaaacacuuugugcuuaagaaguaauuaccacuaaaaaaaacaagaaaacaaaaaaagauggugaaaccccaucucugcuaaaaauaaaaaaauuagccagcugugguggcacagaccuguaaucccagcuucucgggaggcagaggcucaagaaucgcuugaccugcaaggcggagguugcaugagccaagauggcgccacugcacaacagccugggagacagagaagacuccguuucaaaaacagaaaagaaaaucaaaaacaauguugagugaccgaagaaccugaacgggcacagaguuagaagcuucaggcaaaaaggaaauauuaccuguuauuuaauauuuugcuccuaacuugagcuguaaacccacaucuuccaagggcccaaacucacauccacccacaaggucacguuacuuuugucccaacucagaggugaauuaauagaaaaaauaacuauguuagcugccguccugagauucacucccccaucauucuguugguggugcacuuuugaaagugccugucuugcuaggccuuggggcuacaaaggggaaggaggcgggcaggguuuaugcagaagguugacuucagcuaaacuggaguggagggccauuuagucacuucguucuuucuuuuccuggcugugcagaagcagaauaaaggcugcuauucaggcuuugauguuuauucagaccaggcguuuguuguccuucaccucaggaaggauugcugggggaagaaaaagaaaaaagcagaaguugcuugaagacaucuucugccuugugaaagcuuagucuccuugaggaaaugaugcugguguccuggacgggcggggagggagguucccuuggugacugagagucccugugaucuaaucagcaaugagcagugaggacuggauguucuccuccaaaaucucugccaaagaccccggagaccaccuucaacugacccuggacacuuggugaaggaguuccccaaauacguaaaucuggaguucccaucagccuggcagaauaggaggucagaauuagguaagacugaauuuaaagaaaaaaagaagggguucuauucuugcacaaguuggucauuguaaagcaacaccccaucuauaaguaagggugcuaaauccucaugaauguauuggccugggaagcacagaauccucuggggacauauagguggggaccgaucccagaucagaggucagggaaagccuucucgugccuuccaagcccauucccuguugaaaaauggcaagguccagaccaaguuugcuuuguggcucaguguucuuuuucauaaugaggaugccaauauggguugugaauggaauuaaaagaguuaauacacuuucagcguuuuuaaagcagugucuggaacauagugaggacuaagcucugauuuuuuuaucuugcccaaauuccugucuaaggggucugggagucaugcccuacaaaccauaaaaucccaucagauggguuuuauuugacacuguauaucgugacuuaccuuccagucugacucuggcauaacauuaugagacaagaaaaaaaaucaaaauauuuaaccccaaaacaugcuucugugccauaucuugaaauggcccugcagagccauccuuugugggaggaaaaucugcaucuguaaagaauuucugccgggccugguggcucacgucuguaaucacaacacuuugggaggccaaggcagguggaucacuugaggucaggcauuggagaccauccuggccaacauggugaaaccccgucucuacuaaaaauaccaaaauuagcugggcgugguggcacacaccuguaaucccagcuacuuggguggcugaggaaggagaauugcuugaacccagaagcagagguugcagugagcugagaucacaccauugcacuccagccugggcaacagagggggacucagucucaaaaaaaaaaaaaaaaucuccauuaacauagcuagaucuuuuucuuccaugcccucccaauccugaagagauuaacuaaaagucuagcaccuuuuaaagaucugaagaggaaaaauuugucauuuauuguuucuaagggcagccaccguaagacuucaaaggaacguuggucuccacagucuuuuaucuuaacuugaacauuuccuuucuauggaucccaggucuuaagacaagccucaaccaauugucagccagaaaauguuuaaauugaccuauagcuuggaacugcccuuccuccccgcaacccccaugcuuugaguuguccugccuuucugaaccaaaccaauguauuucuuaaauguauuugauugaugucucaugccucccuaaaauguguaaaaccaagcuguaccucgaccuccuugggcacauguucucaggaccuccugagggcugugucacaggccauggucacucauauuuggcucagaauaaaucucuuaauauuuuacagaguuugacucuuuucaucaacaacaguugugagcuauuaaucagcauaaugggccuuaguuagcaaggugggagaacggagggggaggcgucuuaggcagagcgucaaccaaugggaugggaagagaccaucucuuccagagcugagagucacgcagccuucacagcacagaauccuguagaucagcgacucugccuccggaagagcauggggcacagaggaugugccgaggagggggagccauuuugcccccagggccguugggcaaggucuggagacauacuucgcugucaccacuaguguugggggcuacuggcauugagugggacgccacuccacacccuguagugcacagggcagccccuccccaagagugacccugcuccacaugugaacagggcuuugcugaugaacccuucucuagguggggucaggagauguggcuggagagggagacagggccacgcgacaccuucaguuuugugccaaaaacaggauugcaccaugaaaggccaugagauuuguguguaguugaaaaucauguauguauuuggguuuggcauauuuaagaaguaaaaugaacaggacuuggcaguugaguguggggaaugaaggagagaaaaaccugugauuuccuucaugauagagggaaaauacugggaaaaaaagacaggaaaaucuaaagcuucugcugucuaguaguuuuuuagaagauguaggugacagaauggaauaauguguuucuugggcaaaaaaucugggggaucaauaacuugagaauugaugucguauugucugugugucacguuaaauauucuucaguauaaaguguucaggguguguaaguuuccuuuaaguauaaccugugagcugcuagcgaguauucugaauacccuaauguggcaccuacacucuagagaugucuccuaagcaauguaacauuagcaacccacgucagaagauuuguucauuagcauaaagcauuucagaaauuaggcuggcgcgguggcucacgccuguaaucccaacacuuugggaggccgaggcgggcagaucaccugaggucaggaguucaagaccagccuggccaacaugguaaaaccccaucucuacugaaaauacaaaaauuagccaggcguguuggcuggcaccuguagucccagcuacucgggaggcugaggcaggagaaucgcuugaacccagguggcagagguugcagugagccgagauuguaccacugcacuccagccugggugacagagugagacuccgucucaacaaaaagaaauuaguagugucuaagauaugugguucacugggaagacgacacaggcuuuugaccaagaagucagggagcccucaccugcugggcagcccuugagggguugccagcucuauuuggucuugcaucccugccauaacccucugucaucuggcuuaacuagauuggcuaguguggcugccaguaugguccaguguggacucgauccuucgggcagggugcuuggagaacacagagaguucugcagcccagcagaauagaccguuuuguguguguguggcugaaucuggagugagaguuccucucauuguagggcacaccugguggugagguuggaaggaagaggucagaaggguccccaccccccucugauccccugagaaugaacauuugccaggagagccaggccguccucacggaaccggggaaauuggucuaggucaguuucuaacggugaaguucaaaauuaaaagcagcucugguaagugaaaaaauagagucugacaccuagagaaccaaguucaugucaccuguggagggggauaaacugcacaaggaguggauguaaaaaauauucacgccgagaguaaguuguggaguuguuucaaagggugccccccguuaugcuaaaacaggaggcuaguccuuggaaacacugaaaucaucuucuaaaaccagggcgacaaacugcugccugcccggggugaaacgcagccucccugccaguuuuguaaauaaaguuguaguggccccagcuauacuauuauacgcuuacguguuguucacauuucugcuuuugcuucucaggggcagaauggaguaguuagaacagaggcccucugacccacgaacccaaagguauuuccucucugucugcuuccaggaaaggccuucugacccgugcucuacaucuugauaucagauauucacuagauaacugaguugcaugccuaggguauugucugcagagcugccaaggguacuggggaaaugcgugaagauggucucgggaagagaacaaaauagagcauuugguccuccucggcccagagcagggaagcccaaggggcaguucaguccagccaggaguguguugacaucagaaugauggcaaauguugucacacucauagcuggacuuggugcagcgggguggugacuguguguuuguuguguuucuccaucuggaacggagagugcaaagguguguuugucggaaugggaagcauuuuagauaaugggggcagaucggagcacuacaggacacggaccagaaaggagagaaagcgaaggaagaaaugcaaacauccuuugcauccaaggcaguacuuucccuuccaggcccggcuacuuucuggccgcaucauucugaauucucugugucaagcauuugggaagaaaaaaaaaguaugaggaaaaguuuucagguuuucuagauuuucuuuugaggagucaaaggaaagugugaaugcagaugaaguucagacaaggaggcuauuuuauuuuuucugccuuccuugguuuuguuuguuuuuugaagaucuuguuacuaauuuuuccacguccaaagauagccauugaggccagccgcgguggcucacgccuuugaucccagcauuuugggaggcugaggcaggcaggucacuugaggucaggaguuugagaccagccuggcuaacauggugaaacccugucucuacuaaaaauacaaaaauuagcugggcauaguggugcaugccuguaaucucagcuacucaggaggcugacacaggagaacugcuugagccugggagguggaggcugcaaugagccaagauugcgccacugcaguccagccugggugacagagugagacucugucucaaaaaaaaaaaaaaaaaaaccacaaagauagccauugaaaguuguugcugggcgcuguggcucacucuuguaaucccaacacguugggaggcugaggcaggcagauugcuugaguuccgaaguuugagaccagccugggcuacauggugaaaccccaucucuacaaaacauacaccaauuagcugagcauaguggucccagcuacucagaaggcugaggcaggaggaucacuugagcccagggaaguugaggcugugaugagccaugauggcaccacugcacuccagcuugggcagcaacagaaugagacccuguaucacacaaaaagaaaguuguuaauaucuucauucagcagauauuuuuugagcgucucccauggguacagugcuguguaggcgcuacacacagagccggcgucagcagucccuguccucaggaggcagccgcucaaccacagacagcuugcgcacaucagcucgaugcuaagcauugucacuuggaagacaagucuagcauucuagcauggaagacagacacaagcacguaauuacccaaacauuugucugauugugauacgaucagugcuaugacagagaaguguagggugaugacagagagaggacucugaauagagccgaccuaguuccagagggcguaggguccaaggaagagcuucccuuucccccucugaggguucacugaaaaccagcugggcaaagacagacucauaggagacacggcacacaccuguguuggucauaguuuuacaugacaugggagccuucagaaugaagacccagagacacgagagacuggccaguuuaugcuuagguucaacaagguacggacagccacaugggaauaggaugggaugaaaagggucugaucgaacaccgauagacugcuuggggaggcccagcaaggcgagucugucuggauucaucuucgccccucugugcagccuucuuuccuucugguacaaggcaggcccgcucuggaaugggagcuuugugacuugcaaucaaacaagguaguuuggauaauuuauuauuuuuuuuuuugaaauggaguuuugcucuuguugcccaggcuggagugcaguggcgugaucucggcucacugcaaccucugccuccuggauucaagugauucuccugccucagccucccaaguagcugggauuacaggcaugugccaccgcacccagcuaauuugguauuuuuuuaguaaauagagacgggguuucaccauguuggucaggcuggucuugaacuccugaccucaggcgauucacucgccucggccuuccaaagugcugggauuacaggcgugagccaccgcaccuggccugggauaauuucuuuauggucagguuuuacacaggaaggcaggggaaaguuagaguaauaauuuuggguuucacuggcuaacgcagugaaaccccgucucuacuaaaaauacaaaaaaaguagccacacgugguggcgggcaccugcaaucccagcuacucgggaggcugagguaggagaauggcgugaacccgggagguggaacuugcagugagccaauaucgugccacugcacuccagccugggcgacagagcaagacuccaucucaaaaaaaaaaaaaaaaaaaaaaaaguguauagaucugaauacuaucuggaaggacccugcgaugcuguggcagcggggagagaagagcacuagggggacuuccaggggccuggcuugugccgcugugugcacugugggcaggucccugcacguggaaugcuggcugaugccagcucggcuggggcaggagagucuuaacaugcugacugcgaggugccugucagacgacacacuguaaguuuuuguugaauuagggcaguugcaacccacgggcacuccgagaggcuuccgggcugaagaugagaagcugagugugggaugaaguuugcuuaguccugcacuagggguggggcaaacugggauauaacaugaucagaaaggagacaggcugggaaggcagagggccccggaaauccagaaaacuuagggaagccgaagaagaggaauuucccaagcagaagggcugguuagcgaggcuggauguugcuaacaggcccaucugcucaagacgccaaaggggcagugaggguuggcaccugaagguccguggagaucuugucugaucuuguuccgcaggaguaguggcagguggaagcccaggagugggcagccaugggagauggagacggugaaugugugccacacuuucauuuccagaaguccuuuugcgaugagcaggggaggagagaguagagccugauucggggaggaugcuggguugcuggggaaaccuucuaaggggcucgggcauauuugaugcugccugaaugugagugggaagaggaaacagggagaggcaugacugugggggugguuaacuccugagcuguuggggaggggugagcuggagaaggaguguggccucugcugggaccucagggagaggcccagaggccugcaugugccagaggggugggcaugguggggggcacuugacggugugccugucuugcagcugugacuuucucuguagaggaggcaaggccaugagcugcugguagcaggacagauaaggaccucagaggcuggaggagagggaaggugucaccaccccagcccucccugguucauugccaaagccucuuagcuugucucuuuucacuuucaacacagcagucaggcugagucuggugaaaugcucagccagauugcaucucuucucugcuucacauccaacacacgccgaggcuucugccaggaccugcuauccucugcgcugugggccccucagugacauaaccuucccagaccccugugaacucccaaagcccagcacaucccacgucaggcccauagcaccugcuuuucugauauucugauauaauacccacugauguuauuuuuuguuuauuugaauuuauuuuuaaaauuuacauuguuacuuuuaguuugacaacuaguaauuauauauauuuaugggauaccaugugauguuuuggacuaugaauacauuguggaaugauuauaucacgguaaugaacaugucuaucaccuugaagacagucaguauuccguaucuguggguuccaugucugcaguuccaagcaacuacagaucaaaauguuaaaaaauauauagaaauaaaaaacaacacaggccgggcccgguggcucacgccuguaaucccagcacuuugggaggccgaauugggcagaucaccugaggucaggaguuugagaucagccuggccaacauggcaaaauccaucucuauuaaaaauacaaaaauuagccaggcgugguggcaugcgccuauaaucccagcuacucgggaggcggaggcaggagaaucgcuugaaccugggagacagagguuucagugagccaagaucgcaccacugcacgccagccugggugacagggcgagacucugccacgaaaacaaaacaaaacaaaacaaaaaaacccaaaaaaccaaaaacccccccaaaaccccaaacaauacagcagaacaacuauugaauagcauuuccauuguauuagguauuauaaguaaucuagagaugauuuaaaguauacaggaggaugugugaaggugauaugcaaaugcugugccauuuuauaucugggacuuaagcauccuuggauuuuguuauccacagauucccaggggugauuguaccuuuuuuuuuuuuuuuuuugagacagagucuuggcucuguugcccaggcuggagugcaguggcaugaucuuggcucacugcaagcucugccugccggguucaugccauucucuugccucaaccucccgaguagcugggacuacaggugccugccaccaugcguggcuaauuuuuuauauuuuuuaguagcaaccugguuucaccauguuagccaggaugcucucgaucuccugaccucgugauccacccgccucagucucccaaagugcugggauuacaggugugaggcacugcgcccggcaauuguacuuauuauuuuuuguagugaaaacauuuaaaaucuuuuuuuaagcaauugaaauauacaguauguuauuauugaugauggucaccaugcuguacaagcuauuccuccuccugccccccaccaagccccccaacagccucugggaaccaccauucugcucucuacuucugugugcuggacuuuguuagcucuucaucuuuucccccacaguauccacgugguucgcugccucaucaccuucaggcuuuuuuuuuuuuuuuuucuugagaccaagucucucucugucacccaggcuggaguauaguggcacgaucuuagcucauugcaaccuccauuucccugguucaagcgauucuccugccucagccuccuguguagcagaaauuacaggcgugcgccaccacaccuggcuaauucuuauauuuuuaguagagacaggguuucaccuuguuggccaggcuggucuugaacuccugaccucaggucauccacccaauucggccucccaaagugcugggauuacaggcaugagccacugcgccagccaccuucaggucaccuucuuuagcgggaacuccccugcccacccuucucaaauggcagccccuuccaccacacacugucuccccgucucccuggggcuggugguuuuccucccgagcaaaaaccugccucugacauagaggagauuugcaauuuucuggcucauugaccuuuucccugcucuagaaaguuggcccuugggcgcaguggcucacgccuguaaucccagcacuuugggaggccgaggcgggcggaucaccugaggucaggaguuugagaccagccugaacaacauggugaaaccccgucucuacuaaaaauacaaaauuagccgggcgugguggcgaaugccuguaaucccaggcauguacucgggaggcugacacaggagaaaugcuugaacccgggaggcagagguugcagugagccgagaucgcaccauugcacuccagccugggcaacaagagugaaacuccuucucaaaaaaaaaaaaaaaaaaacagaaaaaaaaaaaaggaaaagaaaaaaaagagaguuggcaccuggagggcagggauuugugcauguuuuguucuuuacugaacccucguugccccagcggugcugggcauacagcaggugcgcuuggucacugaaaaugcaugagagguuccgacgcaguagugagcaacuugggaucccaucucacagaucuccacuuacccucugccucgggggucccccagcaggcgccagugccuggggcugccauggagaaagcugaccuggagacucuccagggcuggcguuguuccagaugcucacacgcuuacuacagaaagacugggggacgggagugguuaagguguugacaagaaaguaauugaaauggcggagcauggaaucuccccagaacugggagaaaagcucggagggacuguggguccgagggggcagaggucaauggucuggaauuccgaggaggccaaaggacucauaauggaaggauugaggggaugagagacugcgauggauuguguauaaacuaacaauaagggcgcuaagcuauuacugugguguggcuuagagaucuucagccuugaguaauugaauugaaagcuaaguugaauugaaaacccaaccuaaauugucuuggacaauaaagggaauguaauggcuuuugccauaagaaggcuggaggcagggccuccucagggugguuuuccagcagaggacagggacaggaguccacuuaucuccgucuccugcaucugcuucccucuccuggcagaaucuucucgccagccccuccugggucucccugaaucccaggucaggcccauggagaaccucugagguugagucucugaaaacacgacccaggucccagaauugaacgucuagggguggguguguggagagccggauguuuugauuggcaugagccugcaggagcacccuuggaucuggagauggggcucguccuccucaaguaagugccagggagggucgagguauuaggaaggagcgugugggaacagacacuagaggcaacaccccgcccaaaagcgucacucguccguauggagaagggaaaugggaaacgcaggccuccgggaacuucugaagauguagaggacuaacagguguuguggaucuugaaggagugagaaauaccauuagggagguuggaauuggggagauucucacagauguugaaaugccuggcuucucuggguagauuggugaccuuguagcagugaguagcuccucgaucagcugggugccgacugccagagccaguggggucugaccuugcacucucgccuagaagcauaaugugagccccauggguccugucagauuuuccaguagucacauuaaacauagcaaaaagaaacagauaaaaucaacuuuaauauuauauucucuuucacucaacaugucuaaacaugauuuugaucuauuuuguuuguuuucuuucuuuuuuuugagauggagucucgcucuguugccuaggcuggagugcaauggcacgaucuuagcucacugcaaccaccgccugccggguucaagugauucuccugccucagccucccgaguagcugggauuauaggcaugcacuaccacgcccagcuaauuuuauauuuuuaguagagacgggguuucuccauguugauuaggcuggucucgaacuccugaccucaguugauccgcccgccuuggccucccagagugcugggaauacaggcgugagccaccgcacccagccucguuuauuuuuuucuuugacagggucucacucggucguccaggcuggagugcaguggcaccgucuugacucacugcagccuugucuuccagggcuaaagccauccucccaccucagcuucccgaguagcugggacuacuacaggcgugaaccaccacgccuggcuacuuuuuguauuuuuuguggagacagggucucgccauguugcccgggcuggucucaaacuccugggcucaacccauucacccgucuuggccuccuaaagugcugggauuauaguugugagucaccaugcccagccccaucuauuuugaaauaaauuauauauuugaaauauuuaugauauaaauagaauauuuauaaaacauauuugaaauacacauuauaaauauguguauacauauaauuuauauauuuacguauaaguaguaauauauauuauacgugugcaugucuaaccgagcugcgugugucuuucacacugagugccuuucuauuuggauuaggcacaguuuuagugcucagcugccccagguggcuuucuuuaucuuacuggacuaugggggccugacccugcagaugggcguccccuccuguucggugcagagcucauccugucuuaugauuucaccauccucaccuccaguucauugaauuucaccugaucucaauugacauuugaguucaagacacuuccugaucuagucacuuugccuguuaggugauugaauuuuugcagucuuuuaaaaaagaguuccuguguguauucuauuuuuuuuuuuuuuuuugaggcagagucuugcucugucauggcuuacugcaaccucugugucccagguucaagcaauucuccugccucagccuccugaauagcuggcauuacaggcaugcaccaccauacccagcuacuuuuuguauuuuuaguagagacgggguuucaccauguuggccaggcuggucucaaacuccugaccucaugugauccaccugccucagccuguugggauuacggucacuccagccugggcgacagagugagacuccaucucaaaaaguaaauaaauuugcacuccagcaaauauuuuugagacugucucaaaacaacaacaacaaaaaaacaaaaccaaaacacagaaaugaccaaacucuacuguacacucaaguaaagagucugguugcuggccggggagccacagagcgucugugaaucuugagucaggcgcgcacacauaggcuucuucucuuuguggaccugccaagugcccaaaaucucuaugggagaugcuuuuguuuucaagaaagccuuuuuaaaucaaaucagaauuauuugggaauaauaggugcuuagugaauuuauuaguugaauugaauuauuacuugacagaaggagagaacauagaucgauuuaaagguguugcaagucagccagaaacaaggguacaauuuuaguucaugaauaauuuagauuagacaaauuuauuuagaauauuuaugagauugcaaaguuagugucaaaaugccauuuaaaaauaugcuuaauaggcugggcacggcggcacacgcauguaaucucagcacuuugggaggcugaggcaggcggaucaccugagguugggaguucgagaccagccugccaacauggugaaacuccaucucuacuaaaaauacaaaaauuagcuaugugugguggcacgugccuguaaucccagcuauucuggaggcugagacacaagaaucgcuugaacccgugaggcagagguugcaacgagcugagauuaugccacugcacuccagccuggcccacagagcaagaccguaucucaaaaacaaacaaacaaaaacaccuuaauaaaucagaaacuaccgauugucucuauguaaccaccugcauuccacgcacucugcuguaucgauucugcauaagucaugagucccucaggaauggacucuccaaguagaauucagccccuuuuccaucuaucaguguuuauuuuuggcuucucauuucuuagagcuuuacgaagaacauaaaauagcaauuauucaaccauggucagaagcauguugaauccuuauuuuugugugauguauuuuauauuuuuuuaggcugaagcgagcugauagcuugacugcugcaggcaucuuuccugauccugcuggucaguuaccuucagcauuuccaaaggauacuagguuugguggggagagaaggaauguuacugacccacaaugacuggaucaaaauuaacagugaaaaugguaggcucaagauacacgaugcacuucaguaaguuaaaccaaccuaagucucaagacccuaguuauucuuuauuugcacagugauguugugacacuuuacguuaugaaaaagaaacagaaagagagagagaaaaauaucauccacauauuaguacaguguagaaucucaccauaugccccagggucagacgauuugaaccucauguuucucuguggcucccacaguccuagcaacuuggucauuuuaugaacacaguguuuaaaggcucuagaccucccccuacuuccuccuccucugaucuuuguccuccucuucuuuguuuuacucaugauuuugugcaauauugcuccuaaaugcacaccaguuaauucaccugguguucagcugaauaaauaacuauuucauugcuggaauuacaaaagaaaaaagggcuagguuggacuugaacuuuguucuauaguacugucuggaugauuuaagagauuuucaaggguaauuuuuuuuuaauuuauuuuuuauuuuuauuuauuuauuuauuuuugagacggagucucgcucugucgcccaggcuggagugcaguggcgcgaucucggcucacugcagucuccgccucccggguucaagcgauucuccugccucagccucccaaguagcugggauuacaggcauaugccaccaugcccagcuaauuuuuuuguauuuuuaguagagacaggguuucaccauguuggucaggcuggucucgaacuccugauccgccuaccucggccucccaaagugcugggauuacaggcgugagccaccgcgccuggccgauucaaggguacuuuuaaguguacuugauuuucauguaugugcugauuuuguaaucagugccccaaguaagaugugacuccaucuucccuauaaaugcagugcagagggguuauaacagagauaggcucaaaacaaaaugggaauuuugagagacugugguguguaggaacuggggcugucaggagaguucucuggaaggagcuggcacuaggaagugucaugucagcggcguggagacucaagaaggaagcgugaugugccagagguccugcugugggagggugguuggaguggagugcacuucugccaugcagggugagcuguguucugggcugaggcauuuaucccagagacacgcucagccauuaguugauucccuaagcaggauagaaaugguccccauucucaugccacugacaguugagcugaauacggugagcucuuugcagguuuuaaucagaaaagagaccuggucccauuuguuguguaucuacauacacacgcacgcucacacucacacacauacacaccucaaacaauuuaaaaagauaauauaugcaugugguaaaaacuauccaacaauacaaaagcucgugugucucuuucuuucuuucucuuucucugucucucucucucucuugcucucuguuucuuucuuucauuuugagacagggucucgcucuguugagacccaggcugaaguguagucgcaugaucauggcucacugcagccuugaauuccuggacucaucgauccucccaucucagccucccaaacagcugggaugacgggugcaugucaccacacccagguaauuuuuuaaauuuuuuguagagacagaguuucaucauguugucuaggcuggucucgaacuccugagcccaaaugauccuccgaccucugccucccaaagugcugugauuacaggugggagccacugcaccuggccugacucuccucuuuggacacaaucauuguuaucucuuuuuaauguauccuucuagagauauucuaugcccacacaguguauauacccaaaaguauucuucacugugcucuguuuucauuaauagugaaucuuggaauucauucuuaauacuucauagugaucuauugcauucuuuugauggcaaaagaacaugauuagguccaucuaccauaauauaacgagggcccugcggaugcacggugagguaguuuuuuggucuuuuugcuacuucacagcugcagugcguauuccugggugcaugcuuuugcacauauauccaaguccaucuuuggaauaaauaucuagaaguggaguuauuuggucacaggguuugugcauuuaaaauuuucuagcugcuguugcauugcccacuagagagguuguaccaauuugcucucucacagauaauguauaggaguguuuauuucaggaggccucaggucaacauuuuaaucuuuacagauuuucuggauuaaaaagauggcugauauugagcaucauuuucuuuguucaagaguccaguuguauuucuuuuucuauggacugcaauuuugugcccaucuuuauuuuucuuuuucucuuuucuuucuuucccccuuccuuccuucccuccuucccucccucccucccucccuccuuccuuccuuccucucucuugcucccuuucucuuucuuucucucuuucuuuuucuuucuuucuuuuucuuucuuucuuuccuucuguuucugucuuuuucuuuucuuuucuccuuccuuccuuccuucuucccuucccuuccccuuccccuuccucccucccucccucccugccucccucccucccuccuuucuuucuuucuuucuuucuuucuuucuuucuuucuuucucucucucucucucucucucucucucuuucuuucuuucuuucuuucuuucuuucuuucuuucuuucuuucuuucuuuuuuucucuuucuuucucucuuucucucuuucccucacucuguugcccaggcuggagugcaguggcacgaucuuggcucacugcaacguuugccucccggguucaagcaauucucgugccucagccuccccaguagcuaggauuacaggcaugcaccaccacaccuggcuaauuuuuguauuuuuaguagagacaggauuucacccuguuggccaggcuggucuugaacuccugaccucaagugaucugccugccucagccucccagagugcugggauuacaggcuugagccacuguggcuggcuuuuuuuuuuuuuuuuuuuugagacagggucuugcucugucaccuaggcuggaguacaguggcacagucguagcucacucagccucgaccucauaggcucaagcaguagucccaucucagucucccaaguagcuaggacuacagguaugugucaccaugcccagugcauuaaaaaauauuuuuuauagagacaggguuucaccauauugaccaggcuggucucaaacuccugggcucaagcaaucugucugccucgaacucucaaagugcugggauuacaggcgugagccaccucacccagcccucauguccguuuuccuauuguguuguuagccuuuuuucuuuauugauuuacgaaugcucuuuauauauuaagcagaugagccuuuuucuauaguaacagucguaaauaguuuuuuccccaguuucucauuugucuucugauuuuguucauguuguugucacuauugaaaaaauuucuuuuuuguuuaugagguauuuuauauuuauguuaccaggagcugaaacuaagguggagacaaagagaagagacauguuugaaagacauaaauauuguguguguguguguguguguguguguguguguguguagcagguagaauggaaaaaccaggaaguauuuuuuuugaagcuaugauaauaggugacuuuugaagucuuuucaaagaaccgagcaacagaggcccaaaaacaaucuuuagauaccacaauucagggacaggagagaaaauguggaauuaaggaaauagaaaaggagcugcugucugguauggcaaaugccacuggagguggcagugugugccccaugucugaaggcugucagggccuccugggucaaucuuccuuccaauggccucgguuccagccacaguccuggguaucugagacuggcagaugaauggcuaaugucauugauucuaggccuucuuuuguauuuuaaggcagggugcuuacaaagggugauucaguaaauaagucaucuuguggaauucauuuaaaaucuuaaucauaguagcugagcacaguggcucaugccuguaaucccagcacuuugggaggccaaagcagguggauuaccugaggucaagaguuugagaccagcuuggccaacauggugaaaccccguuucuacuaaaaauacaaaaaauuagccaggcguaguggugcacacguguagucucagcuacuugggagacugaggcaggagaaucgcuuggagacccaggaggcggagguugcagugagcugagacugcaccauugcuccccagccugggcaacaugagugaaacucugucucaacaacaacaacaacaacaaccaaaaaaaaaaaaagucuuaacuguagcagcaaccuguuacauauuaacauuuuccccucaucuucuccuuucucuguauuuuuugauaaagggcccaucuagaggcugcagggcacgugugcguuuugaaggaugccuuugacuuugaaagccgaucugagauugcaaaccucaucuuggcugagaacugcgaggcugcccuggcucuucaucucuauaggggaggcaggcuuuugcaagguaauccucuuuuucuucaaaaguaaaacacuagaaauucugaaaaccggaagugccuguaauguccaauaacacgggaaacagugucuccuuuuuauccaguucagaaaugggagacaugcaauaaucucuuugguuugcuuucuuaaugcacaauuuucuuaaauguuauaacagucaagaauggauguguauugaaacuguuuuuaccauauuaaaaguaucauccuuaauuuuuguuuguuuauuuauuuguuuuuuugggacagggucucucugacucucacccaggcuggagugcagugauacaaucucggcucgcugcaaccuccgcuuccugggcucaagcaauccucccacuucagccucccaaguagcuggaacuaugggugcaugccaccauguccccuaauuuaaauuuuuguuuuuuuuuucagggauaggguuucacccuuguugcccaggcuggucuugaauuccugggcucaagcaauccauccuccucagccucccaaagugcugggauugcaggcaugagccuggcccugaauuuuuucaaugcauauuucaucuuucaaaauauauuuuuuucaaaagaauucuuuuacaaauagagcacuuaugaaagauguuguucaacccaucaauuuaugaggaaacuacuaagauguuaaaaccaguuuaaagcacauuugagcaacuggaguuuaaauaagcaauuuaauaaagaauaucagaguaaauucacgagguuaguugcagaacugauuaacauccaacaaggcaaugggccccaagcuuuggaaguaucucuucuacuggacagaaaugauuuacgucucucccugacacaaagcuacaaauggcuuaauguaacuucacagaguaugagcuuucaauuaauaguaaauagugaagucaaacaacaauacacucucucagaaaaugagucuuuagaggacccuuuuaauuauggcuuccuagaacauugcaagaaaaugcauguggaccuuauuuauucuuauuauucuugaccuuauuuucagguuguggaaaauuuuucuuaacacucacaagacccaucugacuuuacugagaguauagcagccaccaaauaaaggcaagacagauauuuuuguuauugucuggccugagugauuuccucaaacaugaauuaaaugacauaguagugguaucauuugugcugcaccauuuuaagggauaguaauagcaugucauuggaggaucaaaauuugcucuagucaucaucacaucaggauuaaauuuuggucagcaaaaugugucacacuuucaaaaauuuuagagguuuuuuacugaaggugauuuuuucauuuuuccacacuguaucaaaccuuauuuaagcuccagcucuuuuuccugccuccuguuccacaggaaguugagcccucucugaacacucucuucauauaugggcacaucuuacuauguguucuuuuuuauuuuuucagguaauacaugaaaaauugccccgguguaaaauguaacugagugguauaguaugaaaaguaagccugucucccaccucuuauccccacuguauuauuucucauuuccagagguaaccacaguuaacauuuucuuguggauauucuccuagaaauauauguacuguauugauuaucuauuauuacauaacaaauuacccccugccccaacuuaguugcuuaucgcaguacauuuguuaucuaaugguuccugugggcauucaaaagcagcuuagcuggguggucugucucaggguuucccaugaggcugcagucuuaucugguggcuugacuggggcuugcugaugugcauccauuauagugcacucacaaggccguuggugggaggucucaguuccuuaccacaugguccucuccauggcccucuugaguguccucacgaugugauggccagcuucucccugagagaaccaucaaaagaaaagcaaguuggaauuugccuuauuuuucaugacccaggcucagaagucaauacaacaugaaucccacaauauccuucugauuacacaggucagcacuauucagugugagagggcacuacacagagcaugcauaugaggagguucauguacacccaugcauguauuuauauguaccuccucccccaucuuaaacacacacacacaaauggaagcccaccgcugaauauauauucagcaucuuccuuuucaccgcucagccacacaucugggaacuuucucccauaguggcacauacauagaucugucucauccauugugcagaggugccaucauuuaaagucuucaauaaauaaauguuuacauugucuuuaauuuuucuauuucaccuuuuagaaugcuugucucuguacagacaucauagcauaccaacuugggagaauauauuugugcuuccauauuuuugcauccgugccugaacaaucuaaaugaacuguuuucuguauaugcggagaguguuucugaaaguauuauuucuagagaguuauuuucugcugaacaaguauaugacuuugaauuuuuuuuuucuuuuuuuuugacacagggucucacucuguuacccaggcuggagugcagugauacaaucuuggcucacugcaaccuccauuucaugggcugaaauaacccucccaccucagccucccaaguacaggcaugugggacugcaggcaugugccaccaugcccggcuauuuuuuugguauauuuuuagagacaaggucuugccauguugcccaggcuggucuugaacuccuggacucaaccaauccacccaccuuggccuccuaaagugcugagauuaaaggcaugagccacugcacccagccuugaauucaguuuuaaguguagugaaacacagucugagcuuugucucugaaugugaaagaaguguagaguuuaacuuuccuuauaggccaagaugaaguucggaaucccugauagcucaguaggaaccuuuguaagguugucacugacuguugcaacucuuucaugcagucacaaagccucagcccugaguuuagugauucuguugacagugaguuguguuguuuucuuuucuuuuuuucuucagcuuuuaaguucagcaguacaugugcaggaugugcagauuuguuacauagguaaacgugugccauggugguuugcuguacagaucaucccaucacuuagguauuaagaccagaauccauuagcuauucuuccugauguucucccucuucccccaccccacccccaacaaguugucaaguugugucauuuucuguaaagugauacuuauuauuuuuuucuuuuucuuucuuucuuucuuucuuucuuucuuucuuucuuucuuucuuucuuucuuucuuucuuucuuucuuucuuucuuucuuuuuuuugggggggugggcagagucucacucuguggcccaggcuggagugcaguggcaugaucuuggcucacugcagccucugccuagcaggcuuaaguaauucuugugccucagccuccagaauagcugggauuaacaggugugcaccaccaugcccagcuacuuuuuguguuuuuaguagaaacgggcuuucacuguguuggccaggcuggucuccaucuccuggcuuaaaguuguuugcccgccucggccucccaaagugcugggauuacaggcgggagccaccaagugcagccggccccuguuauuucuuuuuaaagguuuuacacacauauguggaacauuuuauucccacaagugggauuaggucuguauauuuaacucauaucuuagcuacuuuuccaaauccacaaagcuacauucuuuuuauuggcugugagguauuccacugugacaaugcaccauacuuauuaaaagucucucuuguuuuuuugcuauuccaagcaaggcugaaguguuuucgauuacauuucuuuacaccauuguauguggauguuggaaauauaaauuccuaggaaagccugugggucaaagggcuguguaacuuuuguuuugauugacagugacaaaaugcuauauggaaagguuauuccaguucguauucuacuaacagaugggcaaggacuuauuucuccucuagucagauugcuggauuuuuguuuuuuccuucaaacuuacaguucucaauuuuaccaugcuugaccucugcuucaaauaaacaaagucaucugaaguuagguuugcuucuuuuaagaguugaaggaggagaggagcccucugcaaaaccaaccuauugcccagaggaaaaaaaucaauuacauugcucaaucuaauaaauaucgagaacugaagccaugcuuacucuuaguaaaugugguuaaacuuuuacuuguucauuccuaguuguuguccauauggaaauuaaacuguauuuauuccucaggguuauguuuuugaagguuaaagucucucuguguagcaucauguguaaaaagcaccagaaccauugucaguaagaagagcugucccugugcaccgugagguuuucacuuagcaaaguaucuggggaccuucucugcaccaguugcagacauugaguugcccuacccugucauuaacuggcugugugauauuucauucugugcauacacuacacauuucuuagacagccuucuauugauuaaacuguauuuaaaaauauauaguucuuauugauuuuuaaauuacuuauagaggugauuuggaaacuauguaaaaauacaaagaagaaaauauggcaccugcaguuucgccacccagaaacgaccacuguuuguguguguguuuuugguuuuauuuauguuuuuauucaaaauuaaguuugcaaaaaagauauaauuuuacaauuaagcuugcaacuucuuuuaaaaaauauuuguagucggccgggcgcgguggcucacgccuguaaucccagcacuuugggugguggagacgggcggaucacgaggucaggagaucgagaccaucuuggcuaacacggugaaaccccgucucuacuaaaaauacaaaaauuuagccgggcguguuggcgggcgccuguaguuccagcuacuggggagguugaggaaggcgaguggcgugaacccgggaggcggagcuugcagugagccgagauccugccacugcacuccagccugggcgacagagcgagacuccguuucaaaaaaaaaaaaaaaaaaaaacuauaguccaggcgcggugccucacaccuguaaucccagcauuuugaaggcugaggcaggcagaucacuugaaguuaagauuucgagauuagccuggcccgcauggugaagccccgucucuacuaaaaauacaaaaaaaauuagcugaccaugguggcgagugccuguaaucccagcuacuugggaggccgaggcaggagaaucucuugaacccaggaggugaacguugcagugagcugagaucaugccccugcacuccaguccgggcaacagagugagacucuguaucgaaaaaaaaaaaaaaaaaaaaaaaaaaaauauauauauauauauauauauauauauauauaaaauuuauagauauagauacauaaaauaaauauauuuauauaccuauauaaauauauauuauauauaauauauaaaaauauauauuuuuuauggaguauuuaguaugugcuaagcacuuugauaaaugcuuuggaugcagagauacugcuguaucugacucuugcucuguaguuuguguguauauuuuaaaaauugcaaucauauuauacuuuuaauugcguaaccuauuuuacaauauguuagaaauagauggucuauauuuccucugucauugaauguucuuuugcagcaaguuaugaauggucccguccuauuuccauuucuccccucaguuuuaaacaauaucaugaugaacagccuucugcauaaaccuuuggagcccauuuccuuuaggauuuuccagaaauaaccuugcaggaucaaaggguauaugcauuuuuaaagcuuuucauacauauugccaaguuauaacuagucacauuuauauaacuguguauauuaaauauugcuaaguaaaaccuuaacagcuuggagaaguggaaguuugcuuuucuguuuaaaauuaguauuugcugagaaaauaauuauauaaaauagcuaaguagaauaugcaaauaauggaaaauagcacauuaacaacauuaauacacauuacggauauauugcagguauaacgcaauuuuuuuuuuuuuuuuuuuugagacagagucuggcucuuguugcccaggcuggaguacaauggugagaucuuggcucacugaaccuccaccucccggguucaagcaguucuccugucucagccucucgaguagcugggauuauaggcgcccaccaccaugcccugcuaauuuuuguauuuuuaguagagaugggauuucacuauguuggcgaggcuagucucgaauccugaccucaggugacccaccaccuaccuuggccucccaaaaugcugggauuacaggugugagccaccacacccagccugcaaauguuuuaaagaacaauaucaacuuucauuccuuaagguauggaccaauuauuauaugaacgucaaaguaacacauuauauuuguuucucccucuugggcaugucuguaagauauuuuuggcaugcauaccgauccaucguuucaagugugugugaacagaacuuuacagguauccuuaacuuagauggaauggaaccuguucccagguagugugcuuucuggacucuuuccuauacacccuaaauggcacacaaggaaaaacuuaacuugaugcuggccaagaguguguuaaucaagcuccuccucuuucuauuuauuuauuuauuuauuuauuuauuuauauuuuuaauuuuuuuuuuugagacggagucucacucugucgccaggcuguaguguaguggugggaucucggcucaccgcaaccucugacuccccugguucaagcaauucuccugccucagccucuugaguagcugggauuacgagcacgcgccaccacgcccagcuaauuuuuguauuuuuaguggagacggguuucaucauguuggccaggauggucuccaucuccugaccucguuaucugcccgccugggccucccaaagugcugggauuagaggcgugagccaccacgcccagccuucuuucuuuuuaagaauaugcuuuaggcuugagccuaauaaggaagcagauaaggucggguggcugauugagaagccaaguuuagggccgggcguaguggcucaugcuuguaaucccagcacuuugggaggcugaggcggggggaucacaaggucaggaguucgagaccagccuggccaacacggugaaaccccgucucuacuaaaaauacaaaaauuagcugggcauggugguggaugccuguaaucccagcuacucgggagccugaggcaggagaauagcuugaacccgggagacggagcuugcagugagcugagaucgcgccacugcacucuagccugggcgacagagcuagacuccaucucaaaaaaaaaaaaaaaaaaaaguagaagaagccaaguuuaggaagcuaugauuuucuguuuuucucagccgauuacugggagagacaaaccucuagcacaaguacugauuuaggaauaagacccuuacguggguggcuccgagucaacucacuuggaaaauagcuugugugcuacucuucauucucagugcauuucagcaaaugcucuuugaggaccuaacuuugagugccaucauauuagagcaaggggugcagacauaaauaagagaaucuucuagucuauaaauaaaacccaagaccuuaugauacauggcaugacauagaagggaaaggauuuacuucugagagaccuggagaagauuucagaaacaagggaugacugaauaggguuuugaagagugaauaagaguuuauaaauauauccucgaaaaaugaaaaauagaacuaccguaggauccagcaaucccacuucuggguauaugugcaaaggaaaugaaaucaguguguggaagagauaucugcaaccccauguucacugcagcacuauucaaaacaggcaggacggggaaucaaccugugcccauugauguuaaauggauacagaaaaugggguauauauauauguaauggaaaacgaaggauauucugucguuuguaacaacauggaugagccuggaggacauaaugcgaaauacaauaagccagucacagaaauacaaauaccacaugguucucacuuguaugugaaauccagaaagucaaauucauagaagcagagaguaguaggaugguuaccaggugcucaggauugugaggagauuagggaaacguuggucaaaaagcacaaaauuucagcuaggaggaauacauucaagauuuauuguacagcauggugacuguagugaauaacaauguauuguauacuugaaaauugcuaagagaggggccaggcaugguggcucauaccuguaaucccagcacuuuggaaggcugaggcggguggaucacuugaggucacgaguucgagagcugccuggccaacauagugaaacccugucucuguuaaaaauauaaaaauuagcugggcaugguggcacugccuguaaucccagcuacuugggaggcugaggcaggagcaucacuugaaccugggaugcggaggcuggagugagccaagauagcaccgcugcacucuagccugggugaccaagugagacucugucucaaaaaauagaaaaaaaaauugcuaagacaguaguagguuuuaaguguucucaucaccaaauaaaugauaaauaugugagguaauacauauauuaauuagcuugauuuuuuuuuuuuuuuuuuuaagaaaugggaucuugcuguguuucccaggcuggucucaaacuccugggguggagcaauccuccugccuuggccucccaaagugcugagaugacaggugugagcuacugugcuuggccuaauuagcuugauuuagcuauuccacaauguauacauauuuuaaaacaucauguuguacaccauauauauauacaauaauaaaaagagaguuugcaaaaauauuuuaucuacaucauguuauagcagaggacuuccagaauuuuucaauuguaaucaugggugaauuuauaagucuuauuuuuuugagacagagucgagacucuuucgcccaggcuggagugcaguggcacaaucuuggcucacugcaaccucugccuuccagguucaagcgauucuccugccucagccucccgaguagcugggauuaaaggcaugugcuaccacacccagcuaauuuuuguauuuuuaguagagaugggguuucaccauguuagccaggcuggucucaaacuccauaccucaagugauccacccgccucggccuuccaaagugcugagauuacagguaugagccaccaugccuggccccucucuuagcaauuuucaaguguacaauacauuguuauuuacuacagucacugaguagcuuggccaaaggcaugccuguucuaggcggagaagcagaauucuaaccuggggcugucuggagugaaaguccugugauuucuccagauaggucaaauuagcuuugacauauaugaguuauugcugcuggucugauugaguaagaaagggcugucaucuuaaguacuaaauauguucacaccuuuuaaacaaccucguugauaguguguaucuuuuaggugucuauuuuucugucuuugggaauuucacugaaaacgacucucccacuguuuuacuuagccuccuuuaguagcaguuuuuauugggggaauaucccagauaugguuuggcuguguccccauccaaaucucuucuugaauuauagcucccacaauucccguguguugugggaaggaccuggugggaaguaauugaaucauggaggugggccuuuccugugcuguucucaugacagugaauaagucucucaugaucugaugguuuuauaaaggggaguuucccugcacacgcugucuucucuugucugcuaccaugugagaugugccuuucaccuuuugccaugauugggaggucuccccagccacauggaacugugaguccauuaaaccucuuucuuuuguaaauugcccagacauauccaauugccaugccaguuggguaugucguuaucaacagcuugaaaauggacuaauacagucccuuuguggcaauaggguguaucaguuucccacugcugcuguaauaauuuaccacaaacccaguggcuucagacaacacaaauucaucaccugaccuccaguucuggagaauaauugcucccagagauguccacauccuacuucccaagaccccugaggcggugacaggggagccuguucuggagguuggaaagcugaagcggaucucccaggcugaaauucaggugucagcagcugcgcuucuuccuggaggcucuuggggagaaucuguuuucuugucuuuuccagccuugaggggcauccacaugucuuggcucauggcccuuccuccauguccagagccaucaggcuggugaggucuuccucacucugaacuugauucucuggccucccucuuccacuuguaacgaccccugugguuauguugagccugccucgauagucuaccguaauaccccuccccugucccagccucauggguccugggaauuaggauguggacaucucugggagcaauuauucucccuaccacagauucauguccuuaccauaugagaaaaaucuucacucugucucaacaucucccaaagccuaaaccccuggugaaccaccucuacugggcgggcguuucuaugucucucuguguuuuuggaaaaguucuuacaggucuguaguaagaaauucaaacaauauaaaauguuacagagugaaaaguaagucucacucccaacccagauuuuuuuuuuuuuuugaggcggagucucgcucuaucacccaggcugcagugcgguggcgugaucucagcucacuccaaccucugccucccggguucaagugauucucaugccucagccuucggaguaggucggauuacaggugugccccaccacaccuggcuaauuuucguauuuuuacaaaaauagagacagaauuuugccguguugcccaggcugaucucaaacucccggccucaggugaucugcccuccuuggccuuccaaagugcuggcauuacaggugugagccaccgcaccuggcccaucccagaucuguagucuuccaggucucuuucccagaggugacaacaguuauuauuuuguguacuaucacagaugcucugugcauauagaaauguguguuuauggcuuuuguuuuugugcaagcaucuuuuguucaccaauaugcguuuuuuuuuuggccagucuuucuaugugaguacacacacacacacacacacacacacacagagcuccaaaaaaaaagaguuggucuucaccaaugcacaaguaaguugcuucucaaacugugcuacuuuuagcagccuugcuggagccauguguauuauuguugagcuuaauaucuggaggcugaauucauagcaguggaauucuagggugagagugaccuagauagagagaaagaagaugagaucugcuaauuuacaugacaaaaacaauucaaaggccaguaaaaggaaagaucaguaucuucuccuuuaaauaucuugauagaaauagcuuguuugagaaaucuaacugggugaacuccaguuagaucuggucuguugggugauuuguaggccauagucucucugaaauuuuuaggugaccuuugggaguccuuucggggagucgcuuuugauaagcacaucauucagccugagaugggcagggcuaaugcccuguccugcccaucugcgcucaugaaauguucaucaaggaagcagggaguggacucacacacugccucccauccgcacaggacgcgucacucggaauauacauacucccuuugcaaauucuuucccacuuuaugcgcucagcaucuuguguuauuuuggcccuuauccuaguugagccugucauaauuuaucaccccugcuguacugaacaguucuugaggauauuaucaagguugucuguaccucucucuccccuguuguugucccaagcuagcacggugccuguugguguugaugaacaauaggacucaguuuggagagcccuuuuuuugucaugaauuuugaugauggcagauuagcccauuuccuaggaaugauaagcuuggcuuugauugauagaugaggcuaacaauauuuuuuauuugcuaaaguuuaaaaugaauuaauugaaagauagcccugacgacagugguuggggccucccgugauuccucuugguguuguguuuauuguagugauaccuauucugcuauccaggagagguggaugcagcuaaauguacagcaacaaacagcuccggcgaucugggaacuucaguguuuaagauccuugcuugggaaugguuggugaaggcuguuuuuagggcuaaauucugcuuugugacugucaucguuuugcaggccaccgaaucccuuuuggagucaucuuugguggaacugauguaaaugaagaugccaaccaggcggaaaaaaacacagucaugggcagaguucuugaggaagccagguaauaccugcgagaauuucauccaugccaaacauuuaaacugugugaauugaauuaauugaaaccaaagaccgagggcaccaauugccgggaagguuuacaucuuagcacuuaaaaccaauuucauguaaccuuuucuuucauuugguacauuuuuauuuggccacaaauagucauugcuaacagguuauugcacuuaagucuucaacuacaguuaauauuagauaagccucuuuagaauggucugcauggagccaggcauagugaggcacgccuguggucccagcugcuugggaggcugaggcaggaggauugcuggagcccaggagcccaaggcuacagugugcuaugguugcaauccagccugagugguagagcaaagcccucuuuucaaaaaaacaaguguucuggauguagaaaacacgaaucacaggcaaacuccagccuuagcagcacacaaauuaggaucuaguuugcaucagguuugcccaaguagacuaucuuuggcaugggucuuaucuauguagcuuucugagcuauauaugccauuugcaagaagggucaccaacaggauuucuaaacuguggcuuaggccuuuuccuuggguauggcccucuagcugucccagggaccugagagguagcugcugugagaacagcucuacaugcucuaaguggggcuucuuacaggggucacugugauaauccugggggcugcccugcacgucucugaucccagauacugaucaugggcagcagccuccagguaccacaacuaccuuaguaugucucccuauaauucuaaugcccccagggugggggaaguuauuauccccaguugagaauuccuuccagcgcuguacuucccaacuuuuccaugucaauacggugaaaggagguucaucggaggcuguuguucuggaccagcccccgcacugucccccagcggacuagcccaagacagaaaggagucacuugugcugagcgcuauguaaucaaacugaacuuugaaaugggucagccuucuuucucucuucucuucucuuuuccugacagagucucauuccguugcccaggcuggagcgcaauggcgcgaucuuggcucacugcaaccucagccucccggguucaggcgauucuugugccucaggcucccgaguaacugggauuaugggcgccugccaccacagucggcuaauuuuuguauuuuuaguagagacgggguuucaccauuuugccaggcuggucucaaacuccuggccucaagcgauccaccugccucggccucccaaagugcugggauuacgggcaugagauaccgugcccagccugaaaugggccaguuuucuaaaaggcaagaaauuccaggcaacuucagucagcagaauagggaagucuucucugcuuuaacccuguagggaaaguaacucugaaaugccccaucugcuuuuuguuuccugugucugcuuucuucagcccuugucugucuguaaaacacgccuucucugcgcagcucaucagaacacucauucuguuuuguagaaugaggugcugcccaauucuagaauugcugauaaaggcccauuauaaucuuugaacucaauuuguugucauugugucuuuugacaaggcauacuuagaaaauuaucauauuuguauagcaauuuaaaguggauuaaaagccuugauuaaaaaaaucacucccauuucuuugucuaacgaauaacaauaauaagaauuaaaauaaugauaaaaucaggccgggcacggugacucaggccuguaaucccagcacuuugggaggccugaggcagguggaucacuugaggucaggaguucgagaccagccuggccaacacggagaaaccccaucucuauuaaaaauacaaaaauuagcuggguguggugguggguaccuguaauuccggcuacuugggaggcugaggcagaagaaucacuuuaacccaggagguggccaggugcgguggcucacacauguaaucccagcauuuugggagacugaggcagguggaucaccugaggucaggaguucgagaccagccuggacaacagggugaaacuccaucucuacuaaaaauacaaaaauuagccggacaugguggccugugccuguaguuccagcuacuugagaggcugaggcagaagacuugcuugaacucgggaggcagagguugcagugagcugagaucgugccauugcacuccagccugggagacagagcaugacuccaucucaaaaacaaacaacagcaacaacaacaaaagaacccgggagguguugguugcaguaagcaagauguugccauugcacucuagccugggugacagagcgacacugucucaaaaaaaaaaaaauuuaauuaauuaaaaaaauaaaaaauuaaauaaaauaaugauaaaagcaauaugaaucuuccaugaucauaugaaaauugugaaaaaaagcggaaauuaaaucaaaagaacuaccuauacaugcauacccaaaacaaagaacuuuucugaucagucaugaggugcucagugggcuuccucgggguuuggcuggacagucaaggggguucugugcaguuuguccucccacauguucacuggcugcugguguuagaagaaagcuucaccugugucuagaauaacccugaaaccacaguuuacaguugguccaacaaguacugccuaacuaucccuucgacccuuuuaaaucuuugaaucauuguagagaacaaaacaaagcaaaacugguaauugauuuuaucccaauaaaucaccagccauuaauuuucuguggcucaccucauggcugggaagcucuggccagggaauuugggacacuucaagucuuuauguagcuggaucacccuauuccauacaggggacagcauucaaaguucugucgggagccucagauuccuuguuugguaauguaggugucagucucgcuucugaaaaccaggguuacugagagguaucacugcauuuaggacccuaguccuuccugaggaccccgaucguauguuguggcaaugcaaauguggacccaaaaaaccugagacaggucucaguuacuauuuagaaaguuuauuuugccaacguugaagacacgcacucaugacccagccucaagagguccugaugacacgugcccaagguggucaggcacagguugguuuucuacaucuuagggagaugugagacaucaaucaauauauguaggagguacacugguucggucuggaaaggcgggacaacuggaagcgaggcaggaagacucaaagcagggagggguuuuccaggucacugguaggugacagacaaaaggucgcauucuuuugcauuucugauuggccuuucccaaggaagcaaucagauauacauuuaucucagugagcagaggggugacuuugaauagaaugggagggagguuugcccuuagcaguucccagcuugacuuuucccuuuagcuuugugauuugggggcccaagauauuuuccuuucacaccaccuuaucauaauagagagcacacgugugagugugcaugugugugcguguguguguuacaauaaaaaaagacauuaaaacacguugggguuaccuugaaaggggaucuuuuauuacagguuuucuuauugcuguuguucuuucacucugcaaauucauuaccuuuagauuccuguaguugguaaugcacugccuuacggaagaaaaacaauucuguuuacuagaaacaacauugaaugaauccaucuuacaguauuauuauuaguauuauuuauuucauuguuauuaaagcaaacacggauuucuauuuugggggguuauugaucgagguuagugggcaggaaagcugcauggaucagauucuuuguccaguacaacauagcacacguuucuguaaaagaaaguauugaacuugucuagcuuuauaaugaguauuucauuuuuaaucaaauguuuuuaaauaguuauauuuuuccuauagggucuauuuuugaaguuuuuuuaguauuuaaauuuuuuuucuauauuauauaguauucaaacuuaccuuagcuucagcuuuuuggcuuauaaauauuauaauguaauaaguacuugauaauuacauuaucaauaucaaaacuaaaugaagaguaugugaaaccuauggaaauuauuuggugaaggaucauccagguacauauuagaagaaaauauucuuggccaggcaugauggcuaaugccuguaaucccagcacuuugagaggccgaagcggguggaucacugaggucaggaguuugagaccagccuggccaacauggggaaacuccgucuucacuaaaaauacaaaaauuagcugggcauggugacacaugccuguaaucccagcuacucaggaggcugaggcaagagaaucgcuugaaccugagaggcagagguugaagugagcugagaucucgccauugcacugcagccugggugaaagagggagacucugucucaaaaacaaaagaaagaaaagaaaaaauuaucgucaagcaaaugagcaaaagagaguuuguauaaaaugaaacaccucaaaaauagccucauaaauaggaaaucuauagcacacgauagguuaaacgaggugaauuugcuguuuuguaggcauaaaauggcugaauauugguaguuucauaaguuuuaagcuauagauauuuaagcccaaagauuuuuuuuacaaaaaaaaucacaugugaaagugaguaaaucuauuucaaaauggcaauguucaacuaaaaaugcaaaaaugguagcuuuauauuuuucauaagaaaugugguuuuuuaauuuaauugaauuuuauuguuuuuuuuuggacacagagucuuacucugucgcccaggcuggagugcaguggugcagucugagcucacugcaacuuccaccuccuggguucaggcgauucaccugccucagccucgucaguagcugggacuacaggggugcaccaccacgccuggcuaauuuuuguauuuuuagugaagauggaguuucucuguguuggccaggcuggucucgaacuccugaccacagugauccaccuuccucggccucccaaaguguugggauuacaggugugagccaucacgccccacuaauuguucaauucuuaaguuucucaguuuugaaguuucccagcaaaggaagguuuacacacucuccugaagggcccauugucaggcaauuguuauuuagcuacuuuucuuucuuuuuuaucuuauuuucacaggauaaagucuauucccccagauacaguuuccuugcaccucuuguuaguuuucagagcaaauggagagcuucucauaacugaggccagcagaacaacccaugcugggcucgagccuccuuccgcgucagcacuguauggugcuuggauuaugaaagugggccuuggugggaaguccagcgugagauccucuccguccgucuuuccuuacuuuucccuucaguaggggaccugugauggaaugugccucgacuggugacaggguuuuagaggaggcagaaaggaaagcucggggcaggcacagacaggggaaguggggccuucuggaggaagaaucugccauuuuuggguccugcugcagggaaggaaucauccuuuccugguucucaucugcaguaauuauuccugugguguuugccugauggugauuuuuccauuugcacugcgucuuguuuauuaacuggaauucuaccuuacggaagacuuuccucuuugaucccauuuacuuauuugauuauuuauuuguuauucaguauggacucgugggggccgggcaugguggcucauggcuguaaucccagcacuuugggaggcugaguuggguggaucacuugaggccaggaguucgagaccagccuggccaacauggugaacccucaucucuacuaaaaauacagaaaaaaaaauuagccgagcaugguggugcgugccuguaauccuagcuacucaggaggcugaggcaggagaguugcuugaacccaggaggcggagguuacagugagcugagacugugccacugcacuccaaccuggguaacagagcaagacuccaucucaaaauaaauaauaaauaaauauauuaaaaauuauauauauauauauaacauggacucauagauauuuauuuuauuucccuuuacagauuaucuguuacuauuuuuguuuauucgguugcucaaauugccccagauuugcccacaggagaugcuuugagcugaugccuguguucuuuugacaugcucucaucauucaucguuuucugagcacuuuucuacuuucuggcaucguaaaaugucccugauucaucuccugucuaccuuguccuacuucuggaaauggcuauuucucaaaggaguccugguuccuuuauaauuuuuuuuuguccuuuuagagaauauuauuuagaaacuaagaucugugcuuauugcuuacucaguguccuugcuuguaagcccucuuagagcuuggaaauguauguauguauauaugcacauauacaacuauauguauuuuuauuucaucacuagaaguaugguucucauuauuugacauugguaugaagcuuaggguuuguauuaggcauccgaauggagguaugaaguagguagaagucugggcaaguuaggggaggggucgggaguuuguuggucaauauacagaagcuauuuuuuuuuuuuuuuugaggcagagucucgcucugucacccaggcuggagugcaauggcacaaucuugacucaucgcaaccuccgccuccuggguucaagcuauucuccugccucagccuucugaguagcugggauuacaggcaugcaccaccacgccgggcuaauuuuguaauuuuaguagagaacgggguuucucaauguuggucaggcuggucucucaaacuccuaaccucaggugauccuccccccucggccucccaaagugcugagauuacaggcgugaaccaccgcuuccggccuuacagaugcuauugaaaccuggaaacuggugagaucaccaaaggaguaagugcagauagagaagagaagcccaagaacugagucuuggagcagcccauuuuugagaaaucagagagagaaauuagugagacugagauugaguggccaguucgaugaaacggaaugguaugguggaaaccaaugaagaagcauuucaaggaggaaggagagagcguaugugccuguugcuauugauagguuaaguaagaugaagacugaggaccggaccauucagcuuaccaacauggagguccuuagugaccuugagcacaguuucaauggugcagucaggggagcugccuggagugguuuaaaugagaagagaggcauuggagguguugagucaagguaacaccagggcuuuuuuugucaaggagaaaagagaaaaaggacaauaauugaagcagggacugugggauuaagggaguaguuuuuauaaugaguagaggagaaaauaaugaugugggagaaagauaggaggauauauauuaucuacaggaagucuugaaagauuguaaguccugacuuuauaaaauauuuuguuaagaauuuucuuucuaacuaaaaaaaauggcugucccaaugcaauguagaaauuuugaaaaguacugaagaagccagggaaaagcaaauuaccaauuuuuuuuuuguacuucaugcgugcuuuaaccaugacuagcuuuuugguaggugaucuuuuaauuacuuacauuuguaugucugugacuauauuuucauuguuauuauuuuugaaaauuugggcugaaugacacauacuuuuuuuuuuuuuuuuuuuuuuugagacagagucuugcucuguugccaggcuggagugcaguggcaugaucuuggcucacugcaaccuccgccucccagguucaagcggucccccugccucagcguaccgaguagcugggauuacaggcaugcaccaccaugcccagcuacaguuuugauaauuuuaaggugccaaacaugguuuuaauggcugcauagaauucuaucauaaauucuguaaaugauucuuugagauugggcauuuauaucuuuaucauaaacaacaccacagggaaaaaucuguuucugucuuuguguacuugucugauugugucuuuggguugaauucauagagguagaauugcaaggucuaacgcuacgaacaugugaauauauugaugcaguuucucaaauuucucuucagaaagaauauuugcauuuuaauucaccaaguggguguauguuuucauuuuucucaccuuugucaacauugggcauuuuuauuuuuaaaacugccaaucuuauaugugaugcaauucuuuccuauuguuccaauuagauuuauuuuguuauuagagaaauuucacuuuuccucacauuuuauggucccuuauauuugcucucacgugaacaucccauuuuucccaucccuuuuugccccuugggauguuuggcuuccuuguuaauuuugaagagcuccugaguaaggauauuauuccucuuuucuccaugucaauugcacauguuucuuccaaauuguuauuuuuguuuuaauuugugguauuucaguaguuuuuaaauuuuaauauaaucaaagcuuuuuuaucuuuagaauuaauuucauagcuuuuuuucuuucuccuuuucauacccugccugugguauccaauaaugucauagcuuuuuaugcucagaaaaccuuucccaggcugaggccagcugcuuguucucuuauaucauuccagacuucucuuguagucuuaccuuuuuuuacuuagcuccugaaccaucuuuugagauauaugauauaagguaggaaacuaacuuuuuccauguauuuaaccacuucucuaaccuuaugcuaugucaaauucuuuuuuuuucuuuuuuugagacagagucucgcucuguugcccaggcuggagugcaguggcacgaucucggcucacugcaagcuccgccucccggguucacaccauccuccugccucagccucccgaguagcugggacuacaggcgcccgccaccaugcccggcuaauuuuuuguauuuuuaguagagacgggguuucacgguguuagccagguggucucgaucuccugaccuugugauccgcccgccuuggacucccaaagugcugggauuacaggugugagccaccaggccuggccuaugcuaugucaaauucuuaaauguauuugggucuguuucuggccuuguauuugguuuugaucuuucuaucuuuuuuucacugccaacacuguuuuaauuguuauauuuuuaauauguuuugauaucuguuaauacacaucucaucuuugaauucuucuucuucuuccucuuccucuucuuccuccuccuccuccuccuucuucuuccuuuuccuucuuccuuucuucuuucuucuuccucugucacccaagcuggagugcaguggcacaaucauggcucacugcagccuugacaucccaggcucaagcgauccuccugccucagccuccugaguagcugggacuacaagugugcucaacuaugcccagcugauuacaaaaauguuuccuguagagaugggggucucccuauguugcccaggcuggucuugaaugccugggcucaagugaucuuccugccucagccucccaaaguauugggauuacaagugugagccacugugccuggccugaauucuuuaucaaaauuuucugauuguuugucacccaauuauauguauagguaaacuuuaaaauuauuuugucaaauuucaauagaaauccacuucuggauuuuauuugaauuauugauuuugucacguaauuugguaaaaauggacguuuugauaguauuggagcuucccaucuaagaaugugcuccacauuuccaugaaaaaguaucucuuaauauuccugcacuucauggcaaacauaauguuaauaaauagauuaccuuguuuucuuaguuuugagaucccuugugcauuuccuaaagaagcaauugaaaggagggagaugauaacagugagcacccaugugcauucaguaaauugugauuguguccccauagucuucccuuggcagagcuaguggaguggacaggcugcccuugaauggucaggguggauuaacccagcaaguuccuugcuucucuccugcaucuucauuucuugcuuuugauuuuaucccugccucucugaacuugcguggaaggaagagaaaaaauaggaguuuugagcuucguuugguuuacuucuugcauauaaaacuuuuuuuugaugugaguugagauuaaaccuaauggccaaugaccacaaguaauaaagauugauugcauuuuaaauuuagugucucacguugucucucauaauuuguuccaaagagcuguuucauaguucuuuuaauugaauucuggccuaauuguuucuauuauuuuuguucauuuacuagauuugcugucgcuuucacagagucaaugaaggaaauggcacaagcgcaguggguauguguuuaucugguguuguuauuuugguugugcugaugaaauugcagaauucgagaaccgaaaggcagccuuacugagcugacaguguucccauggacggugccuguugcggccacaauaguguauuauguuucccauagauugauuuuguauguguagaugcaccuaaaacgucccugauauuuuuugauguuguuauugaaugacaaaaguagcccaguaaugguuguauguuguuguuguuguuuuguugcuguuuuuuuuuuuuuuuuuuuuugagacggagucuugcucugucaccuaggcuggagugcaauggcgugaucucagcucacugcaacuuccaccucccggguucaagcaauucuccugccugagccuccugaguagcugggauuucaggugcacaccaccauacccagcuaauuuuuuuguauuuuuaguagagaugggauuucaccacguuggucaggcuggucucgaacuacuggccucaaaugaucugcccgccucagcaucccaaagugccgggauuacaggcaugagccaccgaaccuggcccuguuuucuuucuauguucucagaucgggugauuuaucagcugcgcuauaaauguugcagcaaccuuguauacaugagaguaacaaucucuuaggugacagagguaguuuccuggguuggaccguuuauuagaagagcuuuaaacagucaagaguuuguagauccacaaguuaguucauuuauugacuuuguauucaugaugacuuagagggcugguguaugagcuggugggaacuuaacugaauucccaguaaggagcuaugugaacgcaccauagagcuggugccugcaaaacuaaagaaaaaaaccaaaggucaguuucccuuuggugagugaggcugcugucucuggcggugggaacugcauugagccugcuccaccagcguucauccgcugugcacaaugugcaugcccugaucauuugcaggcguuauuccuguugguugggaggaucaaggaacagggcuuaugcccugaucauuuguaggcucugcccauucuuuauggaauugcaauuugcaaaauggugguacuugaaaacugcugcacugggacaagggcagaacccagucaucuguggucucuuccgaaagcucgggaugcuagacauaugugaaugugaaguugcacacgcccugacggcccauagucuuacucuuuauaucagacuuuucccaggcagagcauggagguuguauuuccuagugcaguuuaaugacuugucaaucucaguauuagaaaacccaacaggcauccugguuuccaguuuuauuguaauaccaaacuuuuuuuuuuuuuuuuugagacagagucucacucugucacccaggcuagaguguaauggugcuaucucagcucacugcaaccucugccccccagguucaagcgauucuguugccucagccuccugaguagcugggacgacaggcaugugccaccacacccggcuaauuuuuguauuuuuaguagggacgugguuucaccauguuggccaggcuggucucaaaugccugaccucaagugauccacccaccucagccucccaaaguguuggggcuacaggugugagccacugcaccuggccuaccuguuggacuaucuaucugccuucuuaagguaguuuucaaaccagugguuaccaaaauggggucccuggaccucugagauucccugggacucuuucagggccuccgccaagucaagcuuuuucuaaauaauaaugcaaagccuuuucuuuuggcuuuucucaugguuuaaaaugcagugaugaguaaaaugcagcugccuuaauacuaacgaaggcaguggccccaucugugcuaauauucgcugauuagucaccaccacccacuuaagccaguuucacuuaaaaaugucccugaugaagaaauacaaauuacuagcuuuucaaauauuaacuuuugaauacauguuguuauuuuuuuuuuaguagagaugggguuuugccuuguuggccaggccagucuugaacuccugaccucaagugaucugcccuccucagccucccaaagugcuaggauuacaggcgugagccaccgcgccugaccuuuucucucucucucucucauuuuuuuuuuuuucugagauggagucucgcucugucgcccaggcuggagugcaguggcgcgaucucggcucacugcaaccucugccucccgguuucaagcuauucuccuaccucagccucccaaguagcugggacuacaggcgcccaccacaacgcccugcuaauuuuugcauuuuuaguagaaacgggguuucaccauguuggccaggcuggucucgaacucccgaccuugugauccacccaccuuggccucccaaagugaugggauuacaggcgugagccaccaugccuggucccucuuuuuuuuuauuauuauuauuuuuuuugagacgggcucucauucuguuacccaggcuagauugcaguggugcaaucauggcucacuggagccucgaacaccuaggcucaagccauccucccaccucggccucccaaagugcugggaugacaggcaugagccacuauguguggccaaauuugaauuuucaaguaaaauuagaauuuuggaaagccagcaugagguugucaguuucccaauaucugaaggcuuuccugaugaaauugguggcucuacuaacaaaucugaguuuuuuggauguuguauaaugaaacguuuaaacauuugaaagaucuucaugacucagugaaccaguagguuuucaaugaucaauaugugaccuauagaaucaaguacagaugaaagaucaguucauaguaccagguagaccaauggacuuuaauauaacugaguaugaaaaguucggccaggugcaguggcucaugccuguaaucccagcacuuugggaggccgaggugggcggaucaccugaggucaggaguucgagaccagccugaccaacauggagaaaccccgacucuacuaaaaauacaaaauuagccaggcaugguggugcgugccuguaaucccagcuacuuucgggaggcugaggcaggagaaucgcuugaacccagaagguggagguugcagugagccgagauuguaccauugcacuccagccagggcaagaagagcaaaaauucugucucaaaaaaaaaaaaaagaaagaaaaaaagaaaaguucccugaugcagcuaaacuuuaagaaauugccacuugcugaguuugggugcaguguccaagaacaaugccuacagugaucggaaaggccauuaaaauacucuuucuuuuccuacuaccugucugcaagaggcaggauuuucuuuauagaccucaaccaaaacaacauauugcaacaaauuaaaugaaacagcaaacgugggaacccaacuguguugguuaagacagacauuaaagaaauaauugccaggcgcaguggcucaaccuguaaucccagcacuuugggaggcugaggcgggcagaucaccugaggucaagaguucaagaccagccuggccaacaugacgaaacccugucucuacugaaaaugcaaaaaauuagccgggcaugguggugugcaccuguagucccagcuacucaggaggcugaggcaagagaauugcuugaacccaggaggccgagguugaagugaacagagauggugccacugcaagacuccgucucaaaaaaaaaaaaaaagaaagaaauauuuuaccuguggaagcaugcuccuuuuccaugaauucauugcccuuuucucuaacuugucagccuucaauaucauccuccaccauaaauccuuccuugacccuccagaauuggcauagaugaguucccuuccucugucaguuaccuuuugcugcuuaacaaaccaguugccuuaaacacgcaggguggccucacuuccaugccuggaccuuagcugggaugguggggaccccugaggccugucuccauggggucugucauccuguuuuaggcucggcaggaagagagaacgggccucaacucacaagcacauuccaggccucugccugugauaagcuugccuccuucccauugaccaaagcaacucagcggguggagauacgguccccaccucauaaugagaggaucuuuaaugcugccuuacaagggcacggaugcagggagggggagaauugauggccucuguaaccaucugccacacuucaugcuugucucuaaugaguauaacauguuuuacuuucuuccccgugcuucucaaguggugagcuucuugagaaagggacaugagguagucacucgugcaucccuggagaauaguauauacugucucaggcccggugaauauccuuuaaauugauugauuaggaacgacuccuccuuuagaaccuuuugguuuuuuuaaauauuuuuauuuuuauuuuuugagauggaaucuugcucugucacccaaggugaaguacaguggcgcaaucucagcucacugcaaccucugccucccaaguucaagcuauucuccugccucagccuccugaguagcugggauuacaggcucccgccaucaugcccagcuaauuuuuguauuuuugguagagacgggguuucaccauguuggccaggcuggucucgaacuccugaccaugugauccgcccgccuuggccucccaaagugcugggauacaggcaugagccacugugcccggccagaacuuuuaauuaaagaaauuuucaggcauguguagaaguagcaagaauaguagagugagcccuuuaugugcccaugacccaguuuauuguuccucaauucuuauuuacucuacuuccuccugaauacacacacacaccuacacucacacacacacauacaauguuuucgagaauaauuucaaaaauuaccaauaucaugccauuucaccuauaauuaugugccauuuuaccugcaaauguacuuugauaaagacuuuuuuuaaaaaacauaaacacagugguacagguaacuuuuguauuggcagaccacagucaguaaggaagaaauaaagagggguuuaagagcguucauacaaccuaacauuuuuaucaauacaguuuggaagaaaucaaggaauagaauuuggagggggaaaaagagaggaacugaaucauuugguucuggauguauugacuuagugacaaauauuggacucggguaaauauccagaauagagcugagaauguaggacuguccucagaggagggcacaguuggggacacagccaugugagucacugguguccaggugaugguuaaagcaugaaaacagucuuuuuuuuuuuuuuuuuuuuuuuuuuuugagacagagucuuucucuguugcccaugcuggagugcaguagugcgaucucggcucaccgcaaccugcggcucccggauucaagcgauucuccugccucagcuucccaaguagcugggauuacagaugcccaccaccacacccaacuaauuucuguauuuugaauagagaugggguuucaccauguuggccaggcuggucuugaacucccaaccucaggcgauccaccugccucggccucccaaagugcugggauuacaggugacugccacuaugccuggcuaauuuuuguauuuuuaauagagacuggguuucaccauguuggccaggcuggucucgaacuccugaccucaagugaucugcccaccucauccucccaaaaggcugggauuacaggcaugagccaccgcgccuggcccauuucccacccuaaacacucagcugucagguauuacaccacuuacgccguuucccagaagcuaagggugcaggucaugccucuguuuggucaaggccgaauuuccuaguacacacccacuauaugucaucaauaugaaaguuacuagugacaucauauuuuaccuuuuugugugugaagucuuugaaauccuguguguauuuuacacucacagcacaucuuaauucaaacagggccuuagacgugcccuggaucagccacguggccacguguggcgagggcuguugugugcucagggcagcucuguuucaggauuucugaaacuuacucacacgauaucugauccuggaggacacaugaacggacaugugcccagugaggguuaguuuguaaccggugagugaacuucagcccccagggcugcucuuguggaaauguugucuugggagcuggguuuaugaucgccuaccuaucucuggcugaccuucacaaguuaguuugauuggauuucaguaaagacgguuuuaucucuuuuaauuugaaaugccuuuguuuaugcucaagucauuauuuuuuaguguuguuuauaucagccuuaauuugacauuguaccuacuuuguaaaauauacaauccuagugggcuccucaccaggucagcaugcuaggcuguuaaugccuagcacgcgugaucaacguagguuauguuuugggauggcauuacuauguugguuugugauauuauaauauaucuuuuaaguguuuuuuuuuuuucuuuauuaaaggagucucacucuguugcccaggcuggauggagugcaguggcgugaucguggcucacugcagccucaaacucgugggcucagacgauccucucccccucagccuccuggguagcugggacuacaggcccaugccaccacaccuggcugaaauuuugacuuuuuuuuuuuuguggagauaaggucucacugcguugcccaggcuacucuugaacuccuggccucaaguaguucuccugcaucaaccuccuaaaaugcuagaauuacaggcgugagcgucugugcuggccaguuucugauauuauaauauugauuugacauuuucaagaauuugauucauuucacauuucugauccugaaauauauguugugggaaguuugaaaauauuuuauguaggauuuugauuucuugcuacaauauguaauagauauucaggaugcaaacuugaguacuucuaguucuaguccacguuuagagcgcuuugucuaaauucaucagaauuucaccagaaaauguaaaaauuucaccaagaagaaaaaaacacccacgaacaaauuaaauguguaucuuaauggacgcuucuaccaggagaagcaaugguuaugguuuaauaugucuccauugggcucaaaaccccucaugccuguuuucacacucuuuuccuaauaagcauucuucuaagaggacauuaucuaaacucaaauauuuauuuaugagcuauauuuaaaaaauccuguuugaguaaauauugcuugaagcaguuaucaaauucaaacaaaaaaaagcacagugucauucauaauggcccaucaauaugcuuugcaaaggcuaaguuuucagguguuaucuuuagagugagguuuuucuuuuuuuuuuuuucuuuuuuuuuucuggaaacuuugagucacccccuucuggggccuaauuuaucuacuuugccuuggcacuugugaaagaaaaguaacuucuucaaguugcuguguuaggcaaaaccuaaaguguaauuuuacuuuguguacauuuacucaucaaaauucuuuuggaaauuaaaauauagaaagcaagacagaucucauuggcugucacaagugcaguuccuguacaggugagcuccacaagucagugcagauguuagcgcuggccuaaucggaaugagcugcgugucuccuuaucccuaaagucugcaguagaagcaugcugucuuuugagcuacuuauuacuucucccucuuccugcauggccccauugcuuuaugucugauuaccucggaaagucaucuuggcagcagcugaaacuacacagaccauaccuuuuauuagaguucccacccuccuggaaacauaaaaaugcauugaacacguggguuucaccucuagacuaccucuuuucugugccaacccucucaccucugcaggagaagcuccagggauugaucaugucccaggaagcuaaucuuuuuuuuuuuuuuuuuuuugagaccgagucucgcuuuguugcccaggcuggagcacaguggcgugaucucggcucacugcaagcucugccucccggguucacgccauucuccugccucagccucccgaguagcugggacuacaggugcccgccaccacacccagcuaauuuuuuguauauuuaguagagacgagguuucaccguguuagccaggcuggucuugaucuccugaucuugugauccacccgccucagccucccaaagugcugggauuacaggcguaagccaccgugccccgccacuaaucauuuuuaauagcuucuaugaaggugagcccucauuggagauuucuggauggaacugcaaauguucuuuaugucuguguggguuuuuuuguuuguuuguuugcccccaugugagaucccugggaauugagaaguuugaaaggaacucagaaguaugaaaaacgcauccauuccagagcauagaucuugaguuuacuuuuuccaugacccggggcucaaaugugugguaccaucacaaguauuguuuguaauucauuaaauugcccaggcagagcaugguaggggaaucuucugaauaaaaugaacaaucauucugaguuguuuacuccauacauuuaauuguuuaaaaaaacaaaaaucuucucuggaaauuuccuguugauguuccuguuucuugagucgccccaguagauggggugccacacucucauccuuuuauuuugugaagggucacggguuguucuuuuaaauuuauuuaacuauuuauuuuuuagacgagucuuguucugucccccacgcuggagugcaguggugcgaucucagcucacugcagccuccgaaagugcugggauuacaggugugaguccccgcgccuggccggauuguguuaacuucaucucuauugcugcuccauauuggaccugacagaauccuaccccagucuaguuucaacauuucuuucucaucucacccacguauuuucuuuuacuuuccuucuuucuuucuuucuuucuuucccuuucuuucuuucuuuucuuucuuucuuuucuuucucuuucuuucucucucucucucuuucuuucuuucuuuuucuuuccuuucuuccuuucuuuccuucuuucccucuuuccuucuuucuuuccuucuuucuuuuuuucuuuccuucuuuccuuccauccuuccuucuuucuuucuuuccuucuuucuucuucuuuuuuuuuuaauuguucuccuacccaaggcggaagacuggcagcucagcuaggugcugggcucuguaugguggcuggcguuucugugggacacggagggcagcaggaaggaaaauaaacacgacaggccgggcgcgguggcucacgccuguaaucccagcacuuugggaggccgaggagggcggaucacgaggucaggagaucgagaccaucuuggcuaacacggugaaaccccgucucuacuaaaaauacaaaaaauuagccgggcguggugacgggcgccuguagucccagcuacucgggaggcugaggcaggagaauggcgugaacccgggaggcagagcuugcagugagccgagaucgcgccccugcacuccagccugggcgacagagcgagacuccgucucaaaaauaaauaaauaaauaaauaaauaaaaaauaaacacgauagguccaagcgucauuccacuggguuuugauauuggcuucgcagcuagucucccguuucugaccugugccauccaucuauaaugaagcaggacaccaacgcuucuuccucauauuccagaaucccaacucuugaaaaccucuuucuuuguuguuaaaauguugugaaguguuagugucuggacauuuuuuuucuaugaaaaaugauuaaaguacuuccuaguaaaaaaagaaaagaaaagaaaagaaaaauuguucuuugugugguugguuccauugcaggaguucaguggcaaggcugaaucuccccacaccucgccuuccuuuugaauauuacuuucuuuuuuuuuaugcacgauaacagauuucuaagggaaaagaguagagggaggaaaaaagacacugugaccuugaaaagugcccaauuucuuuguguuuuguggcauaaauauauuuugcaacuuuauauguaugggccaucauuucuuuuaagcaguuuguaaucguuuuacaaguaguuuuuacaaagccacagucugaaguuguauuauaauuucagaacaaaaacuauuauuuuugucaucuguagagcauaaaauugugccuguauuucaaaaauaaucuauugugguuuccauuugcagaaaguuuaauuuuagaaggugaaucucuggcuuauguuuagucaaagaaugggaaguucuuugguugauguuauuuccagcaugaaaagguaucaguuaguccuugggucuguuagaaguccaucuauuuauagguaucuauccaauaggauccuggcuuuuuauauccaguaaugagccaaagagguaacaguugcugauagacacaccucaguguuugccauugugugcacugaugagcuaaucugcaaggcaggccguacacaaggacuuugacucauguuauuucaaggcagagagaacaauaauaaauauugagcaaagaaagcuaauuuguauuuguuacacuuucauauagaaaauguuuuucaaaaucaauauaagccaauuggcuuuugccagauuucuuuuauugcaaugauuacaaauaacucagguccagacuuccuuuauacugcaacuuuauuuccucuguuugccuggaugagaucugaaaauaccauuuaugcaacgcuuuucaaaugauuagaaaaaugaugcucagagaugugggaagaucagcagauaaguccagaaaucuucacuuucagucaauuccuucugcugacagagcugagauacaaguuuaacucuuuuuuuuuuuuuuuuuuuuugguggaaaaaggaguuucuugacaggaacauuuugaguuuauguauugcuaauugcagagccuauuuccaaugaaaauagugacaaaaacuauaaacucuauguugccucaccuuauauuuaucuaggauuaugcugaaucuguuauugucaaacacuuauauuaaguuauauuaaguuaaaugccaugguguucuauugugagugcuuuaccauccaucuucaagauguugccaggcgaguguuuuggacacaggguuguuuuaggaagaaacacuccaagccuccacuacacuccaguaacagcucuuccagcuuuccagggaaauuauaauucagcauaaggaguaguuuagggcucugaacugcaauuucuaauuucaauggucgccuuuagccuuuuuuuuuuuuucauuaaaguuaaugucuuuuuuaacugguagagaagaggucuuugaaacucucucuuaaagguuuacuauuuuaagggcauuuggaauaccacacauaccugcuugcacgaugaaguggggaggagaggcaagacuucuggaggcuugagaugcuuccuguagugaaauacaaaaugcgaugcuaaggacaaaaccaacaccauaccgagccucguguguacccaccaccuucuuuauuuuuuuuauuuuucaggcagagucucacucugucgcuuagucuggagugcaguggcgcaaugucggcucacugcaaccuccgccucccggguucaagcgauuguccugccucagccucccaagcagcugggauuacaggcgcaugccgccacacccggcuaauuuuuguauuuuuaguagagacaggguuucaccauguugcccagacugguuuugaccuccugaccucaaaugauuugccugccucggccucccaaagugcugggaucauaugggugagccaccaugccuggccgugccacccaccuucugccuggaugcugccucuaccaaaccuucccaggcuuggggagggccagucuccuucuuccuguugauugucucgcccuuggcagggcuacuucacuuuagcuugugucccaaaauauaaaacugaaguggggacaacguccaacguggaucagcauaccccaugcagugccgagggcucccuggugcccuaaagaccacacuguaucccuacaccgaggaaggacaggggugugucuucugugaccuccagggaucuagcuaguucagucacuuaaugcauugaucaggcuuaggucacaugacaaaaagacauccauuuuuggacucuuucaccaaaaugacggccuguuuugaucacuugagagaaaccguccuuggcauggacuugcuccaucacucugcuccugccuccaccuuuccaucuaaacgucaccuuaaaaauauuccugccacuguuucaaaaugaacuggagaaauggauucaauuucucucuaguaguuuugugacauuccaccagaaaacauggcaaggaauaguaaguugauaucuugguacaaauauccauauccgucaugcaagggccgccuuuugcuuggugccagggagguaacuuaccagacgcuuuccacccggcuguccucccuugccuggaaggaucugccuccuggggccugucuuugguuucccaacauauuggcagcuccuccuucuccuccugcuccuuucuucuuuuuuucugggggugguggaagcagucuuccccucagggaugcauaagccauaacaugcuuccccaaaccuccaccuccacgcaggggcgggagcugcaucagcugggccggcacuggcaugcucucuggcugaacuucaguaaugucuccacuaauauagcaaguguaaaauugcaaaauugcauuaggccucauuuaagagacuuuuugugugugugcuucuuaccuuauagaugcuguauuuuuaauggcaaaaccuauuaaaaagcagaaguaaugcuuugcucuuacagaguaauaagucuaugagcagcuguguagaugauucucagugauguuuuccaggacggcuuuuuuuguuaaugaccuucauuuuauuucuaaaaagcaguugucaugcacuguccaauguacuuuucuuuucucucuccccuccuuucaaaagccgcaugcuaaggguaaggucuauguccagagucaagguaagauuuuuaaaauauuuauuuacuuauguacagggauagagaaugaauauaucaaaauagaugcauauuuauaugugauaaauauauauauauauuuaaaagaauaaguuugcauccuuaagagacacauauugagauguuuaugaaggagauaauaugauuucucagauuuacuuaaaaauaaucagugaaauggcuacuuuuuuuuuucuuuuuugagacaaggucuggcucugucgccuaggcuggagugcgguugugcgaucucggcuuacugcaaccucugccuccuggguuaaagcguuucucuagccucagcccccccaguagcugggacuauaggcaggcaugagccgccaugcccagcugauuuuuuuuguauuccuuguagaaaugggguuucgccauguugcccagguuggucuugaacuccugggcucaagcaaucugccugagaauggcuacauuguuaagauuuuucuaacauuagaauaaaagauaaauaggagaaauuauaaaauaaugauuuaaaaugcggaucacuuaacauuuucugccaguagaaguacgauauacuccaucagcaguauguuuggaaaaaacaaaccaaaccaaaugcggagcuucuguuucagcugacuugaguugggggaacuggaacucuucucccuucauacuccuccuuccucccugcccaauucugccccuaugguggcaucugaggcccuucaucaaacccucugagguuuaaacacaguuuuuuguuuuuguuuugagaugaagucuugcucugucgcccaggcuggagugcaguggcgcaaucuugguucacgucaaccuccgccuccuggguucaagcaauucuccugccucagccucccgaguagcugggauuacaggugcccccccaccacgcccagcuaauuuuuguguauuuuguagagacaggguuuuacuguguuggcuaggcugaucuugaacuccugaccucaggugaucuguccgccuuggccucccagauugcugggguuccaggugugagccaccgugcccggccucucuaaacacaguuuguaaaccacuguacuacaugauagaaauaauggaaagacuagauccaaggaagaacauguaauuggccccaagcucagguuagaacgagugcagaggcugaggccaggcguucgggccuccugaggacuuccauggugcucaggcgcaccuuagugaggcacggcauccugucaucaccguguccuugcugcauuggcuucagugacauuuuuagcuggugcagcaggaaaaaccugggcucugaggcagcgcguagguuugaacacagcgucuaccaccuccacccugcgcauuuugaagugcguuuaaccucuuugaacaucaguguccagcuggauaaacuggaggaagcagucugcucagugggccuuuaaggguuacaguggaguauggaaagcgccuacaugcagucggagcccagggcuggcuugaaaugggcgcuuguuaaauagccgcugucaguaugauucagugugaauaacgauuaugcagguggauuuuggaggugguuagaugacuugauuuacuuacauuuuauaaaauuucaaaauguuucuguuaccaagauaacguguuagacguugccucugaauuucuaaauuguaaaauagucauuuuuuuuuucagcaaaaauuaaauguaacuucucucucugaagaaguaauagccaacagaccaucaggcaugaguuggugaggguugagagugggaauuuuacagggagguauaauuuucacauggggcuuagcugacaguguuuuugaaaccuguuacuuccuggcauuuuuaaggaacucaagguuugucuaaccccuaaccccguuugggccugucauggauccuggggcugaaaggggugcgucuuuucucauguggaauccaugggcucuuuuuaacccuccugugcugaaggauucaugggacuucagugacacacucagagcaucgagcggcuuuauaaaaaccaggugcuacuguuauuuaaacuucaacacaagugggccgugugugguggcuuacaccuguaaucccagcacuuugggaggcugaggcgggaggaucacuugaagucaggaguucgagaccagccuggccaacauggugaaacccugucucuacuaaaaauacaaaaauuagccggguguggcagcgggcgccuauacucccagcuacucgggaggcugaggcaggagaaucgcuucaaaccgggaagaggagguugcagugagcagagaucguggcacugcacugcagccugggugacagagcgagacucugucucaaaauaauaagaauaauaguaauaauaauaauaagccucaacacaaaauaacucauuguauuucagcagucgcuucaaagugaacuugcccuuuuuuuguuucuuugacccaggaauugcaacaacaccaaacgccgcuuuuaacuggaauaccuuucuucaacgcucuggugagacaugagaucuucuuagaggauuuugaugaagugcaucuugucaguuacuuucaggagcuugugacguucaugcgguuuugaaaaagugguugucagagagaacaagguucauuucccucugucugcggcuucaugaguaguuuuauccuuuugaggaacagcagggcuagaaagccagagagacaggggcucuggcccuuucugaugcuguuuuuagcaccugcuuuccaaauuuucaguaucauuuccugugacauuuguucuuuauaagaauaacaaccucauguguucauuuuauuuuacuuuacuaauuauacacguaguuaaauuaccauuguagaaaaaugagaaaauaucagaauaugcaacacauuuuuuuuuuuuuuugagauggagucucguucuguugcccaggcuggagugcaguggugugaucuagacucacugcagccucuaccucccggguucaagugauucuccugccucagccuccuaaguagcugguacuacaugcaugcgccaccaugccuggcuaauuuuuguauuuuuaauggagacgggguuuugccguauuggccaggcuggucucgaacuccugaucaggugauccacccaccucagccucccaaagugcugggaauccaggcaugagccacugggccuggccaaaaaaugcaacaaaaauuuuaaucacuugaaauuucaucaccaaaaagaaacugcuauuaauguuugaugugaucuuucucaacaauuuacauguaaauaaugauguuuaaaagacaaagucaagcuucacuuacuacucuaaccugccuucuuugcucauuaugucaguagaauagagugaacucauccuuuuuuuaaaauaauucuauaguuuguaugcagugaaaugcagagaucucaaguguaaaauuaggcaaauguuugacaaauguauauacccaugugacaaauaccccaaucaagauagauaacauuuccaccacucaagaaaguucucucaugcccucuuccauauuuaauuucugucucuuuauaggcgauuccuagucuaauuuuucuuaucuuagauuaguuuuaccuguucuugaacuucaucuaaguggagucaugcauugaauaauuuuuuguaucuggcuuucuuuguucaacuaauguguuugagauuuaucccuauuguguguaucuguagaccuuuuuucuuaguauucuauuuuggaaugguguauuucauuccauauaucacaaauuguuuaucucuucuucuauugaugaacuuuuagcuuguuuuccauuuuuaaccguuacaaauacauuuacuaugaauauccuugugcaagguuuuuuggugaccuauguuuucacuucucuuggauaaaugccucuaagucaaauagcuugacuauaugauuaacauuauaaaaaauauccaaacaguucuccaaggugugccaucuuacacuuccacagaagcugacaagagcuucaguuacuccacauucuugcccaccgguggaguagacagucuuuucaauuuuaguuguucuagggagauaaugaaauggugucucauugucauucuucuaaguuucauuucccugaugauuaauuuuguucagcaccuuuuuaugugcgcguuggccauucauguaucuuguuucgugagugucuagccaauugugugugugugucuucuaauuauugguuuguagaacuuccuuauauucuagguacaagccuuuugucagauaaauauauuguuaauauuuucucccauuaucugguuuauauuuuuguuugcuuaaccaugucuuuugaagagcagaagaggcuuaaauuuuauugaagucgaguuuaucaaacuuuuucuuugaugguuagugcuuuugaguccugucuacaaaaucuuuaccuacccuagggucacaaagauguuuuucuuucuuuuuaaaaugucuuuagaaguuuuagugcuguagcucuuucauuuaagauuauaaauccaucugaaauuacuauuuguguguuguaugagguagggaucuguuuuuuuuucuuaacaauauccagaugguuccggcgucauuuauuggaaauguuuuucuuugcccauugaauugcucuggugccuucguugaaagucaguuuacuguauguggccuuccauuaucuaugccuaucuuuauuccaauaucaugcuguuuuguugguauaggguaauaguaagucuagaaaccaaguaguguuagucaauaacuuuguuucagaauuauuuuagcuauucuagguuuuuugcauaucaauuuaaauuuggggcucaacucaucaauuucuguaaaauccuguuacauugaaccuccaccuccuggcuucaagcgauucuccugccuuagccucucaaguagcugggauuacaggcacgccccaccacaccuggcuaauuuucuguauuuuuuggagagagaggguuuucaccauguuggccaggcuggucuucaacuccugagcucaaguaagccaucugccucagcuucccaaagugccgggauuacaggcaugagccaccucgccuagccuccugcugcaaacuucuaagaagagacugaagaugcaaaaucaauucucugcccucagcaaacagaaagacaccccaagucuguuuucaugcuaaagacuugaaacaagaagacauacaugcagccaaaaaacauaugaaaaaaguucaucauccacugaucauuagagaaaugcaaaucgaaaccacaaugagauaacaucgcacaucagucagaauggcgauuauuaagaggccaaaaaacaacagaugcuggcgagcuuguggagaaauaagaacgcuuuuacccuguuaguggggauguaaauuaguucaaccguuuuggaagacaguguggcaauuccacaaagauacuauuugacccagcaaucccauuacuggguauauacccaaaggaauauauaucauucuguuauaaagauacaugcacguguauguucauugcagcacuauucacaauagcaaagacauggaaucaacccaaaugcccaucagugauagacuggauaaagaaaaugugguacauagacaccguggaauacuaugcagccauaaaaacgaacaagaucauguccuuugcaggaacauggaugaagcuggaagccguuauccucagcaaacuaaggcaggaacagaaaaccaaacaccgcauguucucaacuuauaagugggagcugaacaaugagaacauguggacacagggaggggaauaacacacacugggaccugucaggagaggguagggcugggggcaucaggagagcaucaggaaaaauagcuaaugcaugcugggcuuaauaccuaggugauggguugauagaugcagcaaaccaccauggcacacguuuaccuguguaacacaccugcacauccugcacacguauccuggaacuuaaaauaaaauaagauaaaaugaaacaaaaaagacuugaaacaaagccucuaccacauacucuaugucaguauuaaguucuauugaaaagaaaaauuuccaagcauuuuaucagaaauaauuuucguaguguauucaucaaucucagccacacuagcauggcuguucucaguauuacagaugaacccacacgaccucagcugcuuugucaugucaguuacauguaccauuauucagaacgagugggcccauuuucaauuuccuguuguaagguuagucugucuucaaucuaucacaggacgcaauggcguuguaacuaagauucauaauuuccaguaggagaaugauuugucaucacauuccauagucucaggguugacuguuucguuggucuugcuauugaaugauuaagggaacagccaggagauuuuaaacacuccuuacaaagcguuuuccucuggagaccuacuuggcugcugcuuaaucuuaaugugugcaauuagaaguuguaaauguauucagaauauaugggcuuagagagacugguuguggcucugauagcugacaguggcagauaacggcuuaaggguagauguaggauuaaucugcgucucuggguuuuaugaucaggcaucuguucgcauuugugccaucguuugucuuugucgucucucaggcucuggggaugggccguccucaucaaccuuacucuaucuucccuuggccucuggagcauuggaaaccugugacugugauuugucccucccacuuggagcuucagacagugaaaacagaagguagagugaaguugguagacacuauuagugaucagauaccaucugccuucucaccaacuauuaaccuugaaaucagggggagugggugggaagggcuucauuuaacacugcauauaaacaguugagugauugauuagucaccaggguguguagugugcuucuuaaaugucugauguccacguggcgaugcauucuccucuuccggcaugucacagguuuucugaccauacucaauucuaucucuaagccccagcuaaagaaugaguaagucuccuuaauuuaaaacaucaaaccccucuuaugcuuaccauuaucucacauacaaacaggucaacuaagaacaaauaaauaauaaagcagguuaaguguaguaaauggcaugguuguaauuuuuucacacgauauugacaauagcuauucugauuggaagauagauguguagacaucaaauuaguuaccuggucuuugaguuuuucugugcauuucuagauacauuuuaaaugugaugauuccauguucuaugaauuuugccuuuaaauuucaauaaccaacacaucuaaagucaugauuccuuucaggcuaucaaaccuaaaacguaugaaagcuuaaauugacuggguaacuccuuccuguuuuucugauuucuguuuuauuguauuucuaguuuuauugcuuauuucucucucucucucucucucucucucucucucucucucucucucucucccccuccaucucucucucuaucucucugucaacucuauuuguauuucuauaauggaaacucaaauuugccuaacucagauuguagcacuuuucuuccucaggcuaguccuaggaaaacucacuuguuuuuuguauggaaaacuaguguuaguagaagccuuuauucuugcauagcccccaaaucagcuuuuucagcuauaauuuaguaagucuaauguguucgacugaaguacuuuuuuuuuguaauaacaagugaaaaauaaugaagaguguguccuggcgcaguggcucacgccuguaaucccagcacuucgggaggccggaggccgaggcagcggaucacuugagggucaggaguucaagaccagcuugaccaacauggugaaguccugucucuauuaaaaauacaaaaauuagccaggugugguagugcaugucuguaaucccagcuacuugggaggcugagacaggagaauugcuuggaccugggaggcggagguugcagugaggugagauugcggcauugcacuccagccuggacaacaagagugaaacuuugucucaaaaaaaagaaagaaagaaaaaagaaaauaauaaagacagcuucuagaauagaauacagggcauagagacugccucagcguggauuggguuucuguuccugagcccgcucaugacucauacuugggagauuaagcaauguggaguguagcuguuggcagcaauaugccagaucgugaaaacaacacauuuuguuuugaagauaaaaauaccguucuccaggaaaugguucuaucggaaagacauuuguuaagugacgaguucaaaucuugacucauggauaaccuagauauuagaggaaaagcaaagguaauaaaaauaaguuuggcauuaaaaggaggagacaacauuuauuaaaaaaauuagucagguaugugcccugucucugagcaucagcaggccaaccuuauuuaauaguucuuuguuaaaagcuaagaauuuauaccaccuuaaagcugucaggggcuuuagggagcccgaaguguaauucaucagaguugaugcuuacgugugaugagccugagcccuugaacacuugaucaggauuuuuccucuauaaucuuuauuuuuggugaaugauauuuugguauguggaaagugcacauaagcuacucaaauccaaaugcugucucuuucuuuuaguuuuuuuuuuuuaaccuagaguaagacaagucuauagcccuuuauucuaucauuuucuaauuuaguuuccuauauucccauuacacuuaaucuccaacccaggaagaagaugaggggagaggaaaggaauauaggauucacuccaucucccugcagcgucuugcaggucaggggucucauaaugaauugaguaaguuagggaccagcacuuuuaaacauugaagugaaaucaaauagaaaacaucgaaguggcuugcauguagucagccuaaaguauguuuuuaaucauauauaaacucuaugucuauguauguguauguguguauuuauauaucucgugugacugaguugcaacauaauauguuuaucuuaccguaugucauagucaaaaaacucugaaaaucaauauuguaucuuauggauuauucucuucucagggccaucuuuccaagggaucccaggacggggguaguuggagggccacuuuuuuacagccugugugaccaaaaugccaaugcgucuucagagccucgaguucucaguagcuaagugugucagaguagaggaacaacauagguuuccagcacucauacuucucacauagcaaaaaugaagaauuaaacagagucucuucaucuugacgucaccugcguucuucacacagugcuuucaauaccaucucuggaugccaucuuuguagauuguuuguuuguuugacauuuacuuuuuuuuuuuuuuccaauucgguaauacugauucuugacuucccccucuuuuugguaccuuugugauucuccuuguaccuuccuucuuucccucuucccccuucuguguauaugaauagacauuccaugcacaucaagaauaugggggaagugauguuucucccuucucagugugucacauauggauguguacagcgucagcuugucccaauacuggagaucuuuuucugacuauguaaacucuguguguguguguguguguguguguguguguauacacaccagcuaugugugcugggcuaaggcuuccuccccuaguuaaacugguauucccugguuucuccguguacuguacagguauuauauuuccuuuguaauuaguaaguaauuuuugagagggugcucuuaaucucuauccucaucaaacuuucacuugcaaauuuuagcauucauuaguggcuuuugccuaguaauguaggcuuggacuguuucuccuaccugaccucucaaucuugaaaaguuuucuccauuuuuaacaaucauuuauuaaaaugaauagcuugacucuugaccucauauucaaaugccuaaccucaaauucuucugaccuacaauucaaauucugcauguagcgucuagcuuagacuuuuggucaaacaaggacucacuaagguuugcauuucuaaaguuagcuucaggauacuuagaauauuaaggaaagggccaggugcgguggcucaugccuguaaucccagcguuuugggaggaugaagccaguggaucaccugaggucaggaguuugagcccagccuggccaacauggugaaaccucaucuguaccaaaaauaccaaaaagagccgggcaugauggccugugccuguagucucagcuacucagggagcugaggcaggagaaucgcuugaacccaagaggcagagguugcagugagccgagaacgcaccacugcacuccagccugggcuacaggcugagacuccaucucaaaaaaaaaaaaaaaaaaaaaaaagaguauuaaggaaauauuaaaaacucuacauauucaaugaaaauugacaaugcagauugucagcggcuuauucagaggcugugacaauuuuccaaggcuuuucuaagagcgacaucucgaucuuaacauuucaguaagauuugcucccguuggguauuaauuuuuugaagcuuuugugauugcauuaaaguggugucgccauaagucauuauauucacacuaguuguauucuuguucaagauuuggaauagcauagagaaaaugaaagugcuugaauuaaauaauggacgaaugccugugcugggaaagaaaaccuugaaccugcauaauuuuauggccaauuauacagguuauaaaugcugaaguuuuaggucggcuuguguaaaauauauuagcaauuucuauugcaugcgucguguacugagcuguaauaagccaccgcaggaugcaccaccugcucccauuuguucuguggugggggguuuggaccuucuaaugccuccaaagucuuugcuaauaaggcucagcuuuuuccuguaucugcagaugucuuggucuggaucccucacuuuuuuucuuuucuuuuuuuuuuugagauggagucucacucuguuacccaggcugggagugcagugcaccaucucugcuuacugcaaccuccgccucccggguuuaagcgauuauccugccucagccuccccaguagcugggauuacaagugccugcuaccacagccagcuaauuuuuguauuuuuaguagagacgggauuucaccacguuggucaggcuggucucgaacuccugaccucaggugaucugcccucccgccucccacaauguugggauuacaggcgugagccacugcgucuggccaggaucccucacuuuagagagcagauucacuauaggaauuuggacugugaagcaaaugugucuaaauuuacgccucuuuuucagaaacuuuuauuacaaaauuaaacauauuuucucauuaaaaaaaaaaugcaccagcugaaagcagccaccccugcauuucuccugaugcugggguuuggcccugcgagggcugcuucauguguguccgcugggcucacuuggacacuuacagacggcccaacccucacuggguccugcaugagcucauaauguguccagggccucaugcagccgggagucuccagacuaaagccucauucuuggccuggagcacuggcucaugccuguaauccuaacacuuugggaggccaaggugggcggaucacuugaggucaggaguucgagaccagccuggccaacauggcgaaaccccaucuccacuaaaaauacaaaaaguagcucggggugguggugugugccuguaaucccagcuacuugggaggcugagggaugagaauugcuugaaccggggagguggagguugcacugagccgagaucgugcugcugcacuccagcauaguugacagagugagacuuggucucaaaaaaaaaaagaaaaaaaaagaaaaagccucuuuuauuuauuuauuuauuuuuuugagacaucuugcucugucacccagacuagagugcagugaccuuggcucacugcaaccuccgccucccggguucaagugauucuccugccucagccuccugaauugcugggauuacaggcccccgccaccacgcccaguuaauuuuuguauuuuugguagagaugggguuucaccaucuuggccuggcugauguugaacuccugaccucaagugauccuggugagccaccaugcccagccaaaaagccucauucuuaagaaugagaacagagaucgcggggccagauuagaggguaccggugugaacggggcaguggggagagugggaagcacaaagucuucccccgcccaggcuuggaaaucacauauggccacugccacugacagccauuggaagucccaggccagccccgggucuugggguacagugaucuguuccacuucagaugggaagggcugcaaagacuguggccauccaccacaagcagucuuagugacagcuuccaaccugggaaacaaugcugcuucuuucuuuucuucauaaauaaauuguuuuuuguuuuuuuuuuuuacuuuuuccauauuuauugagguacaauuaaugaaauuauauguaugugagguguacaaugugaugguuugguaucuguauacauuuuccuuuauauaccuauggacauguguuuguuuaucuuuucuucaacuuuuauuuuaaguucuggguacaugugcaggaugugcagguuuauuauguagguuaacaaugugccauggugguuugcuacacagauuauccaaucacuuagguguuaagcccaagcauccauuagcuauucuuccugaugcucugccuccugcgaccccaacccuccgacaggccccaguguguccuucccccauguguccaugugcucucaucauucagcucccacugauaagugagaacauucgguuuuuaguuuucucugccugcauuaguuugcugaggauaauggcucccaacucuauccaugucccugcaaaggacaugaucucguuccuuuuuauggcugcauaguauuccaugguguauauguaccauguuuucuugauccagucuaucauugaugggcguuuggguugauuccaggacaugcauucauuuagguguguggaucucucuaugcauauaugaguucaugaggacauuaauauauaaaccauuuuucuaguuucaucaagacauuauucuuccuaucuagaauugcaucuaaaucuuuucuagaacgucuggcuccuauuucagucauaguugagucaguucccccgugccucauccuuuuucuuugcagcaaaaguugcauuuuacagccugagcucagcuccauuuuuucccaccagaaaucauuaguuuacagcaaggaaauuaauauaaaaguaagaguaggggcggggugugguggcucacgccuguaaucccagcacuuugggagcccaaggcgggcagaucaccugaggucagaguuugagaccaaccuggccaacauggugaaaccccaugucuacuaaaaauacaaaaauuagccaggugugguggugcaugccuauaaucccagcuacucaggaggcugaggcaggagaauugcuugaacccaggaggaggagguugcagugagccgagccgagauugcaccacugcacucagccuggacaacagagcaagacucugucucaauaauaauaauaauaauaauaauaauaauaauaauaauaauaagaguaggagaagcuggccucgaagucagaggccuccacuucugaaugcaucugugaugucauugcuacugcagcauccagagcccuccccacugaaaacauucugaacucuucucuuacagagauuaaccaaagugcugauaauuugcacauauuucuucugauauguggacuucgacaaguuaaggauccucucuaucugguggacgcauuuucagguguguuugcuggcuaccuuccuccacuguuuauagaauuccuugugggcgcccaucucagcauuucucucuucagggcccugaguuuucuuuccucauucuuugcacgugagcagaacuguuucuagauugcuacuuuggaaaagaacagaaaaauaaugcaugggaucagcagcucuuuggaggaauuucuguuuaguuuuccacuguccugugcccucagguucugagaaaaucauaaaaauagcaaauaaugauaggacuaaaauaauuuuaccugaaaauauuucacacaugcugauuugugugaugcauuuggaguuuugguuauuguuuaagguaaucgauacagucuugguauauuccaaaguccacauugaauuggggugauauuggagacuaguccuaguuauccaguaaauuagaaaucuggacaauggauaauauuguagaaauucacuuaaaaucauaaaaugucaaauacagaaauucuaaauaaauauaauuuaaauugccuaauauuaugaaugaaagccaaaugauaugaaauaauuuauguuauugagaaauuuauauugaaguuaguugugcuugcagcugugacuuaaacccauuugaaguguuuuuuugucuucuuuuuucuucccaagccuggcaucaggaggagcccaaugugcaccuggugauuguggguccugaaguaaguugaugugcaguaaacacuuaucucaucucuguuuuccucuauauacuuuuuauguauuuucuacaaucaguuuacauugcucuucuuuauuuuuuugagacggagucuugcucugucccccaggcuggagugcaguggcgugaucucggcucacugcaaccucuaccucccggguucaagcaauucuccugccucagccucccgaauagcugggacuacaggugcccaccaccaugccuggcuaacuuuuuguauuuuuaguagagacaggguuucaccguguuagccaggauggucuccaucuccugaccuugugauccacacgccucggccucccaaagugcugggauuacaggcgugagccaccgcgcccagcuuacauugcucuucuaaccaaguggaguuuuccucuuuuuaaguaaaugaagucaauuugccucuuaaaaaugaaaacuagaccaagguuaaagaucauuacaacggcaaugaaucuugacgacuaauuuauugcuacaaaggauaacuaauaacuucuacggaaauacagaggaguccggcugggcgcacuggcucacgccuguaauccuggcaacuucgggaggcugaggcgggcagaucaccugagggcaggagucggagaccagccuggacaacauggugaaacccccaucucuacuaaaaauacaaaauuuagcugggcaucguggugggugccuauaaucccagcuacucaggaggcugaggcaggagaaucgcuugaacccgagagguggaagcugcagugagccaaggucgcaccgcuguacuccagccuggccgacagagcaagacucugucucaaaaaaaaaaaaaaaaaaaaaaaaaacaaaaaagaauagaaaaaaagaaaagaaauacauaggaguccuauaaaaagaaaauuaaaguuauauaaagugaaaauuagucuaauuuggugcauaaggcaaauauuaugugugauccaaauugucuuugaaauuuccuuaaauugcucaacaaacuuggcacgguuccuuccacccagcaucagauggcaggugacaccuuugggagccuuguuguguggaaaaugaguaucuguaaauccgagaaacacgcugggaugggagacguucugguggccgugacuaugguggccgugaccgagggauggagccccugagagccacuugcagaugccgccucccauuccauggggacucugggauauucacucgucccucaccagaucaggaccaaacacgugcuguguuccacgccaguccuaauagaagucccaagggcuuaggauucauagaaucuguggcugcacuggucaucucaugagaaugagcucgucuuuacuccaagcgguuuggaaaacagaauacaccuaguguuuccagccagacaggguggaccgcugccagugacagcuccgcguguuugugguuuuuuuuuuucuuucuuucuuuuugagauggaguuucgcuccugucacccaggcuagaguacaauggugugaucucggcucacugcaaccucugccuccuggguucaagcgauucuccagccucagucuuccuagcagcugggauuauaggcgccugccaccacaccuggcuaauuuuuguauuuuuaguagggacggggguuuuaccacguugggcaggcuggucucaaacucccgaccucaggugauccaccugccucgaccucacaaagugcugggauuccaggcaugagccaccgcacccggccucuuugugggguuuuuguuccaggguugcugcuauggccugagugugugcaucccuccagauuccuauguugaaaccuguuccccagugugaggguauuaggagguggggccuuugggggugauucagauaugagggcagauuugugcccauuagggaggccccggagagcugccucgccccuuccaccaagcgaggaccuggcgagcaucuggaugggaagcaggccucgcagacacccaucuuucccgcaccucaguguuggcuuccacccucuggaaccaugagcagcacauuucuguuguucgucagccucugcuuuaugguauuuugcaauagcagcucacauggacuaagcugccuggucugcagcguuaaauaaagucuguguggcugcacuggucaucucaugagaaagagcuugcacugacuccaagcaguuuggaaaacaaaacgcacuuagcguuuccagccagaugggguguaccauuggcagugaugacuccguuucuucagggguguucuguuuccggucccuaaagcagcagugucccugaaaaucugagugaagcgaacucuacacaacugccaggcaccuugucuguuuugugguucuuucuuauauaguuuuuuguaguucccuagggaccccaaaaaagcaugacaugggaguuacaagcuuuucucaguauuuucaaaggcuuuuggaaauauuuaccuggaaagggccacaaaagguauuaaaaaugucaagggcuaggccaggugugguggcucaggccuguaaucccagcacuuuggaaugccaagaggggcgaucaccugaggucaggaguuugacaccagccuggccaacaaggugaaaccccgucucuacuaaaaguacaaaaauuaaaaauauaaaaauuagccaggcaugguggccugcaccuguaaucccagcuccucgggaggcugaggcacgagaaucacuugaaccugggaagcggagguugcagugagccaagauugcgccacugcacuccagccugggugacagagcaagauucuguuucaaaacaaacaaacaaauaaaaacaucaagggcuagaaucugugugaccacauugaauaccauauggaagauaaauuacgcuuaaauguggcaguuuguuaacauacacccacauauaugcaugcacacacacaccuuaagugcuagcauuguaguaguaacaagauaauucccagugugcuaauucauguuaagucccauagagguaugguuauuauuauuacuuuuuaaaauuaucuugucauuuuucuguuugaagaacauugaaagaaaaacuucuaguuugaugcuaaaauucuggcuaaucaagagagaaggccucagacugggagccaugagcaggcaacaacaguaucuagaaggcauuuaauaaugugguuuucuuuuucauuguuuucauucugaugaucacaucucagguacagugcuugauaccagcuuuccaauuaugaaaauugccuuucaaaauaaauugacuucacaaaaaguauaagcaguggugcagauggcaugcagauaugaaaaacggugcaagugcaugcgacuagccaaaguuugggaaagaguucuguacagcauuagcgugugggauggaagaaauacuuaaaaagaaccccugcuggagaugaucauccacaaacacugaacugacgaucaucuggucgcaaugucuggcuuuuucuggaucaggaagcugguacggggggcaaacgcaggggcacacagauagcacuagguaugugacagagcccucuuccagagaaguaaagacucugggcgcguguaagcugauugcagaggcgggagaagagagagcugcuagaacaaaggacgcugccuggauugaucuguccucuuuaacucagcugccugccggugagggagcaggugccauuuguuucuuaauggcuucuuaaguaauagucuuuuaggagagacgaccguuguugcugcuguuguuuucauaugaagcaaucagaaauguuuuucaccucccggaggaaauacgucucuucuaccacccuuuuuuuuuuuuuuuuaaaaugagacggagucuugcucugccgcccaggcuggagcgcaauggcgugaucuuggcucacagcaaccuccgccucauggguucaagcaauucuccugccucagacuccuuaguagccgggacuacaggcacgugcuaccacgccuggcuaauuuuuuguauuuuuaguagagacgggcuuucgccauguuggccaggauggucucaaucuccugaccucgugaucugccugccucggccucccaaaauccugggauuacaggcuugagccacugcaccuggccacuuuuuaauuuuuuuuuuuuuuuugauauggagucucacucugccacccaggcuggagugcaguggugcgaucucggcucacugcaaccuccgccuccuggguucaagcgacucuccugucucagccucccgaguagcugggauuacaagcgccuaccacuacguccggcaaauuuuguauuuuuaguagagacggggguuucaccauguuggccaggcuggucucgaacuccugaccuccggugauccgccugccucggccucccaaagugcugggauuacagguguaagccaccgcgccuggccccccuuuuacuacuucucuauggaacacggcaccuccccucuaacuuucguuugccugcuucugaaagcacagugaguguaaaaaguguuugucuucccuccuaaagugucuguuaggaaucuugucccugcagggccgggagcugacucugcaggagaagccacaaguccagaggccuccucuuuuuauuugaaggggugaaugugugugguuuuuuaauuaaaaauaaugucagugaaaugccuuuaguuuuaagugcugggaacuaaacacuguguucaugugaggauaugugcacacacacgcacgcacacacacacacacacacacacaacguuggccuuguauguccuacaaaaugcaucucuguauuuucuuugcuuuccuaauucuggaaggaggucaucgcgaaauggguuugagcaaggaucgccauggcuuugccuguugaggaguugacuaggacuugacauugcaggauuagggaacagucgggggcguggggcugcaugaaggugcugccggcuccuggccgcgauggaaagccccgucuggggaagcuuuagcuccuccuugauuuccagagauccccccucuccauuuccaagcuaguccaacacaucuguaacauaccugaugacaacauacgugguaggcaaguacgggucccagaugaguccccuagagcucacaccccaacuggaucgccgucccugaaacccccauguccccgucuggagcugcacguccagcccagcacguuaguuggcuuggguggagcagagaacacaaaguaaugagaggaaaggguagcugggagaggcggcccugcagcagaguguccgggacccuggugggaaggacuguggucugagaguuuuuuaaauucgucgccaucaauuauuaagaauucuaaagcaccucuuucacgaggcacuuugcugucuauaauuaaagcagcccuaggcaauggaaaagugcacccuuugguuauggauuuguuguuucagcaaacaggucaugagcgccaggucugugccuguugacacgcagccccgagcuguccugggauuugcugaaaccgcggcucccacauccaaucgcgguuugcagcgaggccgccggucuucagccucggggggccuuuagcagaggcgaaggcucugggcacgacccugguuuaagauccggcucugggcacgacccugguuuaagaucccugccucgucgaagguccuccauaucuaagggaaaagcaauagccaccgccacaaaaccuugacgccaucucaguggaugaaauaauuugaguuucuacguuucuaaggucucgcggagucuaagaaauuacaagccccuuccaacaacuuauuuauucuggacucccccggucccacugaagccucacagcguggggggccucugggcagguguuucagugccucgugcugcagauaggcuggugucuucgcuuguuguuuguuuuuuaaccguaagcaggaaaccacuccucuccgggagagagagcuuuuuaggacguggggaagcccuguuuccuaaaagcccuguuuaucaguguccaugugucaaugcuuuaccaaggccaguuucuaguuccucagccgacgucacugaacacagggugcggaagcgaugcggguagacgcaggcggcgcccgugcgcaggcggagccgagucccgcgcauuucacacgggaagccgccauaggcgcacacgcaugcgcacgucagaaacaagcucuauugaacaauacgcuuucuuuuacuucaugcaguucaugcauucugauuuuuuaaaaacugucccgggcugcccuuugggaugauaugcuguucuauucuacgucauuuugagaaaugcuuguuuuuuauuuuaccccaaaauugauuuuauaauuugcuacuuaggguguaguuugaaaagcugugacuugggugaccccggauggagggucuguguguggguccguggguguguuggacucugguuagggccagugcacuuacugcuuccuuggggugaaauucucucucugcagaccucagucuggcucagaugccacccucucagacacccuuccccugaccacccaacugaaacucccucucuuccaucaucauuauaacauuuccaaacaucgacugcuuuucagagucaaguauucaauuuaauuacacuucugaauacagaacuaggaggggacuaaggcgauuucaugcuugaaguugacuauuuccugcagugugacuagggcacgugcugaagauugggagauggaucugagaagugggcgagaggucaagucuugggacacauuaaaauucuuauuggaaagacuauggcauacaacagauuuaacacccugaaucucaccacuauucgugacauccgacgggagugcacucugcuucagcccaugucuuucucuguuaacugcaaagcucaaugaaugaacacacccuuuagguaucagcuagacacuuuggagggcuggagcuuuucuaggucacguucagugccucuuaguacaaaaccacauugacuuacugugucuucaaagagacagucuuuuuuuuuuuuuuuuuuuuuuuuagauggaguguugcucuguugcccaggcuggauugaaguggcacgaucucggcucacugcaaccuccacccccuggguucaaacgauucuccuuccaaguagcugggauuauaggcacgugccaccacaccuggcuaauauuuguauuuuuaguagagacgggguuuugccauguuggccaggcuggucucgaacuccugacuucaggugauccacccgccucggccucccaaaguguuaggauuacaggcgugagccacugcgcccggccagcucagucuauuuuuaggaggcaauggcagugcaucuaugcaguguuucccucuuguccauuucucuccuugaagcccuaguucgcaggaggucccaaugaagaaaccacaccagcucaguccugagccuccaccccaggcaucagaaaccaccucuggcccaacgccagccaaaaguuauugauuagaagaagacaaggucucacuaagagaauuccugggcaggcuggcgagccagcuuggauuuaggcagaaccaagacauuccagaggccaggaugucgcgucaagaagcccuucauucaaggcuucacaccugagaaaaugagccccacccaugccucagucucugucauucucuucaaggacgggguccaggacaggguccuggaagucucugucauucucuucaaggaugggguccaggucaggguccuggaagucucugucauucucuucaaggacgggguccaggacaggguccuggaagucucugucauucucuucaaggacgggguccaggaagagggcacugaauuguccccgccugggucauagcccacccuuuugugagccuggaacaggacaggcuggaaaugcuucagcagaagcaaguacaggcggggugcgggcuguguggacuuuugcacuggccauuucugggcgcagccaggaggcaguugauauucaaagcaguuuucuuugaauaucaucucucugcuuuuuaauuugcauuuucuacucuaccagagcuuuaugaaauaguagaguagccgggcgcgguggcucacgucuguaauccuuuugggaggcugaggugggcggaucgcuugaggucagguguucgagaccaggcuggccaacauggugaaaacccaucucuacuaaaaucacaaaauucacugggugugguggcacaugccuguaaucccagcuacucaggaggcugaggcaaggaaaucgcuugaacccgggaggcagagguugcagugagccaagauugugccauugcacuccagccugggugacagagugacucugucucaaaaaaaaaaaaaaaaagaacaauagaguagagauguucuuagauugccuaaaaugucgcugaggcugcauauguuuuauuuauauuuauuuguuuauguauuuauuuguagagaugggaucccacuauguuucucaggcuggucuggaagucccggccucaaacaauccucccaccuuagccucccaagucacugggacugcaggcuugugccaccaugccuagcacuguuuuaguuuuuaggugccguacacaugcucauuuuugugguaauucuuagcaagaacuuuuuaaaaagauggguuguagucccguacgaaauccacgcaaucauucaaugcuaaccgcuggcaaguuaguuaacaccccuagaccacaaccacauggcuuuguaguagaguggucacacgcaugucguggauucuggauccagcuaccugggugcgcaggacuuaacugcucugucccucaguuuccccaucuauaaaauggggacgacugagcuaauacuaccugccucacaguuugcagcggggauucgaugagugaacacuuggacggugccuggaauagugccugguuccuaggcagcauccugugaguguuaaauaaaauaucuuuuuuuuuuuuuuuugagacggagucucacucuguugcccaggcuggagugcaguggccugaucucggcucacugcaagcuccgccucccggguucacgccauucuccugccucagccucccgaguagcugggacuacaggcacccgccaccacacccagcuaauuuuuuguauuuuuaguagagaugggguuucaccguguuagccaggauggucucgauccccugaacuggugauccgccugucucggccucccaaagugcugggaugacaggcgugagccaccgcacccggccauaaaauaucuuuucaugcugauguuaccuuucugcuuugacaugcugagauucuguuuuagcugcaggaugguuugagcguggcuuugguuuucuauuaaagcuucuuugaucucuuagcucaaccguuucaacgaagcauauggucucugcuugcaggcgaucauaugugggugcauuuucuggugcucuuugauaaggagugggguaugcacauuugguuugagcaugacagcuuaaugacuuuccacaauaacuucuuauaucgaagauuacuucccuuaagccuaggaguuguaacaagguauuuugcuagaaaauaaauaagcuuggaaggaggaaaugagaauuuucauuguggcuugcgaugcuuuugcccuuuaaaauuucaugacaugugcuuucauuaaauaaaaauauccccccuucuuuuucucuuuaucuugcacuuuguuccacguggcuucacuaagagauuugaaagugaacugauguggaagguaaauccagaaaaauuuaaugcaguuuuuaguuucaacuugaaaguugcuguuaugccuuaaguuuuagauaaaguguuuuuguggucuuauaaaauuugauuucuuuccuugauaaauuauuuuuccuuaguuauucaugagagcagaggcaugcuaauaaaauuaaaaguaagagaaauuccuaacuaaaaauacucauaaaaugugauuuugaaaauuaauauguagagcccaaaaaaggcuuucauuggacuguguacuuuuucaugauaagauguuaggguuaaaggauaauucaguuguuuaggauaauucgagcaaaaggcaucagaaaugggaaauggaaagguggggucugcuggaaaucauucuuuuugcagaucuuaugagcauagaacuauaugcagggcccugugcauggccuugggagggacauggagauaggaggagaaggugggcaaguaucaaaagacguuggccccugugguaggagguguuaccauagcgugggguggagauguuacuucuggacagggugaugggaaagugucucagagagggggcauugccugcaucucagaggaugaauagguuuuggggacagaggaugacauuccugguagagagaaugcagggacacagauagacacugauaugguuuggcuguguccccacccaaaucucaucuucaguugcaaucccgugaucuccacgugucaugggagguaguuuaaucaugggggugguuacccucacgcugguuuuugugauaguaaguucucgggaucugaugguuuuauaaggggcuucccccuucacucugcacuucuccuugcugcugccaugugaagaaagacguguuugcuucccuuccaccaugauuguaaguuuccagaggccuccccagcccuuuggagcugugagucaaguaaaccucuuuccuuuguaaaugaugcagucuuggaugugucuuuauuaacagugcgagaacagacgaauacggacacgguugggguauaguggauaaauuaauaaguagguaggcuuuccagaaucgacguaagcuuaugaacuauaucugaggaaauacuuuggacagaaacuagagaggcagcagagcauaguuuuacaaauucagccccaggagucagccugaaugugaauacuggcucagcaacuuucuagcugugugauccugguuaaguuauagaacucucugagcuucagugucuucauuuguaaaaggcggguaaugauaaccagguuguuggaagaaauaagcuaaugcauguaaaggacuuagcauauguucugcacagaguagguggccgagaaguauuaacuauuaauggcaacaacagcaauaaacaaaaaaauuguguauggcuauaauuuuucucuugaaauagauuucuaggaauucuuuuaaauuuucuuaugcauccaaauuggcugaaggcuaacagcaaauuuucagugacuuagugaccucagggaugucaacgagcuuaacauuaccaauccuuugcguuaaaucucaggcuuucuggucaucugaaggagcugggguuuaauacacacgugaaacaucuccuugccagaagaaauggaaauaaaguuucuagaaagcagcguuauuucaguuaguguuauaaacuguugggauaucaucauauucuucaaaccaacuugguuuguaacucauaaugccuacugguaaaguguaaaugagaauagaaauugaauaugccuucacucccggcucaucaggaguagcagcugggaagaaacugcaggcauagcauuagcaaaauguguuuagacccucugccuguaucuuugaauaaaugcuuagaauuuuguguuacacuugcauauauuuaggaauuuuuuucaguauuuuaaaauucuauucauugucgauaagaccaggagaggcauggguguugguuguuuuguugaagacuuugcuguuggaugagccagauaugauaacuguauucugcagcuuuguccugagugggcuggaaaaggugaaacagcacccuaggaagguccucucagcaccucaguaagcaaacuuaccugaggccagguuguugcacaagacgagaucauugcacaagacgagguugcauaagaugaugucgugucacggugagguuucugcuggugaggaguguggcugcugccccugggaauccagggguuccuuucaggcaaucagggagcuucucucuaccucccaguucuggaguuuucagaaguguggcagugucacuuaaucucagauguguacuuaaucucaaaaguacacauuugaggccgggugcagcagcucauaccuguaauccuagcacuuugggaggccaaggugggcggaucacuuaaggucaggaguucgagaccagccuggccaauauggcgaaacccugucucuacuaaaaaaaaaaaaaaaaaaguacacauuugagauuaagcucagccgggcacaguggcucaugcuuguaaucccagcacuuugggaggccgaggcaggaggaucacuugagcccaggaguucgagaccagccugggccacauugugagacccuguguuaguucucccacugcuauaaagaacuaccugagacuggagaauuuauaaagaaaacagguuuaauuggcucaaguuccucaggcuguauaagaagcacagccagggaaugccucaggaaacuuucaaucacaguggaaggcgaaggggaaguaggcgcgucuuacaugucugggucaggaggaaaagcgcgaggcuggaggugccacacacauuuaaacagccaaaucuccugagaacuccaucgcgagacaacacugggggauguugccaaauuguuagaaacccccccccaccgccgauccaaucaccuccuaccaggccccaccuccaacaauggggauuacaauuuaacaggagauuuggguggggacacagauccaaaccauaucagaccccauuuuuaauauauauauauauaucuuauauauguacacacauaugugugcauauauaagauuaagcuuauagauuauuuuguauugguggugccgucuguagcucucaauagauguauuuuguauuguauuguagcucucaacagauguauuuuguauugguggugggaucuguauugguauuguauugguauuuuguauugguggugucgucuguagcucucaucguuauuuucuucuagcauuuuucuaauaagacuucgacauuugacuuuuuucuucugcaacacauauagcaguuacugugucccaggcacaguucuaacagcaaccagagaggcagcagagcauaguuuuacgaauucagccccuggggucaggcugaaugugaauacaggcucagcgcuucaugucuucucagucauuuacuccuccgagcaaucccaaggugcuagaguucucauuggacagacgagcaaacugacacgcagagagguccguuaaugugcaugaggcuaguuuggugccuggguggccugacccuggcccucuguauccggaguccccucagucuggugcugccucuuucuggccuccacacauccacuacgaguuugcuuaaaaacuucuggccugucuuugaggagcgauaaguuugaacauguugcuauuaauuuuugcaugaauucaacaaguguguuauuagccuucaggaaugcaacaggacggaaauagucccugccccaaagcaccuguuccuuccagaugcaaagcaggagucaagucgggacuggaggauguuagguugugacuaaugaaaaggcugccccuggccuuuaaaaaguugagguggaauucacaugccacgaaauucaccauuuuagaggguacaagccaguggguuuuagucuauucacaaaguugugcaaccaucacaccuaucucauuccugaauauuuuuucucuccccaagaggauacccucuauccacuaagcagucacuucccauuuccgccucaccccaauaaccccuaauuagauccugagugaccccuggguaaccaccaaucuacuuucugucucugugauuugccugcuuuggccauuucauagacauggaaucauacacucuguggucuuuccugucugguguaacucacguggcaucguguuuuccaagcucacccuuguugcugccuaaguuggcacuuccuugucacggcugaguggcacuccuuuguauggauuggcacaucacgucuacucauucaucagcugaugaucagguccuggccuuucaaacuguuucugcgaagucauccuguuaaaaaauauuuugauauggucagaccuuuggucauagacuuacuaaggauuccaaccuauucugccugaaugauuuuaugacaaaauccuucugcaucauuuaagcaacacuuccacugcaauauugggugguugucaaauugucccauuucuggaaacgacucugucucaagaccuuaaguuggcugaaggguucucacucaccacacucagguguagccauacaggcuccuaaccagagucuauauguauucuuuggaacauucugucucuucuuucucucucucuuucucuuuuuuuuuuuuuuuuuuuuugagacagagucucacucuguuaccuaggcuggagugcaaugcggucaucucggcucacugcaaccuccgcaccccggguucaagcgauucuuccgcuucagcuucccaaguagcugggauuacaggugcucacucuacccccacgcccagucaauuuuuguguuuuuaguagagacaggcuuucaccauguuggccagcaggcgggucucgaacucuugaucacaugauccccccuccucagccuccuaaaaugcugggauuccaggcaugagccaccagcaugagccaccgugccuggucucucucucucucucuuuuuuuuuuuuuuuuuuuuuuuuacuauuauuguuuuuauuauuuaauagcugggcucauaguaccauuuccuacuuauuuuuuucccucucugaauuguugagucuggcucugcugccauuugauguaauuccuggagacuuagcuucauuucaggcuuuugcuaacaugugucuucuuuuuuuuuuuuccacuguuuuaaggucauuuauuagaacacagucauucagaagccacugagacaucaggcagcaggaaggaaggugggguggagcaggcccugugaaggaccaaggacaaaguaauagccucaguuaugaaauuucauuuuauucugauaaagacuaauguaugccugauaaccuagugauaauccacaaguuugguaguucacaacauuuuuagaaagcacguacgauuaacauuuaaauaaggcauuauagaaaguuuuauaaagaaugaaguguguacuauaauucuuuuaagaaacuuugguucaucuugaaagaucaaugaauuuuuaaaauaucagaagaaaaggaaaauaaauuuuuuuccccaaaaauacauaagaacugcuuacuggcacuuguauuuuaaguaccuggggaaaaaauggaaaagauuuuuaaaggcaauuaauaacagcuuguacgagggcuuguuucauuuguucuggcaccaaguaaagaguaaauacgccauggaagacgccaucagguuuuccguccaccucuccuacugccccacuucucccagaccacacagcacaucagcagccauccuugcugccccacucaggaaucacuuuagauuccaauuuucuuuguuuguuuguuuuuguuuuuuguuuuuuuuuuuugagacagagucucgcucugccccccaggcuggagugcgguggcacgaucuaggcucacugcaacauccaccuuccggguucaagugauuccccugccucagccuccugauuagcuggggcuacaggcgcgccauccagcccgaguaauuuuuuguauuuuaguagagacgggguuucaccauguuggccaggauagucucgaucuccugaccucaugauccacccgccucggccucccagagugcugggauuauaggcgugagccaccacgcccggccuagauuccaguuuuuaaauggcuucucagaugacaccaacagaguucuuucccuuuaaaauaagguggcagugaaugcuaacagguaucgauuucuuggaucaggaacaaagaacuccuucaggaaacucacuuacugguccugguuaaccuauuguguaaagucuuuuuauuggcacaccuguuuacuaauuaugauugauugcuauuuaugccaagggagcguuucccaggcauaucucaucuauuuacuaacgacaaagugugcuuacuuuauuuacauagugccacagguuuucucuuuucucucuuuuuuuuuuuuggcagggaguggcacuauaacuuguuauuuaucagggcggaucauacauuuggaucaaaaagaggaaccggcaaguagauccuaaaacacauuucucaaccugagucacaucugaaaacauauagauuuuaauuacauuuuguugaaaauucauucaacuucggugcuuguccaagaacuuauaauguuaauuucugacauaaaucauaacccucaguacauauguauuuucaaaggaaacaagucaucuuaaaguaauauuuuucuauaugcgaauggauacauuguuguagcaaauugaaaauucugaguaaacugaaaguaugcuuaacaacaaaauaaauacagcauauaugguuagcauacacauuucuuaguagcagaggauuugugucuuacaacaaaucuguaaacccacuugcuuucuuucugguauuuuauauagugucuccccauguuccacaacgcuggagaugucuuuuguggcaucgaucugugcaaacauuucugaucacauauuuucccccaaugacauguaacuuuuuuuuaacuuuuccgggaaaauacggaagcuuuaucaaccacuuauuaacugaacaaaaacuuagauuacuaccaaaugcucuuuuaauuuugcuccaacagauguuuuaaaaguucagacaucacugauguuuuugaggauagcugcguaaaacacacuagaugauuucaaaggaugaaucuuaguaucugacucauuuggcacauccuuaguaucuagaaucaaaucaguagaaauaaaagucauauaauuuucaaagaauucauacauacuggaauucuuaggaaaagcagcuucuaaaugcaaggacuaugagguuugcccaucuuacuacuaauaguuccacacauuucuccuuauagaguaacugaagcuuccuggcuuguuugaggaacgucaguuuggaggaaagcauauccacagggccaaaucuuguugguuucuguucuggagaauguuuccaacaccgcuuuuuuucugguaauaguccaggacuggcuuuguuuggcuucauaagccuuuagucucuugauaaccaucucugguuuaucauccucacgcugaaugagcggcuccccugucagagcaucaaugcccacaguugugggaggguugaauccaauguuguagacuuggccauuggugagaugaauccagugagcaguaaggcguuguuuaaugaccucaaaggacauauucagguuaaucacugugucggucugaucagcuuuaucuagggcuucugccuguggaaguguccuuggaaaacuauccaacagcuagacugggugagauuuugcaguuccugaagggccacgccaagaugacaucauuugggaugaguuucccuuggucaaugaaagccuuggcuaacacgucaauuuauauauauauguauauauauauauaaaguucugggguacaugugcacaaugugcagguuuguuacauagguauacaugugccauggugguuugcugcacccaucaacucgucauuuacauuagguauuucucguaacgcuaucccuccuccagcccccgacccccaacaggccccggugugugauguuccccucccuguguccauguguucucauuguucaauucccaccuaugagugagaacauguaacaggccaauuucugcgccccgcagcauguugucccggagcagguccccgcuggaaaggugcuuuagcucgaaguauugagugauacgcgacgacacagugcccuugcccgagccgggggcccccaugaucaccacacgcagcagccgcgaggacacccccguggccgcagaccgaggcccacgccgcgcuggcaccagggcuuuggccuggcccgugcuggccggcuggcagcgccacuagcaggcggcgaccgcugacauuuaucuuugucucuuuucaggucgauccaguguuuacaagggaagugaaagccaaagugaaaagguaagaguugguggagaccagucauuuugcagaacgggaagccugaguggccccuggguuaccugaacucacauuuauccagucccaggcacuauuccaagcaguuuccaacuguuuccucaugcaucuucccggcgagcccguggcauccuaggcacuauuauuugcccagggaaaggccaauaaaaaucacuuugugauuauaauuuuuaauggaucacauuggccagaauggaaagauuuaaacucucaaggauuuggaagaauggagggguauugcccuuugucacagccugccuggagggcaauuuguugguguguugguuauaaguugcauuugucggccaggaacccaacagcacaggcuugaacagauugaacuuucauugcucacaucaacaagucugaggguggucauucaaggagcaaaacggaggcuucccugagaccucagggauuuggcuccugucucuguccugacuuccucagccuguggcucccauccugaaggugacaugguagcuauagagcugugucaucagucugcauuuuaaguggggugaugggaaugagcagaccagaaggaugugggucuuauuugggucagcccccuguaaaguggugucuucacagccccccaggauuccagccagacucauuggccacaccaaccacaaagggcacugacaaagacuguuuuuuccccaucuauaaucagggaucuuuagauugcuccuaggugcagacgcgugugugcaaaaguaucaccugcucggggaagggaggccuggcagagccaugagagugguggccagcgguggggacggggaagaucgaagaaaggcgaagauuuacauugucuggugaaaaaaauagaacaaggcaaaaugucuaugacaaaauagcugucagcgcugugugcugggaacagggcuuuugugacauuaucgucucuaguauuucuauuuccauucuuuuuuguuguuguuguuguugagacagaguuucgcucugucgcucaggcuggagugcaguggcgugaucucagcucacugcaagcuccaccuccuggguucacgccauucuccugccucagccuccugaguagcugggacuacaggcacccgccgcugcgcccggcuaaucuuuuguauuuuuaauagagacaggguuucaccauggucucgaucuccugaccucgugaucacccgcuuuggccuccuaaagugcugggauuacaggcgugagccacugcgcccggccuccuuuuuuuuuuuuuuuuuuuuuuuuuuuuuuugagaccuagucuugcucugucauccaggcuggagugcaauggcacaaucucagcucacugcaaucuccgccucccggguucgagcaauucuccugccucagccucccaaguagcugggauuacaggugcgcaccaccacgccuggcuaauauuuguauuuuuaguagagacgggguuucgccauguucgccaggcuggucuccaacuucugaucucaggugaucugcccgccucagccucccaaaaugcugggauuacaggugugagccacugcacccggccuauuucuauuauuucuauucuuauugucucauuaguauuuuaaagaauuauuugaaaaaaaguugaauuauuagaaaaauguucucuaaaucaugcagagaaaauggcaugaaccuugucucugacucuucuaguccuugagagcaggugucuuuauggagcauauggaaaacaaaagcagacauguuaagcaacucccucccucccuugucagggacaugagcuguaaggauuuccaccccaguauaguucuccuggcugaacgcuuggucaacaaugcuuacuugcugaucuagaguauuacacccaaauugucaucucuccuccucccagcugccuacccaugagauucuuggaaucagagccacucuuccugcuuuguguuucagagccgcugggguacgauugauuggagagaugccucaagaagaucugcacgcgguggugaagaauugcuucgcgguggugaauagcucugucucugaaggcaugucagcugcaauuuuggagguaauuauguaacucgaguacugaaagugggagugugaaauuguccaucacuccuucuccuauuuacggaggugacgucuuugucaauaacauucugcacuucucaaagcuaaaaaggccaagcagcauaccuguuggaguucaaaaguacuuuugaaguucuaucugggaguuuaaaaauaucauuucauuucucauugcuaucucuccuagccagcuacgauguaaaauaaaacugggauagcauugccucucugaccuucuaaauaucucugacaggaaggcagcuaagguuacaaaagauugagacaggaaacagauugaagguauuuuugcaggaagccucccuuuacuugaucuuuucucuuucuuuuccauauguucuguaauuccagaauuuaagggaggggaagaaagggcuggacuuugcagguggcaggagacaggggcaggguaguguucguagaugacgggguggcgugggggccaggguggaucugaucucuucaucuagcagucagcucuauaaaaucgcuucaucuuuuuugacaaaaugugucuaucccagcaccacucugcaauuccccaccagcauaucuguguuuucaggaccgaggcuggagugggaaggccgugcucgugaaacccaggcaggcccuggcugggcuguguccccucuucuguaaaagauccuggcaauccucgcauucccuuugcaaugggaccaccuacaucucuucuccuccuugagagguuuuugacugggguauuuaaccauuaucuucggugcuugauauuagguccuagagagaaucaccagcaugugucucacagaaaaagauguuccuucucuuguuucguuguuaguucauugcccugggggcuccugaagaaugaacccagaaaagggcaggcugggcucacucacaccaacgccagccuuuagcacuggguuuuccucaugcgauuaaagcacccaggaccacaagccugauucccuuggugguucucagcacacacacugcacacgacagacauggcguaaacaagcauugaugggcacgugauaaagccuguuuuccugucgaaaggaaacauguggccacugcuuccugaggucuuugauccagguuucauguguucuuucugaauacguagauuucuuaugucagugucuacuuagguucacgcuguuacuuuaucauaagucuuugggauauccauguauccccuuggauaccaggugaauguacugaacuuacugacaaaaguuaagaucugcaaaccuuugggguccagagagaacaugguaaauaaacuaggaaaaaaauccucuccuuacauuuaagaaaugacugacguuguaugcauaauauuugcucuuaauuuggcaucauuuauaaaagaaaaaaaagaccccaaagaaaaaaacacagagggagauggcagaagcuguguguccgugcccaugaaucugcuguuaggugcuuucagagcacaaagugugaguuuguaacgugaucauccucagccagaugucagcaccucugcuuagggguugucacuaguauuaaucuccauuguccuuucaaauuaccucccaacugcaguccucggggcaauacauuuuauucgucauguaggcuuuaaaaguguauaugcuuaugguaccaguauuugaacuauugugaacugcuccuuuguagguaaauauacauuuuuuuucaacuucuuaaggaaagguagagugaaauucgggaaugauuuuauaacuagcacacacagcacuucacugcggaugaaucgcugucaaaccucauuuacuucaaagcaaaggcagcuguuagcaacucugacugccuuaaaaucuugauguuguguuccuuuugaaaacuccaaaauaaccuuugggcgaaguguuuugaaugaaacugauuuuagaggagugguaagggugcauuucauuagaauucaauucagauagccacaguguuuaaucauggaauaagugccuaucacuuuugaaggaagugaccuuuugaccuuucagaauuagcuguauuuucccauggaagcauagaaacgucccauuugcagaaacacguuucuuacugauaaacuccaaaaaucaaacuuuagcuggauucgugggcagcggggugaacaauucuacaacuaaucaguuguuuccacuuuugagcuuuuugacggaguugaauccugcagagaauuacauuaaaaguauauaaacaguuauuugcuuaucccagccaucaugauuaggcucacacacacacgcacacacacaggcacacacacacacgcucacacacaugcaccuacagaugcaugcaugcacacacauguacacacgcacaugcacacgcacguacacacacguguacgcacacacacacgcucugccugagagagaggaagcccaucuucuaaagcagagacgagcaccugcaggaaggaggggauuccuggccucuuggcuuccagacuccagcccuagugauugaagugggaugugaaggcauucaaaggcagcugcgacucugugucacuuuaaccuugacuaguuucugagugugugugugugucuguaaguguuuguaaguguguguguggauacggcagugcgaggccuuucccacuuugaaaagcgaagggccuuuugaguuuucaucauuaggaagaugcuacuggcauguauuugggauggagcagcugcagggagguggggugccgguucaaggugccagaauauagcuaauucugaaaggucaaaagaucacuuccuucaaaagugauagacacuuauuccaugauugaacacuucagcuaucugaauugauucuaaucaauucauugcaucagaguuguacccaaaugccauuggcacccucauugagaaucaccguaaccccaauuauguaagauccgaaugugcugugggcacguguagcccaacuccaucgccacaugacaagcaaugcuuguuugacuugacagacgcuuaguaaaaaccauuaaaaugcaagccgaccucucugcaagaaaaucuagacauggugguuuccagccccagguauacaccagaaugaccuugaagcuuaaaaaaccauaaauacaggugauggugccccccccucacagaucagcuucacuuguuuuggggaggggccuggcugcugagugucuuaugacuguucugcaggguagaacagaggcacugucucuguaaaccuuuaucagcucugcugaaaauggcauccuagccacaaaggcuuuuacaaagagucucaaaugaaguuuccuucugccugcuaagagcuuggagagcucaucugggguaaauaagaaaucaagugaguucucauaggagcagagaguagaaugguguguagcagagacugggaguguggggaguggggagauguugguugaaggaccugaacuuccaauuaggaggaauaaguucaaaagaucuguauugcacgucauggcgacuacaguuaauaacgauauccuugaaaauugcuaagaguagaucuuaaguguucucaccacacaaaacaaguaugaaguaaugcauauguuaauuagcuugcuuuagccaucccacgggguagauguguaucgaaacaucauguuguggccgggcgcgguggcucacgucuauaaucccagcacuuugggaggcugagguggguggaucaccugaggucaggaguucgagaccagccuggccaacaugaugaaacccugucucuacuaaaaauacaaaaaugagccaggugugaugacgugcaccuguaaucccagcuacuaggguggcagaggcaggagaauugcuggaaccugguaggcgaagguugcaguaaacugagaucacaccacuguacuccagccugggugacagagcgagacuccaucucaaacaaaacaaaagaaaacaaaaacacaucauguuguacacuguaaauguaggcaauuuuugcuugccaguuuuuuuguuuguuuguuuguuuuucuaaucaagugaguucaaacacaaaggugucaggugcaucuuggauccugacauuucacuugucuuagucccagaguggggugccugacgcuggcucugaaccgcuuuccgucccaagccugugagucaugcacggugcccuccuguggacucauggggcauguucugaggucgagcacacucaccucugugcacuguccgcccaggcaccgcccgucucccucaggaccagcugcacaacgucaucaucguccaggaguucuucucuccuuaagacguuuccuuuguuaaagguacauuuuguugguuuuccgagaguugacuucggaacuaguuuucuguaaaugugaaacccucagauuacacugaagucucuucgcccucuguucauuucacgucgugaguggguuguguugcaucuuuucugcugaacugcgguuuuccuuggaggcagggccgugcccgccaugguguggaauccuccccugcgucuccccgugcacuguggaccaucaaaugggaugagugaguucaugccuucugucauucagcagaaauguguagagugccaggucugccaggcccuggagaugccgcagcggacagacgcuaaagggccuuguuaucauggaagccguguccuugugagggacggaaagaaggacugggagaugggcaggaagcaggcaaauggaagagugaacagagaacuuuaggacguaguaagugcugaggaggaagcgcagcagcacgacgugacaguggguggcggggaugugcucagggaggcuccaugcugucaugggcugaacuguggccccuccccaaaugccuguguugaaguccucaccccuggcgucucagaaugggaacguauuuggagauagagguaaucaaguuagaaugaggucccugggcagggguguaggguggggguggggggggguggggcugaaaagggaaauuucuuucuuuuuuuuuuuuuuugagaugaaguuucgcucuuguugcccaggcugaagggcaauagccgaucucggcucaccccaaccuccaccucccagguucaagugauucuccugccucagucucccagguaacugggaugacaggccugcgccaccacgcuuggcuaauuuuguauuuuuuuuuuuuuuaguagagaugggguuucuccauguuggucagucuggucuugaacucccgacuucaggugagccgccugccucggccucccaaaguucugggauuacaggugugagccaccgugacuggcuuuuuuuuuuuuuuuuuuuuuuuuugacguacucuugcucugucacccaggcuggagugcaguggcacauucuuggcucacugaagcuuccaccuccccgguucaagugauucuugugccuuagccucccgaguagcuggaaccacaggcaugcaccaccaugcccagcuaauuuuguuucuauuuuuaguagagacuggguuucaccauguuggccuagcuggucuugaacuccuggccucaagugauccucccaccucagccucacaaagugcugggauuacaggcgugagccaccacgccuggcccauguugagcaucuuuucacgugcuuaucgccccauuuauaccuucucugaagaacuaucuagucaaaccccuugcccacuuuuucacuguguucuccuuuuguuguugaguuguaagaguucuuuauauauuauagauacaaaucuccuaucagccuaucagauauuuauuuccuaaauauuuccucccauucuguagauugucuuuucacuuucuuaaugguuuccauugaagcucaaaaguuuuuaauuuuauuuuuauuauuuuauuuuuuuguagaaaaaggagcucacaauauugcccaagcuggccucaaacuccuggccucaagcaauuuuccugccucaaucucccaaagugcuggaauuauaggcaugagccacugcaccucguugaaaguuuuuacuuuugaggaaguccaaucuuccuauuuucuuguuguugcuuguguuuuugaugccaugucuaagaaggcuuugccuaacccacagucuuaaagacuuaacuuguguauuucucucuaagaauuuuaugguuuuaauuuguccauuaugucugugauccauuuugagugaauuuuguguguguggagugaggaaggggccagauuccaaauuccuuccuucuuuggccugugcgcacuaacaaugacuaaaauagcuuuuuuuuuuuuuugucuccgaaacagagucucacucuguugcccaggcuggagugcagugacgcaaucucggcucacugcaaccuccgccucccgggaucaagcgauucuccugccucagccuccugaguagcugguauugcaggcacaagccaccaugccuggcuaauuuuugucuuuuuaguagagacgggcuuucaccacguuggccaggcuggucuugaacuccugaccucaggugauuugccugccuuggccucccaaaguucugggauuacaggugugagccacugcgcccagucuaauauagcuuuaauauaauuuuacuuuacuuuaucucgagaucugguccuaaggucaccuguuuuuuuuuguuuuuguuuuuguuuuuguuuuuugagauggagucucacucugucgcccaggcuggagugcaauggcgcgaucucggcucacugcaagcuccaccucccagguucgccauucuccugccucagccuccugaguagcugggacuacaggcacccaccaccacacccggcuaauuuuuuuuuuuuuuuguauuuuuaguagagaugguguuucaccauguuagccaggauggucucgaucuccugaccuugugauccucccgccucagccucccaaagugcugggauuacaggcgugagccacugugcccaggcuaauauagcuuuaauauaauuuuaauuugcuuuaucucgaggucugguucuaaggucaccuguuuuucacuugggauuuauggguguggagugcguucucaagaccugggacaggucacuaugcucuauaaaacuuacugagucagguaggaagcccaucugcuacuguaaucucauuugcaguuauaacaauucccagggacagauguaaauucuguaguauuaagccauuuaaucuggacaagcacgguagcucacaccuguaaucccaacaguuugggaggccaagguggauggauugcuugaucccaggaguuucagaugaguguggaaaacauagcaagaccccauugcuacaaaacauuuuuaaaaacauuagcugaggaugguggcaugugccuguagucccagcuacuagagaggcugaggugggaggauugcuugagcccaggaggugaauguugcagugagcugagauugagccacggcauuccagcccgggcaacagagugagacccuguccccucuuccugggacccugucccgucuuccccugcaaaaagguuauuuaaucuucccacuacccuuuugaaagagauuuuauugucucuguuuaccucaggggaaacagucaaacagcuggggaagguugagauguugacccaagaugguacaacuaguaucuaguggaaccaggauucacacccaggcaggucaguuucagagcuucccuuacaaaugugauuaucuguuuacuuuuaaaaaguguaaaaucuguagaagaacugaaagaaugguacagcaaauaccuguguacccuucacccacguucauccuccugcuuccucucccucucccucaucucucuguguacacauacagucucuuucucucucuuuucuuuugccaaaucaucugaaagaaggugguugagguugaucaaggcacugcuaauauuucucucugaaacuuugcagauaggugucuucuccugcaccugagaagacaugagcaugccugagaaaguucaguguuaguuaaauuacaucacuggaugugcacuccauacauaauucccucgguguuguauuuuuuuuuuuuuucaggcaggauccacacaccauucaugcauugcauuuggcuuugugucucuuuagugucccccaacccagcuccccauagcucuucaugacacugaacccucugaaagguccuggucaguuguccuugagaacauacugauagauuuggcugacgcauuccucaggguuggauuuacauccuauuuccagcugggacuccacgcaggugauguguacuucccaccacgucaaacgggagacacaucuggucagcucuucugacuguuggugacagauggcuccauugugagggcucaccugucccucaccucuccucugugauugauaagucaucuguggaguggugcuuugggauuuggggacacagaugcuccucgaguuaugaugggacugcaucccaauaaacccaucacaaguugaaaauacugugaguuggcuaacacagugaaaccccaucucuacuaaaaguacaaaaaauuagccgggcgugauggcgggcgccuguagucccagcuacucgggaggcugaggcaggagaauggcgugaacccgagaggcggagcuuacagugagccgagaucgcgccacugcccuccagcuugggugacagagcgagacuccaucucaaaaaaaaaaaaaagagaaagagagaaagaaagaaagaaaauacugugaguuaaaaaugcguuaaauaccccuaaccuaccaaguaucauagcucagccuagcugaccuuaaauaugcucaaaagacuugcauuugccuacaguugggcaaaaucaucuaacacgaaccuauuuuauaauaaaguguugaauaucucacggaagauauuauuggauacuguacucaaagugaaaaccagaaugguuauauuguugcugaaauaugguuuuuacugaacauguauugcuuuugcagcaucaugaagucaaaaaauccuaagucgaaucauuauaagucagagaccaucuguauccuguuucccgaugaccuuuuacucaauggauuugaucgggauccacuaggaucaacuguucauccccgauccucaccugaaucacuuauuacacuggggguuacaaagugaugauuuucuaauuccgcucuucuaucuacacuuauuauaugugcagacccuucugcagagaugagcuuucccuuuucuuccuccuacuuuuccuccuccuccuccucuuuccuuucauuucccucucaugacuagggaaucagguauuuuugaaauuuaguguguuaccaucuguuacaaucauuauucuuuuugaaguugcaaaauugucccgcuguggucagugggauccccuugaaguuggcuucuguuuccuuucaaccugacaucacugaacuuagaacacuguagaaagagaacccgcaaaaugccuccuuuccgggcaggcgaggccagggcugcacacugugcugucaggccaucuucuuguggcacagcugcuaggugcugccaggcuguggggcaucaggcacauaucuccagaccuucggaaauggaaagucggcuucgugaauaaucagaaugauaaaucauuuuccuuuuacuuuugucugcaugucagagagcugaguuugguuuuuguggcauucauacucccuugccugugcuggaaggaaauggcuccucagggaaagugaugaugguaauuaaaaaugcaugcuccaugcggucggucggugaagaggugucaaaugagcauucagagagaggggguucuuugugacacugcaauaauuaugucagacaaacgauuacagcguauaguguuucagagcuuccaaacauacuaaguaauuaaaacucagauguauuuugaaaacaugcuguugagauugggauaucguuuuggaaaggcguauuuuuugugaggugccagagguccaguuaacccaagaaguuauucugccccgcccugacucaucuugccgcagaggcucuugaaaugacugccuuccacccccuuuucuccugucuccuccaggcaauggauuuagaaguaccgguauuggccaggaacauccccgggaaugcugccguggugaagcaugaagucacagggcuacuguuuuccaauccucagguaaagaaaaguucuuucccuccauucacucaccuuaucugaauaguuuuccucuauguuuaauggagagauucuuucuguuagcgcuuaguauuccuguccuacccggagcccugcggagagcaugcugucuucuguuaucaccugggcagcugccuggguguaccacuagcagaagccuagggaacaggagcauugaguuccauuccugauucuguugccaaguugcucuaaggggcugggaaagauaaucaccucugagauauucggauuucugauuucugaaacgugcacucucagacacaaccuuguauuuauggaacaucugcuggcuuucaaaggacgggcgccuaugcgaucacuuuucauuccuugaaacaaacgcacaaaguaugcaggguucuuguguaaauacagaaacacgugugaaugucgggaaauagaagaaagggccauguaccuguccaucgguccagcugguuauccaguaacuucuggggcacacaugugugccaucaccucccaggagcauggaaagguguugcccaguguagggggccacagacaguucuggggauuugcgguccaggguuugccugcauccgacgcccugagugccuccugcagagagugacccuggccgagucuccaagccccacuuucucuucuggauaaguggagcucauaguaauacuugccucuuagaguugugacaugcgcugaaugaguugauggcagagcuuagaggugcacaugaaacaugcucagagcucaguaaacacggauauuaucaaaagggaagguguuggcugggugcagugguucaguggcucacgccuguaaucccagcacuuugggaggcugaggugguaggaucauuugaggucaggaguuugagaccagccugggcaacauggugaaaccccgucucuauuaaaaagacaaaaaaaaaaaaaaaaaaaagcugggaauggugcaugccuguaauuccagcuacucaggaggccaaggcaggauaaucacuugaacucgggagauggagguuacaaugaaccaagaucacgccacugcacuguguauaggcaacagagugggacucugccucaaaaaaaaaaaaaaaaaaaaaaaaaaaaaggaaggcauugucacuacguaugccucuuguuaggcaguaguaaauaaaaaucuuuuuuuuuuuuuuuuuuuuuuuaugagacagggucucacuguguagcccaggcugcagugcaguggugugaucauggcuuacuacagccuugaccuccugggcucaagcgauccucccaccucagccuccuaaguagcugggacuacaggcaugcaccaccacgccuggcuaauuuuguuuauuuuuuuagagacaggagcuugccuuuuugcccaggcuggucucgaacuccuggccucaagcgauccaucugcuuggucuccugaaguacugggauuacaggcaugagcaccaccuucagcaaaaauuagcuucuuaaaaaaauauuagguuuuacgccuaaccaucuuuauuaaagcacauaugauauuccaaaauccagaaaguuaugcuuaaaaacuaaaaacucaaauacuugaauauucaguuuuuaagauuuccuacagcagauguuuaauucaaguucaacuuucccuuucuauaguguggugacgugucaugcuuuucacugccugcuucucacagagucguaaacaaauuccagcacaaacaagaugaaagccagcuucaugaggcaguggggggggacggguggggagguggcagcgggguggggaacggcggguggugggggggcagcaagggagugggggcuggcaggggguggggguggagauugcaagucgcaagguaucagcaggucaugaauaaaugcacugaccauccugggaagcggagggaaauagcaaaggugggacccaggaguuucucuguuauugucuacaaaagguguagguagcacuaaaggcuucucuuuugauaguaauaccuaaaaaccuaaauaauaucagaauaggaagaguuuucaguaguuacuuguugauucuccaaacaaaggcuuauugcuuuuuaccauauuccaugucucucaaaaucaacgccagccaagcuucaggucagugaauauuaauauccgcucuggcaaaguguucugggauuuuuuuuuuccaucucccaaaaggcaacgucuauuuacuuuauagcucaauuucagaggaccaaagaaagcacuccaacuuuaucagugaacgucugaauagcaauuccuuauaaguggaucuauuaggcugaacaaaagaaugagagcuguuuggcucuuccaauuucauacagccucuuguaagauacuccuuuuaaugucugcaaaucauuaucgugccgccgauguauucaggucauuucugcgaguuaccggcuuccugugagccaucagacacgacucugcggcacucacggagucucguugcagacuuauuuugauuccagcgcuuucguguucauuucacaaaggauguuaaaaaaaauagaacucuucugguuuuauguugggggaggcugcgauucuuaacacacguugaaagagugugcuagacguggaugucgcaccugguucagucugguuugguuuucuuuacggucuucuuccaauuuuaccuagcaugggguaggagcuguuguuuuaaacaacaacaugcauuuuaaauaagucagggacuaugguucuaugaaucuugacuaagaaacucagaugaaaggaaccacuaguggguugccaguguuggcaagauuaauuuuaaauaugaggccgggcacaguggcucgugccuguaaucccaguacuuugggaagcugagguggguggauugccagagguuaggaguucgagacaagccuggcaaacaugcaaaacccugucucuacuaaaaauaugaaaaugagccaggugugguggugggugcauguaauccuggcuacaugggagggugaggcaggagaaucacuugaaccuaggagggggagguugcagugagccgagacugcaccgagauugcaccagugcacuccagccugggugacagagcuggguaucuaaaaaaaaaaauuaaauauauauuucaauaugcguuagaaccagcauuccauuuuuuaagaaggaauguccaugucagagcgucagccuuaguuauguacauauauggaguauauauuaccauguaugcuauucaaaucaaugcuaaaugugcaguuaguaguucugcauucgcuuuuauuuucuaauugagaauguaaagaaacccgauauaaaaagaugaaguucaacagguuagauuguauguuuaauaccccaguuaccuauuuuucaaaacagaaaacugauuuuacauacaguaaaggaugugggugacuguuaaagggcauucccuauucuuuucauuuugugaaucuuuuauaaaacaguauuagucaggguuccccagagaaacagaaccaguaggagacagauauaaauaugugaggagauuauagcaauuggcugacaugauuauggaagccaggaaguuccaucaucuguugucugcaagcuggagaugcaggaaagccaguggugcaauucaguccgaggcuaaaagcccaagaaucaggguugugaauccaaaagaaaggaggucagcauauggaccugcacccccauguuuaucaaagcgccacucacaaucaccaagguauggaaucaaccuaaguguccaucaacagaugaaugcauaaggaagaugugguacauauggccaguggaguacuauucagccauaaaaaagaaggagucaugucauuuauggcaacgugguuggaacuggaggucauuauauuaagugaaauacgguaggcaaagaacgaugacuaucgcacauucuuggagucugaaaggcugagauucaggagcuuagaugucucugugcaggagaagauggaugucccagcucaagaagcaggaagauuccccuuuuuguucuauucggauuggauggugcuggcccacauugcugagggugcaucuucccucuucaguucacagauucaaaugcuaaucucuuccagaaacagccucauagacacacccagagauaaggcgucaccagcuaucuggacaucccuuagcccaggcacacugacacauaaaauuaaccaucguaaagacuaaaccaacaaaaggaacagaaaugugaccuuuuuuuuugaaaccauaacacucacucugugagucaggcaguuuuucugguaacccgaacucugucccccucucccuuccugacacuuguguccuacgguggccuugugugugugccccugucccccuccacccuucccagcacuuguguccuauggcggccccaugucugugccccgucccccuccaccucccgccacuuguguccuauggcagccccgugugugugccccugucccccucggccuccuggcacuuguguccuauggcggccccgugugcgugcuccagugagggguugaacacgucaugccuucaagggcggagugagcugcaguguauagugggauuggggcagucaacuguucuccuagcugccuguugcagaccugcagggcuagcucugggucuagacacaauguccagagucuuugaaugaauauucacaucucaucuaagaagggacaggacuaagauaucagcaauggcuauagcagugcauggauuagccugggcagcagcaaugaggucuuuagggaaagacuuccuggcaaacaggugugggcaaggaaugaguggagggaguagaacacaguguggccugugcugggcaggagguucaagcucaggugucuggagggcacccagguaugcagggggugagguggccuggucaggugcaacccuagggaccuuggggucagacauacagcccuugcugcuguugaagagcggcugaaagucgauucuuauguggguauuaccgauuuauaaaugcagacaacucagucagauucuaaaauaauuccuuuuuuuucuugagauugagucucccucuguugcccaggcuggagugcagugaugugaucucggcuugcugcaaccucugccucccggguucaagugauuauccugucucagccucccgaguagcugggacuacaggugugcgccaccaugcccucuaaguuuuguauuuuaucaguagagacggguuucaccauauuggccaggcuggucuggaacuccugaucuugugaucugccugccuuggccucccaaagugcugggauuacaggcaugagccaccgcgcccagccaaaaugauucuuuuaaacaugauggggaccuacuuacacauucguggggagauuugcugccagccugugaccucugcucuggaucagggauaccccuuuccgcugaaaaugagaacuguaacucagccggagcacacugugcacaccaacgacaguggguuaccugaggaggacacaucaaaggugacgucuggucccagaguccaggcugccucuggccaucaguguccuccucgcuccugacagaagaggugucagcugucccaggagggccugcuguggguuugggaguggagugggguugauuccagggucguaugggccagaaaauagaaaggacuugaugugauaaaacaacagugggaugcugggcgcaguggcucacaccuguuaucccagcacuuugggaggccgaggugggugaaucacuugaggucaggaguucgagaccauccugagugacauggugaauccccaucucuacuaaaauacaaaaauuagccaggcauaguggugggcgccuguaaucccagcuacuugggaggcugaggcaggagaauugcuuaaacccgggggguggagguugcaguaagcugagauuacgccauugcacuccagccugggugagagugagacuccgucucaaaacaaaaacaaaaagguguuuuuuucucucucuacaugaaaauuaacgugugcuggcuccuaucacgcacagucauguuaggcagagagcuuuuauggaguucuuacuaugugcccagcacggagccagguccugaaggugaaggaaugaaacagaaaggcugcaaggcccucgggaaugcacaguuggcuguggguggugcgcagauggcagagcacggcagcagguagcaugcccucugcaucaucggcccaucaugagcgacaccugucuuagucuguuccggcugcaguaacagaauacuauagacugggggcuuaagcaacaaacauuucucucucacaguccuagaggcugcaaguccaagaugggcaccucauagacagcugucuucucccuguguccucaugguggaagggccgagacagcucucuggggucccuuuuauaaggacacuaaacuuggccaguugcgcuggcucaugccuguaaucccagcacuuugggaggccagauugcuugagcccaggaguucagggccagccuggccaacauggagaaacccugucucuacaaaaaaaguaaaauauuaucuggggguggugacagaugccuguagucccagcuacucgagaggcugagaugggaggaucacuugagccugagagguagaggcugcaagggagccauguuggcguggcugcacuccagccugggugacagagugagacccugucucaaaacaacaaagacaccaaucuuuccauccucaugacccagucaccucccaaagaccucaccuccugccguccccuugggggugagcagcucaguguaugaauuugaggagacacaaacauucaccccacaauaugaccccuugucaaauguucacccugugauggacaugguucccucugcuuuacauggauggacuccaugaacucucacaacaauuccaggacgucaacaccuucauaaucaccguuggaccugugggagaacugaagcauggagaaacccaguuaacuaguuuguaagugucagagccagaccuggagacucgucacccuggcauguuguguuauuagugugaagagauugcuaaggaccacuggcgagaagccugcagguuuaccugugcagggugagguuuaaggaaggaagggacguugagcugggcuucaaaggacaagauuccccaggcagggaaaggcauucacaguagagggaaucaccugggcaaaaguuuaggggcgugagagugugcaaugcauuggaagaguuaggcguagugcagugugaaaggugugagggaaggaauggccuaaaugaaagggaacucagauguaaggagcaugggacauagaggaguguggugagcagaguucugagauggccuguggccucugccuccugguguucggcuguuaugguaggcuacguggcaagagggauuuugcagaugugauuaagguaacuaaucaguugacuuugaguuaaucaaagauaugaacugugugggccugaccucgucaucagagcccuuuaaauuuagaucuagaggucaaggacagaagaauucagagagacugggaccuguggagggauccacauggcaaggaacuuugggcagccucuaggagcugggggcgaccccugguugacagccagugggagaaagauggcuugggcccuacaaccacagaaacugaauucugccaacaacugugugagguucaaggaagaccccaagcuccagacaggagcccagcccagcccaaacuuugaucucaggcucgugggaugcugagcugaaaagucagcucugcuaugucugugccuggacuuugacuugcagaaaccaugagacaauacauggaugucauucuaagucccaaguuuguggcuauuuguuaugcagcaauagaaaacuagucccagaggcugggcaugguggcucacaccuguaauccuagcacuuuggaaggcuaaggcaagcagauugcuugagcucaggaguucaagaccauccugggcaacauggcaaagucuugucucugcuuaaaaaaaaaaaaaaaaaaaaaaaaagaaaaaguaaaaagccagaugugguggcucaugccuguagucccagcuacuggggaggcugaggcgggaggaccgcuuuagccugggugauggaaguugccgugagcugagaucuugccacugcacuccacccuggauaacagcaagacccugucucaaaaauaaagaaaaagagaacuagcuccaggaagaaggcaagggaagaguuuccagugaugccaaugcagcuggcugcagaggaggaaagaauguguucacaguggcagagaugggaccuccaaaaagaggacuguuucagguaauuaaugcaucacauuugagaugauggaagaucauucaaggggauucauagggucuuacuggagaaaaccuuacguuucucuuucccccugcaaccacugcaucuuucuguauucaaugagcggcugggaguaggagucccuggugcaauuggagagaaggagacagcagaaugcuccugggagccagggcugagcugagagggcgugcauaccagccagcaucccugccugaaaugccccagggguggcuggcugcacuuggaagaaaguccaaacuuuuucugauggccaccaagcugucccugagcuaaccacugccuaccacucugccuuugcugcucugcggccacgugggcaucucugcuccucccucacagguaacuugaguccccagccucuuuucaccacccuucccuaucuuauuucauuccuggcaugugucacggugccacacugcuugcuccccacacccuccuccccaaccuccucagacuguuagauccaggagagcaguuucuccaacuguaaaauggggaagugaggccucaucugggggguuuugugcucuucugcacgcagccccagcacuugggcagcaccuggcacuaaauguguguugacaggugaauggugagcacagggucccgggguggggguggcagcuguuggcacaaagauaaugggaaucuggagggaaguuugcuuuagggagcuuaugaggacagccuacugaacugaauaaaaagccauuuuuaauuuuuuuuuaaaaaaugacgauuaaacauauucagcccugguaggaacagaauaaucucuauuucuauauaccucaccccuggaaaacuucaauuuaagcaaagcuuuccaaaccuacuaaagauugauuuuuucuuuaccgccacaauccuguuauuucuccuuuuaagaaguagaaaaggguugagcuauuuuccuagguauuuuauugcucuguuuuauagcuucgaaauuaaaauccauuugacauuuaauagaagcugugaaucuauacacugucccagggucagacuuuuaaaguguagcucaaaccuauuuugcuuggagguucuguuuguauggugcacagcuauagaaaaacauaaguucuggaauaaugacauugaccagagcuagcauuuauccagaaugggcugggcucuggccauaguguucuaugugacuugcauuuucacuaaagauagcuuauuuuucuucaaacgcuaauggcuuuaauagucagucaacgguuuaauguuugggaaaugugaggcccgguagaaaacaucagccuccaaacuuucauucaggcagggcugcgcugagaucucaaguuuugcucuuggaagcugagugauccuggacaccucuccugcccucugcucgaugcuucuucgggagaguggagaucaugaccucucuuuggggaauagcugagggagggcacaugcacuauugccucucccuuccccuggaaaaaaaccugccaauacucaaccgcguucacagcuugcagcgcugugcacuaggggaagccguggaauauggaaagcacuuauguuuaagugcugggaucagcccacagcaggauucccacccggugcagagcacugagaacccagggagaaauucccgucucacucuuacuucgaguuacguucuacuuacggauuuggggaggccacuggccaacauuauguaacauauuacuucucucuuauguuuuaaaaguguuuuaacguaacaucuauaauucuuggaaguucaacgcauccaggauguguaagcaccagcccgugcacagcacacaguagguccucagcaugaaauccgagaugcagauccugcugcguugauuggauuuccaguuaagcccagaggaaacucgggacaaagcaugugugaacuacauuggagguuaaugcaaaacuuauguggauuuuguuuugcuuuguuuuuuuugagacagagucucgcucugucgcccaggcuggagugcaguggcgcaaacucagcucacugcaagcuccgccucccgguucacaucauucuccugccucagccucccgaguagcuaggacugcaggcgccugccaccacaccuggcuaauuuuuuguauuuucaguagagaugggguuucacaguguuagccaagauggucuccaucuccugaccucgugauccgccugccucggccucccaaagugcugggauuacaggcgugagccacugcgcccggucacuuauguggauuuccaaguagugugaccugguggcuuauuguacgauacugggaagcauuugagaguggacuaauaauaauacaaggacaccaggcugggcacaguggcucacgccugucaucccagcacuuugggaggcugaggcagguggaucacuugaggucaggaguucgaggccaacauggccaaaccccaucucuacuaaaaauacaaaaaaucagcugagcagggucgcaggugccuauaauccuagcuacucaggaggcugaggcaugagaaucacuugaacccggaggguggggguugcagugagccgagaucaugucacugcacuccagccugggugacagugcgagacaucgucucaauaauaauaauacuaggacaacagauguaaaccucacccgagcagcauagggacagccugccuggggguugugauugggugccugggcugguguauuguuagggacacagauucuccagugagcuagagagggugggucccuugccucgggccacuuggguggggugaagagcugggugaggacugggucugacugcagagccugagcucgggcagcgccaggagcacaaauggcccugcucucccccuucccugcugcugccguggcaacuccuccucacucggccccgucuuuccugcugugccucccuuuuucucucccucugccucugucucgucaucuccuugucugucucuguagcuccucucucccucugucuuuuucugucucucauagucacucucucagucucuguagcccucguccuccucucugucugugucucucucugucucuguuucuguagccuuccucccucucagucucuguuucucugauugucucuuccucugucucuguuucuguagccuuccuuccucucagucucuguuucucucauugucucuuccucugucucuguuucuaccucuaucucagucucuagcucucucucucacucucucucucucucccugucucccucccuccccuccucuccuguuuuacaccuaacccuuuucuaaagugguucuucucacccugauucucucuguauucuuggggagaagggaccauuucugagccccacccuggguguagaugccccuggaugcagccagaggugggaagagaagccccuggcugacugugcagccccuagggcagguuugccccgagcugggugugcaccgagcugagugugcacugagcugcugcgcggcaagcagggccaggacgcgggugagccacaagguggggcucacugcucaggcacagaggcugggccaucaccaaggugcggaggcacucggggcuccuccuggccgccucacuccugaccaagcagggagcauccugcuugcaucgcgucuggaauucucugaaaauacagagagggaagaggcagagagagaagagcuuccuucccgcugugagcucaguccccaccucugagaacaggaggaggcaucucugcgucauccugacacuuggcucuccaccaucuccugggcccucgcgugggugcaccuguugcucugcaaagccugcugggcaccugccaggagugugagcccgcaggcuccagcuggggacugugauuaggggaggggccaggcauggagagacccuccccucccccugccucugccugugugcgcuuccuggaggccuccuggugaucugugucagcccugacaaaugcaguccccagucagcggggugcuugccucacaucaaaacaacgcugcuguaggaaucagcuccgaaggccguuucugggguauccuggaauucagaaggaagaggauggugacauguuggcacugguagaagccgggccagggucuguggaggaccccggugggcugcagccuuagggguaaugcugcaggggaaggccugcuuggagccucagccccugccuguugcaggugcgugcacaagcagcugggcacaccguccuggguccugggcucccaagcccgccgcgcccucuccccugagccccacuucccaucugucccacuucuccugagcucugucugcaaacgcagcuggaccccaucuccacugcacucccggaccgaggggcuguagggucuugccugggcuguuccagcagccuccuccuuccagcccgcccacucccuccccgcagccacaggcaccaagucaaaguccgcuucuauccacugcagcugaggacccucugguggcuuccccuuugcaccuagaagaaaaugccacugcuggccuggcuucugaggccuugcacagcuugcgcugcccccuccucguuccaggcuucucuguccggcaccugagcuuugcucacccucugucucuaaccgagcugcgcccacggcuggcaccuccucaaauguuucuugguugaaaucaccuuggaaggacuuuucguggccacccacugugacugggguucccauuuggguuuccucuguccccgcaccugugucuguguacacugcacucuuugccaucuauaaacaccaguccccagccuggaagcuucccgagggcagcagucaggcauguuuacucaucagcugucccucgcagggacucugauauggacugggugcucagugaguacuggaagggaugauuaugccccggcguacaaggcgcaacccuuccagagggcguguuuuuuuauuuucaucugauagugagcgaugcagcacgccacacacuuguacuuuaacugcucucauuucuuuuucuuuucaaagucgcagaugacagcagucaucccgcccaaucauuggcaccugucggauuuuguccccaugccuagcaaguagucucugacaguuucaugccagucacagguucuggugcugagugccacgcggcaaaacgacaggaucgccuacuccugccugggugcuuagaucccauguaaaugcuuuuggcuuagaaauugucuuucuuuugcccucccuuccucccucccuccuuccuuccuucaucucccuccuuucuuccucccuccuuuucuucaucuguucuuugcucccauuuucuuugauuucuucucccucccuccuuccuuucucccuucuucccuccucccuuccucuccuccucccucccuuccucucucccuccaucccucccucugccucccucccucccucucucuaccucccucccucucucccuuccucucuccuucugucccuuucucucuccuucucucucuuccugucuuucucccucccucccuaccucccucccuucuucccuccuuuccucucucccuuccccccucccuccucccuuccccccucccuccucccuuccccccucccuccucccuuccccccucccuccucccuuccccccucccuccucccuuccccccucccuccucccuuccccccuccauccucccuuccccccucccuccucccuuccccccucccuuccucccucccuccucccuuccucccuucuuugcucccucccuuccucccuucuuugcucccucccuuccucucucccuuccccccucccuccucccucccuccucucucccuuucugugcgccauugaccucaucguuccgcauuagugagcucagccuucuuuugaguuuugccgggagaauccauuguuugcacuuuauacgggagaauggucucugugguuuucccugacucucugucgcacacgucaaggcucccucuccagggucgcugccacaugucugaaugagcaagcugucccuuggggaucuugggcugcagcggaacugggcugcaugcggggcaaagccaugagacgaccagggugccaacaggaaguggcagcugcucuaaugggccccaucacuucaggagggcagcauugggagacauuauuucucgcucuucuggaggccagagcugguuguuuuggucugugaccaccgcccaugcggucacucagagcccaggcuccuuccauggccuggcuccagcuccacguguagguagcugcgggagagagaagacaggguccaccaugggagguaugugugacuugggcuggagggagcacacgccccucucugcucaugcucccuuggcuggaacccaguuacaucacaccugcugcuagggaggcugggaauuguggcccgggaagaaccggggagcaacugugugacugggugcuccuccuuucaccccaaagacugaggcuaacauguucugggaggaaaaaaacacagaaaacaagacccaucauaaggaagauggcuagcaucuguugaaugcuugcucugcagauacaaauguggauuaucucguuuaaccugcacaaugacaaaugugcucuuaucagccccauuuccuagaugagcaaacuaggcacagaggaguuaacuuccucaaggcccagaaccugguaaaaggugcagcugagguucauacucugcuuuccagcuuuauuaaggucugcuugacaaauuuaaagauuguauacauguaugguguaucacuuaguguuucgcugugugcauccauugugcaaugaugaaaucgagcuaauuaacauuuccauccccacacauaccuuuucuuuguaaugagaauauuuaagauccacugacuuagcaacuuucaaguauacuagagucaccaggcugccccauaggucuccagaaugugacccuccuaacugaaacuucggaaccauugaccaguguuuccuuauuuccucuccugcagccugccagccccugguaaccaaccuccuacucuguuucuaugaacuugacuuuuuaagaauccacauauagguaaaauuaugaaguauuugucuuuucuguuuuguuuguuugcuugguuuuuuuuuuuuuuuuuuuuuuuuuuugagacucgcucuguugcccgggcuggaguccagugacacgauauuggcucauuguaaccuccgccuccuggguucaagcaauucuccugccucagccuccccaguagcugggauuacaggcaugugccaccacaccuggcuauuuuuuuuuuuuuuuuuguauuuuuguagagacgggguuucacuguguuggccaggcuggucuugaacuccugaccucaagugauccacccaccucggccucccagaguguugggaugacaagcgugagccaccaccccagccugcuuguguuucuuuccucucccccaggcauaaccagaacgaauggcagauuuaccgccgcacuuuaaugggcugcucuuucccuccaacuuccuccugcucuaacccgccaagccgucacacaagcccagaggaaggucucccggucccccucuucccucccuuuucugccucucaccuucuucuuuccuucaagaugcccaccuucuccccaccaacccccaaagcacaccagagcagcagaagcaccuuucagccagccggguguguguugaaauggcuaguguucuacucggcccaucgucuggaaagugagcgaaugagaagcacagaaaauauuccugaaguuguuuuuagcuucaucgguggcucccagguuucccguguguguguguaggggguguguguguaggggguguguguaggggguguguguguguguguaggguguguguguguggggggggcgcuuggugaucugugcuccacaccacaugcagcagcggugcucagagggggacagucugggucuagaugccuuuucugccacucagugauguguuaaccucaggcagguucccaggugaccugggcucccaucucuugaucugugcguguggagggggagagggcgcauaggaauaguccaaauuccuaguuccuuuucugcaauuucaaaauccaaaaagcgcuuggaaaacaugcagucgggacccaccugccagcucugugcguuuuuacuagcagguaccuggcugauggccggaguccuuguucacacggacaucuacggacccacccggcucacagauggcaagggcucuugcucccuccuaccccagccacagcaaugccuuugagccacacuaacccugcaucgugcauuucaugagccacagagccccgggaauggcaggaauaaaacacagguucuccgacggucagugacccugcuguuagcuacccaggucuugcacuguuuucccuccucaaauaacagcuguccuuugaccagcacaaucgaccucugcugugcaaacgccagaagggaaagaggaguuuuacugucucaccauccauaagaccacucuuuuucgugaguuuggugccaaaacuccugucugaacugaugugaagucaccuagggcuguuuguccugcgucacgggacuauucauacauuuugauuaagaaacacugaucuguuguugaugggcauggccuuagaccucgcuggagaugauauguaauagaaggcuauagcagcugaauuacuaaaaucccccagguccugaauucugaagccucauuccguguacguuuuugagcacuggaugcauguuggcugcuguuguuaauuucuggcuggauccugaccuccacuggaggcccuuggccagaggccagcucucucuucgcuaaagaaguguugaagaaagaagcauuugccccucauugaggcuguucuccccuccaccagcagugaagaugaaucggaugggaauuagcuuucucaccugcuggcuuuccuuuguuuagugcccccccgcaccugcaccugcaaaccuccuuccucaugcuacagacucccacgcuccgucacuccugagcacccaccaugucuguggguggccuguuagauacacgcucaggcauugucccggcaaagggucugagcacggagccucccuggcucagcgugcuuacacagggcccacuggcagauucacugggggucagucuuggaauggacgucagacucaggcaucaugacugggggcggggggaagucaagcaucgugaguaggggucagaguccccacccuaccaccuuguccucuggcucuguauugaguaauugcuaugcacagggcucauugacugagagguuauuucugacccuacccaguuggcuugcucaguuuccaucugcagaagauucccauagcuguuuuuuuguuuuuuauuuuuuucuuuugagacggggucucacucugucacccaagcuggagugcaguggcgcuaucucagcucacugcaaccuccaggucccugguucaagcaaucauccugccucagccucuggaguagcugggacuacaggcgcgugccaccacgccaggcugauuuuuguguuuuuuaguagagacaggguuucaccauguuggccaggcugggcuugaacuccugaccucaagugauccacccgccuugggcucccaaagugcagagauuacaugugugagccacagcucccggcccccuaauggcuguuuuugauacuuauuuuaaagugagccccuaacuguaaccaugauguucagggugaaauaacuucaauucuccuauaaaucaaugacuacucuguguuuuaagagguggguggaagguucaugcugaagaguuuagagaagagcuucguguucuuuugcaugguccugacuuuacccgaugcaggagcuacugggagaacaaucaacguacgcuggcagucggggugaugacauggucacauugaugugucgucagcggcgacaguuugacaguuuggauagugccauaaaaugugaccagagggauggugccguguacaagaaaaguaccacagucagaugcacguuccucuucuaggcauugaggucuugaaggaggagccucacaacuugcaguuuucaacaaaauaaaucugucccaugaccaaauaauuuuuggaaaaugaggcaggcacggcagguugccuuagaccugucaggcuuccugcaauccccugggggcgcuguuggacacuguuagaaaacgcucauuccugaaccccacccuccacccacccaaucaguaucucggggacugagggcggguauguggggcguguguguuuuacaagcucccuuagagagucuuacagcaagguuugagaagcaaagccaccgucgaagccuuaauuaacucaaagccuccaaccagaaaagcccgaggaaaacccgagaucuuuaacgacggcggccugcgccagccuugagacacuuccucgucaacgucucccaucgacaagcugucguauuugaagcagcgggagaggagcuucggggcuguuuaguuuaacacaccaagccugaaauucaagaguuuuccugugauugacuguagcucaucuuggaaaaauaaguauauaucacuugcugaagguugucagaauguaaugcucuuuaaaaccguaacguuuuaaaucugccagccccagcaugcauccugcucaaggcuuuugcuucucguggaggaguuuuuuuccccuucuguucuauggcuuugaggugacaucaucaugagaaggauuguaaugagguucuaauauucauuuuauaaaauggguacuggcugggcgcaguggcucacaccuguaaucccagcacuuugggagaccaaugaagguggaucacuugaggccaggaguucaagaccagccuagccaacauggcaaaacccugucucuacugaaaaaacaaaaauuagucgggcgugguggcacaagccuguaaucccagcugcuugggaggcugaggcaggugaaucgcuugaccccgggaggcagagguugcagugagccgagaucgcgccgcugcacuccagccugggcgacagagagagacuccaucucaaaagcaaaacaagaaaacaaaauggccaccacuucuuuuccucuggaucuuggugaaaccucagggggauggagcaggucaaaaggauucaaugagaaaugcuccaccagcagcuccagacuccucagaaaggaagaagcucugaggacggucaucaacuaauugaguaauuacucucuaaagacaaaaccaugcucuuuugcaugauuauuauuauuauuuaacaucacaagugcauuaccugagccagcguuggcacaccuguggcccuggaccuacaucuggucugcacauguguuuuguuuacuuugcuguauucuuaaaauauugaauuaccuguugauauuuaacauggaacacuuuuacauaaauauccagaauuuagaccucucuuggaaaagaaaagaaaugcggcaaccagcauaggccuguauuuaccauguggcugugugcaccucccacuucaccugcugggccccggaaggcauuugcguuucccaccgcugaucaggaacaggugaggcuuguuuuaaacucucuugagagauggaauuucuguacuugguuuugcuuugaguuuuuagcgucugcccucuauaaugccuugugaguucuuuucuuuuuucuuuuuucuuuuuuuuuuuuuuuugaaacagaguuucacucuugucgcccaggcuggggugcaaugaauggcgcuaucucagcucacugcaaccucugccucucagguucaagcgauccuccuaccucagccuccugaguagcugggauuacaggugugugccaccaugacuagcuaauuuuuuuguauuuuugguagagacaggguuuaaccauguuggccagguuggucuggaacuccugaccucagguaaucugcccacuucagccucccaaaaugcuggguuuacaggcaugaguccccgcacccggccugugaguuauuuucauaaauaauuuucaagaguagaucacugcauagccaagcagaagauccugaguggacacccccuccuccgggguuacagugcguguguguggcugucagccaaucggcuuuuccgcagcucccagcugaaaccugugugaaaccugcagcaccugggcuggaaggaucugccucagggacacucaggucugcaaguccugcuguguagcucuccagugcauuugauaaggugcccggugucagauuccagagccauggcugauguccggcauggcaugucagggcgggcacggcucuccuccuccgugugagugucuggcccugccuuccugugugcggcaucguccugaggucggugggaauugcugcaguggauccgggcuccccaugcgaccuggguggccucagaggcuggagggggcagucguuccuaguguucucuucuuagaaggaggaaaccacuuuuuccagaagacacugacugcugaucucucccucccaucuuguuacgggaaaggggucccgauccagaccccaagagaggguucuuggaucugucgcaaggaagaauucagggugaguccguaaagugaaagcgaguuuauuaggaaagugagggaguagaagaauggcuacuccguagacagagcaccgugagggccgcuguuugcccauuuuuaugguauuucuugaugauaugcuaaacaagggguggauuauucaugucuccccuguuuagaccauauagggcaauuuccugacguugccauagcauuuguaaacugucauggggcuggcgggaguguagcagugaggacaaccggaggucaugcucaucguccucuugguuuugguggguuuccgcuggcugcuuuacugcaaacuguuucaucagcaaggucucugugaccugugucuugugccgaccuccuaucucauccugugacuuagaaugccuuagccuccugggaaugcagcccagcaggucucagccucaguuuacccagcugcuauucaagauggaguuccucugguucaaacgccucugacaaucucaguggccagacuugggucaaacguuggcaggggagaacaggguaacaguguucauucucuacugcauguaacaaaucaccacaaacucagcagcuugaagccacaccugccugcugucuggcaguuucuacagguccaggcucugggcacagcccagguggguccucggcuuggggccucaugucccaccagucccucucgguggcugggccacauucuccucuagggcacgguugguggcgggguucaguuucuugugacugugggacuaaggccauuguucucucgcugguuguuggccaggggccacccucagcucuuagaagcugccaggacagaugccccuggaugugugaugggcuacaucucaauaaacccacuggaagcugaaaaugcacuuaacagccugggcaacacagugaaaccccgucuccagaaaaaauacaaaaauuagccagauaaggggcaugugccuauauuuccagcuacuugggaggcugaggugggaggaucucuugagcccaggaggcugaggcugcagugagcugugguugcaccacucuacuccagccuggguaacacugcgagacucugucucaaaaaaaaaaagaugagaaaaugcacuuaauacaccaaccuccggagcaucccggcuuagcccagccuaccucaucagugcucagaacacuuacacuaaccuauaguugggcugucauccaacacaaagacuguauuacaguacgguuuugcauaucucauauaauuuaucaacuacuguacugagaguaaaaauagaacgguuguaugggugccugaaguacaguuucuaccaaaugcaucucacucucacaccauugaaaaacugaaaaaccuuaagcugaaccaucauaagucgggacuguuugugguuucuugccccacggccuggcaacauaggguguccccugcucugcuuugcugagaugaaguccugugugacaccacccugucgagggagccacaucccgggaccuuugccauauucuguugguuggaggcaaguccacccacacucacgucacagguggggguggcuggggucagcccagggugugucugcgaccccacaacaggcucggacaaaucaggaccaacuuuuggaaguggagacagggucuucuucccagaccauguuguaaagggguagaacuucaaacauucacgguucucuuguugaagaggaggagcugagugccuggcaagagugucaguuauacaucacuguguaacuaagaaucccaaaagucagugccuuacaacuaccgccauuugauuuguuugcaguuuuccgagucugcaguuugagcuggauucgcgggguggugcuucugcugaucuggugaguggccuggggccacugguccagcaagagucuucuggcggcuggccuggagcuggauguuccgagacggccucacucaugguguuggucacugcucagugucccuguucacauggccucccuucccccaggagacuagcccaggcuuugcuuuaccugguggucuccagggccggggcgcauggaagcuauaagggcuuuugaagcuuuguguggaaggcagacggcaucacuuccgauauauccugucagucaaagcaaauuacccgaacaagucagauucaucgggggcgggguggggaauagaccacacccacucaacggggacaguggcagugucauaucgcaaagagaugugcauacagggauagaggguguggccaucuuugcaaaccaucuucgcugguaagcacacgacagucuguguccacauggauuucucacgucuacaggcgcguguccagcagauucccgaugcagccacacaggagcuuuuaguccagaagaaaaucccagagccucagggagugacuuaggauucaagagagauuuuugcuuuugcuaaugguuuuccuuuccuuucuuucugccacucauccaggguuuuaagccagcagccaagacguugcuuacucauaaccccccucucucuugcuuuauuuaagucuauguuuuuucguucacuuuuccaugcggagagaaaagaagaguguguuuuaucacaaucuguuccuagaaacucuuuuauugaggauuugguuguaaaagggccaugcauucuguaggaauaguaagcagagcggggaaggaggggguuggguuuccaccaaagucuccacgucagauaaaucaaagauaugaccagcaucauaaaauaauauacccagcuauaagcaucucaaaugauuuuaauaagaauguuguucuacccugaaacgggaauaaacauauuuuuauuauaaaacgaccaccaauuuacuaugaaguauaaacguaaucuauaaacauauaauucuacuguacgauaaauauugcuauuuauauugccagcuauaaaaggcacucaacauuuaauuaacaauaauuuugagaauauguuuaugugccuuuuaaacagcaaaagcacucuauguugaucuuaggcauugcugccuucuuggaauuuacaugggcugugggggaauaaccaugguaaugagagcuaaguaugugccgggcuuugcucaaaauucuuuguuugcaguaacucauuugcuauccucucaacacccuaggaaagagguaugugauuaccccugauugacaguugaggagcugaggcuuggggaggguaagaaauugacccacugccgcucacgugaaggguaggguguggauuuaaacccacgccucccgugucaagaacucugcuguugacuuacacacgcgcauggagaguaacgacugguccccuccucucccugaauacccuuuaacagugaaaauacuucuaauuuuuuuuccaauccugaagggcuuugauauuaaaaccaggucagcaggagcacucuuucauugcugcaccaagggucugcaagccuucuucaguaaugagcauaaacggaaacacagcccgaagcugagccgcgggaggaaaggccagaaaagcaaagagcugauaaaccccccucccucccuucuucaugcugggagccccugggacuugggguagggcuggguuuaccgauuaaguaugcaucacuccucuacagaugggaaauguggugcucagagaggcucacuagcuugcccaaggccacacagcaaagugaggucguucagaagaaauugaacccaggucuggcucugaagcacuagugcuuuccacuaaagcagauaccacccguauugugaagacaggcuuggcucugcacccagggaagaggacagaacaacacaaaggaaaagaaaugggcugggggucauauuguauggggcucagacucugggguaacaccuaauuucacaucugaggcuccacucaugagagggaagacauuguggaucugagaguccuugggaagacagcuggucuuguugauugagggaagggaguugauggcuccaguauuuuucgugauguucaucccagcauaugugugcgugugugugcaugugugugcauaugugugugugcauguaugugugcgugugugugugugugcauauauauuauuuccuacucagucucaguguuugcauuaacucccaucccuccuaaaagucacucucuccaggcccaggaggcagacaagggcaaggccagcagccaaugcagacacaggaucuugggugcauuugcaaaaucucccuucaucagugauuuaugucuacuucuccuuccuuuuuugcaggaguuuguucaucuggcaaagagacugguuagugauccugcauuagaaaaggaaaucguagugaacggaagggaauacgugagaauguaucauucauggcagguggaaagagacaccuaccaacagcucaucaggaagcuggaaggaagcacugaagauugagggccccgccucaucagacaccugcucucugacacacagcucugggugcacacucagagacagaguucuggaucacgugggcccagugcaguucaaauaaaaccagccucagcggaauccuagaaaauguuagucgugaguccccagagccacugcauucaucccauauccuucugugcguucagaugcugucccaggcguguucaccagccaguccugauggaggugcaugagugacuggguugacugggacagggaaaggggaacugguuuucagggaauuugggagagaauuugauuaccugccuuagggcuuugguguggacaauagaggcuuauuuucaagcagucaugguucagacuccucccgccugccuucugaccaaccucuccccaucguugccaguuugaaaggcaaaagcaaaacagacgugucagcugagccgaguccucgcaggauuuuuguugugaucucaggacucugacaggcacgugggugacccgaggcuucucugaacacuagaaagcgcugugagugagcucacgcccggcacagcucacuuuucaaugguggaauugaaaguugugcuuuuuagaaaaguggccaggcugcccgcaggccccgcccaccucuuggcugaauuugaguggaaaaccaggaaggaacaagcgccacgucacgcauagccugcaaaucgcccgcgugacccugagauggaggccugaggcuuuggguccagggugggcucuuccccuucccacaucagggacccggggauggaugucggaagggucaccagccuccagccuuuggcaggauggagcuugggucugcagggcuuugcagccacacagcgaggucaguccggggccagccgcgccaucaugguaaugguggccucgccccauccaugucauccaugucacaugaggacgugcagucuuccuuguccucuccuaguggaauuugccugggagaaccuccacugaauacugaaauuguugcaugccuguggauuccuuacgacaauggggaacgcgguguuucccaccucuuguggguagaaagcagucugcuuugaggaggcgagaaggcaaagccagggcagggcguugcugugggaagcguucggugaaagcggguuucgacgcuuaggagggccgagggagaagauuccaccagcauuguccuugcuucaaguuuuaggaugucugaacuuucagcuuucauguuuucaaccaucauuuuuuuaauggcacaaccuacaucuuguuuuuaaaagaaguagccucaaauuaaacuccuuaaacucugaugcccuggggaugagaacaacuagcuuggaucucgugccguguaauucaauguuucauuccgcugccuccaucauguaauagaaucgcuuuccagaaaggcaguuaacuggaagcagcagaggcucccagccgugagaggacugcucaacaaugccccccaucgccgcccccccaccccucgcaccccuuguguuuucccucugaggggcccaaggguuauggcuuucaugucuagguguggggacagaggagggagaggcagauccugggccgggagaggauggccuggucugaaucuggaguaauuaaugccacccaaagaaaaggcccugccagguccaauguugucuuagaucugaugaugcugcuauuuacaaaacacugaucguccgaaagcuugaaucuguuccuccucgaaugacccuguagaugccugaccuccaccguaccuccacaucacuauucauguccuucuaggaaaaugugcacaugccucacgcacuaugugggaagggcguguuuuuaaauuaauaaagugugucaccauuagccauacg
